United States Patent 8,541,208 (PROCESS FOR THE PRODUCTION OF FINE CHEMICALS) - sequence listing, part 15

SEQ ID NO: 78803 - DNA, 1551 bp, Francisella tularensis subsp. tularensis Schu 4
  CDS (1)..(1551): transl_table=11
atgacagatatacataatcataagattttgattttagattttggctcgcaatatacacaacttattgctcgtagagtaagagaagtaggtgttttttgtgaaattttccctcatgatgtagcagctgattttatcaaaaattatcaagcaaaaggaataattttatcaggtggtcctgagtcagtttatgattctgatgtcaaagctcctgagatagtttttgagcttggagtacctgttttgggtatttgttatggcatgcaaacaatggtaatgcagcatggtggcgaagtaaaaggagctgatcaaagtgaatttggtaaggcaattataaatatcctaaattcaacaaataacatattttcaaatatggagcatgagcagctagtttggatgagtcatagtgacaaagtcactcaaactggtgagcattttgagataattgcttcttcaacaaatgctccagttgcggcagttgcacataaaaataagcctttttttggtgtgcagtttcacccagaaactactcatacagaaaatggtaagcaaattattgagaattttgtcgttaatatctgcggatgtgatactctgtggaatatcgaaaacattatcgaaaatgatataaaagaaattaaacaaaaagttggtactgataaagtaattttagggctatctggaggtgttgattcatctgttgtagctgcgatattacatcaagctatcggcgatcagctaacttgtatatttgtagatactggtttactgcgccttaatgagggtgatcaagttatgcaagtatttgcagagcatatggatattaatgttattcgtatcaatgcaaaaaatagattcttagatgccctaaggggtatctgtgatccagaacaaaaacgtaaaattatcggtaagctatttgttgatatttttgatgaagaggctgctaagatagagaatgctaaatggcttgcgcagggcactatctacagtgatgtaattgaatcagctggcaataatcagtctaaagcgcatgtaattaaatcacatcataatgttggtggcttaccaaaagaaatgaaacttaagcttttagaaccattaagagagcttttcaaagatgaggttcgtaaattaggcttaggtttaggattaccttataatatgctttatagacatccatttcctggtcctggtcttggagtacgtatattaggtgaaataaagaaagagtatgtagaaacgttacaaaaagctgatgctatatttacagaagagctctataaacataatttataccatgatgtttctcaagcttttggggtgtttttacctgtcaaatcggtaggtgtagttggtgatcagcgtagatatgagtatgtaatagctctaagagctgtcgttagtatcgattttatgactgcaacgtgggctaatttaccttatgattttctgtcactagtttcaaatagaattgtaaatgaagtaaaacaagtatcaagagttgtgtatgatgtgacaggaaaaccacctggaacaattgaatgggaataa

SEQ ID NO: 78804 - protein, 516 aa, Francisella tularensis subsp. tularensis Schu 4
MTDIHNHKILILDFGSQYTQLIARRVREVGVFCEIFPHDVAADFIKNYQAKGIILSGGPESVYDSDVKAPEIVFELGVPVLGICYGMQTMVMQHGGEVKGADQSEFGKAIINILNSTNNIFSNMEHEQLVWMSHSDKVTQTGEHFEIIASSTNAPVAAVAHKNKPFFGVQFHPETTHTENGKQIIENFVVNICGCDTLWNIENIIENDIKEIKQKVGTDKVILGLSGGVDSSVVAAILHQAIGDQLTCIFVDTGLLRLNEGDQVMQVFAEHMDINVIRINAKNRFLDALRGICDPEQKRKIIGKLFVDIFDEEAAKIENAKWLAQGTIYSDVIESAGNNQSKAHVIKSHHNVGGLPKEMKLKLLEPLRELFKDEVRKLGLGLGLPYNMLYRHPFPGPGLGVRILGEIKKEYVETLQKADAIFTEELYKHNLYHDVSQAFGVFLPVKSVGVVGDQRRYEYVIALRAVVSIDFMTATWANLPYDFLSLVSNRIVNEVKQVSRVVYDVTGKPPGTIEWE

SEQ ID NO: 78805 - DNA, 1602 bp, Dehalococcoides ethenogenes 195
  CDS (1)..(1602): transl_table=11
ttggaaattgccaaggaaaagtccggcgccaaaccggagtttattgataacgaagatgaaagcctgcgtgaatcaatagtaatctttgatttcggttctcaatacagcttacttattgcccgccgtatacgtgagatgcatgtttattgcgagctggtttcgcacgataccccttgggagaaaatagcccacttaaatccccgcgggtttattctttccggcgggccttccagtgtctacgaagcaggagcgcctttggcccctgcttatatatttgaaagtaaattgccggttttgggtatttgctacggtatgcaggctatcacccaccagcttgggggggtagttgagcacagtgaaaaacgcgaatacggccatgccttactccactcaagcgtggcaaattccgacctcctgtcggatatgcccgaaccctctcccgtttggatgagccacggagaccgtattgagaaaatgccggccgggtttacggcgctggcttacactgaaaactgcccggtggcggttatgggtaacgaagcggacatttacggtttgcagtttcaccccgaagttgtccattcccctaacggcaaaatcattcttaaaaactttgttttcaatatttgtaaatgtcatgccaactggactatgggcaactatattcaggaaagcattcataatatacgcgaacaggtcggagacggtcaggttatctgtgccctttccggcggggttgattcggcggtagtggcttctcttatccacaaggccattggtgaccagctgacctgcatatatgtaaataacggtcttctccggcgtgaggaggctgaccgcaccctgcatgttttcaaaaaccatatgggtatgaaaataatatatgtagatgcggttgaccgtttccttgatagccttagcggagttaccgaccccgaacagaaacgcaaggttatcggcagtgaatttattaaagtatttgaagatgaagcctgtaagcttggcaagattgattttctggctcaggggacactttaccctgacgtcatagaaagcgtttcttccgtatctaaagcttccgccaaaataaaaagccatcataacgtgggcggcctgcctgcccatatgaagttaaaacttatagagcctttgcgctatctctttaaagatgaagtgcggctgctgggcaaagagctgggtttgccggacgaaatgatttggcgtcagcccttccccggccccggtctggcaatacgcattatcggtgaagttacccgtgaaaagctggaaatcctccgcgcggcggactggattgtaatgagcgaaattaaaaaagccaaaatgtatcaccaggtatggcaaagctttgccatattgactgatgttaagtctgtgggtgttatgggtgatttccgcacctacggttatctggttgcaatcagggctgtcaccagcgaagacgccatgacggcggactgggctaaactgccttatgatttgctttcagttatatccaaccggattgttaacgaggttaaagaagtgaacagggtggtttatgatataagctccaaaccgccttccactattgaatgggagtaa

SEQ ID NO: 78806 - protein, 533 aa, Dehalococcoides ethenogenes 195
MEIAKEKSGAKPEFIDNEDESLRESIVIFDFGSQYSLLIARRIREMHVYCELVSHDTPWEKIAHLNPRGFILSGGPSSVYEAGAPLAPAYIFESKLPVLGICYGMQAITHQLGGVVEHSEKREYGHALLHSSVANSDLLSDMPEPSPVWMSHGDRIEKMPAGFTALAYTENCPVAVMGNEADIYGLQFHPEVVHSPNGKIILKNFVFNICKCHANWTMGNYIQESIHNIREQVGDGQVICALSGGVDSAVVASLIHKAIGDQLTCIYVNNGLLRREEADRTLHVFKNHMGMKIIYVDAVDRFLDSLSGVTDPEQKRKVIGSEFIKVFEDEACKLGKIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRAADWIVMSEIKKAKMYHQVWQSFAILTDVKSVGVMGDFRTYGYLVAIRAVTSEDAMTADWAKLPYDLLSVISNRIVNEVKEVNRVVYDISSKPPSTIEWE

SEQ ID NO: 78807 - DNA, 1542 bp, Staphylococcus aureus subsp. aureus COL
  CDS (1)..(1542): transl_table=11
atggaaatggcaaaagaacaagagttaatccttgtcttagactttggtagccaatacaaccaattaattacacgccgaattcgtgaaatgggcgtttatagtgaattacacgatcatgaaatttcaattgaagaaattaagaaaatgaatccaaaaggtattatcttatcaggtggtccaaattcagtttatgaagaaggttcatttacaattgatccggaaatatataatttaggaattccagtacttggtatttgttacggcatgcaattaactactaaattattaggtggtaaagttgaacgtgccaatgaacgtgaatacggtaaagcaatcattaatgcgaagtcagatgagttattcgctggcttaccagcagaacaaactgtttggatgagtcattctgataaagttattgaaattccagaaggctttgaagttatcgctgatagcccaagcacagactatgcagcaatcgaagataagaaacgtcgcatttatggtgttcaattccatccagaagtacgtcatacagaatatggtaatgatttattaaataattttgtccgtcgtgtttgtgattgtagaggtcaatggacaatggaaaactttatcgaaatcgaaattgaaaagattcgtcaacgcgtaggagaccgtcgtgtattatgtgcgatgagtggcggcgtagattcatctgttgtagctgtactattgcataaagcaataggtgatcaactaacatgtatctttgtagaccatggcttacttcgtaaaggtgaaggcgacatggttatggagcaattcggtgaaggtttcaacatgaatattattcgtgttaatgcgaaagatcgctttatgaataaattaaaaggtgtttcagatcctgaacaaaaacgtaaaatcattggtaatgaatttgtatacgtatttgatgatgaagcatcaaaactgaaaggtgtagacttccttgcgcaaggaacactatatacagacgtcatcgaatcaggtactaaaacagcacaaacaatcaaatcacaccacaatgttggtggattaccagaagacatggaattcgaattaatcgaaccaatcaatacattgtttaaagatgaagtacgtaaattaggtattgagttaggtattccagaacatttagtatggagacaaccattcccaggacctggtcttggtattcgtgtacttggagaaattactgaagataaactagaaatcgttagagaatcagacgcgattttacgccaagtgattagagaagaaggtcttgaaagagaaatttggcaatacttcacagtgttaccaaacattcaatcagtaggtgttatgggagactaccgtacgtatgatcacacagtaggtattcgtgcagtaacatctatcgacggtatgacaagtgacttcgcacgcatcgattgggaagtcttacaaaagatttctagtcgtatcgtaaacgaagtagatcacgtcaaccgcgtagtctatgacattacatcaaaaccaccaagcacaattgagtgggaataa

SEQ ID NO: 78808 - protein, 513 aa, Staphylococcus aureus subsp. aureus COL
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCDCRGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 78809 - DNA, 1602 bp, Gluconobacter oxydans 621H
  CDS (1)..(1602): transl_table=11
atgacattgacccagcaggacgccagcaccgtcgaaaagctcgacgaaacccttcacgaagaccgtatcctcattctggatttcggcagccaggtgacgcagcttattgcgcgccgcgtccgcgaaagcggcgtttactgcgagatctggccgtttacggcgaccgaggaaaagatccgcgcattcaatccgcgcggcatcatcctgtccggcagcccggccagtgtgcatgacgagaatgcaccaccgattccgaatgtggtcttcgcgctgaaccgccccgtgctggggatctgctatggccagcaggcgatgtgccagatgctgggcggcaaggtcgagagccatgaacaccgcgaattcggccgcgcctatattgatattgccgaggactgctcgctgttccggggcgtctgggcacgcggcaagcgtgagcaggtctggatgagccatggcgatcgcgtcacgcagcttccgccgggcttccgcgccgttgcccattccgaaggcgcaccgttcgcgatcatcgcggatgagggacgtcgtctgtatggcgtgcagttccatccggaagtcgtgcatacgccgcatggtgcagccctgatccgcaacttcacgcataatgttgcaggttgcagcggaacctggacgatggctggcttccgtgaactggaaatcgcgcgcatccgcaagcaggtcggttcgggtcgtgtgatctgtggtctgtcgggtggtgtagacagctccgttgcggccaagctgattcatgatgcgatcggcgatcagctgacctgcattttcgtggatccgggcatcatgcggaccggcgaggctgacgaagtcgtcaagacgttccgtggccgcttcaatatccgtctcgtgcatcgtgacgcctccgagctgttcctgaaggaactggctggcgtgacggacccggaaacgaagcgcaagacgatcggtcgcctgtttatcgaggtcttcgaggaagaggctgcgaagctgggtggcgctcagttcctggctcagggcacgctgtatccggacgtgatcgagagcgtgagtttctcgggtggtccgtccgtgaccatcaagtcccatcataatgtcggcggtctgccggaccgcatgaacatggaactggtcgaaccgctgcgtgagctgttcaaggacgaggtccgtatgcttggccgtgagctgggtattccggaaagcatcgtcgggcggcatccgttcccggggccgggactggcgatccgtattccgggtgatgtcaccaaggaaaagctggatctgctgcgcaaggtggacgcgatctatcttgaggaaatccgtcgcgccggtctgtatgacgcaatctggcaggctttcgcggttctgcttccggtgcggacggtcggcgtcatgggcgatggccggacctacgatcaggcctgcgccctgcgcgccgtgaccagcacggatggcatgactgcggaagtctatccgttcgacttcgcattcctgaaccgggtggccgggcgtatcgtcaacgaggttcgcggcatcaaccgcgtgacttatgacatcacgtccaagccgccgggcacgattgagtgggaatga

SEQ ID NO: 78810 - protein, 533 aa, Gluconobacter oxydans 621H
MTLTQQDASTVEKLDETLHEDRILILDFGSQVTQLIARRVRESGVYCEIWPFTATEEKIRAFNPRGIILSGSPASVHDENAPPIPNVVFALNRPVLGICYGQQAMCQMLGGKVESHEHREFGRAYIDIAEDCSLFRGVWARGKREQVWMSHGDRVTQLPPGFRAVAHSEGAPFAIIADEGRRLYGVQFHPEVVHTPHGAALIRNFTHNVAGCSGTWTMAGFRELEIARIRKQVGSGRVICGLSGGVDSSVAAKLIHDAIGDQLTCIFVDPGIMRTGEADEVVKTFRGRFNIRLVHRDASELFLKELAGVTDPETKRKTIGRLFIEVFEEEAAKLGGAQFLAQGTLYPDVIESVSFSGGPSVTIKSHHNVGGLPDRMNMELVEPLRELFKDEVRMLGRELGIPESIVGRHPFPGPGLAIRIPGDVTKEKLDLLRKVDAIYLEEIRRAGLYDAIWQAFAVLLPVRTVGVMGDGRTYDQACALRAVTSTDGMTAEVYPFDFAFLNRVAGRIVNEVRGINRVTYDITSKPPGTIEWE

SEQ ID NO: 78811 - DNA, 1551 bp, Lactobacillus acidophilus NCFM
  CDS (1)..(1551): transl_table=11
gtggctaagaatctagaggattttgataagattattgttcttgacttcggtagtcaatataatcaattaatcaccagacgtattcgtgactttggcatttattcagaacttttgcctcatgatctttctattgaaaagatcaaggaaatgaatccaaagggaatcattttctcaggtggtcctaatagtgtttacgacgatggtgcgttaaaggtagatcctgaaatctttaagttaggtattcctattttgggtatttgttacgggatgcaactgatgagctacgacttaggtggcaaggttgaacgagctgaaaataaggaatatggtagagcaaatattactgttgaagatccagatagtgctttgtttaaagggttaccaactaagcaatatgtttggatgagtcatggagacctagtaactcaagctcctgagggttttgaagtaactgcatcaagcaagaactgtcctattgcggcaattgctaacccagacaagaagttctacggtatccaattccacgctgaagttcgtaactcggaatatggtttagatattttgaagcactttgcttttgatgtttgtggtgctgtagctaactggaccatggctgacttcattgatatgcaagttgatgaaattcgcaaggaagttggtgacaagaaagtcattttaggcctttctggtggtgtagattcaagtgttactgcaactcttcttcacaaggcaattggtgatcaattaactgccatttttgtggatcacgggatgcttcgtaaagacgaaggcgaccaagtaatgaaggctttgaacaaggatcttggtgtaaacattatccgtgttaatgctcaagaaagattcttgaacaagcttaagggcgtaactgatcctgaacaaaagcgtaagattatcggtaaggaatttattgaagtcttcaacgaagaagctaagaagcttaaggacgttgacttcttagcacaaggtactttgtatactgacgtcatcgaatcaggtactaacactgcccaaactatcaagtctcaccacaacgttggtggacttcctgaagatatgaatttcaaattaattgaaccactacgtaagcttttcaaggatgaagttcgtgaacttggtgaaaagcttggtattccacacgacttagtatggcgtcaaccatttccaggtcctggtcttggtattcgtgttcttggtgaagttactgaagacaagcttaagatcgtgcgtgaatctgatgcaattttgcgtgaagaaattaagaaggctggccttcaagaaaagatttggcaatacttcacagttcttccaggtattcgttcagttggtgtaatgggtgatggccgtacttacgactacactattggtattcgtgccgtaacttcaattgacggaatgactgcagactttgcccaaattccatgggatgtgcttggtcatatttcagatagaattgtaaacgaagtagataatgttaaccgcatcgtttacgacgtaaccagtaagccaccttccactattgaatgggaataa

SEQ ID NO: 78812 - protein, 516 aa, Lactobacillus acidophilus NCFM
MAKNLEDFDKIIVLDFGSQYNQLITRRIRDFGIYSELLPHDLSIEKIKEMNPKGIIFSGGPNSVYDDGALKVDPEIFKLGIPILGICYGMQLMSYDLGGKVERAENKEYGRANITVEDPDSALFKGLPTKQYVWMSHGDLVTQAPEGFEVTASSKNCPIAAIANPDKKFYGIQFHAEVRNSEYGLDILKHFAFDVCGAVANWTMADFIDMQVDEIRKEVGDKKVILGLSGGVDSSVTATLLHKAIGDQLTAIFVDHGMLRKDEGDQVMKALNKDLGVNIIRVNAQERFLNKLKGVTDPEQKRKIIGKEFIEVFNEEAKKLKDVDFLAQGTLYTDVIESGTNTAQTIKSHHNVGGLPEDMNFKLIEPLRKLFKDEVRELGEKLGIPHDLVWRQPFPGPGLGIRVLGEVTEDKLKIVRESDAILREEIKKAGLQEKIWQYFTVLPGIRSVGVMGDGRTYDYTIGIRAVTSIDGMTADFAQIPWDVLGHISDRIVNEVDNVNRIVYDVTSKPPSTIEWE

SEQ ID NO: 78813 - DNA, 1587 bp, Ehrlichia ruminantium str. Gardel
  CDS (1)..(1587): transl_table=11
atgtcaaaggtagctattattgattttgggtcgcaatttacacaattgcttgctagaagaataagggacttaaatatttattctgagatatttctacctaatgtagcatttgatcttattaagggtgttgatgcatttattctgtctggtgggcctaggtcagtacctaattcagatggaattcctaaaattgtacatgatattcttcagtttaatgaaaaaacatctattccagtattaggtatatgctatgggttacagattctcagtaattattttgaatctgatgttgtatctaattgtaataaggagtttggaaagaccattctcaatataataaaaaattcaaagataatagaaaacatttgggaatcaggggaccaagcttatgtgtggatgagtcatgcagatagtgtttataatataccacgtggttttgaggttattgcatatagtgtattgaataattccattgctatggtagcgaatgaacagcgtaggatttatggtatgcaatttcatcctgaggtctatcatactccagatggtataaatttacttgcgaactttctagatattgcaggttgtcaaaaggattggacggtaacatcttttatagacgatcagcaagatgctattaagaaacaaattggaaataaaaaagtaatagcagcacttagtggaggtgttgattcaagtgtggctgcagcgttgacgtataaggcgataggtgaccaacttcattgtgtatttattgacaatgggttattgcgttataatgaagtggaaaaagtaaagcagctatttattaatgaactaaaaattcctgtaacaattgttgataaatcagcagtgtttctaaataggttgaaatctataactgatccagaacggaagcgtaaaataattggggaaacttttattgagatatttgaagaagaggctaataagcttgaaggagtagagtttttaatgcaggggactatatatcctgatgttgtggaatctggaggtagtggttctattgcgaaagaaagtgtggttattaagtctcatcacaatgttggtggcttacctaaaaccatgaaatttaagcttgttgagccattaaagtacttatttaaagatgaggtaagaatattaggtaggaatcttggtatctcaactgaaatattgatgcgtcatccatttcctggaccaggtttagcagttaggataataggtgaaattactgaagagaaagtaaaaatgttacaagctgctgatgatatatatattaatctaataaaaaaatacgagttatatgatgttatgtggcaagcatttgtagtattgttgccagtgaaaacagtaggtgtgatgggtgacagaaggacatatggtcatgcttgtgttttaagggcagtaaattcacatgatggtatgacagcagaaagtttcccattttgtatggatgaagaaactcaatggaaattttttaaatgtatacaggaagctagtaatgctatcattaatagtgttaatggaattaatagagtagcgtatgatattacatctaaacctcctgctacaattgaatgggagtaa

SEQ ID NO: 78814 - protein, 528 aa, Ehrlichia ruminantium str. Gardel
MSKVAIIDFGSQFTQLLARRIRDLNIYSEIFLPNVAFDLIKGVDAFILSGGPRSVPNSDGIPKIVHDILQFNEKTSIPVLGICYGLQILSNYFESDVVSNCNKEFGKTILNIIKNSKIIENIWESGDQAYVWMSHADSVYNIPRGFEVIAYSVLNNSIAMVANEQRRIYGMQFHPEVYHTPDGINLLANFLDIAGCQKDWTVTSFIDDQQDAIKKQIGNKKVIAALSGGVDSSVAAALTYKAIGDQLHCVFIDNGLLRYNEVEKVKQLFINELKIPVTIVDKSAVFLNRLKSITDPERKRKIIGETFIEIFEEEANKLEGVEFLMQGTIYPDVVESGGSGSIAKESVVIKSHHNVGGLPKTMKFKLVEPLKYLFKDEVRILGRNLGISTEILMRHPFPGPGLAVRIIGEITEEKVKMLQAADDIYINLIKKYELYDVMWQAFVVLLPVKTVGVMGDRRTYGHACVLRAVNSHDGMTAESFPFCMDEETQWKFFKCIQEASNAIINSVNGINRVAYDITSKPPATIEWE

SEQ ID NO: 78815 - DNA, 1563 bp, Wolbachia endosymbiont strain TRS of Brugia malayi
  CDS (1)..(1563): transl_table=11
ttgtcagcaattgccattattgattttggttcacaatttacgcagcttatcgcgagacagatcagagaaatggacgtttattgtgagatattccctagcaacatcagttttgaaacaatatcgaaattcaatggatttattctctctggaggaccacaatctgtgcatgatggttgttctgaggcaagtggagtagcacatgagattataaaatttaatgaggcaacaaatgttcctatacttgggatatgctatgggcagcaacttatttgtcattactttggagcgaaagtaaaaaaagagttcaaacaggagttttgcaaaactaagattaagatactaaaggaatcctccattgtaaaggatgtgtggaatgttaattctgaagtggatgtattaatgaatcatgcggacagtgttgaaactgcaccacaagggtttactgttattgcatcaggtgtaataaatcaaacaattgcgatagttgccaatgaacagcgtaggatatattgtactcagttccatcctgaggttaagcctacagcgaatggtagtaaattgctttctaacttcttggacattgcaaattgtaaaagagactggacaatgaagtcaatcattgaaaagcaaaaggagaaaattaaaaatgtggtaggagagaaaaaagtaattgctgcggtaagtggaggggttgattcaagtgttgcagtggctcttacatataaagccgtaggaaaacaattaaactgtatttttattgatactgggttgttacgtaagaaccagaccattgctctgttggaagagattccagtaaattatgttgataaatcgaatttgtttttgagtagattaaaaggtataactgatccagaagaaaagcgaaaaattattggtaacactttcattgaagtctttgaagaggaggcaaaaaaaataggtaatgcagattttttaatgcagggtactatttactctgatgtggtcgaatcagggcatgcttcggggaatgctagtacaatcaaatctcatcataatgttggtggattgccagagaagatgaatctcaagctagtggagcctttgcgctacctctttaaagatgaggtaagactgcttgggaaagaaattgggctttcaaacgagataatatttcaacacccgtttcctggacctggacttgcggtaagggtcataggtgaagttgatgaggaaagggtgcgaatattgcaagaaatagatgaaatatatatcaatacaatgaaaaattacgatctatatgataaaatatggcaagcttttgctgtactattgccgataagaactgtaggtgtcatgggagatggtcgtacatacggatatgtttgtgctttgagggctgtgacatcgtttgatggtatgacggctgatgcatttccatttgagaataaaagtcagcattcattaatattttgggattttttgcagaatgtcagcagtataatcgttaataacgtttccggagtaaatagagttgtgtatgacttaacttcaaaaccaccggcaactattgagtgggaataa

SEQ ID NO: 78816 - protein, 520 aa, Wolbachia endosymbiont strain TRS of Brugia malayi
MSAIAIIDFGSQFTQLIARQIREMDVYCEIFPSNISFETISKFNGFILSGGPQSVHDGCSEASGVAHEIIKFNEATNVPILGICYGQQLICHYFGAKVKKEFKQEFCKTKIKILKESSIVKDVWNVNSEVDVLMNHADSVETAPQGFTVIASGVINQTIAIVANEQRRIYCTQFHPEVKPTANGSKLLSNFLDIANCKRDWTMKSIIEKQKEKIKNVVGEKKVIAAVSGGVDSSVAVALTYKAVGKQLNCIFIDTGLLRKNQTIALLEEIPVNYVDKSNLFLSRLKGITDPEEKRKIIGNTFIEVFEEEAKKIGNADFLMQGTIYSDVVESGHASGNASTIKSHHNVGGLPEKMNLKLVEPLRYLFKDEVRLLGKEIGLSNEIIFQHPFPGPGLAVRVIGEVDEERVRILQEIDEIYINTMKNYDLYDKIWQAFAVLLPIRTVGVMGDGRTYGYVCALRAVTSFDGMTADAFPFENKSQHSLIFWDFLQNVSSIIVNNVSGVNRVVYDLTSKPPATIEWE

SEQ ID NO: 78817 - DNA, 1614 bp, Xanthomonas oryzae pv. oryzae KACC10331
  CDS (1)..(1614): transl_table=11
gtgtgttcttgcgaatctccaattccaactccccaatcccggctctcaatgaccaacatccataccgacaagatcctcatcctcgacttcggcgcgcagtacacacagctgattgcgcggcgcatccgcgagatcggtgtctattgcgagatctgggcgtgggatcacgatccgtcggagattgccggtttcggtgccaagggcatcatcctgtccggtggaccggagtcgaccacgctgccaggcgcgccggtggcgccgcaggaagtattcgatagcggtctgccggtgttcgggatctgctacggcatgcagacgctcgccgcacagttggggggcgcgaccgaagcggcggatcagcgtgaattcggccacgccgaagtggacgtgatcgcggccgatgccttgttcgccggcctcaccgaccatgccggcgccccgcgtctgaatgtgtggatgagccacggcgaccacgtgtcgcaggtgccgccgggcttcaccatcaccgccacgaccgaccgcattccggtcgcagcgatgtccaacgaagacaagcgttggtacggcgtgcagttccacccggaggtgacgcataccctgcagggccagaccttgctgcgtcgcttcgtggtcgatatctgcggctgtcagacgctgtggactgcagccaacatcatcgacgaccagatcgcgcgcgtgcgcgaacaggtgggcgatgacgacgtgatcctgggcctgtccggcggcgtcgattcgtcggtggtggccgcgttgctgcacaaggcgatcggcgacaagctgacctgcgtgttcgtcgataccggcctgctgcgctggcaggaaggcgaccaggtgatggcgatgttcgccgaacacatgggcgtcaaggtgatccgcgtcaacgcggctgatcgctacttcgccaagctcgaaggtgtcagcgacccggaagccaagcgcaagatcatcggcaacctgttcgtggagatcttcgacgaagaatccaacacgctggccaatgcgaaatggctggcgcagggcacgatttatccggacgtgatcgaatcggccggcagcaagaccggcaacgcccatgtgatcaagagccaccacaacgtcggtggcttgccgcaacacatgaagctgggcctggtcgaaccactgcgcgaattgttcaaggacgaagtgcgccgccttggcgtcgaactcggcctgccgcgcaccatggtgtatcgccacccgttccccggccccggcctgggcgtgcgcatcctcggcgaagtgaagcgcgagtacgccgagctgctggccaaggccgatgcgatctttatcgacgagctgcgcaaggccgatctgtacgacaagatcagccaggcgtttgcagtgttcctgccggtgaaatcggtgggcgtggtcggcgacgcacgcgcctacgaatgggtgatcgccctgcgtgcggtcgagaccatcgacttcatgaccgcgcactgggcgcacctgccgtacgacttcctcggcacagtgagcaatcgcatcatcaacgaactgcgtggcgtgtcgcgggtggtctacgacatctccggcaagccgccggcgacgatcgagtgggagtga

SEQ ID NO: 78818 - protein, 537 aa, Xanthomonas oryzae pv. oryzae KACC10331
MCSCESPIPTPQSRLSMTNIHTDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVIAADALFAGLTDHAGAPRLNVWMSHGDHVSQVPPGFTITATTDRIPVAAMSNEDKRWYGVQFHPEVTHTLQGQTLLRRFVVDICGCQTLWTAANIIDDQIARVREQVGDDDVILGLSGGVDSSVVAALLHKAIGDKLTCVFVDTGLLRWQEGDQVMAMFAEHMGVKVIRVNAADRYFAKLEGVSDPEAKRKIIGNLFVEIFDEESNTLANAKWLAQGTIYPDVIESAGSKTGNAHVIKSHHNVGGLPQHMKLGLVEPLRELFKDEVRRLGVELGLPRTMVYRHPFPGPGLGVRILGEVKREYAELLAKADAIFIDELRKADLYDKISQAFAVFLPVKSVGVVGDARAYEWVIALRAVETIDFMTAHWAHLPYDFLGTVSNRIINELRGVSRVVYDISGKPPATIEWE

SEQ ID NO: 78819 - DNA, 1554 bp, Vibrio fischeri ES114
  CDS (1)..(1554): transl_table=11
atgacgactaatatccacgatcaacgtattcttattttagattttggttctcaatatacgcagcttgttgcgcgtcgtattcgtgaaatcggtgtttactgtgagctttggagctgggatgtagaagaatctgacatccgtgattttaatccagacggtatcattttatctggtggccctgagagtgttacagaagaaaactctcctcgtgcaccacaatatgtatttgattcaggtgttcctgtatttggtgtgtgttacggcatgcagacaatggcagagcaactgggtggtaaagtagcaacatcaactgagcgtgagtttggttatgcagcggtacaagtaactggtgaatcagcgttatttaaagatcttgaagcaactcaagatgtttggatgagtcacggtgataaagttgttgaaatcccatctgatttcgtaaaaattgcagagacagaaacctgtccatatgctgcaatggcgaacgaagagaagaaatactacggtgttcaattccacccagaagtaactcacactaaaaatggcatgaaaatgcttgagaactttgttcttaatgtgtgtggttgtgaaggtttatggacatcagcttctattatcgaagatgccgttgctcgtattaaagagcaagtgggtgatgatgaagtgattcttggtttatctggtggcgttgactcatcagtagttgcaatgcttgctcaccgtgcaattggtgacaaactaacgtgtgtattcgttgataacggtttattacgtttaaatgaagctgatcaggtaatggaaatgtttggcaataaatttggcctaaacattgtacatgtgaatgctgaacagcgtttccttgatgcactagaaggtgaatcagatcctgaaacaaaacgtaagatcattggtcacgtattcgtagatatctttgatgaagaatcgaagaaactgaaaaatgctaaatggttagcgcaaggtactatttaccctgatgttattgaatcagctgcatctaaaacaggtaaagctcacgtaattaaatcacaccataacgttggcggcttgccagatgatatggaaatgggtcttgttgagcctctacgtgaattatttaaagatgaagttcgtaagatcggtctagaactaggcttaccttataacatgctttaccgccacccattcccgggtccaggtttaggtgttcgtgttcttggtgaaattaagaaagagtactgtgatttacttcgccgtgcagatgctattttcattgaagaattacacaatgcagatctttacaataaagtatctcaagcattcactgtattcttaccagttcgttctgttggtgtaatgggtgacggtcgtaagtacgattgggttgtttctctacgtgctgttgagactatcgactttatgactgcgcattgggcacatttaccatacgatttcttaggtaaagtatctaaccgtattattaatgaagttaatggcatttctcgtgtagtttacgatatttcaggtaagccaccagcaacaattgagtgggaataa

SEQ ID NO: 78820 - protein, 517 aa, Vibrio fischeri ES114
MTTNIHDQRILILDFGSQYTQLVARRIREIGVYCELWSWDVEESDIRDFNPDGIILSGGPESVTEENSPRAPQYVFDSGVPVFGVCYGMQTMAEQLGGKVATSTEREFGYAAVQVTGESALFKDLEATQDVWMSHGDKVVEIPSDFVKIAETETCPYAAMANEEKKYYGVQFHPEVTHTKNGMKMLENFVLNVCGCEGLWTSASIIEDAVARIKEQVGDDEVILGLSGGVDSSVVAMLAHRAIGDKLTCVFVDNGLLRLNEADQVMEMFGNKFGLNIVHVNAEQRFLDALEGESDPETKRKIIGHVFVDIFDEESKKLKNAKWLAQGTIYPDVIESAASKTGKAHVIKSHHNVGGLPDDMEMGLVEPLRELFKDEVRKIGLELGLPYNMLYRHPFPGPGLGVRVLGEIKKEYCDLLRRADAIFIEELHNADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 78821 - DNA, 1557 bp, Rhodobacter sphaeroides 2.4.1
  CDS (1)..(1557)
atgacccagcacgaccgtctcctcatcatcgatttcgggtcgcaggtgacccagctcatcgcgcgccgcctgcgcgagctgaatgtctactgcgagatccatccctatcagaacgtgaccgaagccttcctgaagggcttcgctccgaaggccgtcatcttctccggcggcccttcctcggtcttcgccgagggcgcgccgatgccccccgcgggcgtgttcgacctcggcgtgccgatcctcgggatctgctacggccagcaggtgatgatgcactgcctcggcggcaaggtcgaacgcggccacggcaccgccgaattcggccgcgccttcgtgacccccacggcggagcgtctggcgatcctcgacggctggttcgaggagggccgcgagcaggtctggatgagccacggcgaccatgtctcgcagatcgcgccgggctttcaggtgttcggcacctcgcccaacgcgcccttcgccatcaccggcgatcccgcgcgccatttctatgcggtgcagttccaccccgaggtgcaccacacgccgaagggcgcgaagctctacgagaatttcgtgcgcctcgcgggcttcaagggcgactggacgatgggggcctaccgcgaggaggcgatcgccaggatccgggcccaggtgggcgaccagaaggtgatctgcggcctctcgggcggcgtcgacagttcggtcgcagcggtgctgatccacgaggccatcggcgatcagctgacctgcgtcttcgtcgaccacggcctgctgcgcctcggcgaggccgagcaggtggtcaagatgttccgcgaccattacaacatgccgctgatccatgccgacgagtccgatctcttcctcggcgcgctcgagggtgtctcggacccggaagtgaagcgcaagaccatcggccggctcttcatcgacgtgttccagaaacatgcggccgacgtgggcggcgccaccttcctcgcgcagggcacgctctatccagacgtgatcgagtcggtgagcttctcgggcggtccctcggtcacgatcaagtcgcaccacaatgtgggcggcctgcccgagaagatgggtctgaagctggtcgagccgctgcgcgaactcttcaaggacgaggtccgcgccctcggccgcgagctcggcctgcccgagagcttcatcggccgccatcccttccccggccccggcctcgcgatccgctgccccggcgagatcacccgcgagaagctcgagatcctgcgccgggccgatgcggtctatatcgaccagatccgccgccacgggctctacgacgagatctggcaggccttcgtggcgctcctgccggtgcgcaccgtgggcgtgatgggcgacggtcgcacctacgactatgcctgcgcgctccgcgccgtgacgagcgtcgacggcatgaccgccgactactatcccttcacccacgacttcctcggcgagacggcgacgcggatcatcaacgaggtgcagggcatcaaccgcgtgacctacgacatcacctcgaagccgccgggcacgatcgagtgggaatga

SEQ ID NO: 78822 - protein, 518 aa, Rhodobacter sphaeroides 2.4.1
MTQHDRLLIIDFGSQVTQLIARRLRELNVYCEIHPYQNVTEAFLKGFAPKAVIFSGGPSSVFAEGAPMPPAGVFDLGVPILGICYGQQVMMHCLGGKVERGHGTAEFGRAFVTPTAERLAILDGWFEEGREQVWMSHGDHVSQIAPGFQVFGTSPNAPFAITGDPARHFYAVQFHPEVHHTPKGAKLYENFVRLAGFKGDWTMGAYREEAIARIRAQVGDQKVICGLSGGVDSSVAAVLIHEAIGDQLTCVFVDHGLLRLGEAEQVVKMFRDHYNMPLIHADESDLFLGALEGVSDPEVKRKTIGRLFIDVFQKHAADVGGATFLAQGTLYPDVIESVSFSGGPSVTIKSHHNVGGLPEKMGLKLVEPLRELFKDEVRALGRELGLPESFIGRHPFPGPGLAIRCPGEITREKLEILRRADAVYIDQIRRHGLYDEIWQAFVALLPVRTVGVMGDGRTYDYACALRAVTSVDGMTADYYPFTHDFLGETATRIINEVQGINRVTYDITSKPPGTIEWE

SEQ ID NO: 78823 - DNA, 1569 bp, Xylella fastidiosa Dixon
  CDS (1)..(1569)
atgacgccgaatattcatcacgacaaaattcttatcctcgatttcggcgcacagtacacccagttgattgcccgtcgtatccgtgaaattggtgtctactgcgaagtgtggccctgggatcactcccctgaagagattctgagcttcggagccaaaggtatcatcctctccggtggccctgaatcgaccacatccccgggtgcgcctgcagcaccgcagcacgtctttgatagtgacttaccaatcttcggtatttgctatggcatgcaaaccatggccgtacatcttgggggtgcgaccgaggcagccgacaaacgtgagtttggtcatgcctcggtccaggtgatttacccggataccttgttttccggcttgtccgatcatccctctgagttccgtctggatgtgtggatgagtcatggtgaccatgtttcacgcgtcccgcccggcttcaccattacagccgccactgaccgcatccccattgcggcgatgagtcgcgaggataagcgctggtatggcgtgcaattccatccggaagtgacccataccttacagggacaggctttattgcgccgttttgtggttgatatatgtggctgccagacgttatggactgccgctaacattattgaagaccaaatcgctcgtgtgcgtgaacgtgtcggtcgcgatgaagtcattctcggcctgtctggtggcgttgattcttccgtcgtcgccgcacttttacacaaagccattggtagccaactgacgtgtgtatttgttgataccggcttgcttcgctggggggaaggcgaccaagtgatggccatgtttgaggaacatatgggcgtcaacgtggtacgtatcaatgcggcatcgcgttacttcgacgcactgcaaggtgtctacgacccagaagccaaacgcaaaatcatcggcaacctgttcatccagatattcgaggaagaggccagcaaacgaaagcaggccaaatggttggcccaaggcacgatttatcctgatgtgatcgaatcggccggcagcaaaaccggcaaagcccacgtaatcaaaagccatcacaacgtcggcggcttgccggagcagatgaccctgggtatggtcgaaccattacgtgaattgttcaaagatgaagtgcgccgccttggcgttgcactgggcttgccccatgccatggtatatcgccatccattcccaggacctggcttgggagtgcgtatccttggtgaagtcaagccggagtatgccgagttactggccaaagctgactcgatttttattgatgaactccatcaagccgacctgtacgacaaggtcagccaagcctttgcagtctttcttccggtgaaatcagttggcgttgttggtgatgcccgtgcgtacgaatgggtgattgcactgcgcgcggttgagaccgttgatttcatgacggcacactgggcaccactgccgtatgacttcctgagtaccgtctccaaccgcatcatcaatgaactacgcggcgtgtcccgtgttgtctacgatatttccggaaaaccgccagccacgattgagtgggagtga

SEQ ID NO: 78824 - protein, 522 aa, Xylella fastidiosa Dixon
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASVQVIYPDTLFSGLSDHPSEFRLDVWMSHGDHVSRVPPGFTITAATDRIPIAAMSREDKRWYGVQFHPEVTHTLQGQALLRRFVVDICGCQTLWTAANIIEDQIARVRERVGRDEVILGLSGGVDSSVVAALLHKAIGSQLTCVFVDTGLLRWGEGDQVMAMFEEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 78825 - DNA, 1554 bp, Lactobacillus gasseri
  CDS (1)..(1554)
atggctaagactaatctaaatgactttgacaagattatcgtgcttgattttggtagtcaatataaccaactgattacccgtcgaattcgtgattttggtatttattcagaacttttgcctcatgacttgagcattgaaaaaattaagaaaatggcacctaaaggaattatcttttcaggtggtcctaacagtgtttatgatgaaggcgcattaaaggttgatcctgaaatctttaagctaggtattccaattttaggtatttgctacgggatgcagctgatgagttacgacttaggtggcaaggtagaaaaggctgataattcagaatatggccgtgcagatatcgaagtaactgatccaaatgcggtcttgtttgaaggcttacctaaagagcaatatgtatggatgagccacggagatctagtaactaaggcaccagaaggctttaaagttactgctaagagtaagaattgcccaatttctgcaattgctaatgatgaaaagaaattctatggaattcaattccatgcggaagttcgcaattcagaatatggcttagatattttgaagaactttgcattcaatgtttgtgatgcaaaggctaactggacaatggacgatttcattgaaatgcaagttgatgaaattcgtgaaaaagtcggtgataagaaagtcatcttaggcctttcaggtggtgttgattcaagcgttacagcaacacttttgcacaaggcaattggcgatcaattgactgcaatttttgttgatcatgggatgcttcgtaaggacgaaggcgaccaagtaatgcaggccttgaacaaggatcttggtgtaaacattattcgtgttaatgcacaaaagcgctttttagataaacttaagggcgtaaccgaccctgagcaaaaacgtaagatcattggtaaggagtttattgaagtctttaatgaagaagctaagaagcttaaggatgttgatttcttagctcaaggtacgttatatactgatgtgattgaatcaggtactaatactgctcaaacaattaagtctcaccacaatgttggtggcttacctgaggatatgcattttgagttaattgaaccacttcgtaagcttttcaaggatgaagtacgtgaactgggtgaaaaattgggtattccacacgacttagtatggcgtcaaccattcccaggtccaggtcttgctattcgtgtattaggtgaagttaccgaagataaacttaagattgtgcgtgaaagtgacgcaattttacgtgatgaaattaaaaaggctggcctgcaagaagatatttggcaatatttcacagtacttcctggtattcgctcagttggtgttatgggtgatggacgtacttacgactacaccattggtattcgtgctgtaacttcaattgatgggatgactgcagactttgctaaattgccatgggatgtattaagcaagatttctacaagaattgtagatgaatgtgatcatattaaccgtgtagtttatgatattactagtaagccaccttccactattgagtgggaataa

SEQ ID NO: 78826 - protein, 517 aa, Lactobacillus gasseri
MAKTNLNDFDKIIVLDFGSQYNQLITRRIRDFGIYSELLPHDLSIEKIKKMAPKGIIFSGGPNSVYDEGALKVDPEIFKLGIPILGICYGMQLMSYDLGGKVEKADNSEYGRADIEVTDPNAVLFEGLPKEQYVWMSHGDLVTKAPEGFKVTAKSKNCPISAIANDEKKFYGIQFHAEVRNSEYGLDILKNFAFNVCDAKANWTMDDFIEMQVDEIREKVGDKKVILGLSGGVDSSVTATLLHKAIGDQLTAIFVDHGMLRKDEGDQVMQALNKDLGVNIIRVNAQKRFLDKLKGVTDPEQKRKIIGKEFIEVFNEEAKKLKDVDFLAQGTLYTDVIESGTNTAQTIKSHHNVGGLPEDMHFELIEPLRKLFKDEVRELGEKLGIPHDLVWRQPFPGPGLAIRVLGEVTEDKLKIVRESDAILRDEIKKAGLQEDIWQYFTVLPGIRSVGVMGDGRTYDYTIGIRAVTSIDGMTADFAKLPWDVLSKISTRIVDECDHINRVVYDITSKPPSTIEWE

SEQ ID NO: 78827 - DNA, 1581 bp, Azotobacter vinelandii
  CDS (1)..(1581)
atggcccaccaagacatccacgcccaccggatcctgatcctggatttcggttcccagtacacccagttgatcgcccgccgggtgcgcgagatcggcgtctattgcgagctgcacccgttcgacatgagcaacgaggagatccgcgccttcgccccgcgcggcatcatcctcgccggcgggccggagtcggtgcacgaggccgacagtccgcgcgcgccgcaagcggtgttcgatctgggcgtgccgcttttcggcatctgctacggcatgcagaccatggccgagcaactcggcggcaaggtgcaaggctcggatctgcgcgagttcggctatgcccgtgtcgatgtggttggcaaggcgcgcctgctcgacggcatcgaggatcatgtggacgacgacggcgtgctcggcctcgacgtgtggatgagccacggcgacaaggtcaccggaattcccgagggcttccatgtgctggccagcactccgagttgcccgatcgccgccatggccgacgacaagcgccgctactacggcgtgcagttccacccggaagtgacccacaccaagcagggcctgcgcatcctcggccgcttcgtgcgcgagatctgcggctgcgaggcgctgtggacgccatccaacatcgtcgaggacgccatcgcccaggtgcgcgcccaggtcggcggcgccaacgtgctgctcggcctttccggcggcgtcgactcctcggtggtcgccgcgctgctgcatcgcgccatcggcgaccggctgacctgcgtgttcgtcgacaacggcctgctgcgcctgcacgagggcgaccaggtgatggccatgttcgccgagaacatgggcgtcaaggtgatccgcgccgatgccgaggcgcagttcctcgccaacctggccggcgtgtccgacccggagcagaagcgcaagatcatcggccgcaccttcatcgaagtgttcgatgccgaggcggcgaagctggagaacatccgtttcctcgcccagggcaccatctatcccgacgtgatcgaatcggccggcgccaggaccggcaaggcccatgtgatcaagtcccaccacaacgtcggcggtctgcccgaggacatgaacctcaagctggtcgagccgctgcgcgaactgttcaaggacgaggtgcgcaagatcggcctggaactgggcctgccctacgacatggtctatcgccacccgttccccggtccgggcctcggggtgcgcatcctcggcgaggtgaagaaggaatacgccgacctgcttcgccgcgccgaccatatcttcatcgaggaactgcgcaaggccgactggtaccacaaggtcagccaggcgttcgtggtgttccagccggtcaagtcggtcggcgtggtcggcgacggccgccgctacgcctgggtggtcgccctgcgcgccgtggaaaccgtcgacttcatgaccgcccgttgggcgcacctgccctacgagctcctggaaaaagtctccaaccgtatcatcaacgagatcgacggcatctcccgggtcacctacgacgtgtcgagcaagccgccggcgaccatcgagtgggagtga

SEQ ID NO: 78828 - protein, 526 aa, Azotobacter vinelandii
MAHQDIHAHRILILDFGSQYTQLIARRVREIGVYCELHPFDMSNEEIRAFAPRGIILAGGPESVHEADSPRAPQAVFDLGVPLFGICYGMQTMAEQLGGKVQGSDLREFGYARVDVVGKARLLDGIEDHVDDDGVLGLDVWMSHGDKVTGIPEGFHVLASTPSCPIAAMADDKRRYYGVQFHPEVTHTKQGLRILGRFVREICGCEALWTPSNIVEDAIAQVRAQVGGANVLLGLSGGVDSSVVAALLHRAIGDRLTCVFVDNGLLRLHEGDQVMAMFAENMGVKVIRADAEAQFLANLAGVSDPEQKRKIIGRTFIEVFDAEAAKLENIRFLAQGTIYPDVIESAGARTGKAHVIKSHHNVGGLPEDMNLKLVEPLRELFKDEVRKIGLELGLPYDMVYRHPFPGPGLGVRILGEVKKEYADLLRRADHIFIEELRKADWYHKVSQAFVVFQPVKSVGVVGDGRRYAWVVALRAVETVDFMTARWAHLPYELLEKVSNRIINEIDGISRVTYDVSSKPPATIEWE

SEQ ID NO: 78829 - DNA, 1470 bp, Desulfitobacterium hafniense DCB-2
  CDS (1)..(1470)
atggtcagagaagctcatgtgtactcggagatgatatcatataaaacacctgtggaggagattaaagcaagaaaccccaaaggaattattttttccggcggaccagccagtgtcaatcaagaaggggcacccaaggtggatgaggccatttatgaattaggcattcctattttcggtatttgttatggtatgcagttgatgacggttcagctaggtggaaaggtaatgcatcccgaagttcgggaatatggcaaagccatgctccatgtagatcaggccaagggcctgtggaaaggcctggggggagaacgccaatgttggatgagccacggggactcagtcactgagcttcctgaaggcttcgttatcgccgctcatacagaccataccccggtagctgctatgatggacgaaacacgtcatttttacggagtacagttccatccggaagtaaagcatactccagacgggcaggccatgcttaagcattttttgtttgatatctgcggatgtcatggggagtggacgatggagtcctttatcgacgcccaagtcaaagctattcgggagaaagtgggagatcggcaggtcctttgcgccctcagcggcggtgtggactcctctgtagcagccgttcttgttcataaggccatcggcgaccaactgacctgcgtctttgtggatcatggctttatgcgtaaaaatgaaccggaacaggtcaagaagatttttacggagcagttccatcttaagctgatttttgtggatgcccgggagcgttttatggccaagatcggcggagtatccgatcctgagaccaaacggatcggtatcggcaatgagttcatccgcctttttgaagatgaagcccgcaaattagggcagattgatttcttggttcaaggcactctctatccggatattgtggagagtggtacggataccgccgaaaccatcaagagccatcataatgtgggcggacttcctgaagatatgcagtttgagctgattgagccgttggatatgctttttaaggatgaggttcgtgaagtaggtgctgaattaggtatccccgacgagatcgtctggcggcagcctttccccggaccgggactggcgattcgcattatcggcgaggttacggaagaaaagctggacatccttcgggaggctgatgccgtcatcgtggaagaaatccgtaatgcaggactctacaaagaggtatggcaatccttcgctgtacttcctaccataaaaagcgttggcgtcatgggagatggccggacttacgcctatcccatcgttgtccgcgccgtgaccagcgaggatgccatgacggcggactgggcaagacttccctatgacctgatggagaaaatctccacccgcatcgtcaacgaagtgaagggtgtcaatagggtagtgtatgacattacctcaaaacctcctgggaccatcgagtgggagtaa

SEQ ID NO: 78830 - protein, 489 aa, Desulfitobacterium hafniense DCB-2
MVREAHVYSEMISYKTPVEEIKARNPKGIIFSGGPASVNQEGAPKVDEAIYELGIPIFGICYGMQLMTVQLGGKVMHPEVREYGKAMLHVDQAKGLWKGLGGERQCWMSHGDSVTELPEGFVIAAHTDHTPVAAMMDETRHFYGVQFHPEVKHTPDGQAMLKHFLFDICGCHGEWTMESFIDAQVKAIREKVGDRQVLCALSGGVDSSVAAVLVHKAIGDQLTCVFVDHGFMRKNEPEQVKKIFTEQFHLKLIFVDARERFMAKIGGVSDPETKRIGIGNEFIRLFEDEARKLGQIDFLVQGTLYPDIVESGTDTAETIKSHHNVGGLPEDMQFELIEPLDMLFKDEVREVGAELGIPDEIVWRQPFPGPGLAIRIIGEVTEEKLDILREADAVIVEEIRNAGLYKEVWQSFAVLPTIKSVGVMGDGRTYAYPIVVRAVTSEDAMTADWARLPYDLMEKISTRIVNEVKGVNRVVYDITSKPPGTIEWE

SEQ ID NO: 78831 - DNA, 1623 bp, Nostoc punctiforme PCC 73102
  CDS (1)..(1623)
atgaatacagtggtgactctaccgacagaacaagcgccccaaacattggaaaatgttgggcggtttgatcgcccattaattataattctggacttcggctctcaatattctgagttgattgcccgccgcatccgcgagactcaagtatactctgaagttttatcctatcgcactacttctgaacaattgcgccaactcaatcccaagggaattatcctctctggtggaccgagttcggtttatggtgacaacgctcctcattgcgatcctgaaatctggaatttaggaatacccgtcttgggtgtttgctatgggatgcagctaatggtaaaccaactcggtggcgaagttgcaaaggctgaccgaggtgagtacggcaaagcctcattatatattgacgatcccacagatttgctcactaatgttgaagatggtaccacgatgtggatgagtcacggagactcagttacccaaatgccatcagggtttgaattgctggcacatacagaaaataccccctgtgctgcgatcgctgaccacgaaaggaaactttacggcgttcaattccatccagaggtggtgcattctattggtggcatagcattaattcgtaattttgtctaccatatctgcgattgcgaacccacttggacaactgcggcttttgttgaagaggcaattcgggaaattcgcaccagagttggcgagaagcgagtgcttttggcactatctgggggagttgattcttctaccctggcgttcttactgtataaagccattggcgagcaactaacttgtgtgtttatcgatcaaggctttatgcgaaagtatgagccagagcgattagtaaagctgttccaagagcagtttcacattcctgtagagtatgtgaatgcccgcgatcgctttttagctaaggttgctggtgttacggatcctgaagaaaaacgccgccgcatcggacacgaatttatcaatgtatttgaggaaacatccaagcgccttggtcattttgactatctagctcaaggcactctttatccagatgtcatcgaatctgctgacaccaacgccgatcctcaaactggtgagcgggtagcggtgaaaattaagagccatcataatgttggcggtttacccaaagacctaagatttaaattggtggaaccactgcggaaattatttaaagatgaagtccgcaaagttgggcgttccattggtttaccagaagaaattgtccaacgacaaccttttcctgggcctggtttggcaattcgcattttgggggaagttacatctgagcggttaaatattttgcgcgatgctgatttgattgtgcggcaagaaattaaccaacgcggtatgtatcatgatttctggcaagcatttgctgtattgctgccaatccgtagtgttggcgttatgggcgatcaacgtacttacgcttaccccattgtcttgcgaattgttaccagtgaagatggcatgactgctgattgggcgagagtgccttacgatgtcctggaagtgatttccacgcggattgtaaatgaagtgaaaggggtgaatcgggtggtttatgacatcacctctaagccgcctggaaccattgaatgggagtaa

SEQ ID NO: 78832 - protein, 540 aa, Nostoc punctiforme PCC 73102
MNTVVTLPTEQAPQTLENVGRFDRPLIIILDFGSQYSELIARRIRETQVYSEVLSYRTTSEQLRQLNPKGIILSGGPSSVYGDNAPHCDPEIWNLGIPVLGVCYGMQLMVNQLGGEVAKADRGEYGKASLYIDDPTDLLTNVEDGTTMWMSHGDSVTQMPSGFELLAHTENTPCAAIADHERKLYGVQFHPEVVHSIGGIALIRNFVYHICDCEPTWTTAAFVEEAIREIRTRVGEKRVLLALSGGVDSSTLAFLLYKAIGEQLTCVFIDQGFMRKYEPERLVKLFQEQFHIPVEYVNARDRFLAKVAGVTDPEEKRRRIGHEFINVFEETSKRLGHFDYLAQGTLYPDVIESADTNADPQTGERVAVKIKSHHNVGGLPKDLRFKLVEPLRKLFKDEVRKVGRSIGLPEEIVQRQPFPGPGLAIRILGEVTSERLNILRDADLIVRQEINQRGMYHDFWQAFAVLLPIRSVGVMGDQRTYAYPIVLRIVTSEDGMTADWARVPYDVLEVISTRIVNEVKGVNRVVYDITSKPPGTIEWE

SEQ ID NO: 78833 - DNA, 1563 bp, Bifidobacterium longum DJO10A
  CDS (1)..(1563)
atggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctaccccgacgtcgtcgaatccggcggcggcgacggcgcggccaacatcaagagccaccacaacgtcggcggcctgcccgaggacatcaagttccagctcatcgaaccgctgcgcactctgttcaaggatgaggtgcgcgccatcggcaccgagctcggtctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcgccgatcgtcctgcgcccggtcagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaa

SEQ ID NO: 78834 - protein, 520 aa, Bifidobacterium longum DJO10A
MANGPVLVVDFGAQYAQLIARRVREAGVYSELVPHSMPVDEILAKDPKAIILSGGPASVFEPGAPTIDTKVFESGVPVLGICYGFQVMAYELGGKVDKAALGEYGKTSATIDDAAGILADSPAEQTTWMSHGVAVEQAPAGFEVLAHTEGAPVAAMADESRKLYGVQWHPEVKHSPLGQKLIENFLHRCAALPNDWDASSIIEDQVKKIREQVGDAEVICGLSGGVDSAVAAALVHKAIGDQLTCVFVDHGLLRKGEVEQVKHDFVAATGIRLITVDAADDFLDALAGVSEPERKRKIIGEKFIRTFEKAQRQVLEEAGARGKEVKFLVQGTLYPDVVESGGGDGAANIKSHHNVGGLPEDIKFQLIEPLRTLFKDEVRAIGTELGLPDEIVWRQPFPGPGLGIRIIGEITKERLDLLREADAIAREELSKAGLDRDIWQCPVVLLADVHSVGVQGDERTYGSPIVLRPVSSEDAMTADWSRVPYDVLATISTRITNECRQINRVVLDCTSKPPATIEWE

SEQ ID NO: 78835 - DNA, 1551 bp, Desulfovibrio desulfuricans G20
  CDS (1)..(1551)
atggaaaagcagaacaaagtcattatcgtggactacggttcgcaggttacgcagctgatcgctcgccgtatccgcgaggccggtgtctattccgaaattcatccctgcatcgtcactgccgcagaagtagccgccatgtctccttcggctgtagtgctttccggcggacccgccagcgtgctgggcgaagattcccccgcgctggacaaaggcctgctggaactcggcgtgccggttctgggcatctgctacggcatgcagctgcttgcgcacaatctgggcggagagctttcctgctccgaaacccgcgaatacggccccgccgacctgaagttctgcgccggaagccccctgtgggacggcctgaaaacagatgaatcatcacgggtatggatgtcgcacggtgacagagtgaaaaaagtgcccgccggatttacggtgaccggcagcaccgaaacactggaagtggccgccatggccgacgaccagcgccgcatctatgccgtgcagttccaccccgaagtccatcactccgaagacggcgtgcgcatgctgcacaacttcctgtttaaaattgcaggaatcaaggctgactggtccatgtcctctttctgcgagcgggtgataaaagaagtctccgagcaggtaggccccgacgatcaggtggtctgcgctctttcgggcggcatagactccaccgtggttgccgtgctgctgcacaaggccatcggccaccgcctgcactgcatctttgtggacaacggagtgctgcgcctgaatgaagttgatgaagtttccggctatctgcgcgaacacttcgacctcaacctgacggttgtagacgcccgcgaacgctttatgaagcagtttgccggagtcgaagaccccgaaaagaaacgtaagatcatcggctacaccttcatcgacgtgttcgatgaagagtcgcagaaaattcccaacgtgaagtatctcgcgcagggcacgctgtaccccgatgtcattgaatccatatcgcacaagggcccttcggccgtcatcaaaagccaccacaacgtgggcggcctgcccgaaaccatgaaactcaagctcatcgagccgctgcgcgaactcttcaaggacgaagtgcgcaagctggccgtggaactcggcctgcccgacttcattgtctggcgccatcccttccccggtcccggccttgccatacgcgtcatcggcgaggtaacggaagagcgtctggacatcctgcgcaaagctgacaaaatcgttcagaatgagttgacggcgtctggctggtatcgcaaagtgtggcagggctttgccgtactgctgccgttaaagacggtcggtgtcatgggcgatgaccgcacctacgagcacgtcatagccctgcgcgtggtggacagtgtcgacgccatgaccgcagactgggtgcggctgccctccgaagtgctggagcgcatctccagccgcatcatcaacgaggtcaaaggcgtcaaccgcgtggtttacgacatatcctcgaagccgcccagcaccatcgagtgggaataa

SEQ ID NO: 78836 - protein, 516 aa, Desulfovibrio desulfuricans G20
MEKQNKVIIVDYGSQVTQLIARRIREAGVYSEIHPCIVTAAEVAAMSPSAVVLSGGPASVLGEDSPALDKGLLELGVPVLGICYGMQLLAHNLGGELSCSETREYGPADLKFCAGSPLWDGLKTDESSRVWMSHGDRVKKVPAGFTVTGSTETLEVAAMADDQRRIYAVQFHPEVHHSEDGVRMLHNFLFKIAGIKADWSMSSFCERVIKEVSEQVGPDDQVVCALSGGIDSTVVAVLLHKAIGHRLHCIFVDNGVLRLNEVDEVSGYLREHFDLNLTVVDARERFMKQFAGVEDPEKKRKIIGYTFIDVFDEESQKIPNVKYLAQGTLYPDVIESISHKGPSAVIKSHHNVGGLPETMKLKLIEPLRELFKDEVRKLAVELGLPDFIVWRHPFPGPGLAIRVIGEVTEERLDILRKADKIVQNELTASGWYRKVWQGFAVLLPLKTVGVMGDDRTYEHVIALRVVDSVDAMTADWVRLPSEVLERISSRIINEVKGVNRVVYDISSKPPSTIEWE

SEQ ID NO: 78837 - DNA, 1584 bp, Pseudomonas aeruginosa UCBPP-PA14
  CDS (1)..(1584)
atggccatgtcccaagacattcacgcccaccgtatcctgatcctcgatttcggctcccagtacacccaactgatcgcccgccgcgtgcgcgagatcggcgtgtattgcgaaatccatcccttcgacatgagcaacgaggcgatcatcgccttcgcgccgcgcggcatcatcctcgccggcggtcccgagtcggtgcacgaagccgacagcccgcgcgcgccgcaggcggtgttcgacctgaaggtgccgctgttcggcatctgctacggcatgcagaccatggccgagcagatgggcggcaaggtgcagggctccgacgtgcgcgagttcggctacgcccgcgtcgacgtggttggcaaggcgcgcctgctggacggcatcgaggaccacgtggacgacgacggcgtgctcggcctcgacgtgtggatgagccacggcgacaaggtcaccgagatgccggccggcttccacatcctggccagcaccccgagctgcccgatcgccgccatggccgacgatgcccgcgcctactacggcgtgcaattccacccggaagtcacccacaccaagcagggcctgcgcattctctcgcgcttcgtcctcgacatctgtggttgcgccgcgctgtggaccccctcgaacatcgtcgacgacgccatcgccaccgtgcgcgcccaggtcggttcctccaaggtcctgctcggcctctccggcggcgtggactcctcggtggtcgccgcgctgctgcacaaggccatcggcgaccaactgacctgcgtgttcgtcgacaacggcctgctgcgcctgcacgaaggcgaccaggtgatggccatgttcgccgagaacatgggcgtgaaggtgatccgcgccaacgccgaggacaagttcctcggccgcctggccggcgtcgccgatccggaagagaagcgcaagatcatcggccgcaccttcatcgaagtcttcgacgaagaagccaccaagctgcaggacgtgaagttcctcgcccagggcaccatctaccccgacgtgatcgagtcggccggcgccaaaaccggcaaggcccacgtgatcaagtcgcaccacaacgtcggcggcctgccggaggacatgcagttcgaactggtcgagccgctgcgcgaactgttcaaggacgaagtgcgcaagatcggcctggagctgggcctgccctacgacatggtctaccgccacccgttccccggcccgggcctgggcgtgcgcatcctcggcgaggtgaagaaggagtacgccgacctgctgcgccaggccgaccacatcttcatcgaggaactgcgcgccttcgactggtaccacaagaccagccaggcgttcgtggtgttccagccggtgaaatcggtcggcgtggtcggcgacggccgtcgctacgcctgggtcgtcgccctgcgcgcggtggagaccatcgacttcatgaccgcgcgctgggcgcacctgccctatgaactgctggagaaggtctcgaaccgcatcatcaacgagatcgccggtatctcccgggtcacctacgacgtgtcgagcaagccgccggcgactatcgagtgggagtga

SEQ ID NO: 78838 - protein, 527 aa, Pseudomonas aeruginosa UCBPP-PA14
MAMSQDIHAHRILILDFGSQYTQLIARRVREIGVYCEIHPFDMSNEAIIAFAPRGIILAGGPESVHEADSPRAPQAVFDLKVPLFGICYGMQTMAEQMGGKVQGSDVREFGYARVDVVGKARLLDGIEDHVDDDGVLGLDVWMSHGDKVTEMPAGFHILASTPSCPIAAMADDARAYYGVQFHPEVTHTKQGLRILSRFVLDICGCAALWTPSNIVDDAIATVRAQVGSSKVLLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHVIKSHHNVGGLPEDMQFELVEPLRELFKDEVRKIGLELGLPYDMVYRHPFPGPGLGVRILGEVKKEYADLLRQADHIFIEELRAFDWYHKTSQAFVVFQPVKSVGVVGDGRRYAWVVALRAVETIDFMTARWAHLPYELLEKVSNRIINEIAGISRVTYDVSSKPPATIEWE

SEQ ID NO: 78839 - DNA, 1539 bp, Fusobacterium nucleatum subsp. vincentii ATCC 49256
  CDS (1)..(1539): transl_table=11
atgaaaaaaggtggaattgttatactagactttggttctcaatacaatcaacttattgcaagaagagttagagaaatgggagtttatgccgaagttgttccttttcatgaagatgttgataaaattttagctagagaaccaaaaggaattattctttctggtggacctgcttctgtttatgctgagggagctccaagtttgaatattaaattatttcaaaaaaatattccaattcttggactttgttatggtatgcaacttataactcatttacatggtggaaaagttgcaagagctgataaacaagagtttggtaaggctgaactagaacttgatgataaaaatcatatattatataaaaatattccaaataagactactgtttggatgagccatggagaccatgttacagaaatggcatctgattttaaaattattgctcacactgattcttcaatagctgctattgaaaacaatgataaaaatatctatgctttccaatatcacccagaagttactcactcacaacatggttttgatatgcttaaaaactttgtttttggtatagcaaaggctgaaaaaaattggtcaatggaaaactatattgaatcaactgttaaacaaataaaagaaagagttggaaataaacaagtgatactaggtttatctggtggagtagactcatctgttgctgctgcacttatcaacaaagcaataggtaaacaattaacttgtatttttgttgatactggtttacttagaaaagatgaagctaagcaagttatggaagtttatgctaaaaactttgatatgaatattaaatgtataaatgcagaagaaagatttctatcaaaacttgctggtgtaactgacccagaaactaagagaaaaattataggaaaagaatttgttgaagtattcaatgaagaagctaaaaagattgaaggtgctgaatttttagcacaaggtacaatctatccagatgttattgaatctgtttctgttaaaggaccatctgttactataaaatctcatcacaatgttggaggtttaccagaagatttaaaattcgaattacttgaacctttaagagaactatttaaagatgaagttagaaaagtaggtagagaattaagtatccctgattatatggttgataggcatccattcccaggacctggtttaggaattagaatcctaggagaagttacaaaagaaaaagctgatattttaagagaagccgatgcaatatttatagaagagttgagaaaagctgatttatataataaagttagccaagcttttgttgttttacttcctgtaaaatctgttggagttatgggagatgaaagaacttatgaatatacagctgttttaagatctgctaatacaatagattttatgactgctacttggtcacacttaccttatgaatttttagaaaaggtttctaatagaattttgaatgaggttaagggaattaatagattgacttatgatatttcttctaaaccacctgctactattgagtgggaataa

SEQ ID NO: 78840 - protein, 512 aa, Fusobacterium nucleatum subsp. vincentii ATCC 49256
MKKGGIVILDFGSQYNQLIARRVREMGVYAEVVPFHEDVDKILAREPKGIILSGGPASVYAEGAPSLNIKLFQKNIPILGLCYGMQLITHLHGGKVARADKQEFGKAELELDDKNHILYKNIPNKTTVWMSHGDHVTEMASDFKIIAHTDSSIAAIENNDKNIYAFQYHPEVTHSQHGFDMLKNFVFGIAKAEKNWSMENYIESTVKQIKERVGNKQVILGLSGGVDSSVAAALINKAIGKQLTCIFVDTGLLRKDEAKQVMEVYAKNFDMNIKCINAEERFLSKLAGVTDPETKRKIIGKEFVEVFNEEAKKIEGAEFLAQGTIYPDVIESVSVKGPSVTIKSHHNVGGLPEDLKFELLEPLRELFKDEVRKVGRELSIPDYMVDRHPFPGPGLGIRILGEVTKEKADILREADAIFIEELRKADLYNKVSQAFVVLLPVKSVGVMGDERTYEYTAVLRSANTIDFMTATWSHLPYEFLEKVSNRILNEVKGINRLTYDISSKPPATIEWE

SEQ ID NO: 78841 - DNA, 1611 bp, Psychrobacter sp. 273-4
  CDS (1)..(1611)
atggacactttgtttatgaccactgtaactgccacccccgcaatcaaagaagatcgcatcttaattctcgattttggctcgcagtacagccagcttatcgcccgccgtgtacgcgattcaggcgtattctgtgagatgttcccttacgatatcgacacccagcgcatcactgattttggcgcaaaaggcatcatcttatctggcggtcctgagagcgttcacgcggaaaacagcccacgcattaacgatgccgtatttgagctaggcgtacccgtacttggtatctgctacggtatgcaagcaatggcagagcgcttcggtggtaaagttcacgccagtgatatccatgaatttggcgcagcgaccattaatatcgatggtaaatcgacgctgactaatggcatcgaagacgcagcagcgaagctcaatgtctggatgagtcatggtgataaagtggtcgacgccccacaaggcttcgatatcgttgccagtacgccaagctgcccgattgctatcatggctgacgattcgcgccactattatggtcttcagttccacccagaagtcactcataccgcccaaggtcaggcattgctaggacgttttgtccatgaaatctgtgactgtgcgggtagctggacgcccgataacatcatcgatatgcgtattgaacagctgaaaaagcaaatcggtgataagcaagtattgctcggtctttcaggtggtgttgatagttcagtcgtcgcggcacttttgcataaagccattggcgaccaattaacgtgtgtgtttgttgatactggtctgttgcgtctacacgaaggcgaccaagtgatgcaaattttcgcagaaaacatgggcgtaaaagtcattcgtgttgatgctgaagagttattcctaacggcattggctggcgagtctgaccctgaagccaagcgcaaaattattggtaaaacctttatcgacgtctttgccaatagcgcccgcgaaatcagtgagcaaagcgatggtaaagtcatcgaattcttagcgcaagggacgatttatccagatgtgattgaatcagcgaagtcgcatcaaggtaaagcgcacgtgattaagagccatcataatgttggtggtttgccagatgatttggcatttgaattggttgagccgttacgtgatttgtttaaagatgaagtgcgtaaattaggtatcactcttggtttacctgcgaagatgattaaccgtcatccgttcccaggaccgggtttgggtgtgcgtatcctaggcgaagtgaccaaagaattcgctgatatcctgcgttctgctgatgctatctttatggaagagttagaaaaatcaggctggtatgagaagaccgcgcaagcgtttgcggtattccaaccaattaaatcggtcggcgtggtcggtgatggtcgtcgttatgcgtgggtgattgcgctacgtgcggttgagaccgtggactttatgaccgcgcgttttgctcatctaccgtatgatttgattgagacggtatcgaatcgcattatgaatgagatcgctgaagtatcacgcgtgacttatgatgtgtcgagcaagccaccggctactattgagtgggagtaa

SEQ ID NO: 78842 - protein, 536 aa, Psychrobacter sp. 273-4
MDTLFMTTVTATPAIKEDRILILDFGSQYSQLIARRVRDSGVFCEMFPYDIDTQRITDFGAKGIILSGGPESVHAENSPRINDAVFELGVPVLGICYGMQAMAERFGGKVHASDIHEFGAATINIDGKSTLTNGIEDAAAKLNVWMSHGDKVVDAPQGFDIVASTPSCPIAIMADDSRHYYGLQFHPEVTHTAQGQALLGRFVHEICDCAGSWTPDNIIDMRIEQLKKQIGDKQVLLGLSGGVDSSVVAALLHKAIGDQLTCVFVDTGLLRLHEGDQVMQIFAENMGVKVIRVDAEELFLTALAGESDPEAKRKIIGKTFIDVFANSAREISEQSDGKVIEFLAQGTIYPDVIESAKSHQGKAHVIKSHHNVGGLPDDLAFELVEPLRDLFKDEVRKLGITLGLPAKMINRHPFPGPGLGVRILGEVTKEFADILRSADAIFMEELEKSGWYEKTAQAFAVFQPIKSVGVVGDGRRYAWVIALRAVETVDFMTARFAHLPYDLIETVSNRIMNEIAEVSRVTYDVSSKPPATIEWE

SEQ ID NO: 78843 - DNA, 1635 bp, Dechloromonas aromatica RCB
  CDS (1)..(1635)
atgtctcaccagaaaatcctcatcctcgatttcggttcccaggtcactcagctgatcgcccgtcgcgtgcgcgaagcgaaggtcttctgcgaaattcatccgtacgacgtttccgaagaatttattcgcaattacggcgccaagggcatcatcttgtcgggtggcccaagttcggtgaccgagggtgatacgccgcgagcgccggaagtggttttccaactcggtgttccggttctcggcatttgctacggcatgcagaccatggcccagcaactgggtggcaaggtgatgaccgccgaggcagcgggcaaatcccgcgaatttggctactcggaagtccgcgcccacggccacacggcactgctcaacgatattgccgacttttatagtccggaaggtcacggcatgctcaaggtctggatgagccacggcgattcggtcatggaactgccggccggcttcgtcaagatggcttcgaccgcctcgtgcccgattgcggcgatggccgacgagagccgcaagttctacgctgttcagttccacccggaagtgacgcacacccagcagggccgcgccatcctcgaacgtttcgtgcatggcatctgcggctgtggcactgactgggtcatgggcgactacatcgccgaggcggtcgatgccatccggcgtcaggtcggcgacgaggaagtcattctcggcctgtccggcggtgtcgattccagtgttgccgcggcgctgatccacaaggcaatcggcgaccagctgacctgcgtttttgtcgatcacggcctgctacgcctgaacgaaggcgacatggtgatggagatgtttgcccgtaatcttggcgtcaaggtcatccgtgtagatgccgttgatgacttcatgggcaagctggccggtgtctccgaccccgagcagaagcgcaagatcatcggtaaggaattcgtggaagttttccaggttgaatccaaaaagcttgccgctgccaagtggctggcccagggcacgatctacccggacgtgatcgagtcggccggcaagggcaagaagggcgctcacacgatcaagagccaccataacgttggcggcctgccggaagatatgcacctcaaattgcttgagccgctgcgtgagttgttcaaggacgaagtccgtgaactgggcattgccctcggactgccacgcgagatggtgtatcgccacccgttcccggggccgggcttaggggttcggattcttggcgaagtcacgctgaaggcggctcatctgttgcaacgcgctgatgccattttcatcgatgaactgcgtgccacccacgcaaccgaacgtgatgtggcggccggtgcctgcactgaagccgacatcggcaagagctggtacgacctgaccagccaggcctttgccgttttcctgccagtcaagagcgttggcgtgatgggggatggtcggacctacgagaatgtcgtcgccttgcgcgccgtggtgaccagcgacttcatgacggcacactgggcgcaccttccgtatgagctgcttggccgggtttccaatcgcatcatcaacgaagtccggggtctgaaccgcgttgtttatgacgtgtcaggcaagccgccggctacgatcgagtgggaataa

SEQ ID NO: 78844 - protein, 544 aa, Dechloromonas aromatica RCB
MSHQKILILDFGSQVTQLIARRVREAKVFCEIHPYDVSEEFIRNYGAKGIILSGGPSSVTEGDTPRAPEVVFQLGVPVLGICYGMQTMAQQLGGKVMTAEAAGKSREFGYSEVRAHGHTALLNDIADFYSPEGHGMLKVWMSHGDSVMELPAGFVKMASTASCPIAAMADESRKFYAVQFHPEVTHTQQGRAILERFVHGICGCGTDWVMGDYIAEAVDAIRRQVGDEEVILGLSGGVDSSVAAALIHKAIGDQLTCVFVDHGLLRLNEGDMVMEMFARNLGVKVIRVDAVDDFMGKLAGVSDPEQKRKIIGKEFVEVFQVESKKLAAAKWLAQGTIYPDVIESAGKGKKGAHTIKSHHNVGGLPEDMHLKLLEPLRELFKDEVRELGIALGLPREMVYRHPFPGPGLGVRILGEVTLKAAHLLQRADAIFIDELRATHATERDVAAGACTEADIGKSWYDLTSQAFAVFLPVKSVGVMGDGRTYENVVALRAVVTSDFMTAHWAHLPYELLGRVSNRIINEVRGLNRVVYDVSGKPPATIEWE

SEQ ID NO: 78845 - DNA, 1623 bp, Anabaena variabilis ATCC 29413
  CDS (1)..(1623)
atgaatacagcggtgactctactaaccgaacaagcccctcaaccaatagaagagtttgggcagcttgagcgtcaaatcattatcatattagacttcggctctcagtattcagaactgattgcccggcgcatccgcgagactcaagtatactctgaagttttgtcttatcgcacctctgctgaacatttacgccaactaaatcccaagggcatcattctttctggtggtcccagttcagtttatagcgatcgcgctccccattgtgacccagaaatttggaatttgggagttcccattttgggtgtctgctacggaatgcagctgatggtcaaccaactcggcggcgaagtagccaaagctgaccggggtgagtatggcaaagcatcattacatattgatgatcccaccgacctactgaccaacgttgaagatggcacaacgatgtggatgagtcatggtgattcagtcacaaaaatgcccccagggtttgaagtgctggcacatacagataatactccctgtgctgctgttgctgaccacgacaaaaagctttatggcgtgcagttccatccagaagtagtccattccatcggtggtttggcattaatccgcaactttgtgtatcacatctgcgagtgtgaacccacctggacaacagccgcttttgtggaagaagctattcgggaagttcgggctaaagttggtgacaagcgagtactattggcgctttcgggaggagtcgattcttctacactggctttcttgatgcacaaagccatcggcgaccaattgacctgtgtatttatagaccaaggctttatgcggaagtatgagccagaaaggttggtgaaactatttcaagagcagtttcacatccctgttgaatatgttaacgcccgcgatcgcttcttagatatcatggttggcgtgacagacccagaagaaaaacgtcgtcgcattggacatgaattcatccaggtatttgaagaaacatcgagaaatttgggaccctttgactatctagcacaagggactctttacccagatgtcattgaatcagctgataccaatgttgacccccaaaccggggaacgggtagcagtaaaaatcaaaagccatcacaacgttggtggattacccaaagacttgagatttaaactggttgaacccctgcggaaactatttaaagatgaagtccgtaaagtagggcggtctgttggcttaccagaagagattgtccaacgccagccatttcctggccctggtttagctattcggattttaggtgaagtcaccgccgacagattgaacattctgcgcgatgctgatttgattgtgcgccaagaaattaaccaacgtggtttatacaacgaatattggcaagcattcgccgtcttactacctatccgtagtgtgggcgtaatgggtgatcaacgcacctatgcttatcctatagtcttacgcattgttaaaagcgaagatggcatgacagcagattgggcgcgtgtaccttacgatgttttagaagcaatttctaaccgcattgtcaacgaggttaaaggcgttaatcgcgtagtgtttgatattacctccaagccacccggaaccatcgagtgggaataa

SEQ ID NO: 78846 - protein, 540 aa, Anabaena variabilis ATCC 29413
MNTAVTLLTEQAPQPIEEFGQLERQIIIILDFGSQYSELIARRIRETQVYSEVLSYRTSAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHDKKLYGVQFHPEVVHSIGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMVGVTDPEEKRRRIGHEFIQVFEETSRNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 78847 - DNA, 1587 bp, Synechococcus elongatus PCC 7942
  CDS (1)..(1587)
atggaggctgcacttgaagttgcagccttgaaccgtgaaatgttgatcattctggacttcgggtcgcagtactcggagctgattgctcgccgcattcgcgaaacgcaagtttattcagaagtgctgtcctaccgcaccacggcggatcaaattcggcagctgtctcccaagggcatcatcctttcaggcggccctaattcggtctacgacgactacgcgccagtttgcgatccagaaatctggaatctgggaattccggtgctgggcgtctgctacggcatgcagctgatggtgcaacagctagggggccaagtcgatcgcgccgagcgtggcgaatatggcaaggcagcgttggtcatcgacgatccgaccgatttgctgaccaacgtcgaaccgggctcgaccatgtggatgagccatggcgactctgtcaaaaccatgcccgagggctttgagctgctcgcccacaccgataacaccccctgcgctgcgatcgcggatcaccagcgcaagttctacggcgtgcagttccacccggaagtcgtgcattccgtgcatggcatggcgctgattcgcaactttgtctatcacatttgcgattgcgaaccgacttggacaacggaaacctttgtcgaagaagcgattcgcgaaattcgggcacgagtcggtgataagcgcgttctcctagcgctatccggcggtgtagattcttcgacgctggccttcctgttacatcgggcaatcggcgatcagctgacctgtatgttcattgatcagggcttcatgcgcaaaggcgaaccggagcgcttgatggaggtattcaacgagaaattcaagattcatgttgaatatattcaagctcgcgatcgcttcttacagcgactggaaggcatcaccgatcccgaagaaaaacgcaaacggattggccacgaattcattcgcgtttttgaagaagaatcgcgtcggctcggccccttcgactatctggcccaaggcacgctctatcccgatgtgattgagtcggcagacactaacgtcgatcccaaaacgggcgagcgagtggcggtcaagatcaagagccaccacaacgtcggtggtctgcccaaagacctccagttcaagctagttgaaccgctgcggcgtctgttcaaagatgaagtgcgtcaggttgggcgatcgctgggtctaccagaagaaatcgtcaagcgccatccgttcccaggcccgggcctcgcgattcggattctgggtgaagtcacagctgaaaagctcaacatcctgcgcgatgcagacttgattgttcgccaggaagtcaaccgtcagggctattacgacgagttctggcaagccttcgctgtgctgctgccggtcaagagtgtcggtgtgatgggcgacaagcgcacctacgcctaccctgttgtgctgcgttttgtcagcagtgaagacggcatgaccgctgactggtcgcgggctccctacgacctactggagacgatttcgaatcggattgtcaacgaagtgaaaggcgtcaaccgcgtcgtctacgacatcacctcgaaaccccctggcacgatcgagtgggaatga

SEQ ID NO: 78848 - protein, 528 aa, Synechococcus elongatus PCC 7942
MEAALEVAALNREMLIILDFGSQYSELIARRIRETQVYSEVLSYRTTADQIRQLSPKGIILSGGPNSVYDDYAPVCDPEIWNLGIPVLGVCYGMQLMVQQLGGQVDRAERGEYGKAALVIDDPTDLLTNVEPGSTMWMSHGDSVKTMPEGFELLAHTDNTPCAAIADHQRKFYGVQFHPEVVHSVHGMALIRNFVYHICDCEPTWTTETFVEEAIREIRARVGDKRVLLALSGGVDSSTLAFLLHRAIGDQLTCMFIDQGFMRKGEPERLMEVFNEKFKIHVEYIQARDRFLQRLEGITDPEEKRKRIGHEFIRVFEEESRRLGPFDYLAQGTLYPDVIESADTNVDPKTGERVAVKIKSHHNVGGLPKDLQFKLVEPLRRLFKDEVRQVGRSLGLPEEIVKRHPFPGPGLAIRILGEVTAEKLNILRDADLIVRQEVNRQGYYDEFWQAFAVLLPVKSVGVMGDKRTYAYPVVLRFVSSEDGMTADWSRAPYDLLETISNRIVNEVKGVNRVVYDITSKPPGTIEWE

SEQ ID NO: 78849 - DNA, 1581 bp, Methylobacillus flagellatus KT
  CDS (1)..(1581)
atgcaacaaaaaattctgattctcgatttcggctcccaatacacccagctgatcgcccgtcgcatccgtgaggccaacgtctactgtgagctgcactcatgggacgtatctgatgcattcatccgcgagttcaacccagcaggcgtgatcctctccggcggccccaactctgtctatgaagacgaaaccccgcgtgcgccgcaaagcgtgttcgaactgggtgtgcccgtattgggcatctgctatggcatgcagaccatggcagcgcaacttggcggctcggtggaaaatgccgccaagcgcgagttcggctacgccgaaatccgcgcccagggacactccgccctgctaaaaggcattcaggacaaaagcaatgcagaaggccacggcttgctggacgtctggatgagccatggcgacaaggtcacggccttgcccgagggcttcaagatcattgccagcaacagcgcaaccccgattgccggcatggcggacgaaaaccgccgcttctacgcggtacagttccatcctgaagtcacccataccaagcaaggcaaagccctgctcaaccgcttcgtgcacgacatctgcggttgcgaccagagctggaacatgccggactatgtggaaaccgccgtgcaacgcatccgcgaggaagtcggctgcgatgaagtcatcctcggtctttccggcggcgtggattcctcagtggctgccgcgctgattcatcgcgcgattggcgaccaactcacctgcgtcttcgtcgacaacggtctgttgcgcctcaacgaagccgagcaggtgatggaaaccttcggcaagaacctcggcgtcaaggtcatccatgtcgatgccagcgccaaattcctcggcgacctctcaggtgtgaacgatccggaagccaagcgcaagatcatcggccgtgagttcgtggaagtgttccagcaggaagctgccaagctgccgcaagccaagtggctggcacagggcaccatctaccccgatgtcatcgagtccgccggcgccaagaccaagaaggcccataccatcaagagccaccacaacgtaggtggcctgcccgatacgctgaaactcaagctactcgaaccattgcgtgaactgttcaaggatgaagtccgcgagcttggcattgccctcggtctgccgcacgacatggtctaccgccaccccttccccggccccggcctcggagtgcgcatactgggtgaggtcaagcgcgaatacgccgacctgctgcgccaggccgaccatattttcattgaggagctgcgcagcaccaaggatgcggacggcaagtcatggtacgacaagacctcgcaagcctttgccgtgttcttgccagtgaaatccgtgggcgtaatgggcgatggccgcacctatgactatgtggtcgccctgcgcgctgtggtcaccaccgacttcatgaccgcgcactgggccgagctgccttacgacctgctgggcaaggtgtccaaccgtatcatcaatgaagtgcgcggcatcaaccgcgtggtgtacgacatctcgggcaagccaccagccacaatcgagtgggagtga

SEQ ID NO: 78850 - protein, 526 aa, Methylobacillus flagellatus KT
MQQKILILDFGSQYTQLIARRIREANVYCELHSWDVSDAFIREFNPAGVILSGGPNSVYEDETPRAPQSVFELGVPVLGICYGMQTMAAQLGGSVENAAKREFGYAEIRAQGHSALLKGIQDKSNAEGHGLLDVWMSHGDKVTALPEGFKIIASNSATPIAGMADENRRFYAVQFHPEVTHTKQGKALLNRFVHDICGCDQSWNMPDYVETAVQRIREEVGCDEVILGLSGGVDSSVAAALIHRAIGDQLTCVFVDNGLLRLNEAEQVMETFGKNLGVKVIHVDASAKFLGDLSGVNDPEAKRKIIGREFVEVFQQEAAKLPQAKWLAQGTIYPDVIESAGAKTKKAHTIKSHHNVGGLPDTLKLKLLEPLRELFKDEVRELGIALGLPHDMVYRHPFPGPGLGVRILGEVKREYADLLRQADHIFIEELRSTKDADGKSWYDKTSQAFAVFLPVKSVGVMGDGRTYDYVVALRAVVTTDFMTAHWAELPYDLLGKVSNRIINEVRGINRVVYDISGKPPATIEWE

SEQ ID NO: 78851 - DNA, 1629 bp, Crocosphaera watsonii WH 8501
  CDS (1)..(1629)
atgactactcaaaccccttacctctccaatacaccagagactttacccagcaacaaccttgataaaagtctcgatcgccaaatgattgttattcttgactttggttctcaatattcagaattaattgcccgccgcattcgagaaacccaagtttattctgaagttttatcctatcgcacaacggtcgaaaaattacgccaacttaaccccaaaggaattatcctctcaggaggtcccaactcagtatatgacgatcgcgcccctcaatgtgatcctgagatttggcagttaggtattcccgtgttaggggtttgctacggaatgcagttgatggttaaacaactggggggacaagtagaaaaagcgacaaggggagagtatggtaaagcttccctgtgtatcgatgaccccacagacttattaaccaatgtagaagacggttcaaccatgtggatgagtcatggagactcttgtacccgtcttcccgaaggtttctctattttagcccatactgagaatactgtatgtgctgctattgctaaccatgagaagaaactgtttggggtacaatttcatcccgaggtggttcactcggtggatgggatcgccctaattcgtaattttgtctatcatatttgtgaatgtgaacccacttggaccacagaagcttttgtggatgagactatacgtgagattcgcgctaaagtgggggataaaagggtattattagccctatctggtggtgtggactcctcaaccctggcatttttgttacatcaggccattggggataagttaacctgtatgtttattgatcaagggttcatgcgtaaaggggaaccggaacggttgatggatatctttgatcgacagtttcatattcccgtagaatacgtccacgcgcgcgatcgctttttaaataaactcgaagggataacggacccagagaaaaaacgccgtctcattggtcatgagtttatccaagtgtttgaagaagagtctaaacgtcttggaccttttgattatttagctcaaggaaccctttacccggatgtgatcgagtctgctgatactaatgtagacccgaaaacaggggaacgggttgccgttaagattaaaagtcatcataatgtgggaggattacccaaggatcttcgttttaagttagtagaacctttacggaagctatttaaagacgaggttcggaaagttgggcgttctattggtttacctgaagaaattgttcgccgtcatccttttcctgggcctggtttagctattcgtattatcggggaagtgacctcggaacggttaaatatcctacgggacgctgattttgtggtacgggacgaaatcgctaaacaggggatgtaccatgatttttggcaagcttttgctgttcttttaccggttcgtagcgtcggtgtgatgggagatcaacgtacttatgctcatcccattgtactgcgtttaatcaccagtgaagacgggatgactgctgactgggctaaagttccttatgatttgttagaaatcatttctaaccgcattgtaaacgaggtgaaaggggttaaccgtgtggtctatgatatcacctctaaacccccaggaaccattgaatgggaataa

SEQ ID NO: 78852 - protein, 542 aa, Crocosphaera watsonii WH 8501
MTTQTPYLSNTPETLPSNNLDKSLDRQMIVILDFGSQYSELIARRIRETQVYSEVLSYRTTVEKLRQLNPKGIILSGGPNSVYDDRAPQCDPEIWQLGIPVLGVCYGMQLMVKQLGGQVEKATRGEYGKASLCIDDPTDLLTNVEDGSTMWMSHGDSCTRLPEGFSILAHTENTVCAAIANHEKKLFGVQFHPEVVHSVDGIALIRNFVYHICECEPTWTTEAFVDETIREIRAKVGDKRVLLALSGGVDSSTLAFLLHQAIGDKLTCMFIDQGFMRKGEPERLMDIFDRQFHIPVEYVHARDRFLNKLEGITDPEKKRRLIGHEFIQVFEEESKRLGPFDYLAQGTLYPDVIESADTNVDPKTGERVAVKIKSHHNVGGLPKDLRFKLVEPLRKLFKDEVRKVGRSIGLPEEIVRRHPFPGPGLAIRIIGEVTSERLNILRDADFVVRDEIAKQGMYHDFWQAFAVLLPVRSVGVMGDQRTYAHPIVLRLITSEDGMTADWAKVPYDLLEIISNRIVNEVKGVNRVVYDITSKPPGTIEWE

SEQ ID NO: 78853 - DNA, 1545 bp, Exiguobacterium sp. 255-15
  CDS (1)..(1545)
ttggaagcacatttggaccaagaaatgatcctcgtcctcgactttggaggtcagtacaatcaattgatcacacgccgcattcgtgatctcggagtttacagtgaactgcattcgcataagatcactgcagcggaagtaaaagacatcgcaccagccggtatcatcttctccgggggaccacggagtgtctacgcagaagacgcgtaccgctgtgatccagaaatctttgacctcggcattccgattttcggaatttgttacggtatgcaattgatgtcgcaacactttggtggaacggttgaacgcgccggacaccgcgagtacggaaaagcgacgttgacactcaacgatccatcgccgatgtatgcgaacctcccgctcgaacagacggtttggatgagccacagtgacctcgtcacatcggtaccaaacggtttcgtcgtcgatggaacaaatgtctcgtgcccaattgcttcaatcaaaaacgaagagctaaagatgtacggcgtccagtatcatccggaagtcaaccatacgatgttcggtaaagaactcttgaaaaacttcctcttcgaagtctgtcagtgtacgggcgactggtcgatggaaaacttcatcgaaatcgaaatcgcaaaaattaaagaagaagtcggcgataaaaaggtcctttgcgccctttcaggcggtgttgattcatctgtcgtcgcggcactcattcacgcagcaatcggtgaccagttgacatgtatgttcgtcgaccacggtctcttgcgtaaaggggaagccgaaagtgtcatgaaaacatttgcggatcacttccacatgaacgtcatcaagattgacgcgcaggaccgcttcctcaacaagttaaaagggatctcggatccggagcaaaaacgaaaaatcatcgggaacgaattcgtttatgtattcgacgaagaagcgtcgaagctgacggatatggacttcctggctcaaggaacgctttatacggatatcatcgaaagcggaacagatacggcccaaacgattaaatcacaccacaacgttggtggattgccagaagacatgcagttcaagttgatcgaaccgatcaacacgctgttcaaggacgaagtccgcgaactcggaaaagaactcggtttgtcggacgaaatcgtctggcgtcagccgttcccgggaccaggtctcgggatccgtgtcctcggtgaaatcacagacgagaaacttgaaatcgtccgcgaatccgatttcatcctccgtgatgaaatcaaaaaagccggtcttgaacgcgaaatctggcagtacttcacagtcttgccgccacttcgttcagttggtgtcatgggtgacgagcggacatacgactatgccgtcggaatccgtgccgttacatcaatcgacgggatgacatcggactgggcacgcatcccgtgggacgtgctcgagaagatttctgtccggatcgtcaacgaagttcagaacgtcaaccgcgtcctgtacgatgtgacgtcgaaaccaccttcaacgattgagtgggaataa

SEQ ID NO: 78854 - protein, 514 aa, Exiguobacterium sp. 255-15
MEAHLDQEMILVLDFGGQYNQLITRRIRDLGVYSELHSHKITAAEVKDIAPAGIIFSGGPRSVYAEDAYRCDPEIFDLGIPIFGICYGMQLMSQHFGGTVERAGHREYGKATLTLNDPSPMYANLPLEQTVWMSHSDLVTSVPNGFVVDGTNVSCPIASIKNEELKMYGVQYHPEVNHTMFGKELLKNFLFEVCQCTGDWSMENFIEIEIAKIKEEVGDKKVLCALSGGVDSSVVAALIHAAIGDQLTCMFVDHGLLRKGEAESVMKTFADHFHMNVIKIDAQDRFLNKLKGISDPEQKRKIIGNEFVYVFDEEASKLTDMDFLAQGTLYTDIIESGTDTAQTIKSHHNVGGLPEDMQFKLIEPINTLFKDEVRELGKELGLSDEIVWRQPFPGPGLGIRVLGEITDEKLEIVRESDFILRDEIKKAGLEREIWQYFTVLPPLRSVGVMGDERTYDYAVGIRAVTSIDGMTSDWARIPWDVLEKISVRIVNEVQNVNRVLYDVTSKPPSTIEWE

SEQ ID NO: 78855 - DNA, 1521 bp, Rubrobacter xylanophilus DSM 9941
  CDS (1)..(1521)
ttgatcgtcgtactggacttcggggggcagtacgcccagctcatcgcccggcgcgtccgggaggcgcgggtcttcagcgagctgctgccctacgacaccccgctggaggagatccggcgccgcgacccggaggggatcatcctctccggcggcccgaacagcgtctacgagaggggggccccgcgggtggacgcggccctcttcgacctcggggtgccggtgctcggcatctgctacgggatgcagctcatggccctgacgctcggcggggaggtgggggcggtccagatccgggagtacggccgctcgaagctcgaggtccggggacacggagagctgttctccggcacccccgacgagcagaccgtctggacgagccacggcgacgcggtgctggccgcgccgccgggcttccgggtgaccgcgcggacgccctccgtcccgatactcgcctttgaggagccctccagggggctctacggggtgcagttccaccccgaggtgcgccacaccgagtacgggatggagatcctgaagaacttcctcttcgaggcctgcggctgcgcgccggactggaccccggtgaacatcgtcaccgaggcggtggagcgcgtccgggagcaggtgggggcgtcccgggctatctgcgccctctccggcggggtggactcggccaccgccgccatgctcgtgcaccgcgccatcggggacaagctgacctgcgtcttcgtggaccacggcctcttgcggcagaacgaggccgagcaggtggtggaggccttccggcgggaggccgggctgccgctcgtccacgtggacgcgagggagcgctttctggaccggctggcgggggtgaccgacccggaggccaagcgcaagatcgtcggcgaggagttcatccgggtcttcgaggaggaggccgggaagatacgggacgcccgctttctcgtgcaggggacgctctactccgacgtgatcgagagcggcacccgcgacgcggccaggataaagagccaccacaacgtcgggggcctgccggaggtgatggacctcgagctcgtcgagcccctgcgcaacctcttcaaggacgaggtgcgggtggtcgccgccgagctcgggatgcccgagcgcctcgtctggcgccagccgttccccggtccggggctcgccatccggataataggggaggtcaccgccgagcggctcgagatcctgcgcaaggccgacgcggtgctgcaggacgagatccgctcggcgggctactaccgcaggctctggcagagcttcgccgttttgcccgcggtgcactcggtgggggtcatgggcgacgcccgcacctacgcctaccccatcgtgatccgggccgtcacctccgacgacgcgatgaccgccgactgggctcgcctcccgtacgacctcctggagcggatctcgaaccgcatcatcaacgaggtccccggcgtgaaccgggtggcgctcgacatcaccagcaagccgcccggcacgatcgagtgggagtga

SEQ ID NO: 78856 - protein, 506 aa, Rubrobacter xylanophilus DSM 9941
MIVVLDFGGQYAQLIARRVREARVFSELLPYDTPLEEIRRRDPEGIILSGGPNSVYERGAPRVDAALFDLGVPVLGICYGMQLMALTLGGEVGAVQIREYGRSKLEVRGHGELFSGTPDEQTVWTSHGDAVLAAPPGFRVTARTPSVPILAFEEPSRGLYGVQFHPEVRHTEYGMEILKNFLFEACGCAPDWTPVNIVTEAVERVREQVGASRAICALSGGVDSATAAMLVHRAIGDKLTCVFVDHGLLRQNEAEQVVEAFRREAGLPLVHVDARERFLDRLAGVTDPEAKRKIVGEEFIRVFEEEAGKIRDARFLVQGTLYSDVIESGTRDAARIKSHHNVGGLPEVMDLELVEPLRNLFKDEVRVVAAELGMPERLVWRQPFPGPGLAIRIIGEVTAERLEILRKADAVLQDEIRSAGYYRRLWQSFAVLPAVHSVGVMGDARTYAYPIVIRAVTSDDAMTADWARLPYDLLERISNRIINEVPGVNRVALDITSKPPGTIEWE

SEQ ID NO: 78857 - DNA, 1560 bp, Mesorhizobium sp. BNC1
  CDS (1)..(1560)
atgaccattacccatcccgacactgttctgatcatcgatttcggcagccaggtcacgcagctgatcgcccggcgcgtccgcgaggccggcgtctattccgaaattgctccctttcagtcagccgaagaggcttatctgcggctcaagccgaaggcggtcatcctttccggcagcccggcctcgaccgtcgagatcgacagtcctcgtgcgcccgatgtgattttccagtcaggcgtgccggttctcggtatctgctatggcgagcagaccatgtgcgcccagctcggcggcaaggtcgaatccagtgatcatcgcgagttcggccgcgccttcctcgagatcgaggaggattgcgggctgttcgccggcatctgggcgcccggcacgcgccatcaggtctggatgagccatggcgaccgcgtgacggcgcttccgcccggctttaaggttgtcggaacttcagcgggcgcgccttttgcggccatcgccgacgataagcgcaaatattacggtgtgcagttccatccggaagtggtccacacacccgatggcgcaaagctgcttgccaacttcgttcacaggatcgcgggccttaagggcgattggaccatggccgcttatcgcgaacaggcggtggatgcgatccgcgcccaggttggttccggcaaggtgatctgtgcgctctccggcggcgtcgattcctccgtcgccgcgcttctcacccatgaggcggtgggagagcagctcacctgcatccttgtcgaccatggcctgatgcgcaagaacgaggcggcggaagtggtctccatgttccgcgagcactataatgtgccgctcgtgctggtcgatgcttccgaccgtttcctaagcgcgctcgagggtgaaaccgatcccgagaagaagcgcaaaacgatcggccgtctcttcattgaggtgttcgaggacgaggcaaaaaagctgggtggcgctgattttttggtgcagggcacgctctatccggacgtgatcgagagtgtctccttcacgggcggcccctcggtcaccatcaaatcgcaccacaatgtgggcggcctgcccgagcgcatgaacatgaagctggtcgagccgctgcgcgagctcttcaaggacgaggtgcgggtgctcggcaggaagctcggcctgcccgaccatttcatcggccgtcatcccttcccgggccccggccttgccatccgctgtcccggcgggatcacgcgcgagaagctcgaaatcctgcgcgcggccgacgccatttacctcgacgagatccgcaagtcgggcctttacgacgcgatctggcaagccttcgccgtgcttttgccggtacagaccgtcggggtgatgggagacggccgcacctatgaatatgtctgcgcgcttcgcgcggtgacgtcagtcgatggcatgacggctgatttctatcacttcgacatggagttccttggccgcgccgccacccgcatcatcaacgaagtgcgcgggatcaatcgcgtggtctacgatgtgacgtccaagccacctgggactatcgagtgggagtaa

SEQ ID NO: 78858 - protein, 519 aa, Mesorhizobium sp. BNC1
MTITHPDTVLIIDFGSQVTQLIARRVREAGVYSEIAPFQSAEEAYLRLKPKAVILSGSPASTVEIDSPRAPDVIFQSGVPVLGICYGEQTMCAQLGGKVESSDHREFGRAFLEIEEDCGLFAGIWAPGTRHQVWMSHGDRVTALPPGFKVVGTSAGAPFAAIADDKRKYYGVQFHPEVVHTPDGAKLLANFVHRIAGLKGDWTMAAYREQAVDAIRAQVGSGKVICALSGGVDSSVAALLTHEAVGEQLTCILVDHGLMRKNEAAEVVSMFREHYNVPLVLVDASDRFLSALEGETDPEKKRKTIGRLFIEVFEDEAKKLGGADFLVQGTLYPDVIESVSFTGGPSVTIKSHHNVGGLPERMNMKLVEPLRELFKDEVRVLGRKLGLPDHFIGRHPFPGPGLAIRCPGGITREKLEILRAADAIYLDEIRKSGLYDAIWQAFAVLLPVQTVGVMGDGRTYEYVCALRAVTSVDGMTADFYHFDMEFLGRAATRIINEVRGINRVVYDVTSKPPGTIEWE

SEQ ID NO: 78859 - DNA, 1581 bp, Ehrlichia canis str. Jake
  CDS (1)..(1581)
atgtcaaaagtagcaattattgattttgggtcgcaatttacgcaattacttgctaggagaataagagaactaaatgtctattgtgaaatttttacacctgatgtggaatttgatcttgtaaaagacagtaaggcgtttattttatctggaggacctaaatcagttgctagtttagcggaaatacctaaaattgttcataatattattgagttaaataagaaatcttcaattccagtgttaggtatatgctatggattacagcttttaagtaattattttaattcagctattgtatctgattgtagtaaagaatttggtaaagctactttgaatattataaaagaatcagaaatcacaaaaaatgtttgggaagtaggtaaaagggttgatgtatggatgagccatgcagatagtgtatataatgttcctcgtggttttgaagttatagcatatagtgtgttgaagaatgtaattgcaatgatatgcaatgaagaaagaaaaatctacggcatgcagtttcatcctgaagtatatcacactactgatggtatagcattgcttagtaattttataaagatagcagggtgtaaaactgattggacaatgaattcctttttggatgagcaacaacgtgttataaaaaagcaagtaggagataaaaaggtaatagcagctattagtggtggggttgactctagtgttgctgctgctttgacttatcgagccataggggatcaattgcactgtatctttattgataatggtctgttacgttataatgaagcagaaaaaataagtcagttattagttaatcaatttcaaatgcctatcactattgttgataaatcatcagtgtttttgaataaacttaagtctattactgatccagaacaaaaacggaaaataataggaaaaacatttattgaagtatttgaaggagaggcaaataaaataggaggagtagaatttctaatgcagggaactatataccctgatgtcatagaatctggtggtgctgtgggaaaagaaagtgtaactatcaagtctcatcataatgttggtggattacctgatgttatgagactgcagcttgttgagcctctaaagttgctgtttaaagatgaagttagattattgggaaaggagcttggaatatcagatgaaatattgatgcgccatccatttccaggtcctggactagcaattagaataataggtgaagttactcaagaaaaaataaaaatgctacaagctgctgatgatatatatatcaatcttataaagaagtacaacttgtataatattatatggcaggcatttgcagtgatattacctgtgaaaacagtaggtgttatgggtgatagtaggacttatggttatacttgtgctttaagagctgttacttctagtgatggtatgactgcaggctgtttcccatttggtgtagatacagatactaagttaatcttttatgaatttttgcaggaagtaagtaatgcaatagtaaataatgttgatgggattaatagagtagtatatgacactacatctaaacctccagctacaattgaatgggaatag

SEQ ID NO: 78860 - protein, 526 aa, Ehrlichia canis str. Jake
MSKVAIIDFGSQFTQLLARRIRELNVYCEIFTPDVEFDLVKDSKAFILSGGPKSVASLAEIPKIVHNIIELNKKSSIPVLGICYGLQLLSNYFNSAIVSDCSKEFGKATLNIIKESEITKNVWEVGKRVDVWMSHADSVYNVPRGFEVIAYSVLKNVIAMICNEERKIYGMQFHPEVYHTTDGIALLSNFIKIAGCKTDWTMNSFLDEQQRVIKKQVGDKKVIAAISGGVDSSVAAALTYRAIGDQLHCIFIDNGLLRYNEAEKISQLLVNQFQMPITIVDKSSVFLNKLKSITDPEQKRKIIGKTFIEVFEGEANKIGGVEFLMQGTIYPDVIESGGAVGKESVTIKSHHNVGGLPDVMRLQLVEPLKLLFKDEVRLLGKELGISDEILMRHPFPGPGLAIRIIGEVTQEKIKMLQAADDIYINLIKKYNLYNIIWQAFAVILPVKTVGVMGDSRTYGYTCALRAVTSSDGMTAGCFPFGVDTDTKLIFYEFLQEVSNAIVNNVDGINRVVYDTTSKPPATIEWE

SEQ ID NO: 78861 - DNA, 1545 bp, Listeria monocytogenes str. 1/2a F6854
  CDS (1)..(1545): transl_table=11
atgaaagactttactgagcaagagaaaattatcgttctagattttggtagtcagtacaatcaactaattacgcgccgcattcgtgaattcggtgtgtatagtgaattacatccgcatactattacagttgaagaaatgaaagcactaaatccaacggggattattttttcaggaggacctaacagtgtgtatgacgaagatgctttccgcgctgacgaaagaatctttgacatgggaattccaattttaggaatttgttacggcatgcaattaatgacaacgcactttggtggcaaagtggaacgtgcgaaagaccgcgaatacgggaaagcggacattcacgtcgaaaaaccaagtcgtttatttgctggactaccaaccgatcaagttgtttggatgagtcacggcgatttagtcgttgaggagcctgctggttttgaagtaacagttactagtaaatcttgcccaattgcaggtattgcggacgaagaacgttccctttacggcgtgcaattccacccagaagtacgtcactcagttcacggaaacgaattactgaagaattttgcattaaacgtttgtggctgtaaaggcgactggacaatggagaactttagtgaagtagaaatcgctaaaatccaagaaatcgtaggcgacaaaaaagtcttgcttgcactttctggcggcgtagattcctctgttgttggtgtgttaattcataaagcaattggcgaccaactaacatgtattttcgttgatcacggccttcttcgtaaaggggaagctgatcaagtaatgacgacattacaaggcgaattcaacatgaacatcatcaaagtagatgcgaaaaaacgcttcatggacaaacttgctggcgtttctgacccagagcaaaaacgtaaaatcatcggtaacgaattcatttacgtattcgatgatgaagctaataaactagacggcgtagaattcctagcacaaggaacactttacacagacatcatcgaaagtggtacagcaactgcccaaacaatcaagtctcaccacaatgtcggcggcctaccagaagatatgcaatttaaactaatcgaacctttaaatacactgttcaaagatgaagttcgcgcactaggaacagaacttggcatgcctgacgcaatcgtttggcgccaaccattcccaggcccaggcttaggaatccgcgttcttggcgaaatcacggaagagaaattagagattgttcgtgattctgattacatcttgcgtgaagaaatcaaaaacgcaggtctagaacgcgaaatctggcaatactttactgctcttccaaatatccgtagcgttggtgttatgggtgatggtagaacgtatgaccatactgtggttgttcgtgcagtgacgagtattgatggtatgacagccgattgggcacgtattccgtgggatgtactggagaaaatttcggtacggattgtgaatgaagtggatcatgtgaatcgtgttgtttatgatattacgagtaagccaccagctacggttgagtgggaataa

SEQ ID NO: 78862 - protein, 514 aa, Listeria monocytogenes str. 1/2a F6854
MKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVEKPSRLFAGLPTDQVVWMSHGDLVVEEPAGFEVTVTSKSCPIAGIADEERSLYGVQFHPEVRHSVHGNELLKNFALNVCGCKGDWTMENFSEVEIAKIQEIVGDKKVLLALSGGVDSSVVGVLIHKAIGDQLTCIFVDHGLLRKGEADQVMTTLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 78863 - DNA, 1605 bp, Rubrivivax gelatinosus PM1
  CDS (1)..(1605)
atgcacgacaagatcctcatcctcgacttcggttcccaggtcacgcagctgatcgcaaggcgcgtccgcgaggcgcatgtgtactgcgagatccacccgaacgacgtgtcggacgagttcatccgcgagttcgcgccgaagggcatcatcctgtcgggcagccacgccagcacctacgaggaccacgacctgcgcgccccgcaggcggtgtgggagctgggcgtgccggtgctcggcatctgctacggcatgttcacgatggtggtccagcagggcggcgaggttgaggccagcgcgcaccgcgagttcggctacgccgaggtgagggcgcatggccacacccggctgctgcagggcatcgaggacttcagcacccctgagggccatggcatgctgaaggtgtggatgagccacggcgacaaggtcaccaagctgccgcccggctttaagctgatggccagcacgccgagctgcccgatcgccggcatggccgacgaatcgcgcggctactacgcggtgcagttccaccccgaggtcacgcacacggtgcaggggcgcgcgctgctggagcgcttcgtgctcgagatcgcgaaggcgcagcccgactgggtgatgaaggatcatgtcgccgaggcggtggcggcgatccgtgcgcaggtgggtgacgaggaggtgatcctcggcctgtcgggtggcgtggactccagcgtggcggcggcgctgatccaccgcgccatcggcgaccggctgacctgcgtgttcgtcgatcacggcctgctgcgcctgaacgaaggcgacatggtgatggagatgttcgccggcaagctgcacgcgaaggtggtccgcgtcgatgccgccgagctgttcatgaacgagctggccggcgtggccgaccccgaggccaagcgcaagatcatcggccggctgttcgtcgatgtcttcaaggccgaggcggccaagctcaaggcgagcggcgcggggcaccgcggcgcgacctttctggcgcagggcacgatctacccggacgtcatcgagtcgggcggtgccaagaccaagaaggccaccacgatcaagagccaccacaacgtcggcggcctgcccgagcagctcggcctgaagctgctcgagccgctgcgcgacctgttcaaggacgaggtgcgcgagctgggcgtggccctgggcctgccgcacgacatggtctaccgccatcccttcccgggccctggcctgggcgtgcgcatcctcggcgaggtgaagaaggactacgccgacctgctgcgccgcgccgacgcgatcttcatcgaggagctgcgcaacaccgtcgacccggcctccggcaagacctggtacgagctcaccagccaggccttcgcggtcttcctgccggtcaagagcgtgggcgtgatgggagacggtcgcacctacgactacgtggtcgcgctgcgcgcggtgcagaccagcgacttcatgaccgccgactgggccgaactgccctatgcgctgctcaagcgcacctcgggccgcatcatcaacgaggtgcgcggcatcaaccgcgtgacctacgacgtgagcagcaagccgccagcgacgatcgagtgggaatga

SEQ ID NO: 78864 - protein, 534 aa, Rubrivivax gelatinosus PM1
MHDKILILDFGSQVTQLIARRVREAHVYCEIHPNDVSDEFIREFAPKGIILSGSHASTYEDHDLRAPQAVWELGVPVLGICYGMFTMVVQQGGEVEASAHREFGYAEVRAHGHTRLLQGIEDFSTPEGHGMLKVWMSHGDKVTKLPPGFKLMASTPSCPIAGMADESRGYYAVQFHPEVTHTVQGRALLERFVLEIAKAQPDWVMKDHVAEAVAAIRAQVGDEEVILGLSGGVDSSVAAALIHRAIGDRLTCVFVDHGLLRLNEGDMVMEMFAGKLHAKVVRVDAAELFMNELAGVADPEAKRKIIGRLFVDVFKAEAAKLKASGAGHRGATFLAQGTIYPDVIESGGAKTKKATTIKSHHNVGGLPEQLGLKLLEPLRDLFKDEVRELGVALGLPHDMVYRHPFPGPGLGVRILGEVKKDYADLLRRADAIFIEELRNTVDPASGKTWYELTSQAFAVFLPVKSVGVMGDGRTYDYVVALRAVQTSDFMTADWAELPYALLKRTSGRIINEVRGINRVTYDVSSKPPATIEWE

SEQ ID NO: 78865 - DNA, 1578 bp, Pseudomonas fluorescens PfO-1
  CDS (1)..(1578)
atggccctcgacattcacgctcaccgcatcctgatcctcgacttcggttcgcaatacacccaactgatcgcccgccgcgtgcgcgagatcggtgtgtactgcgaactgcacccgttcgacatggacgaagatgcgatccgcgaatttgcgccaaaaggcgtgatcctcgccggcggtcccgagtccgtgcacgaagccaacagcccgcgctgcccgcaagcggttttcgacctgggcgtaccggtcttcggtatctgctacggcatgcagaccatggccgagcaactgggcggcaaggttgaaggctccgaactgcgtgagttcggttatgcccgcgttgacgtggtcggcaagagccgtctgctcgacggcatcgaagaccacatcgacgccgacggcctgttcggcctcgacgtgtggatgagccacggtgacaaggtcaccaagatgccaagcgatttccacattctggccagcaccccgagctgcccgatcgccggcatgttcaacgacgaacgcgcttactacggcgtacagttccacccggaagtgacccacaccaagcagggcggtcgcatcctgtcgcgtttcgttctcgacatctgcggctgtgaagccctgtggaccccgtcgaagatcgccgaagacgccatcgccaacattcgcgcgcaggtcggcactgacaacgtgctgctgggtctgtccggcggtgtggattcctcggtggttgcggcgctgctgcacaaggccatcggtgatcaactgacctgcgtcttcgtcgacaacggcctgctgcgcctgcacgaaggcgagcaggttatggccatgttcgccgaaaacatgggcgtcaaggtgatccgcgccaacgctgaagaccagttcctcaacaacctggccggcgaagccgatccggagaagaagcgcaagatcatcggccgcaccttcatcgacgtgttcgatgccgaatcctgcaagctggacaacatcaagtacctggctcagggcaccatctacccggacgtgatcgagtcggctggcgcgaaaagcggcaaggcccacgtgatcaagtcgcaccacaacgtgggcggcctgccggaagaaatgaacctgaaactggtcgagccactgcgcgaactgttcaaggacgaagtccgtcgtctgggtctggaactgggcctgccgtacgacatggtctaccgtcacccgttcccgggcccgggcctgggcgtacggatcctcggtgaagtgaagaaggaatacgccgacctgctgcgtcgcgccgaccacatcttcatcgaagaactgcgcaaggccgactggtaccacaaggtcagccaggcgtttgtcgtgttccagccggtgaaatcggtgggcgtggtcggcgatggccgccgttacgcctgggtcgtggccctgcgtgccgtggaaaccatcgacttcatgaccgcacgttgggcacacctgccttacgaactgctggaaaccgtttccggccgaatcatcaatgaaatcgaaggcatctcccgcgtgacttacgacgtgtcgagcaagccgccggcgacgattgagtgggagtga

SEQ ID NO: 78866 - protein, 525 aa, Pseudomonas fluorescens PfO-1
MALDIHAHRILILDFGSQYTQLIARRVREIGVYCELHPFDMDEDAIREFAPKGVILAGGPESVHEANSPRCPQAVFDLGVPVFGICYGMQTMAEQLGGKVEGSELREFGYARVDVVGKSRLLDGIEDHIDADGLFGLDVWMSHGDKVTKMPSDFHILASTPSCPIAGMFNDERAYYGVQFHPEVTHTKQGGRILSRFVLDICGCEALWTPSKIAEDAIANIRAQVGTDNVLLGLSGGVDSSVVAALLHKAIGDQLTCVFVDNGLLRLHEGEQVMAMFAENMGVKVIRANAEDQFLNNLAGEADPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 78867 - DNA, 1578 bp, Rhodospirillum rubrum
  CDS (1)..(1578)
atgaccgaccgcacttccgtttccgccaccgaccgcatcctgattatcgatttcggctcgcaggtcacccagttgatcgcccggcgggttcgcgaaagcggcgtctatagcgagatccagcccttcaatacggtgacggcggcgtcgatcgcggctttcgcgcccaagggcgtgatcttgtcgggcggaccggcctcggtgacggcggccgatacgccgcgcgcgccgatcgagctgttcaccatgggtctgccggttctggggatctgctatggccagcagaccatggtcgcccaattgggcggccgggtggaggcccccgatcaccgcgagttcggccgcgccttcgtcgaggtcaccgccggctgcgcgctgtttgacggcgtgtggacgccgggcgagcgtgatcaggtgtggatgagccacggcgaccgcgttgacgccatccccgaagggttttcggtggtggcggtcagcgagggcgcgccctatgccgccatcgccgatgaggcccgccatttctatggcgtgcagttccaccccgaggtggttcacacccccaagggcgcggcgctgttgcgcaatttcacccatggcatctgcggctgtggcggcgattggacgatggccgccttcaaggatcaggcgatcgcccgggtgcgcgagcaggtggggagcggccgggtgatctgcgggttgtcgggcggcgtcgacagctcggtggtggcggcgctgatccacgaggcgatcggcgagcagctggtctgcgtgctggtcgatcacggcatgatgcgccagggcgagaccgagcaggtggtgcgcgttttccgcgaccgcttcaacatcaccctggttcatcgcgacgccagcgagttgttcctgggcaagcttgacggcgtggtcgaccccgaggccaagcgcaagatcatcggcgccaccttcattgatgtcttcgacgaggaggcgcgcaaggtgggcggcgccgatttcctggcccagggcacgctctatcccgatgtgatcgaaagcgtgtcgttcaccggcggcccgagcgtgacgatcaaaagccaccataatgtcggcggcctgcccgagcgcatgaagatggcgctggtcgaacccctgcgcgagctgttcaaggacgaggtgcgcgatctggggcgcgaattgggcctgcccgacgagatggtcggccgccaccccttccccggccccggcctggccatccgcattcccggccagccgctgacccgcgagaagcttgatatcctgcgccgggccgacgccatctatctggaagagatccgcaacgccgggctttacgacgtcatctggcaggccttcgccgtgctgctgccggtgcgcaccgttggggtgatgggcgacgcccgctcctatgacttcgccctggccctgcgcgccgtcacctcgaccgacggcatgaccgccgactactaccccttcgaccacaccttcctcggccgcgtcgccaaccgcatcatcaacgaggtcaaaggcgtcaaccgcgtggtctacgacatcaccagcaagccgcccgggacgatcgagtgggaatga

SEQ ID NO: 78868 - protein, 525 aa, Rhodospirillum rubrum
MTDRTSVSATDRILIIDFGSQVTQLIARRVRESGVYSEIQPFNTVTAASIAAFAPKGVILSGGPASVTAADTPRAPIELFTMGLPVLGICYGQQTMVAQLGGRVEAPDHREFGRAFVEVTAGCALFDGVWTPGERDQVWMSHGDRVDAIPEGFSVVAVSEGAPYAAIADEARHFYGVQFHPEVVHTPKGAALLRNFTHGICGCGGDWTMAAFKDQAIARVREQVGSGRVICGLSGGVDSSVVAALIHEAIGEQLVCVLVDHGMMRQGETEQVVRVFRDRFNITLVHRDASELFLGKLDGVVDPEAKRKIIGATFIDVFDEEARKVGGADFLAQGTLYPDVIESVSFTGGPSVTIKSHHNVGGLPERMKMALVEPLRELFKDEVRDLGRELGLPDEMVGRHPFPGPGLAIRIPGQPLTREKLDILRRADAIYLEEIRNAGLYDVIWQAFAVLLPVRTVGVMGDARSYDFALALRAVTSTDGMTADYYPFDHTFLGRVANRIINEVKGVNRVVYDITSKPPGTIEWE

SEQ ID NO: 78869 - DNA, 1620 bp, Ralstonia metallidurans CH34
  CDS (1)..(1620)
atgcacgacaaaatcctcattcttgacttcggctcgcaagtcacacagctcattgcccgccgcgttcgcgaagcgcacgtctactgcgaaatccatccgaacgacgtcaccgacgagtttgtgcgcgagttcgcgccgaagggcgtcatcctgtccggcagccacgccagcacctacgaggaccaccaactgcgcgcgccgcaggccgtgtgggacctgggcgtgccggtgctcggcatctgctacggcatgcagacgatggccgtgcaactgggcggcaaggtggagtggagcgattcgcgcgagtttggttacgcggaagtgcgcgcccatggccacacgaacctgctcaagggcatcgaggacttcgccacggacgaaggccacggcatgctgaaggtctggatgagccacggcgacaaggtcacggcactgccggccggcttcaagctgatggcctccacgccgagctgtccgatcgccggcatggccgacgaggcgcgcggttactatggcgtgcaattccacccggaagtcacgcatacgtcgaagggccgcgagatgatcgagcgcttcgtgctggagatctgcgccacgaaggccgactgggtcatgcgtgaccacatcgccgaagccgtcgagaagatccgcgaacaggtgggcgatgaagaggtgatcctcggcctgtccggtggtgtcgattcgtcggtggccgccgcgctgatccatcgcgccattggcgaccagctcacctgcgtgttcgtcgatcacggcctgctgcgcctggacgaaggcaagatggtgatggacatgttcgcaggccgcctgcacgccaaggttgtccatattgatgcctccgagcaattcctgggtcatctgaccggcgtgaccgaccccgagcagaagcgcaagatcattggccgcgagttcgtcgaggtcttccaggccgaagcaaagaagctgagcaacgccaagtggctggcgcagggcacgatctacccggacgtggtggagtcgggcggtaccaagaccaagaaggctacgacgatcaagagccaccacaatgtgggtggcctgccggaaacgctgggcctgaagttgctggagccgctgcgcgacctgttcaaggacgaagtgcgcgaactgggcgtggcattgggcctgccgcccgagatggtctaccgtcatccgttcccgggcccgggtctgggtgtgcggattctcggcgaggtcaagcgcgactatgctgacctgctgcgtcgcgccgatgcaatcttcatcgaggaactccgcaagacgatcgccacggagcaggacgccgctgccggtctgtgcgaagcgaatcaggtgggcaagagctggtacgacctgaccagccaggcatttgccgtgttcctgccggtgaagtccgtaggcgtgatgggcgatggccgtacgtacgactatgtcgtcgcgctgcgcgcggtgcagaccaccgacttcatgaccgcccactgggcgcacctgccgtactcgctgctgggccgctgctcgaaccgcatcatcaacgaggttcgcgggctgaaccgcgtggtgtacgacgtctcgggcaagccgcctgcgacgatcgagtgggagtga

SEQ ID NO: 78870 - protein, 539 aa, Ralstonia metallidurans CH34
MHDKILILDFGSQVTQLIARRVREAHVYCEIHPNDVTDEFVREFAPKGVILSGSHASTYEDHQLRAPQAVWDLGVPVLGICYGMQTMAVQLGGKVEWSDSREFGYAEVRAHGHTNLLKGIEDFATDEGHGMLKVWMSHGDKVTALPAGFKLMASTPSCPIAGMADEARGYYGVQFHPEVTHTSKGREMIERFVLEICATKADWVMRDHIAEAVEKIREQVGDEEVILGLSGGVDSSVAAALIHRAIGDQLTCVFVDHGLLRLDEGKMVMDMFAGRLHAKVVHIDASEQFLGHLTGVTDPEQKRKIIGREFVEVFQAEAKKLSNAKWLAQGTIYPDVVESGGTKTKKATTIKSHHNVGGLPETLGLKLLEPLRDLFKDEVRELGVALGLPPEMVYRHPFPGPGLGVRILGEVKRDYADLLRRADAIFIEELRKTIATEQDAAAGLCEANQVGKSWYDLTSQAFAVFLPVKSVGVMGDGRTYDYVVALRAVQTTDFMTAHWAHLPYSLLGRCSNRIINEVRGLNRVVYDVSGKPPATIEWE

SEQ ID NO: 78871 - DNA, 1584 bp, Burkholderia fungorum LB400
  CDS (1)..(1584)
atgcacgacaagattctgatcctcgacttcggttcgcaagtcacccaactgattgcacgtcgcgttcgcgaagccaacgtgtattcggaaattcatccgtacgacgtcgatgcgtcgttcattcgcgacttcgcgccgaagggcgtgatcctttccggcggcccgagctcggtcactgaaacggacacgccgcgcgtgccgcaggccgtgttcgaactcggcgtgccggtgctcggcatctgctacggcatgcaggcgatggccgagcagctgggcggcaaggtcgatatcggccacctgcgcgagttcggttatgccgaggtgcgcgcgcgcaaccacacgagcctgctcgaaggcatcagcgacttcaccacgccggaaggccacggcatgttgaaggtgtggatgagccacggcgacaaggtgctggaaatgccgccgggcttcgcgctgatggcgtcgacggaatcgtgcccgatcgccgcgatggccgacgaaacgcgccatttctacggcctgcaatggcacccggaagtcacgcacaccgtgcagggccgcgccatgctcgaacgcttcgtgctgaagatctgcggcgcgcagccggattgggaaatgggccactatatcgacgaagccgtcgcgaagatccgcgagcaggtcggtcaggaacatgtgatcctgggactctcgggcggcgtggattcgtcggtggcggcggcgctgctgcatcgcgcgattggcgatcagctgacctgcgtgttcgtcgatcatggcctgttgcgcctgaacgaagccgagcaggtaatggcgaccttcgcggatcacctgggcgtgaaggtgattcacgtcgacgcgagcgaggtgttcctgcgcaagctggccggtgtgaccgatccggaagcgaagcgcaagatcatcggcgcggaattcgtcgaggtgttccagaccgaagccggcaagctgaccgatgcgaagtggctggcgcaaggcacgatctatccggacgtgatcgaatcggccggcaagggcaagaaagccacgcagacgatcaagagccatcacaacgtgggcggcctgccagagacgctgaacctgaagctgctcgagccgctgcgcgaactgttcaaggacgaagtgcgcgaactcggcgtcaagctcggtttgccgccggccatggtgtaccgccatccgttcccgggcccgggtctgggcgtgcggattctcggcgaagtgaagcgcgatttcgcggacctgctgcgccgcgcggacgcgattttcatcgagacgttgcggactttcatcgacaaggaaaccggcaagtcctggtacgatctgacgagccaggcgttcgcggtgtttctgccggtgaagagcgtgggcgtgatgggtgacgggcggacttatgagtatgttgtcgcgctgcgcgccgtgcagacgctggacttcatgaccgcgcattgggcgcatctgccgcatgagttgctggggcatgtgtcgaaccggattattaatgaagtgcgcgggattaaccgggtggtgtatgacatttcggggaagccgccggcgacaatcgagtgggaatga

SEQ ID NO: 78872 - protein, 527 aa, Burkholderia fungorum LB400
MHDKILILDFGSQVTQLIARRVREANVYSEIHPYDVDASFIRDFAPKGVILSGGPSSVTETDTPRVPQAVFELGVPVLGICYGMQAMAEQLGGKVDIGHLREFGYAEVRARNHTSLLEGISDFTTPEGHGMLKVWMSHGDKVLEMPPGFALMASTESCPIAAMADETRHFYGLQWHPEVTHTVQGRAMLERFVLKICGAQPDWEMGHYIDEAVAKIREQVGQEHVILGLSGGVDSSVAAALLHRAIGDQLTCVFVDHGLLRLNEAEQVMATFADHLGVKVIHVDASEVFLRKLAGVTDPEAKRKIIGAEFVEVFQTEAGKLTDAKWLAQGTIYPDVIESAGKGKKATQTIKSHHNVGGLPETLNLKLLEPLRELFKDEVRELGVKLGLPPAMVYRHPFPGPGLGVRILGEVKRDFADLLRRADAIFIETLRTFIDKETGKSWYDLTSQAFAVFLPVKSVGVMGDGRTYEYVVALRAVQTLDFMTAHWAHLPHELLGHVSNRIINEVRGINRVVYDISGKPPATIEWE

SEQ ID NO: 78873 - DNA, 1614 bp, Enterococcus faecium
  CDS (1)..(1614)
atgcggcgcacagaacgcgccgcatatcggactaagttttattcaaatttgtcttcaccaacacgatttgacgaagagccaaaaattatcgtacttgattacggtagtcagtataaccaactgatcactcgccgtattcgtgagttcggtgttttctcagagttgatgagccaccgcattaccgcagaagaagtaaaggcaatgaaccctaaaggaatcatcctttctggcggaccaaacagtgtttatgatgagaaggcctttggtattgatgaaaagatttttgatttggggatcccagttttaggaatctgttacggtatgcagttgattacttataaattaggcggaaaagttaaaccagccaaaaaccgtgaatacggaaaagcagaattggaaatcacttctgcagaagcggcccttttccaaaacactcctgaaaaacaaaccgtttggatgagtcatggtgacctagttacccaagcaccgactgatttcgatgtcgttgctaccagcaaagattgccccatcgcatcgatccaaaatgcagaacgcaaaatgtacggaatccaattccatgcagaagttcgccattccgaatatggaaatgacttgttgcgccattttacactagatgtctgccaatgtactggtgactggacaatggataacttcatcgacatggagatcgcaaaaattcgtgaacaagtcggtgacaaaaaagttttattaggcctttcaggcggagtagattcctctgttgttggtgttcttttacaaaaagcgatcggcgatcaattaacatgtatcttcgttgatcacgtattgttgcgtaaaggtgaagcagaacaagttatggaaagtcttggcggaaaatttggcttgaacattataaaagtcgatgccaaagaacgtttcttatcaaaacttgctggcgtgtctgatccagaagaaaaacgtaaaatcattggaaatgaatttgtatatgtcttcgatgatgaagcaaccaaacttgccggtgaagaaggcgtttctttccttgcacaaggaaccctttataccgatgtgatcgaatcaggaactgaaactgcccaaaccatcaaatcacatcacaatgtaggtggattacctgaagacatgcaattcaagctgatcgagccattgaacacattgttcaaagacgaagtacgtgaattaggtacccaattaggcatgcctgacagcatcgtttggcgccaaccattccctggaccaggcttaggtattcgtgtccttggtgaattgacagaagaaaaattagaaatcgtccgtgaatcagacgctatcttgcgcgaagaaatcgccaatgccggtttagatcgcgacatctggcaatacttcaccgtcctaccaggcattcgctctgttggggttatgggagatggccgtacgtatgactacactgtaggtatccgtgctgtcacttctattgacggcatgaccgctgactttgcccgtatcccttgggaagtcttgcaaaaaatcagtgtccgtatcgtaaatgaagtcgcacacgttaaccgtatcgtgtatgatattaccagcaaaccacctgcaacagtggagtgggaataa

SEQ ID NO: 78874 - protein, 537 aa, Enterococcus faecium
MRRTERAAYRTKFYSNLSSPTRFDEEPKIIVLDYGSQYNQLITRRIREFGVFSELMSHRITAEEVKAMNPKGIILSGGPNSVYDEKAFGIDEKIFDLGIPVLGICYGMQLITYKLGGKVKPAKNREYGKAELEITSAEAALFQNTPEKQTVWMSHGDLVTQAPTDFDVVATSKDCPIASIQNAERKMYGIQFHAEVRHSEYGNDLLRHFTLDVCQCTGDWTMDNFIDMEIAKIREQVGDKKVLLGLSGGVDSSVVGVLLQKAIGDQLTCIFVDHVLLRKGEAEQVMESLGGKFGLNIIKVDAKERFLSKLAGVSDPEEKRKIIGNEFVYVFDDEATKLAGEEGVSFLAQGTLYTDVIESGTETAQTIKSHHNVGGLPEDMQFKLIEPLNTLFKDEVRELGTQLGMPDSIVWRQPFPGPGLGIRVLGELTEEKLEIVRESDAILREEIANAGLDRDIWQYFTVLPGIRSVGVMGDGRTYDYTVGIRAVTSIDGMTADFARIPWEVLQKISVRIVNEVAHVNRIVYDITSKPPATVEWE

SEQ ID NO: 78875 - DNA, 1569 bp, Magnetococcus sp. MC-1
  CDS (1)..(1569)
atgtcagacgcgctgcattcggaaaagatccttattctggattacggttctcagtatacccagcttattgcgcggcgggtgcgggagacccaggtctattgtgaaatccatggtcatgagatggcagcggaggccgttagagcctttaatccgcagggggttatcctctctggtgggcatcaatcggtctatgatgttggtgccgctgagctgaatgatgcggtgatggctttgggtgtgccggtattgggcatttgttatggcatgcagttgttggggcgtcattttggcggcactgtggcccccagcgataagcgcgagtatggtcgtgcggaaattcaggcgtgtgcggggcaggttggagcattgtttgaggggtttgttgaagccggcgccaaaagcaccgtgtggatgagccacggcgaccatgttgagatgctgcccaaggggtttgtgaccaccgcatcgaccctgaatgccccccttgcggccatggcgaatgaggcgacccatatgtatggggtgcagtttcatcccgaggtcaaccataccgataatggtgagcgtttgatccataattttgtgcgcaccatttgtgggtgtcacggtttgtggacatcggatgggtttattgagtatgaggtggagcgggttcgggccttggtgggggatgacaaggttattttgggtctatcgggtggggtagatagctcggtggtggcggcgctgctgcaccgggccattggcgagcagctgacctgtgtgtttgtggataatggcctgttgcgcttgaatgagggggatcaggtgatggagacctttgcccaaaatatgggggtaaaggtgatccgtgtggatgctgaggcgcgttttttgggcaagttggcgggggtgtctgatccagagaagaagcgcaagatcattggtcacacttttattgagatctttgatgaggaggcgggcaagatcgagaatgccaaatggctggcgcagggcacgatctatccggatgtggtggagtcggcgggtaccaaaaccggcaaggcgaccaatattaagtctcatcacaatgtagggggcttgccggaggatatgcagctcaagctgttggagccgctgcgggagctgtttaaggatgaggtgcgtaaggttggcttggagttgggtttgccgcatcgcatggtgtttcgtcatccctttccgggtcctggtttaggggtacggattttgggtgaggttaaaaaggagtatgcggatctgttacgccgggcggatgccatttatatggatgagctctatgcatcgggccactatgagcgtatttctcaggcgtttacagtgtttttgccggtgaagagtgttggggtgatgggggatggtcgcacctatgattatgtggtggctttgcgtgcggtggagaccaaggattttatgaccgccacttggtaccctatgccccatgatctgctgagccacattgccaaccgcatcatcaacgagattgacggcattaaccgcgtcacctacgacattaccagcaagccccccggcaccattgagtgggagtag

SEQ ID NO: 78876 - protein, 522 aa, Magnetococcus sp. MC-1
MSDALHSEKILILDYGSQYTQLIARRVRETQVYCEIHGHEMAAEAVRAFNPQGVILSGGHQSVYDVGAAELNDAVMALGVPVLGICYGMQLLGRHFGGTVAPSDKREYGRAEIQACAGQVGALFEGFVEAGAKSTVWMSHGDHVEMLPKGFVTTASTLNAPLAAMANEATHMYGVQFHPEVNHTDNGERLIHNFVRTICGCHGLWTSDGFIEYEVERVRALVGDDKVILGLSGGVDSSVVAALLHRAIGEQLTCVFVDNGLLRLNEGDQVMETFAQNMGVKVIRVDAEARFLGKLAGVSDPEKKRKIIGHTFIEIFDEEAGKIENAKWLAQGTIYPDVVESAGTKTGKATNIKSHHNVGGLPEDMQLKLLEPLRELFKDEVRKVGLELGLPHRMVFRHPFPGPGLGVRILGEVKKEYADLLRRADAIYMDELYASGHYERISQAFTVFLPVKSVGVMGDGRTYDYVVALRAVETKDFMTATWYPMPHDLLSHIANRIINEIDGINRVTYDITSKPPGTIEWE

SEQ ID NO: 78877 - DNA, 1587 bp, Thermobifida fusca
  CDS (1)..(1587)
atgtccgttgccggtgctcccgagagcacgttcgacaccgttctcgtcgtggacttcggcgcgcaatacgcgcagttgatcgcgcgtcgggtacgcgaatgccacgtctacagcgagatcgtgcctccgaccatgccggtcgaggagatgctcgccaaaaaacccaaggccatcatcctgtcgggtggcccctcctcggtgtacgccgacggagccccgcaagctccccccggcctgttcgacaccggggtgcccatcttggggatctgctacggcttccaggtcatggcgcagaccctcggcggcaccgtcgaacggacgggacgctccgaatacgggcgcaccacgatcaacgtcgccaccgacagcctgctgttccacagcctgcctcagcagcagaccgtgtggatgtcgcacggcgacgccgtgtcccaggtccccgacgggttcaccgtcaccgggcagaccgcggacgccccggtggccgcgatggagcaccgcgaccgggccctctacggggtccagttccaccccgaagtggtccacaccgagcacggccgggccgtgctgcagcacttcctctacgaggccgcgggctgccgccccacctggacgatggtcaacatcgtcgaagaccaggtggcgcgcatccgcgcccagatcggcagcaagcgggcgatctgcgggctgagcggcggagtggactccgcggtagcggccgccctcgtgcagcgcgctatcggcgaccgtctgacctgtgtcttcgttgaccacgggctgttgcgccaaggggaagcggagcaggtcgaaaaagacttcgtcgccgctacgggagccagcctcaaagtcgtcgacgcccaagagcggttcctcaccgctctggccggggtcaccgacccggaaaccaaacgcaagatcatcggacgcgagttcatccgcgtcttcgaacaggcagcccgcgagatcgtcgctgaagccggggaaggcgacgaagccgtcgaattcctcgtccaaggcacgctctacccggacgtggtggagtccgggggcggcaacgggaccgccaacatcaaatcgcaccacaacgtcggcggactccccgacgacctgcagttcaccctggtcgaaccgctccgggagctgttcaaggacgaagtccgcagagtcggcgaagaactcggcctccccgcagaaatggtgtggcggcaccccttccccggcccgggcctggccatccgcatcgtgggcgaggtcaccgcggagcggctggagatcctgcgggcagccgacgccattgtccgcgaagagctgacccgagccggactggaccgcgccatctggcagtgcccggtggtgctgctggcagacgtgcgctccgtgggggtgcaaggcgacggccggacctacggccacccgatcgtgctgcgcccggtcaccagcgaagacgccatgactgccgactgggcccgggtcccctacgacgtcctcgccacgatctccaaccgcatcaccaacgaggtccccgacatcaaccgggtcaccctcgacatcaccagcaagccgcccggcacgatcgaatgggagtga

SEQ ID NO: 78878 - protein, 528 aa, Thermobifida fusca
MSVAGAPESTFDTVLVVDFGAQYAQLIARRVRECHVYSEIVPPTMPVEEMLAKKPKAIILSGGPSSVYADGAPQAPPGLFDTGVPILGICYGFQVMAQTLGGTVERTGRSEYGRTTINVATDSLLFHSLPQQQTVWMSHGDAVSQVPDGFTVTGQTADAPVAAMEHRDRALYGVQFHPEVVHTEHGRAVLQHFLYEAAGCRPTWTMVNIVEDQVARIRAQIGSKRAICGLSGGVDSAVAAALVQRAIGDRLTCVFVDHGLLRQGEAEQVEKDFVAATGASLKVVDAQERFLTALAGVTDPETKRKIIGREFIRVFEQAAREIVAEAGEGDEAVEFLVQGTLYPDVVESGGGNGTANIKSHHNVGGLPDDLQFTLVEPLRELFKDEVRRVGEELGLPAEMVWRHPFPGPGLAIRIVGEVTAERLEILRAADAIVREELTRAGLDRAIWQCPVVLLADVRSVGVQGDGRTYGHPIVLRPVTSEDAMTADWARVPYDVLATISNRITNEVPDINRVTLDITSKPPGTIEWE

SEQ ID NO: 78879 - DNA, 1563 bp, Geobacter metallireducens GS-15
  CDS (1)..(1563)
atgagcagtgatatccacagcgagaaaatcctgatcctggacttcggttcacagtacacccaactcatcgcccggcgagtgcgggaggcccacgtctactgcgaactccatcccttcgatatggacctggcggcgatccgcgcctttgccccgcgggggatcatcctctccggcggccccaagtcggtgtatgaggaaggggccccggcggtggaggaggctcttttcgagctgggagtgccggtccttggcatctgctacggcatgcagctcatgagccgccactttggcggccaggtggtgccggccgggaaacgggagttcggccacgctgacctcctggctgtggggactcccggccccctcttcgatggctttttcgtggaagggaaaagcccggtctggatgagccatggcgaccatgtgtctctggttcccgcagggtttcaggtggtgggggagacggccaacgcgccggtctgcgccatccaggatcttgcccgcaatctctatggtgtccagtttcacccggaagttaaccatacccctcggggggaactcctcatcgatacctttgtccggaagatctgcggttgcagtggccagtggacgccgggacacattatcgatgatgccgtcagccgtatccgcgcccaggtggggaatgaccgggtgatcctcggcctttcgggcggagtcgactcgtcggtggccgcagccctgatccatcgcgccatcggcgaccagctcacctgtgttttcgtggacaacggcctgttgcgcctcagcgagggggaccaggtgatggccacctttgccgagaatctcggagtcaaggtgatacgggtggacgccgaggatcgctttctcacggccctggccggcgagagcgacccggagaaaaaacgcaagatcatcggcaaactcttcgtggatatcttcgaggaagagtcgaataagatcaccgacgcccgctggcttgcccaagggaccatctaccccgacgtcatcgagagcgccggagccaagaccggcaaggcccacaacatcaagagccaccacaacgtggggggactccccgactacatgaagctgaagctcctggagcccctgcgggagctcttcaaggatgaggtccgggccatcggcgaggagctggggcttccccatcagatggtatggcgccatcccttcccggggccggggcttggggtcaggatccttggcgaggtgaagaaggagtacgccgacatcctccgccgggccgacgccatctacatcgaggagctttacgctgccggccactacgacaagatcagtcaggctttcgccgtcttcctgccggttaagagcgtcggggtcatgggtgacggtcgcacctacgagtacgtggtggcgctgcgggccgtggagaccaaggacttcatgaccgcagggtggtatccgcttccctacgaggacatggcccgcatatcgagcaggatcatcaacgaggtgaagggggtcaatcgggtggtgtacgacatctccagcaagcctcccgctaccatagagtgggaatag

SEQ ID NO: 78880 - protein, 520 aa, Geobacter metallireducens GS-15
MSSDIHSEKILILDFGSQYTQLIARRVREAHVYCELHPFDMDLAAIRAFAPRGIILSGGPKSVYEEGAPAVEEALFELGVPVLGICYGMQLMSRHFGGQVVPAGKREFGHADLLAVGTPGPLFDGFFVEGKSPVWMSHGDHVSLVPAGFQVVGETANAPVCAIQDLARNLYGVQFHPEVNHTPRGELLIDTFVRKICGCSGQWTPGHIIDDAVSRIRAQVGNDRVILGLSGGVDSSVAAALIHRAIGDQLTCVFVDNGLLRLSEGDQVMATFAENLGVKVIRVDAEDRFLTALAGESDPEKKRKIIGKLFVDIFEEESNKITDARWLAQGTIYPDVIESAGAKTGKAHNIKSHHNVGGLPDYMKLKLLEPLRELFKDEVRAIGEELGLPHQMVWRHPFPGPGLGVRILGEVKKEYADILRRADAIYIEELYAAGHYDKISQAFAVFLPVKSVGVMGDGRTYEYVVALRAVETKDFMTAGWYPLPYEDMARISSRIINEVKGVNRVVYDISSKPPATIEWE

SEQ ID NO: 78881 - DNA, 1560 bp, Novosphingobium aromaticivorans DSM 12444
  CDS (1)..(1560)
atgagcatccagccttcagaatcgatcctgatcgtcgacttcggcagccaggttacccagctaatcgcccgccgcgtgcgcgaggccggggtctattccgagatcgcgcccttcagccaggccgaggcggcgttccaccggatgaagccgaagggcatcatcctgtcgggatcgcccgccagcgtgcccgccgatggcagcccgcgcgcacctcaggtgctgttcgacagcggcctgccgatccttggcatctgctatggccagcaggtgatgagcgagcagcttggcggcaaggtcgagcctggcgattcgggcgaattcggccgcgccttcctgaccgtgacggaaccctgcgtactgttcgacggcctgtgggccgtgggcgaacgccaccaggtatggatgagtcacggcgacaaggtgacgcagttcgcaccgggcttccgcatcgtcgccgtgtccgacggcgcgccttttgcggtgatcgcgaacgatgagaagaagtactacggaacccagttccaccccgaagtggtgcacacgccggacggtggcaagctgatcgccaatttcgtgcgccatgtctgcggttgcgccggcgactggtcgatggccgagttccgccgcaccaagatcgccgagatccgcgagcaggtgggcgacagccgggtgatctgcggtctttcgggcggcgtcgattccgccgtggcggcagtgctgatccacgaggcgatcggcgaccagctcacctgcgtcttcgtcgaccacggcctgatgcgcatgggcgaggccgagcaggtcgtcagccttttccgcaaccattacaacatcccgctcgtccacaaggacgtgtcggccctgttccttggcggcctcgccggggttaccgaccccgaggccaagcgcaagttcatcggcaagaccttcatcgacgtgttcgaggccgaggccaggcaggtcggcggcgcggacttccttgcgcagggcacgctctatccggacgtgatcgaatcggtatcgttcaccggcgggccttcggtcacgatcaagagccaccacaacgtcggcggcctgcccgagcgcatgaacatgaagctggtcgagccgcttcgcgagctgttcaaggacgaagtccgcgcgctgggccgcgagcttggcctgcccgagatcttcgttggtcgccaccccttccccggcccgggccttgccatccgcatccccggcgaagtgacgaaggagcgctgcgacatcctgcgcaaggccgacgcgatctatctcgaggagatccgcaacgcgggcctttatgacgcgatctggcaggcctttgccgtgctgcttccggtcaagaccgtgggcgttatgggcgacgggcgcacttatgacagtgtctgcgcactgcgcgcggtgaccagcaccgacggcatgaccgccgacatctatccgttcgacgcaggcttcctgagccgcgtggcgacgcgcatcgtcaacgaggtcaagggcatcaaccgcgtggtctacgactacacctcgaagccgccgggcacgatcgagtgggagtaa

SEQ ID NO: 78882 - protein, 519 aa, Novosphingobium aromaticivorans DSM 12444
MSIQPSESILIVDFGSQVTQLIARRVREAGVYSEIAPFSQAEAAFHRMKPKGIILSGSPASVPADGSPRAPQVLFDSGLPILGICYGQQVMSEQLGGKVEPGDSGEFGRAFLTVTEPCVLFDGLWAVGERHQVWMSHGDKVTQFAPGFRIVAVSDGAPFAVIANDEKKYYGTQFHPEVVHTPDGGKLIANFVRHVCGCAGDWSMAEFRRTKIAEIREQVGDSRVICGLSGGVDSAVAAVLIHEAIGDQLTCVFVDHGLMRMGEAEQVVSLFRNHYNIPLVHKDVSALFLGGLAGVTDPEAKRKFIGKTFIDVFEAEARQVGGADFLAQGTLYPDVIESVSFTGGPSVTIKSHHNVGGLPERMNMKLVEPLRELFKDEVRALGRELGLPEIFVGRHPFPGPGLAIRIPGEVTKERCDILRKADAIYLEEIRNAGLYDAIWQAFAVLLPVKTVGVMGDGRTYDSVCALRAVTSTDGMTADIYPFDAGFLSRVATRIVNEVKGINRVVYDYTSKPPGTIEWE

SEQ ID NO: 78883 - DNA, 1530 bp, Cytophaga hutchinsonii
  CDS (1)..(1530)
atgactgaaaaaatattaatcctggattttggatctcaatacactcagctgattgccagaagagtaagagaattaaatgtttattgtgaaattcacccatacaataaagcaccacaaatagatggcacggttaaaggagtaattctttccggcagtccttgttcagttagagaagaaaacgcaccggatattgacctatctttatacagagaaaaattaccccttttaggtgtttgttatggagcacaattgattgcccataaatcaggcggaacggttcagccatcttctatccgtgaatacggaagagcacggttgaataacgtacacacttcagatgatttatttaaagaaattgtaccggattctcaggtttggatgtcacatggtgatacaatcgtagaaattccttccaattttgaaatattaagcagcaccgaaactgttcgtgtagcagcctacaaagtaaaaggagaagatacattcggcattcagtttcacccggaggttacacactccttacaaggcaaagaattattaagaaactttgttgtacatatttgcggttgttcacaagattggacaccggatgcatttgttgaaacaactatcagtgaactgaaagctaaaatcggtacagacaaagttgtacttggtttgtcaggcggcgtagattcatctgttgcagcagtattgatacataaagcgatcgggccaaacttaacatgtatttttgttgataatggtttgcttcgtaaaaacgaatacgaggaagtattgaattcatataaacatatgggtttaaatgtgatcggtgttgatgcaaaaaaacaattttacaaatcgcttgaaggcttgagtgatccggaagcaaaacggaaagcgatcggtaaagaatttattgaagtgttcgaccaggagtctcacaaaattgcagacgtaaaatggctgggacagggaacaatttatccggacattatcgaatctgtttctgttaaaggcccttcagctaccatcaagtctcaccacaatgtaggtggtttgcctgaaaagatgaaattgaaaattgttgaaccgctgaacacgttgtttaaagacgaagtgagaagagtaggtaagacattaggcatcgatgatatcattttaaaaagacatccattccctggacctggtttggccatacgtatccttggcgacattacagcagaaaaagtagctgtactgcaggaagtggattatattttcatttcacgtctgaaagaaaaaggtttatatgatcaggtttggcaggcaggcgctatattgcttcctgtaaaatctgtcggcgtaatgggagatgaaagaacctatgaaaatgttgtagcattgcgtgctgtaagcagcatggatggtatgacagcagactggattcatttaccatacgattttctggcagatatttcaaatgaaatcataaaccgtgtaaaaggtgtgaaccgggttgtgtatgacatcagctctaaaccgcctgcaaccattgaatgggaataa

SEQ ID NO: 78884 - protein, 509 aa, Cytophaga hutchinsonii
MTEKILILDFGSQYTQLIARRVRELNVYCEIHPYNKAPQIDGTVKGVILSGSPCSVREENAPDIDLSLYREKLPLLGVCYGAQLIAHKSGGTVQPSSIREYGRARLNNVHTSDDLFKEIVPDSQVWMSHGDTIVEIPSNFEILSSTETVRVAAYKVKGEDTFGIQFHPEVTHSLQGKELLRNFVVHICGCSQDWTPDAFVETTISELKAKIGTDKVVLGLSGGVDSSVAAVLIHKAIGPNLTCIFVDNGLLRKNEYEEVLNSYKHMGLNVIGVDAKKQFYKSLEGLSDPEAKRKAIGKEFIEVFDQESHKIADVKWLGQGTIYPDIIESVSVKGPSATIKSHHNVGGLPEKMKLKIVEPLNTLFKDEVRRVGKTLGIDDIILKRHPFPGPGLAIRILGDITAEKVAVLQEVDYIFISRLKEKGLYDQVWQAGAILLPVKSVGVMGDERTYENVVALRAVSSMDGMTADWIHLPYDFLADISNEIINRVKGVNRVVYDISSKPPATIEWE

SEQ ID NO: 78885 - DNA, 1536 bp, Clostridium thermocellum ATCC 27405
  CDS (1)..(1536)
ttgaataatgaattgattctcgttctcgactttggaggacagtataatcagcttattgcaagaagagtcagagaggcaaatgtgtattgcgaggttttaccctacaactcttctattgataaaataaaatcaaagaatccgaaagggattatttttacgggaggtcctgcatctgtactggatcctaaagctccaatctgtgacagggaagtttttgagctggggattcccattttgggtatctgctacggtatgcagctgatgagccatatgcttgggggaactgtggaaaaagcagagcagcgtgagtacggaaaggtaaatattacatttgatacctcaagcatgctctttgaaggtattgaaaaggaatcaacctgctggatgagtcatacctattatgtcaataaccttcccgaaggttttgtaaaatgtgcggatactcccaattgtcctgtggcggcaatagaaaacagggagaagaaattgtacggtgttcaattccatccggaagtggttcatactcccaagggaagagatatactaaacaacttcctctacaaaatctgcggatgttccggagactggaagatggcttcctttatagagcattccataaacagtatcagggaaaaagtcggagataaaaaggttttatgcgctctttccggaggcgttgactcttcggtggcggcggttctggtgcacaaagccgttggaaagcagcttacatgtatttttgttgaccatggtcttctcagaaagtacgaaggagatcaggttgaggaagtgttcaaaaagcagtttgacattagtttaataagggttaatgcggaagacagatttttggaaaaacttaaaggagtgacagaccccgaaagaaagagaaaaattatcggggaagagtttatccgggtgtttgaagaggaagcaaagaaaatcggaacagttgactttctggtacagggaaccatttatccggatgtgattgaaagcggagtgggagatgccgctgttataaagagccatcacaatgtgggcggtcttcctgactatattgatttcaaagagataattgaacctctccgaagcctctttaaggatgaggtaaggaaagtgggaatagagcttggaatacccgaagacattgttatgaggcagccgttcccgggacctggactggctgtcagggttatcggcgaggttacaaaggaaaaagtggatatactgagggatgctgattatattttcagagaggaaataaaaaatgcaggactggacagggaaatcaaccagtactttgcagtgctcacgggtatgagaagcgtcggagtcatgggggatgaaaggacttatgactatacccttgccctaagagcggtcactaccatcgactttatgactgccgactgggcaaagattccgtatgatgtacttgaaaaggtatcgaacagaattgtaaatgaagtaaagcacattaacaggatagtatacgatataacaaccaagccgccggcaaccattgagtgggagtag

SEQ ID NO: 78886 - protein, 511 aa, Clostridium thermocellum ATCC 27405
MNNELILVLDFGGQYNQLIARRVREANVYCEVLPYNSSIDKIKSKNPKGIIFTGGPASVLDPKAPICDREVFELGIPILGICYGMQLMSHMLGGTVEKAEQREYGKVNITFDTSSMLFEGIEKESTCWMSHTYYVNNLPEGFVKCADTPNCPVAAIENREKKLYGVQFHPEVVHTPKGRDILNNFLYKICGCSGDWKMASFIEHSINSIREKVGDKKVLCALSGGVDSSVAAVLVHKAVGKQLTCIFVDHGLLRKYEGDQVEEVFKKQFDISLIRVNAEDRFLEKLKGVTDPERKRKIIGEEFIRVFEEEAKKIGTVDFLVQGTIYPDVIESGVGDAAVIKSHHNVGGLPDYIDFKEIIEPLRSLFKDEVRKVGIELGIPEDIVMRQPFPGPGLAVRVIGEVTKEKVDILRDADYIFREEIKNAGLDREINQYFAVLTGMRSVGVMGDERTYDYTLALRAVTTIDFMTADWAKIPYDVLEKVSNRIVNEVKHINRIVYDITTKPPATIEWE

SEQ ID NO: 78887 - DNA, 1581 bp, Microbulbifer degradans 2-40
  CDS (1)..(1581)
atgcccaataccgatattcattctcagcgtatccttattcttgattttggctcccagtacactcagcttattgcgcgtcgcgtgcgcgaggtgggggtgtattctgaaatccgagcctgggacgtttcggacgaagaaataaaagagttcgcccctaagggcattatcttggctggtggcccagagtcggtaactgcaggcttttcaccccgagcaccgcagttagtgtttgagttgggtatccctgttttgggtatttgttacggcatgcaaactatggccgagcagttgggcggtaaagttgagtcgtctaacgtgcaagaatttggttacgcgcaagttaaaattgaaaacgaatgcgcgcttataaaagatattaaagatcatgtagatgatggcggcgctgcgcttttagacgtgtggatgagccacggcgataaagtggttgctatgcccgagcagttcacgcttatggcatctacgccttcttgcccaattgccggtatggcgtgggaagagaaaaagttttatggcgttcagtttcaccctgaagttacccatacattgcagggtaagcgcatttttgaacattttgcattagagctatgtggttgcgaagccttgtggacagcggcaaatatcgttgaagatgcaatcgggcgtgtgcgcgctcaggttggtgacgacaaagtattgctgggtttgtctggcggggtggattcttctgtagtggccgcgctattgcacaaggctattggcgataagttaacctgtgtatttgttgataacggcctattgcgtaaaaacgaaggcgatcaagtgatggacatgtttgcaaaaaacatgggcgttaaagtgattcgcgccgatgctgcagacctgttccttggcaaccttgctggcgaaagtgacccagagaaaaaacgcaaaattatcggtaatacgtttatcgatattttcgaccaagaagcgagtaagctaaaagatgttaaatggttggcgcaaggtactatctacccagatgtaatcgagtctgccgcttctaaaacaggcaaggcgcacgttattaagtcccaccacaacgtaggtggcttaccagaggatatgcagtttgagcttgtagagccgttgcgtgaattatttaaagacgaagtgcgcaaaataggcttagaattagggttgccgtacgatatggtttaccgtcatcctttcccgggtccgggtttgggtgtacgtattttaggcgaagtgaaaaaagagtatgctgaaatactgcgtgaagcggatgctatctttttagaagagctgcacgcggcgggttggtaccataaaaccagccaggcttttgctgtgtttgtgccggttaagtctgtaggtgtggttggtgatgcgcgtcgttatgcgtgggttattgcgttgcgtgccgttgagactatcgactttatgacagcccgctgggcccacttaccttatgagctgttagaaaaggtatcaaacagaattattaacgagatttcaggcgtgtctcgggttacttacgatgtatcaagtaaaccacctgctacgattgagtgggagtaa

SEQ ID NO: 78888 - protein, 526 aa, Microbulbifer degradans 2-40
MPNTDIHSQRILILDFGSQYTQLIARRVREVGVYSEIRAWDVSDEEIKEFAPKGIILAGGPESVTAGFSPRAPQLVFELGIPVLGICYGMQTMAEQLGGKVESSNVQEFGYAQVKIENECALIKDIKDHVDDGGAALLDVWMSHGDKVVAMPEQFTLMASTPSCPIAGMAWEEKKFYGVQFHPEVTHTLQGKRIFEHFALELCGCEALWTAANIVEDAIGRVRAQVGDDKVLLGLSGGVDSSVVAALLHKAIGDKLTCVFVDNGLLRKNEGDQVMDMFAKNMGVKVIRADAADLFLGNLAGESDPEKKRKIIGNTFIDIFDQEASKLKDVKWLAQGTIYPDVIESAASKTGKAHVIKSHHNVGGLPEDMQFELVEPLRELFKDEVRKIGLELGLPYDMVYRHPFPGPGLGVRILGEVKKEYAEILREADAIFLEELHAAGWYHKTSQAFAVFVPVKSVGVVGDARRYAWVIALRAVETIDFMTARWAHLPYELLEKVSNRIINEISGVSRVTYDVSSKPPATIEWE

SEQ ID NO: 78889 - DNA, 1554 bp, Oenococcus oeni PSU-1
  CDS (1)..(1554)
atgatagaacttgaaaaaaaatatgataagatccttgtccttgattacggtagccaatataatcagctgattactcgccgaattcgcgagtttggtgttttttcagaactgaaatcaagaaaaatgacaattgatgaaattaaggattatgttccaaaagcaataattctttccggggggccaaaatcagtttatgccgatgacgcttttacgattgatccggaaatttttagattgggaatcccgattcttggtgtttgttacggcatgcagttaatggcttatgttttgcctggcggaaaggttcttcctaatgatggcaacggcgaatttggtcaggctgctctgcattttgatgaaaattcgcttttgtttgctaatacgccggaaggacagaaagtactgatgagccacggagactcggttgaagcggtaccggaaggttttgtcgttgcggctaagacggataagacaaaaattgccgctattgccgatgacgataagaaactttacggtgcccagtttcatgccgagacgaccttatccgagtatgggaatcaaattttaaagaattttgtttttaaaatcgcccaatgccaagcaaattggcaaatgaaagattttatcaatgaccaaattgagaagatccgcactgaagtcggcaataaaaaagttcttttaggtctctcaggtggagtcgactcttccgtagtggctgttttacttcacaaggcaattggccggcaattgacctgcatttttgtagatcatggtttattgagaaaaaatgaggccaaactggtaatggaatcattagccggtaaatttggcttaaacattataaaagtcgatgctcaaaaacgttttttggataaattagagggaatcagcgaacctgagcaaaaacggaaaattattggcaaagagtttatcgaaacctttaatgatgaagcgaaaaagctggatgggattgattttttggcgcagggaactctttatacggatgtaattgaatccggaaccgatactgcccaaacaattaagtcgcatcacaacgttggcggtttgccaaaagaaatgcattttaaattaatcgaacccctgcgtactctgtttaaagacgaggcccgtaaacttggcgaagaaatgcaaatgccacatgctttggtctggcgtcaaccatttcccggcccaggattggcaattcgaattttaggcgaaattacagaagaaaagttggctgttgtgcgtgattccgatgcgattttgcgcgatgagattgccaaagccggtttagaagattcagtttggcaatactttacgattttgaccggtctgcgctcggtcggtgtcatgggcgatggtcggacttatgactggacaattgcgattcgggcaattacttccgtcgatggcatgacagctgattttgccaaactgccatgggatctgctgggcaaaatttctgaacgcattgtcaacgaagttggtcacatcaaccgcgtagtctacgacatcacgagcaagccgccggcaacgatcgaatgggaataa

SEQ ID NO: 78890 - protein, 517 aa, Oenococcus oeni PSU-1
MIELEKKYDKILVLDYGSQYNQLITRRIREFGVFSELKSRKMTIDEIKDYVPKAIILSGGPKSVYADDAFTIDPEIFRLGIPILGVCYGMQLMAYVLPGGKVLPNDGNGEFGQAALHFDENSLLFANTPEGQKVLMSHGDSVEAVPEGFVVAAKTDKTKIAAIADDDKKLYGAQFHAETTLSEYGNQILKNFVFKIAQCQANWQMKDFINDQIEKIRTEVGNKKVLLGLSGGVDSSVVAVLLHKAIGRQLTCIFVDHGLLRKNEAKLVMESLAGKFGLNIIKVDAQKRFLDKLEGISEPEQKRKIIGKEFIETFNDEAKKLDGIDFLAQGTLYTDVIESGTDTAQTIKSHHNVGGLPKEMHFKLIEPLRTLFKDEARKLGEEMQMPHALVWRQPFPGPGLAIRILGEITEEKLAVVRDSDAILRDEIAKAGLEDSVWQYFTILTGLRSVGVMGDGRTYDWTIAIRAITSVDGMTADFAKLPWDLLGKISERIVNEVGHINRVVYDITSKPPATIEWE

SEQ ID NO: 78891 - DNA, 1563 bp, Pediococcus pentosaceus ATCC 25745
  CDS (1)..(1563)
atgaaggacttggcgaacgcagatttatcaaattttgataaaatcattgttttggatttcggtagtcaatacaaccaattgattacacgtagaatccgtgaattcggtatttactctgagcttctttctcataagattactgctgaagaaatcaaaaagattaatcctaaaggaattatcttctctggtggacctaacagtgtttatgataaagatgcctttcgaattgacccagaaatttataagttaggtattccaattttaggtatttgttacggaatgcaattaatgacttataacttaggcggacgagttgaaccagctgataaccgtgaatacggtcatgctgatattgatgtgactgatgatcaagcggttatgtttaaagagcttcctgctaaacaaacagtttggatgagccatggtgatttggttcgtgaagtccctgaaggatttaagaccgttgcaactagcgcaaactgtccgattgcctcaatggctgatgatgctcgtaagttctacggggttcaattccatgctgaagtacgtaatactcaatatggtaacgaaattctccggcactttgcatttgacgtttgtgaagctaaagctaactggtccatgaacgactttatcgacatgcaagtacaacaaatccgtgaaactgtgggagaccgtaaagtattgcttggtctttctggtggagtggattctagcgtggttggggtattactcaataaagcaatcggtgaccaattagtatgtatcttcgtagatcacggtttactccgcaagggcgaagcaaagcaagttatggatagtctagaaggtaagtttggtttgaacattatcaaagtggatgctcaagatcgcttcttgagtaagcttgctggtgtttcagaacctgaacaaaaacgtaagattattggtaacgagtttattcaagtatttaatgatgaagcacaaaaacttaaaggaattgacttcctagctcaaggtacgctttacactgatgtaatcgaaagtggaacagatactgctcaaacgattaagtcacatcataatgtgggtggacttccagaagacatgcactttgaattgattgaaccacttcgtactttatttaaagacgaagctcgtgaccttggtgaaaaattgggaatgccagaagatctcgtttggcgtcaaccattcccaggtcctggtttgggaattcgtgtaatcggtgaaatcaccgaagacaaacttcaaattgtgcgtgacagtgacttgattcttcgcgaagaaatcaagaaggctggtctcgaccgtgatatctggcaatactttactgttttacctggtatccgtagtgttggtgttatgggtgacggccgcacttacgattacacagtaggtatccgggctgttaactcaatcgacggtatgactgccgactttgctcgtatcccatgggatgtcttgcaaaagatttcggtacgtatcgtaaatgaagtggaccatgttaaccgcatcgtctatgacattacttctaagccaccggcaactgtggaatgggaataa

SEQ ID NO: 78892 - protein, 520 aa, Pediococcus pentosaceus ATCC 25745
MKDLANADLSNFDKIIVLDFGSQYNQLITRRIREFGIYSELLSHKITAEEIKKINPKGIIFSGGPNSVYDKDAFRIDPEIYKLGIPILGICYGMQLMTYNLGGRVEPADNREYGHADIDVTDDQAVMFKELPAKQTVWMSHGDLVREVPEGFKTVATSANCPIASMADDARKFYGVQFHAEVRNTQYGNEILRHFAFDVCEAKANWSMNDFIDMQVQQIRETVGDRKVLLGLSGGVDSSVVGVLLNKAIGDQLVCIFVDHGLLRKGEAKQVMDSLEGKFGLNIIKVDAQDRFLSKLAGVSEPEQKRKIIGNEFIQVFNDEAQKLKGIDFLAQGTLYTDVIESGTDTAQTIKSHHNVGGLPEDMHFELIEPLRTLFKDEARDLGEKLGMPEDLVWRQPFPGPGLGIRVIGEITEDKLQIVRDSDLILREEIKKAGLDRDIWQYFTVLPGIRSVGVMGDGRTYDYTVGIRAVNSIDGMTADFARIPWDVLQKISVRIVNEVDHVNRIVYDITSKPPATVEWE

SEQ ID NO: 78893 - DNA, 1608 bp, Trichodesmium erythraeum IMS101
  CDS (1)..(1608)
atgaccctaacaacacagacacaaaaaaactcagattctctcactcaatttaaccgtcaaatgatcgtaattttggattttggttctcaatattcagaactaattgcccgccgaattcgggaaactcaagtatattcagaggttatttcttaccgcacaactgcagctaaactggcagatataaaccccaagggaatcattctttctggtgggccaaattctgtttacgatgaaggggcacctcattgcgatcccgaaatttggaatttgggaatacccattttgggtgtatgctacggtatgcagttaatggtaaaacaactgggcggagaagttgaacgcactcagttagctgaatatggtaaagcatctgtatcaatagatgatcctacagatttgctaacaaatatagaagaaggtacaactatgtggatgagtcatggagattctgtcaccaaaatgccttctggttttgaagtattagctcatacagataatactccttgtggagcaatagctgaccacaataaaaagctctatggtactcagtttcacccagaggtagttcattctattggtggtcaagtattaattcggaattttgtttaccatatctgcaagtgtgaaccaacctggacgacagaagcttttgtagaagaagcgattcgagaaattagagctaaagtaggggataaacgagtattattagctctgtctggaggggtagactcttcgactttagcatttttactccatcaggccattggagataaattaacttgtatgtttattgaccaagggtttatgcgaaagtatgaaccagagaacttggtaaaaatatttcacgaatcttttcatatatcagttaaatatgtgaatgctcgcgatcgcttcttatctatactcaaaggggtcagtgatccagaagaaaaacggaaattaatcggccatgaatttattcaagtatttgaagaagagtcaaaacgtttgggaccttttgattatctagctcaaggtactctttatccagacgtgattgaatctgctaatacgaatgttgaccccaaaaccggggagcgagtagcggttaaaattaagagtcatcacaatgttggtggtttgccgaaagatttgagatttaaattggtcgaacctttgcgcaaactatttaaggatgaagtgagaaacgttggtcgttctattggcttaccagaagaaattgtgcgacgacatccttttcctggcccgggattagcaattcggattttaggggaggttacagacaaacgtttgaaaatattacgggatgctgattttattgtgcgcgatgaaattaggcagcaaggtatgtatcatgatttttggcaagcgtttgctgttttgttacctattcaaagtgttggggtaatgggggatcaacgtacttatgcttaccccattgttttgcggtttgttaagagtgaggatggaatgactgctgactggtctcgtgtaccttatgatttgttagaaactatttctaaccgcattgtgaatgaggttaagggagttaatcgggtggtgtatgatattacttctaaacctccaggtactattgagtgggaataa

SEQ ID NO: 78894 - protein, 535 aa, Trichodesmium erythraeum IMS101
MTLTTQTQKNSDSLTQFNRQMIVILDFGSQYSELIARRIRETQVYSEVISYRTTAAKLADINPKGIILSGGPNSVYDEGAPHCDPEIWNLGIPILGVCYGMQLMVKQLGGEVERTQLAEYGKASVSIDDPTDLLTNIEEGTTMWMSHGDSVTKMPSGFEVLAHTDNTPCGAIADHNKKLYGTQFHPEVVHSIGGQVLIRNFVYHICKCEPTWTTEAFVEEAIREIRAKVGDKRVLLALSGGVDSSTLAFLLHQAIGDKLTCMFIDQGFMRKYEPENLVKIFHESFHISVKYVNARDRFLSILKGVSDPEEKRKLIGHEFIQVFEEESKRLGPFDYLAQGTLYPDVIESANTNVDPKTGERVAVKIKSHHNVGGLPKDLRFKLVEPLRKLFKDEVRNVGRSIGLPEEIVRRHPFPGPGLAIRILGEVTDKRLKILRDADFIVRDEIRQQGMYHDFWQAFAVLLPIQSVGVMGDQRTYAYPIVLRFVKSEDGMTADWSRVPYDLLETISNRIVNEVKGVNRVVYDITSKPPGTIEWE

SEQ ID NO: 78895 - DNA, 1551 bp, Moorella thermoacetica ATCC 39073
  CDS (1)..(1551)
atgattggagaaaacaaacagcttgcagaaatagtactggtgctggatttcggcggccagtacaaccagttgatcgcccggcgggtccgcgaagccggggtttactcggagatgataccctataacacgcccctggaaaagatcctggcccggcgaccccgggggattattttttccggcgggccggccagcgtctatagcctcggggcaccccgtatcgaccgggccctctatgaaagcggcattcccattttgggcatctgttatggtatgcagctcatggcccatgacctgggcggtagggtagagggggcctcgggacgggagtatggtaaaacccagctggaaataacagcagcagatccccttttcgccggtttacctgaaagtatacagtgctggatgagccacggcgactatatcagcgccccgccgcctggcttccaggtgacggcccgctcggcctataccccggtggcggctatgagcgacccggccaggaagctttatggcgttcagtttcacccggaagtaaagcatactcccatggggcaggagatactgcgtcgttttctcttccaggtatgcggctgccggggtgactggtcggtgagttccttcattgaagaccaggtggcggccattcgccggcaggtaggtaacggccgggtcctctgcgccctgagcggcggggtcgattcctcggtggctgcggccctggtccaccgggccgtcggcgaccgcttgacctgcgtgtttgttaaccacggtctcctgcgccagggggaggccgaacaggtgcagcgggcctttggccaggccatgggcatgaacatcgtctatgtcgatgccagccggcgtttcctggagaaactcaccggcgttacagacccggaagaaaagcgcaaaattatcggccatgaatttatccgggtctttgaggaggaagccaggaaactgggacgggtggatttcctggtccagggcaccctttaccccgatgtcattgagagcggtaccgaaacggccgccgtcatcaagagccaccataacgtcggtggcctgccggaagatatggaactggaattaattgaacccctgcgccttttatttaaggacgaagtgcgccgggtaggggaggaactgggcctgccggaggagattgtctggcggcaacccttcccggggccgggcctggctatccgcatcctgggggaagtcaccccggagaaactggaaatcttacgtcaggctgacgccattgtcaccgaggagatccggcgagccggcctctaccgggaaatctggcagtcctttgcggtattgccctccatgaagagtgtgggtgttatgggcgacgagcggacctatgcctaccccatcgtcctgcgggccgtgaccagcgatgacgccatgactgccgactgggccaggctcccctacgacctcctggagcgtatctcctcccggatcgtcaacgaggtgcgtcatatcaaccgggtcgtttacgacatcacttccaaacccccggcgaccatagagtgggagtag

SEQ ID NO: 78896 - protein, 516 aa, Moorella thermoacetica ATCC 39073
MIGENKQLAEIVLVLDFGGQYNQLIARRVREAGVYSEMIPYNTPLEKILARRPRGIIFSGGPASVYSLGAPRIDRALYESGIPILGICYGMQLMAHDLGGRVEGASGREYGKTQLEITAADPLFAGLPESIQCWMSHGDYISAPPPGFQVTARSAYTPVAAMSDPARKLYGVQFHPEVKHTPMGQEILRRFLFQVCGCRGDWSVSSFIEDQVAAIRRQVGNGRVLCALSGGVDSSVAAALVHRAVGDRLTCVFVNHGLLRQGEAEQVQRAFGQAMGMNIVYVDASRRFLEKLTGVTDPEEKRKIIGHEFIRVFEEEARKLGRVDFLVQGTLYPDVIESGTETAAVIKSHHNVGGLPEDMELELIEPLRLLFKDEVRRVGEELGLPEEIVWRQPFPGPGLAIRILGEVTPEKLEILRQADAIVTEEIRRAGLYREIWQSFAVLPSMKSVGVMGDERTYAYPIVLRAVTSDDAMTADWARLPYDLLERISSRIVNEVRHINRVVYDITSKPPATIEWE

SEQ ID NO: 78897 - DNA, 1551 bp, Streptococcus suis 89/1591
  CDS (1)..(1551)
atgacaaaacaagatgtccaaaaaattattgtattggattatggtagccagtacaaccaacttatttcacgtcgaattcgtgaatttggtgtcttttcagaattgaaaaaccataaaattacagctgaggaagttcgtgctatcaatccaattggtatcgttctttcaggtggaccaaactctgtctacgcagaaaatgcctttgatattgatccagaaatctttgaattgggtattcctatcttagggatttgctatggtatgcagttaattacccataaattgggaggtaaggttgttcctgctggtgaggctggaaatcgtgaatatggtcaatcaaatcttcaactgaagactgaatcagcgctttttgctggaacaccagaagaacagcttgtactcatgagccacggggatgctgtaactgaaattcctgctgatttccacctggttggtctgtctgctgactgcccttacgctgccattgaaaacacggaacgccgtatctacggtatccagttccacccagaagttcgtcattccgtatatggaaacgatattttgaaaaactttgcgtttggtatctgtggagccaaaggcgactggacaatggaaaacttcatcgaaacagaaattgaaaaaatccgccagactgttggggacaagaaagtcttgctcggtttatcaggcggtgtggattcatctgttgttggtgtgcttcttcaacgtgctattggtgaccaattgacctgtatcttcgttgaccacggtcttcttcgtaagaatgaaggcgatcaagttatggaaatgttgggcggtaaatttggcctcaatattattcgcgtcgatgctgctaagcgtttcttggatctacttgctggcgtatctgaccctgagaagaaacgtaaaatcatcggtaatgaatttgtttacgtatttgacgatgaagcgagcaagttgactgatgttgaattcctagcgcaaggaacactttataccgatattatcgagtcaggaacggatactgctgagacaatcaaatctcaccacaacgttggtggtctgccagaagatatgcagttcaagttgattgaaccgctcaatactctctttaaggatgaagttcgtgctctcggtactgctcttggtatgccggatgaagttgtatggcgccaaccattcccaggaccaggccttgccattcgtgtcatgggtgaaatcactgaggaaaaacttcaaactgttcgcgaatctgacgctatcttgcgtgaggaaattgcaaaagcaggtcttgaccgcgatgtgtggcaatatttcacggttaatactggcgttcgctccgtaggtgtcatgggagatggtcgtacctacgactacaccatcgccatccgtgctatcacttctgtcgatggaatgacagctgactttgccaaactaccatgggatgttcttcaaaaaatctctgtccgtatcgtaaacgaagtcgaccacgtcaaccgcatcgtctatgatataacaagtaaaccaccagcaacagttgagtgggagtaa

SEQ ID NO: 78898 - protein, 516 aa, Streptococcus suis 89/1591
MTKQDVQKIIVLDYGSQYNQLISRRIREFGVFSELKNHKITAEEVRAINPIGIVLSGGPNSVYAENAFDIDPEIFELGIPILGICYGMQLITHKLGGKVVPAGEAGNREYGQSNLQLKTESALFAGTPEEQLVLMSHGDAVTEIPADFHLVGLSADCPYAAIENTERRIYGIQFHPEVRHSVYGNDILKNFAFGICGAKGDWTMENFIETEIEKIRQTVGDKKVLLGLSGGVDSSVVGVLLQRAIGDQLTCIFVDHGLLRKNEGDQVMEMLGGKFGLNIIRVDAAKRFLDLLAGVSDPEKKRKIIGNEFVYVFDDEASKLTDVEFLAQGTLYTDIIESGTDTAETIKSHHNVGGLPEDMQFKLIEPLNTLFKDEVRALGTALGMPDEVVWRQPFPGPGLAIRVMGEITEEKLQTVRESDAILREEIAKAGLDRDVWQYFTVNTGVRSVGVMGDGRTYDYTIAIRAITSVDGMTADFAKLPWDVLQKISVRIVNEVDHVNRIVYDITSKPPATVEWE

SEQ ID NO: 78899 - DNA, 1563 bp, Thiobacillus denitrificans ATCC 25259
  CDS (1)..(1563)
atgcaccagaaaatcctcattctcgatttcggttcccagtacacccagctgatcgcgcgccgcgtgcgcgaggccggggtctattgcgaactccaccccaacgacgtgagcgaggatttcgtgcgcgagttcgcgccgcaggggatcatcctgtcgggcggaccgaattcggtgtacgaggacgagacgccgcgtgcgcccgacgtcgtgttcacgctcggtgtgccggtgctcggcatctgctacggcatgcagacgatggccgcgcagttgggcggagcggtcgagtctgcggccaagcgcgagttcggctacgccgaaatccgcgcgcgcgggcatacgcagcttctgcgtgacatccaggatcgcgtcaccggcgagggacacggcatgctcgacgtatggatgagccacggcgacaaggtcaccgcgctgccggaaggtttcaagctcatggcgagcaacgccgcgacgccgatcgccggcatggccgacgaagcccgccgcttctacggcgtgcagttccatcccgaagtgacgcacacgttgcagggcaagcacatcctcaaccgcttcgtgcacgacatctgcggctgcggctccgactggaacatgcccgactacgtcgaggaagcgatcggcaaggtgcgtagcgaagtcggcagcgacgaagtcatcctcggtctttcgggcggtgtcgattcctccgtcgtcgccgcgcttctgcatcgcgcggtcggcgaccagctcacctgcgtcttcgtcgacaacggcttgctgcgcctgaacgaagccgagcaggtgatggagaccttcgcccagaaccttggtgtcaaggtcatccacgtcgacgcgaccgagcgtttcatgcgcgaactggcaggcgtcagcgaccccgagcagaagcgcaagatcatcggccgcgaattcgttcacgtcttccaggaagaagccgaaaagctgcccaaagccaagtggctcgcccagggcacgatctaccccgacgtgatcgagtcggccagcgccaagacaaagaaggcgcatacgatcaagagccatcacaacgtcggcggcctgccggagacgctgcacctgcaactgctcgagccgctgcgcgaactcttcaaggacgaggtgcgcgaactcggcatcgcgctggggctgccgcacgacatggtctatcgccatcccttcccggggccgggcctcggcgtgcgcatcctcggcaaggtcaagcgcgaatacgccgacctgctgcgccgcgccgacgcgatcttcatcgaggaattgcgcgcgtcgggctggtacgagaaaacgagccaggcgttcaccgtcttcctgcccgtgaaatcggtcggcgtcatgggcgacggtcgcacctacgactacgtcgtcgcgttgcgtgccgtgcagacccaggatttcatgaccgcccactgggccgaactgccgtacacgctgctcggcaaggtctccaaccgcatcatcaacgaagtgcgcggcatcaatcgtgtcgtctacgacgtcagcggcaagccgccggcgacgatcgagtgggaatag

SEQ ID NO: 78900 - protein, 520 aa, Thiobacillus denitrificans ATCC 25259
MHQKILILDFGSQYTQLIARRVREAGVYCELHPNDVSEDFVREFAPQGIILSGGPNSVYEDETPRAPDVVFTLGVPVLGICYGMQTMAAQLGGAVESAAKREFGYAEIRARGHTQLLRDIQDRVTGEGHGMLDVWMSHGDKVTALPEGFKLMASNAATPIAGMADEARRFYGVQFHPEVTHTLQGKHILNRFVHDICGCGSDWNMPDYVEEAIGKVRSEVGSDEVILGLSGGVDSSVVAALLHRAVGDQLTCVFVDNGLLRLNEAEQVMETFAQNLGVKVIHVDATERFMRELAGVSDPEQKRKIIGREFVHVFQEEAEKLPKAKWLAQGTIYPDVIESASAKTKKAHTIKSHHNVGGLPETLHLQLLEPLRELFKDEVRELGIALGLPHDMVYRHPFPGPGLGVRILGKVKREYADLLRRADAIFIEELRASGWYEKTSQAFTVFLPVKSVGVMGDGRTYDYVVALRAVQTQDFMTAHWAELPYTLLGKVSNRIINEVRGINRVVYDVSGKPPATIEWE

SEQ ID NO: 78901 - DNA, 1563 bp, Silicibacter sp. TM1040
  CDS (1)..(1563)
atgaccgagacagcccatgaccgccttttaattatagacttcggcagccaggtaacgcagctgattgcgcgccgcctgcgcgagttgaacgtctattgtgaaatccacccctatcagaatgtcaccatggacttcgtgcgcgagttcgcgcccaaggcggtgatcttctctggtggtcccgacagcgtgacgcgcgaaggctctccccgcgcgccgcaagagatttttgactacggcgtgccgatccttggcatctgttatggccagcaagtgatgatgcatcagcttggcggcactgttcaatccggccatggaaccgccgaatttggccgcgcctatgtgacacccaccgaagagcgcatcgacatgctcagcggctggttcctggatcagacggaacaggtctggatgagccacggcgaccatgtctctgaaatcgcacccggtttcaaggtctacggcacctcgcccaacgcgccatttgcgatcacggcggatctggagcgcaacttctacgctgttcagttccaccccgaggttcatcacactcccaacggcaagacgctctatgaaaacttcgtgcgtctggccgggttcagcggtgactggaccatgggcgcctatcgcgagcagatggtcgaaaccatccgcgagcaggtcggcgacaagaaagtcatctgtgccctttcgggtggcgtcgacagttccgttgcggcggctctgatccacgaggcgatcggcgatcagctgacctgtgtgtttgtggaccatggtcttctgcgcaagaacgaggcggaagaagtcgtcggcatgttccgcgaccacatgaacctgcaggtcatccacgcggatgagaccgagctctttctcggtgagctagaaggtcagtccgaccccgaaaccaagcgcaagattatcggcaagctgttcatcgacgtgttccagaaatacgccgatcagatcgaaggcgcggagttcctggcccaaggtacgctctacccggatgtcatcgagtcggtctcgttctctggtggcccttcggtgacgatcaagtcgcaccacaacgtcggtggtctgcccgaaaaaatgggcctgaaactggtggagccgctgcgcgagctcttcaaggacgaagtgcgcgcgctcgggcgtgaacttggcctgcccgacagctttattggacggcaccccttccccggaccgggtctggcgatccgttgccccggcgagatcacccgcgacaagctggacatcctgcgcgaagcggatgccatctatatcgaccagatccgcaaacacggtctttatgatgagatctggcaggcctttgtggcgatcctgccggtgcgcaccgtgggcgtgatgggcgacggtcgcacctatgactacgcctgtgccctgcgcgcggtcacctcggtcgatgggatgacggcggattactacccgttcagccatgagttccttggtgagaccgcaacgcggatcatcaatgaagtcaaaggcatcaaccgttgcacctatgacatcacctcaaagcctccgggcacgatcgagtgggaatga

SEQ ID NO: 78902 - protein, 520 aa, Silicibacter sp. TM1040
MTETAHDRLLIIDFGSQVTQLIARRLRELNVYCEIHPYQNVTMDFVREFAPKAVIFSGGPDSVTREGSPRAPQEIFDYGVPILGICYGQQVMMHQLGGTVQSGHGTAEFGRAYVTPTEERIDMLSGWFLDQTEQVWMSHGDHVSEIAPGFKVYGTSPNAPFAITADLERNFYAVQFHPEVHHTPNGKTLYENFVRLAGFSGDWTMGAYREQMVETIREQVGDKKVICALSGGVDSSVAAALIHEAIGDQLTCVFVDHGLLRKNEAEEVVGMFRDHMNLQVIHADETELFLGELEGQSDPETKRKIIGKLFIDVFQKYADQIEGAEFLAQGTLYPDVIESVSFSGGPSVTIKSHHNVGGLPEKMGLKLVEPLRELFKDEVRALGRELGLPDSFIGRHPFPGPGLAIRCPGEITRDKLDILREADAIYIDQIRKHGLYDEIWQAFVAILPVRTVGVMGDGRTYDYACALRAVTSVDGMTADYYPFSHEFLGETATRIINEVKGINRCTYDITSKPPGTIEWE

SEQ ID NO: 78903 - DNA, 1542 bp, Chloroflexus aurantiacus
  CDS (1)..(1542)
atgaccacacacagcataccggtactggattttggttcgcaaaccgctcagctcatcgtgcggcggttgcgtgagctaggctactacagcgagttattaccacacgacgcccccgaagatcaggtgcgagcgctggcgccggttggtattgtactcagcggtggcccggcaagtgtctacgaacctggcgcccctacgctcccgtcgtggttgctggagagtgatctaccggtcttcggtatctgctacggtatgcaactaatcagccacaccctgggcgggattgtcacccggccggctggccgcgaatacggcccggcgatgatcaccatcactcatccgcaccccctcttcgccgacaccccaaccgagcaaccggtctggatgagccacggtgatcggatcgaacagttgcccaccggcttcacagcgattgctgccaatccggcaacccccttcgccgccattgctgatgatcggcgcaagtggtatggtgttcagtttcaccccgaagtggtgcataccgtctatggccgaaccatcctgaccaactttgcccgtctgtgtggggcacgccctgaatggcaaccgaacagcttcgtcgccgaagccatcgagcgggtcaaagcccaggtcggcgatcacgggcgcgttatctgtgcgttgtctggcggtgtcgactcagccgtggccgcgctcattattcatcgcgctatcggcgaccgcctgacctgcgtctttgttgataatggtctgttacgggcaggcgaagcggaacaggtgatcgctaccttcagcgagcattttcacgtgccgctgattgcggttgatgcccgcgaagagtttatgaccgctctgaaaggggtgactgaccccgaacagaagcgcaaaattatcggcgagaaattcattcggatcttcgagcgtgaagcccgcgccctcgccggggttgaattcctcgcccagggcactctctaccccgacgtcatcgagtcgacagcccccgaccgcccaaaggcggcgaaaattaaaacccaccataatgttggcggtctaccagccgacatgcagctcaaactggtcgagccgctgcgctatctgttcaaagacgaagtacgcgccgctggcttacaactcgggctgcccgaaacgtgggtctggcgccatcccttccctgggccggggctggcagtgcgtattatcggtgaagtaacctgggagcgcctggagatactgcggcaggcggataagatctttttggaagagttgcatgccagtggctattatcgcgccacccagcaggcgtttgccgtcctgctaccggtacagagtgtgggggtgatgggtgatggtcgtacctacggcgtcacgattgccttgcgcgcgattacgaccgaagactacatgaccgccgactgggcacgtctgccttacgagctgctggcccacgtgagcagccgcatcgtcaacgaagtcgaaggggtcaatcgggttgtgtacgatatttcgtcgaagccaccggcaactatcgaatgggagtag

SEQ ID NO: 78904 - protein, 513 aa, Chloroflexus aurantiacus
MTTHSIPVLDFGSQTAQLIVRRLRELGYYSELLPHDAPEDQVRALAPVGIVLSGGPASVYEPGAPTLPSWLLESDLPVFGICYGMQLISHTLGGIVTRPAGREYGPAMITITHPHPLFADTPTEQPVWMSHGDRIEQLPTGFTAIAANPATPFAAIADDRRKWYGVQFHPEVVHTVYGRTILTNFARLCGARPEWQPNSFVAEAIERVKAQVGDHGRVICALSGGVDSAVAALIIHRAIGDRLTCVFVDNGLLRAGEAEQVIATFSEHFHVPLIAVDAREEFMTALKGVTDPEQKRKIIGEKFIRIFEREARALAGVEFLAQGTLYPDVIESTAPDRPKAAKIKTHHNVGGLPADMQLKLVEPLRYLFKDEVRAAGLQLGLPETWVWRHPFPGPGLAVRIIGEVTWERLEILRQADKIFLEELHASGYYRATQQAFAVLLPVQSVGVMGDGRTYGVTIALRAITTEDYMTADWARLPYELLAHVSSRIVNEVEGVNRVVYDISSKPPATIEWE

SEQ ID NO: 78905 - DNA, 1620 bp, Polaromonas sp. JS666
  CDS (1)..(1620)
atgcaacaccagaaaatcctcatcctcgatttcggctcccaggtcacccagctgattgcccgccgcgtgcgcgatgcccatgtgttttgcgaagtccatccctgcgatgtgactgacgactgggtccgcgactacgccagggacggcacgctcaagggcgtcatcctgtccggcagccatgccagcatctacgaagaaacgaccgacaaagcgccccaggccgtgtttgagctgggccttccggtgctgggcatctgctacggcatgcaggccatggcgcaccagctgggcggcaaggtcgaaggcggccacaagcgcgaattcggttcggctgacgtgcgggcccgcggccacaccgcgctgctcaaggacatcgccgactacaccacgccagagggccagggcatgctggacgtctggatgagccacggtgacaaggtcaccgaaatgccgccgggcttcaagctcatggcatccaccgagtcctgcccgatcgccggcatggccgatgaagaccgccgtttttacgcggtgcagttccacccggaagtcacgcacaccaagcagggcaatgccattctcaagcgctttgtgcttgatatttgcggcacccggcaagactgggtcatgggcgactacatcagcgaagcggttgaaaaaatccgccagcaggtaggcgacgaagaggtcatcctcggcctgtcgggcggtgtcgattcatcggtggcggcggcactgatccaccgcgccatcggcgaccagctgacctgcgtattcgttgaccatggcctgctgcgcctgaacgaaggcgacatggtgatggacatgtttgtcggcaagctgcatgccagagtggtccgcgtcgatgcgagcgagcagtttctaggccacctggccggggtgagcgaacccgaggccaagcgcaaaatcatcggccgggaatttgtcgaagtgttcaaggccgaggcggctcggctcaaggctggcgacggcggccacaagggcgccaaatggctggcccagggcacgatttatcctgatgtgatcgagtccggtggcgccaagagcaagaaagccgtcaccatcaaaagccaccacaacgtcggcggcctgcccgagcagctgggcctgaagctgcttgagccgctgcgtgagctgttcaaggacgaggtccgcgaactgggcgtcgcgctcggcctgccgcatgacatggtgtatcgccatcccttccccggtcccggcctcggggtgcgcatcctgggcgaagtcaaaaaagagtacgctgacctgctgcgccgcgccgacgccatctttatcgaagaactgcgcaacttcagggatgccgagaccggcaagacctggtacgacctgaccagccaggcgttcaccgtcttcctgccggtgaaaagcgtgggtgtgatgggcgatggccgcacctatgactatgtggtggcgctgcgcgctgtgcaaaccagcgacttcatgaccgcagactgggcagaactgccctacgcgttgctcaaaaaggtctccagccgcatcatcaacgaggtgcgcggcatcaaccgcgtcacttacgacgtgagcagcaagccgccggcaacgatcgagtgggaataa

SEQ ID NO: 78906 - protein, 539 aa, Polaromonas sp. JS666
MQHQKILILDFGSQVTQLIARRVRDAHVFCEVHPCDVTDDWVRDYARDGTLKGVILSGSHASIYEETTDKAPQAVFELGLPVLGICYGMQAMAHQLGGKVEGGHKREFGSADVRARGHTALLKDIADYTTPEGQGMLDVWMSHGDKVTEMPPGFKLMASTESCPIAGMADEDRRFYAVQFHPEVTHTKQGNAILKRFVLDICGTRQDWVMGDYISEAVEKIRQQVGDEEVILGLSGGVDSSVAAALIHRAIGDQLTCVFVDHGLLRLNEGDMVMDMFVGKLHARVVRVDASEQFLGHLAGVSEPEAKRKIIGREFVEVFKAEAARLKAGDGGHKGAKWLAQGTIYPDVIESGGAKSKKAVTIKSHHNVGGLPEQLGLKLLEPLRELFKDEVRELGVALGLPHDMVYRHPFPGPGLGVRILGEVKKEYADLLRRADAIFIEELRNFRDAETGKTWYDLTSQAFTVFLPVKSVGVMGDGRTYDYVVALRAVQTSDFMTADWAELPYALLKKVSSRIINEVRGINRVTYDVSSKPPATIEWE

SEQ ID NO: 78907 - DNA, 1536 bp, Campylobacter lari RM2100
  CDS (1)..(1536): transl_table=11
atgaaaaaagcagatattttggttttggactttggttcacaatacacacaactcattgccagaagattaagggagcaaggtgtgtatgcagaaattttaccttttaatgtaagtttagatgagattaaagctaaagagcctaagggtattattttaagtggtgggccagctagtgtatatgcaaatgatgcttatttttgtgataagggtgtttttgatttaaatataccagttttaggaatttgttatggtatgcaattaatggcgcatcattttggggcaaatgttgctccagcaggccataaagaatatggtaaagcaactatagatattcaaaacgatagtgatttgtttaaaaatttacctaaaaagcaaacagtatggatgagccattctgataaggttgagaatttaccacaaggttttgaggttttagcgactagtgaaaatagtccattttgtgtatttggagatgagaagcgtaaattttttgctttacaatttcaccccgaagttcaacatagcgaatttggaaaaagcatcttgaaaaattttgctaagtatgcatgtaattgtgatagtgtatggaatatgggatcttttgcaaaaactcaagcgcaaaaaatcaaagaagaagtaggaaatgataaagttttatgtgcagtaagtggcggggttgatagtagtgtggtggctgcactgcttgctagtgcgataaaagatcaagttgtggttgtgtttgttgataatgggcttttaagaagtggcgaaaaagagcaagttgagtatatgtttaaacacactttgggtattgatttaattagcattgatgcaagagagattttcttaagtcgtttagcaggagtgagagatcctgagcaaaaaagaaaaatcataggaaatactttcatagaggtttttgaagaagaagctaaaaaacataaagatgtaaaatatttagcacaaggaactttatatactgatattattgaaagttctgttgttggggctagcaagactataaaatctcaccataatgttggcggtttgcctgaaaaaatgaatttaaaactcattgagcctttaaaagaaatttttaaagatgaggtaagagctttaggaatggagcttggtttaagtaaagatgtagtttatcgccaccctttcccagggccaggccttgctatacgtataatgggtgaggtaaatgagcctagtttagaacttttaagaaaagctgatgtgattttgatagaagagctgaaaagtagtggttggtatgataaaacttggcaggctttttgtgtgcttttaaatgtacaaagtgttggtgtaatgggggataatagaacttatgataatgcagtttgtgtgcgtgttgttaatgcaagcgatggaatgactgcaactttttctcatttaccatatgaattattagaaaatatttcgcgccgtattatcaatgaagtaaatgggattaaccgcgtggtgtatgatatttctagtaagccaccagcaactattgagtgggaatga

SEQ ID NO: 78908 - protein, 511 aa, Campylobacter lari RM2100
MKKADILVLDFGSQYTQLIARRLREQGVYAEILPFNVSLDEIKAKEPKGIILSGGPASVYANDAYFCDKGVFDLNIPVLGICYGMQLMAHHFGANVAPAGHKEYGKATIDIQNDSDLFKNLPKKQTVWMSHSDKVENLPQGFEVLATSENSPFCVFGDEKRKFFALQFHPEVQHSEFGKSILKNFAKYACNCDSVWNMGSFAKTQAQKIKEEVGNDKVLCAVSGGVDSSVVAALLASAIKDQVVVVFVDNGLLRSGEKEQVEYMFKHTLGIDLISIDAREIFLSRLAGVRDPEQKRKIIGNTFIEVFEEEAKKHKDVKYLAQGTLYTDIIESSVVGASKTIKSHHNVGGLPEKMNLKLIEPLKEIFKDEVRALGMELGLSKDVVYRHPFPGPGLAIRIMGEVNEPSLELLRKADVILIEELKSSGWYDKTWQAFCVLLNVQSVGVMGDNRTYDNAVCVRVVNASDGMTATFSHLPYELLENISRRIINEVNGINRVVYDISSKPPATIEWE

SEQ ID NO: 78909 - DNA, 1554 bp, Campylobacter upsaliensis RM3195
  CDS (1)..(1554): transl_table=11
atgatgaatagtttaattttggttttagattttggctcacaatacacacaactcatcgctcggcgattgcgtgaatatggcgtttataccgagatagtcccttactttgaaaagctagatttcataaaggcaaaaaatcctaagggaatcattcttagcgggggacctgctagcgtgtatgaagagggggcgtataagccggattctagggtatttgagcttggaatcccagtgtttggaatctgctatggtatgcagtatatcgcacatttttttggcggaagcgtggtaagggcagaggcacaggagtttggcaaagcggttttagaaattgcggatttaaatttggcgttgtttaagggtgtaaagcaagattctatcgtgtggatgagccacgcggataaggtggagtctctacctagtggctttgtggaattagctaaaagtggaaatacgcattattgtgctatcgcggactttaaacgaaatgtatatgctttgcagtttcacccagaagtggtgcatagtgagtgtggcggagagattttgcggaattttgctgtggggatttgtggggcagatacaagctggaatatgaggaattttgcggaaagtgagattgcaaaactgcgtgaaaaagtgcttgggggagataaggttctttgtgctgtgagtgggggcgtagattctagcgtggtagccatacttctttatcgtgccataggagaaaatcttatccctgtttttgtggataccgggcttttaagaaagggggagagagaagcggtagaagcgatgtttaaagagaatctaaaagtgcctttgattgtagccgatgcgagagagctatttttaaggcgattaaagggtgttacagagcctgagcaaaagcgaaaaataatcggtgaaacctttatagaagtctttgaagctgaagctaaaaagcacaacacaaaaggtgaaataaaattcctagcacaaggcacactctaccctgatgtgattgaatctgtgagcgtgaaaggtcctagcaaaacgataaaaagccatcataatgtcggcggactgcctgaatggatgaagtttgagttaatcgagcctttaagagagctttttaaggacgaggtaagggcgttaggcagagaattaggaatgcctgaatctatgcttatgaggcaccctttccccggacccggacttgccatacgcattatgggcgaggtgaattcggcggatttagagctattaaaagaagcggattctatcttcatagaagagctgcataaatggggtttgtatgatagcgtgtggcaggcattttgtgtgcttttaaatgtgcgaagtgtgggcgtaatgggcgataaccgcacttatgataatactatttgtgtgagagccgtggaggcacaagatggaatgactgcaagtttctcacacctgccccacgcatttttagaatctgtctcaaatcgcataatcaacgaagtagtagggattaaccgagtcgtgtatgacatcacctcaaaacccccgggaacgattgagtgggagtag

SEQ ID NO: 78910 - protein, 517 aa, Campylobacter upsaliensis RM3195
MMNSLILVLDFGSQYTQLIARRLREYGVYTEIVPYFEKLDFIKAKNPKGIILSGGPASVYEEGAYKPDSRVFELGIPVFGICYGMQYIAHFFGGSVVRAEAQEFGKAVLEIADLNLALFKGVKQDSIVWMSHADKVESLPSGFVELAKSGNTHYCAIADFKRNVYALQFHPEVVHSECGGEILRNFAVGICGADTSWNMRNFAESEIAKLREKVLGGDKVLCAVSGGVDSSVVAILLYRAIGENLIPVFVDTGLLRKGEREAVEAMFKENLKVPLIVADARELFLRRLKGVTEPEQKRKIIGETFIEVFEAEAKKHNTKGEIKFLAQGTLYPDVIESVSVKGPSKTIKSHHNVGGLPEWMKFELIEPLRELFKDEVRALGRELGMPESMLMRHPFPGPGLAIRIMGEVNSADLELLKEADSIFIEELHKWGLYDSVWQAFCVLLNVRSVGVMGDNRTYDNTICVRAVEAQDGMTASFSHLPHAFLESVSNRIINEVVGINRVVYDITSKPPGTIEWE

SEQ ID NO: 78911 - DNA, 1368 bp, Wolbachia endosymbiont of Drosophila simulans
  CDS (1)..(1368): transl_table=11
atgggtgtttattgtgagatatttccaagcaacatcagttttgaaacaatatcaaaattcaatgggtttattctctctggaggaccacaatctgtaaatgatgattgttctgaaacaagtagagtagtacatgaaattataaaacttaatgaggcaacaagcgttcctatacttggaatatgctatggacagcaactcatttgtcattattttggagcaaaagtaaaagagagtttcaaacaggagtttggtagaactaaaatcaagatactaaaagaatcccccattgtaaaggatacctgggatgttaattctgaagtggatgtattaatgaaccatgcggacagtgttgatactataccacagggatttactgttatcgcatcaggtgtgataaatcaaacaattgcaatgattgtcaacgaacagcggaagatttactgtactcagttccatcctgaggttaagcccacaacaaatggcagtaaattgctctctaacttcttggatattgcaaattgcaaaagagactggacaatgaagtcgtttattgaggagcaaaaggaaaaaatcaaaaatgtagtaggagagaaaaaagtaatcgctgcagtaagtggtggggttgattcaagcgttgcagcggctctcacacataaagctataggaaaacaattgaactgtatttttatcgatactgggttgttacgcaagaaccaaaccatcgctatgttgaaagagattccgataaattacgttgataaatcaaatttatttttgagtaggttgaagggaataactgatccagaagaaaagcgaaaaattatcggtaacacttttattgaagtgtttgaagaagaagcaaaaaaaataggtgatgtggattttttgatgcaaggtaccatctactctgatgtagttgagtcagggcatgcctcagacaacactagtacaattaagtctcaccataatgttggtgggttgccagaaaagatgaatctgaagttagtggagcctttacgttacctctttaaagatgaggtaaggctacttggaaaagaaattgggctttcagacgagataatatttcaacatccatttcctggacccggacttgcagtgaggattataagtgaagtcgataaagaaaaggtgcaaatattgcaagaagtagatgaaatatatattaatacgatgaaaaattacgatctatatgataagatatggcaagcttttgctgtattattaccaataaaaactgtaggcgttatgggagatggtcgtacgtatggatatgtttgtgctttaagggctgtaacatcatctgatggtatgacagccgatgcatttccatttgaagataaggattaa

SEQ ID NO: 78912 - protein, 455 aa, Wolbachia endosymbiont of Drosophila simulans
MGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKD

SEQ ID NO: 78913 - DNA, 1494 bp, Wolbachia endosymbiont of Drosophila ananassae
  CDS (1)..(1494): transl_table=11
atgggtgtttattgtgagatatttccaagcaacatcagttttgaaacaatatcaaaattcaatgggtttattctctctggaggaccacaatctgtaaatgatgattgttctgaaacaagtagagtagtacatgaaattataaaacttaatgaggcaacaagcgttcctatacttggaatatgctatggacagcaactcatttgtcattattttggagcaaaagtaaaagagagtttcaaacaggagtttggtagaactaaaatcaagatactaaaagaatcccccattgtaaaggatacctgggatgttaattctgaagtggatgtattaatgaaccatgcggacagtgttgatactataccacagggatttactgttatcgcatcaggtgtgataaatcaaacaattgcaatgattgtcaacgaacagcggaagatttactgtactcagttccatcctgaggttaagcccacaacaaatggcagtaaattgctctctaacttcttggatattgcaaattgcaaaagagactggacaatgaagtcgtttattgaggagcaaaaggaaaaaatcaaaaatgtagtaggagagaaaaaagtaatcgctgcagtaagtggtggggttgattcaagcgttgcagcggctctcacacataaagctataggaaaacaattgaactgtatttttatcgatactgggttgttacgcaagaaccaaaccatcgctatgttgaaagagattccgataaattacgttgataaatcaaatttatttttgagtaggttgaagggaataactgatccagaagaaaagcgaaaaattatcggtaacacttttattgaagtgtttgaagaagaagcaaaaaaaataggtgatgtggattttttgatgcaaggtaccatctactctgatgtagttgagtcagggcatgcctcagacaacactagtacaattaagtctcaccataatgttggtgggttgccagaaaagatgaatctgaagttagtggagcctttacgttacctctttaaagatgaggtaaggctacttggaaaagaaattgggctttcagacgagataatatttcaacatccatttcctggacccggacttgcagtgaggattataagtgaagtcgataaagaaaaggtgcaaatattgcaagaagtagatgaaatatatattaatacgatgaaaaattacgatctatatgataagatatggcaagcttttgctgtattattaccaataaaaactgtaggcgttatgggagatggtcgtacgtatggatatgtttgtgctttaagggctgtaacatcatctgatggtatgacagccgatgcatttccatttgaagataaggatcaacacttgctagtattttgggattttttacgtaatgtcggcagtataattgttaataatgttcccggagtaaatagagttgtttatgatatcacttctaaaccacccgcaactattgagtgggagtaa

SEQ ID NO: 78914 - protein, 497 aa, Wolbachia endosymbiont of Drosophila ananassae
MGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKDQHLLVFWDFLRNVGSIIVNNVPGVNRVVYDITSKPPATIEWE

SEQ ID NO: 78915 - DNA, 2082 bp, Pongo pygmaeus
  CDS (1)..(2082)
atggctctgtgcaacggagactccaagctggagaatgctggaggagaccttaaggatggccgccaccactatgaaggagctgttgttattctggatgctggtgctcagtatgggaaagtcatagaccgaagagtgagggaactgttcgtgcagtctgaaattttccccttggaaacaccagcatttgctataaaagaacaaggattccgtgctattatcatctctggaggacctaattctgtgtatgctgaagatgctccctggtttgatccagcaatattcactattggcaagcctgttcttggaatttgctacggcatgcagatgatgaataaggtatttggaggtactgtgcacaaaaaaagtgttagagaagatggcgttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaaattatatggagcacagttccaccctgaagttggccttacagaaaatggaaaagtaatactgaagaatttcctttatgatatagctggatgcagtggaaccttcaccgtgcagaacagagaacttgagtgcattcgagagatcaaagagagagtaggcacgtcaaaagttttggttttactcagtggtggagtagactcaacagtttgtacagctttgctaaatcgtgctttgaaccaagaacaagtcattgctgtacacattgataatggctttatgagaaaacgagaaagccagtctgttgaagaggccctcaaaaagcttggaattcaggttaaagtaataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgagcttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccagcaatattttgaaaatagtagctgatttttctgcaagtgttaaaaagccacataccctattacagagagtcaaagcctgcacgacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaatgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaa

SEQ ID NO: 78916 - protein, 693 aa, Pongo pygmaeus
MALCNGDSKLENAGGDLKDGRHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMSLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETSNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 78917 - DNA, 2055 bp, Cryptosporidium parvum
  CDS (1)..(2055)
atgataaattcaaaaattattatacttgattttggaagccaatattcacatttaattgctaaaagatttcgtgcacttggttattattctgaaattgcattaccttcaaccaatttaaatacttttaataatgctaaaggtattgttttttctggtggaccttctagtgtttatgatgataatattccagaatttaataatgatattttaaatcttaatataccaattttaggattatgttatggacattatattgttaatattggttatggtggtcaagtacataaagcacctattggtgaatttggttatgctactttaaatattaataataatatttattcacctatttttcaaaatcttgataataattctcaacaacaagtatggatgagtcatcaagatgaaattattatacctggtaatgattttcaattaattgctagtactattaattgtaaatatgctgcattacaaaatcttgaaaaaaaaagattttcattacaatttcattgtgaagttaatgatacaccttgtggtaatattatttttaataattttgcacaatattgtaatatggaaaaaaattggagtcaagattttgtattaaatcatatattaaatgatataaaaatacaatataataaaagtaatgatattaataatgacaacaataataataataataataataataataataacaatgataataataacaatgataatgataataaaaataataacaataataaaaataataaaaatgttcttttatttttaagtggtggtgttgattctactgttacatttgcattattaaataaagcacttggacaagataaagttcttggtttacatattgataatggttttatgcgtaaaaatgaatctaaaaatattgaattattatatcataaatttggttttaaaaattttattattaaagattattctaatagttttttaaatattattaaaaatattactgatccacaaaaaaaacgtatggctattggtgaacattttattaatattaaaaatatttttattcaagaacaaaattttgatccaaataattggttattagcacaaggtacattatatcctgatattattgaatctggtggtacaaaaaattcaaatactattaaaacacatcataatcgtgttgatatgatttatgatttaataaaaaaaggacttattattgaacctttacgtgaattatataaagatgaagttcgtatgattggaaaaaaaattggtcttaatgatgaacttattatgcgtcatccatttccaggacctggattatctattaatgtaatttgttatgatggtaaatcatggaatgaaaatgataataatgaatatcaatcagcagaaaaagaattaaatcaaattattaatacaattaataataataataataataataataataataataataataataataataatattaataacaataatcatattaaatataattatatacttcctatacgttctgttggtgtacaaggtgattttagaacatataaatttcctgcaatattaatttatgataattattctttatcaaatggtttttttaattttcctaataatagagattatattgaagaaatttctagttatattactaatcatacaaattttattaatcgtacttgtatacaattatatcaaaatccacaagtaaatttaactgatatgaaattacaacaagtttattgtgataaatatcgtcttgatcaattaagagaagttgataatattgttattaatgaattaaataattttggttggtataatcaaatttttcaacatttaacaatacatttaccatatgcaagtaatccagaaaaagcaagttttgttttacgtcctgtatgttctgaagatgttatgactgctcgctttgctttctttccaaaagatttacttgaaataattattcaaaaaatttcattattaaattttgttgatgcaatatattttgatgtaacaaataaaccaccagcaacatttggctgggaataa

SEQ ID NO: 78918 - protein, 684 aa, Cryptosporidium parvum
MINSKIIILDFGSQYSHLIAKRFRALGYYSEIALPSTNLNTFNNAKGIVFSGGPSSVYDDNIPEFNNDILNLNIPILGLCYGHYIVNIGYGGQVHKAPIGEFGYATLNINNNIYSPIFQNLDNNSQQQVWMSHQDEIIIPGNDFQLIASTINCKYAALQNLEKKRFSLQFHCEVNDTPCGNIIFNNFAQYCNMEKNWSQDFVLNHILNDIKIQYNKSNDINNDNNNNNNNNNNNNNDNNNNDNDNKNNNNNKNNKNVLLFLSGGVDSTVTFALLNKALGQDKVLGLHIDNGFMRKNESKNIELLYHKFGFKNFIIKDYSNSFLNIIKNITDPQKKRMAIGEHFINIKNIFIQEQNFDPNNWLLAQGTLYPDIIESGGTKNSNTIKTHHNRVDMIYDLIKKGLIIEPLRELYKDEVRMIGKKIGLNDELIMRHPFPGPGLSINVICYDGKSWNENDNNEYQSAEKELNQIINTINNNNNNNNNNNNNNNNNINNNNHIKYNYILPIRSVGVQGDFRTYKFPAILIYDNYSLSNGFFNFPNNRDYIEEISSYITNHTNFINRTCIQLYQNPQVNLTDMKLQQVYCDKYRLDQLREVDNIVINELNNFGWYNQIFQHLTIHLPYASNPEKASFVLRPVCSEDVMTARFAFFPKDLLEIIIQKISLLNFVDAIYFDVTNKPPATFGWE

SEQ ID NO: 78919 - DNA, 2385 bp, Caenorhabditis elegans
  CDS (1)..(2385)
atgaaattttcatcgcaagtttatccgtgttctccaaaacgagtcaaaattggagcgcgtcagagtaaacgtcactgccgcaaccttccatctgaacttcagcgtgcaaaaagaacaaaggccgtctcgaaagtcagtgagcatactatgaaaagatcgagttcaatgttggacatcaacgaggacagtcaacattccacgaacaaagctccaccaccgaagaaggcgccagaagatcgatttgatagtgccaatatgaacgcttcaggaagtcacgtcacccttgtcgagaatcttccagttgagaaggtttcaagtggcgaacgcattgccatcctcgactttggagcacaatatggaaaagttattgatcgacgtgttcgcgagcttctcgtacaatcagagatgtttccactcaacacgacagctcgtacactcatcgagcttggcggattcaagggaatcatcatttctggtggtcccaactcggtattcgaaccagaagccccgtcaatcgatccagaaatcttcacttgtggattgccagttcttggaatttgttacggatttcagttgatgaataagctcaatggaggaactgtaacaagagagcatatcagagaagacggagcatgtgaaattcaagtcgatacgagcgttcatttgttcaatggacttcacaaaacagaaactgtcttgctaactcacggagacagtgtatcagaggctacggtggctccagacttcaaagttatggccaaaagtggccatcatgttgctggaatttgtaacgagaaccgcaagctgtacggtgtccagtttcatccagaagtagatctcactaccaacggcacgaaaatgttcgagaatttccttttcaaagttgtcggatgctgtggaaatttcactattcaaaaccgtgagcaatcgtgtatttcggagatcaatagcattgtcggtgacaagaaggtactcgtaatggtgtctggaggtgtcgactcggctgtttgtgctgcgttgctccgtcgtgctcttggaccaaatcgggtcacagcaattcatattgacaatggattcatgcgtcatgaggagagtgatgctgttgagaagagtcttgcggcgcttgatcttccgattcacaggtataacttcggcacaacgttccgttccagtacagaacactgcaaggatggagaagttgcgttggatgagtgtgatgatccggagatgaagagaaaaatcattggaaatacatttattcgcgtaaaagatgtgattatgaaggacttgaatatcaatcatgatgaatatttccttgcacaaggaactctccgtccagatttaattgaaagtgcaagtgctcttgcttcgggacacgcggacactatcaaaactcatcacaatgacacatttttggtgcgagaactgagaaaactcggaaaagttgtggagccgctgaaagatttccacaaagatgaagtcagagagcttggaaaagatcttgggttgcctgaaagtattgtgcagagacatccattcccaggacctggtcttgcgattcgcattctttgtgcatcagataagaggccggagttgatgttcaacggtccgatgtataatggagatgtgcaaggaagaattatcgatgttactgagcagtttttaaattctgcaattaatccaagtcaaggaatttatgaacacctgcagttcgagcaggcacggaacaatgttctactatcactgtctgaaagagatcgccaactcgccgagcaacaaaccttccaaatcagtgctcacattcttccaatcaaaacagtcggtgttcaaggagatgccagatcctattcgtatgcagttgcactgtccaccgagcaacgaccaattccatggaaactcctgttcgcgtatgcttcagtcatcccgaagctgttccacggagtcaatcgagtcgtctacgcatttggatcaaaaatcgagttttcgatcgaggacctgacgagaacatatcttgtaccacacattgtcactaaacttcaaatggcggatcacatcgccaataatattctattcggacgtgtcgctgcttcggatggtacgcagctgccaaatgttgggcacaaaattcaacagatgccagtcgtccttctgcctgttgattttgatcgtgatagagatatgattggatcatacaggcactcgattgttcttcgtccgtttgtcacatcggactttatgactggtcaggctgcgattccaggagttcacttaccggaagagactcttattgaaatggacaaggccatcagaaccaatgttcttggtatctctcgtgttcttctggacatgacctgtaagccaccgggcaccaccgaatgggaataa

SEQ ID NO: 78920 - protein, 794 aa, Caenorhabditis elegans
MKFSSQVYPCSPKRVKIGARQSKRHCRNLPSELQRAKRTKAVSKVSEHTMKRSSSMLDINEDSQHSTNKAPPPKKAPEDRFDSANMNASGSHVTLVENLPVEKVSSGERIAILDFGAQYGKVIDRRVRELLVQSEMFPLNTTARTLIELGGFKGIIISGGPNSVFEPEAPSIDPEIFTCGLPVLGICYGFQLMNKLNGGTVTREHIREDGACEIQVDTSVHLFNGLHKTETVLLTHGDSVSEATVAPDFKVMAKSGHHVAGICNENRKLYGVQFHPEVDLTTNGTKMFENFLFKVVGCCGNFTIQNREQSCISEINSIVGDKKVLVMVSGGVDSAVCAALLRRALGPNRVTAIHIDNGFMRHEESDAVEKSLAALDLPIHRYNFGTTFRSSTEHCKDGEVALDECDDPEMKRKIIGNTFIRVKDVIMKDLNINHDEYFLAQGTLRPDLIESASALASGHADTIKTHHNDTFLVRELRKLGKVVEPLKDFHKDEVRELGKDLGLPESIVQRHPFPGPGLAIRILCASDKRPELMFNGPMYNGDVQGRIIDVTEQFLNSAINPSQGIYEHLQFEQARNNVLLSLSERDRQLAEQQTFQISAHILPIKTVGVQGDARSYSYAVALSTEQRPIPWKLLFAYASVIPKLFHGVNRVVYAFGSKIEFSIEDLTRTYLVPHIVTKLQMADHIANNILFGRVAASDGTQLPNVGHKIQQMPVVLLPVDFDRDRDMIGSYRHSIVLRPFVTSDFMTGQAAIPGVHLPEETLIEMDKAIRTNVLGISRVLLDMTCKPPGTTEWE

SEQ ID NO: 78921 - DNA, 1608 bp, Chlamydomonas reinhardtii
  CDS (1)..(1608)
atgtccgttgcttctgctcatcaacatgctgtggtccttatcctggactatggctcacagtacacacagctcattacgcgccgcgtgcgcgagctgagcatgttctcggtgctgttccctggcgacgcttcgctggaccgcatcaagggcgtgaacccccgcgtggtcatcctctccggcggccccaactcggtgcacgttgagggctccccccgcgtacccgatggcttcttcgagtactgcgccgagaagaacgtgcccgtgctgggtgtgtgctacggcatgcagatgattacccacctgcttggcggtgaggtcaagcccgccgtgcacggtggggagtatggccgcatgcccatggacatcgctccctcgtcccagctgtttgacttcctgagcagcagcaccgtcaatgtgtggatgagccacggtgatgaggctgtcaagctgcccgccggcttcactgccgtcgccaagagccaccagggcgccatcgtggccattgagaactcggagcgccgcatctacggcttccagttccaccccgaggtcatgcacacggagcacggcatggagatgatcaagcactttctcatcggcatcgccgcggtgcccgctgactggaacatgggccaagtgctggaggagcagatggccaagatcaaggcgcaggtgggccccgatgaccacgtcatctgcgcgctgtcaggcggcgtggactccaccgtggccgccacgctggtgcacaaggtcctgggtgaccgcctgcactgcgtgtttgtggacaacggcctgctgcgctacaacgagcaacaacgcgtgatggacacgttcaagaaccacctgcacctgcctgtgctgtgcgtggaccactccaagcccatgctggaccgcctgcgcggcctgtcggaccccgaggctaagcgcaaggccattggcgcggagttcattgaggtgttcaagaactatgccaacgagctggagaagacgctgggccgcaagcccaagtacctggtgcagggcaccttgtaccctgacgtgatcgagtcttgcccgccccccggcagcggccagaagcacagccacaccatcaagtcgcaccacaacgtgggcggtctgcccaaggacctgcagtttgagctggtggagccgttccgggagctgttcaaggacgaggtgcgcgccatcggccgcctgctgggcgtgcccgatcagttcatcaagcgccaccccttccccggccccggcctggcggtgcgcgtgattggtgacgtgacggaggacggcaagctggacacgctgcgtgaggtggacgagatcttcatcaacaccattcgcgagtacggcctttacgacgagatctggcaggcgttcgccgtgttcctgcccatcaagtcggtgggcgtgcagggcgaccagcgctcgcacgcgcacgtggtggcgctgcgcgcggtgacctcgggcgatggcatgaccgccgactggtacagcttcacgcccgctttcctgcgcgacgtgtccaaccgcatctgcaacaaggtccgctccgtaaaccgcgttgtctacgacatcacttccaagcccccgggcacaattgagtgggagtaa

SEQ ID NO: 78922 - protein, 535 aa, Chlamydomonas reinhardtii
MSVASAHQHAVVLILDYGSQYTQLITRRVRELSMFSVLFPGDASLDRIKGVNPRVVILSGGPNSVHVEGSPRVPDGFFEYCAEKNVPVLGVCYGMQMITHLLGGEVKPAVHGGEYGRMPMDIAPSSQLFDFLSSSTVNVWMSHGDEAVKLPAGFTAVAKSHQGAIVAIENSERRIYGFQFHPEVMHTEHGMEMIKHFLIGIAAVPADWNMGQVLEEQMAKIKAQVGPDDHVICALSGGVDSTVAATLVHKVLGDRLHCVFVDNGLLRYNEQQRVMDTFKNHLHLPVLCVDHSKPMLDRLRGLSDPEAKRKAIGAEFIEVFKNYANELEKTLGRKPKYLVQGTLYPDVIESCPPPGSGQKHSHTIKSHHNVGGLPKDLQFELVEPFRELFKDEVRAIGRLLGVPDQFIKRHPFPGPGLAVRVIGDVTEDGKLDTLREVDEIFINTIREYGLYDEIWQAFAVFLPIKSVGVQGDQRSHAHVVALRAVTSGDGMTADWYSFTPAFLRDVSNRICNKVRSVNRVVYDITSKPPGTIEWE

SEQ ID NO: 78923 - DNA, 1605 bp, Arabidopsis thaliana
  CDS (1)..(1605)
atggagacgccgacgatgaagcctgatacggttttgattcttgattacggctcccaatacacacatctcatcactcgccgtattcgttctctcaacgtcttctctctcgttatcagtggaacttcatcgctcaaatcaatcactagctataacccacgagttgttatcctctccggtggtcctcactctgttcacgcgctcgacgcgccgagtttccccgaggggtttatcgaatgggcagagtcgaacggtgtttctgttttggggatttgctatggtttgcaattgattgtgcagaagcttggtggtgttgttgtggaaggagagagcaaagagtatgggaaaatggagattgaagtgaaaggtaaatctgagatttttgggtcagagagtggtggtgagaagcaaatggtttggatgagtcatggtgatgaagcggttaagcttcctgaaggatttgaagttgtggctcagagtgctcaaggagctgttgctgctttggagagtcggaagaagaagatttatggattgcagtatcatcctgaggtgacacattcaccaaaaggaatggagacacttcggcatttcctctttgatgtgtgtggagtatctgcggattggaaaatggaagatctgatggaagaagagatcaaagtgattaacaaaaccgttgcatctgacgaacatgtcatttgcgccttgtcaggaggtgtagactctactgttgccgcaactcttgttcacaaggcaattggagataggcttcattgcatctttgttgataacgggctattaaggtataaggagcaagaacgtgtgatggatacctttgagagagacttgcatctacctgttacttgtgttgatgcatccgagcggtttttgagtgaacttaaaggcgttgtggatcccgagacaaagagaaagataatcgggggggagttcatcaacatttttgatcaatttgcccaagagttagagaaaaagcatgggaagaaacccgcttttctagttcaagggactctgtaccctgatgtgattgagtcgtgccctcccccgggtactgataggactcattctcacaccatcaaaagtcaccataatgttggaggactccctaaagacatgaaattgaagctcatcgaacccctcaagcttctcttcaaagatgaggttcgtgagctcggaagaatcttgaatgtgccggtagggttcttgaagcgtcacccattccccggtccaggactcgcagttagagtcttgggcgatgtcacccaaggaaacgcccttgaggttcttcgtcaggttgatgagatattcattcaatcaatcagagatgcgggtctctatgattcgatctggcaagctttcgcagtgttcttgcctgtaagatcagttggagtccaaggtgacaagagaacacattctcatgttgttgctcttcgtgcagttacaagccaagatggaatgaccgcagattggttcaattttgagcacaagtttctggacgatgtttcccggaaaatctgtaacagcgttcaaggagtaaaccgtgtggttctagacattacatcaaagcctccttcaaccatcgaatgggaataa

SEQ ID NO: 78924 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGGEFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 78925 - DNA, 2052 bp, Drosophila melanogaster
  CDS (1)..(2052)
atgaactcaaacatttttctgggcacagcagagaatggcctgcggcatgataagattgttatacttgatgcgggagcacagtacggcaaggttatcgaccgtaaggtacgcgaactcttcgttgagacggatatccttcctctggatacgccagctgccacgatacgcaacaatggctatcgaggcatcatcatctccggcggacccaactcagtctacgctgaggatgcgcccagctatgatcccgatctgttcaagctaaaaatacctatgctgggcatctgctacggcatgcagctaatcaacaaagagttcgggggcacagtgctcaagaaggatgttcgagaggatggccaacaaaatatcgagatcgagacctcgtgcccgctctttagtcgcctcagtcgcacacagtccgtgctgttaacccacggagatagcgttgagagggtaggcgagaatctgaagattggtggctggtctacaaaccgcattgtgacagccatttacaatgaagtactacgcatctacggcgtacagttccatcctgaggtggacctcactatcaatggcaaacagatgctatcgaacttcctgtacgaaatctgcgaactgacacctaactttaccatgggtagtcgaaaggaggagtgcatacgctatatccgtgagaaagtgggcaacaataaggtgttgctcctggtcagcggcggcgtggattcgagtgtctgtgcagctttgctccgccgtgctttgtaccctcatcagataattgccgtgcatgtagataatggtttcatgcgcaagaaggaaagtgaaaaggtggagcgttcactgcgcgatattggcattgatttaatcgtccgaaaagaaggctacacgttccttaaaggcaccacgcaggtcaagaggcccggacagtactccgtggtggaaacgccgatgttatgtcagacatacaatccggaggaaaaacgcaagataattggtgatatattcgtcaaggtgaccaatgatgtagtagccgaattgaaactaaagcccgaagaagttatgttggcccagggaaccctccgaccagatctgatcgagtccgcctctagcatggtgagcacgaatgcagaaacaatcaaaacgcaccacaatgacacggatctgatcagagagcttcgtaacgcaggacgtgtggttgagcccctttgcgactttcataaggatgaagtgcgcgaccttggcaatgatcttggcctgcctcaagagcttgtggagaggcaaccctttccgggtcctggcctggcaatccgcgtcctttgcgctgaggaggcatacatggaaaaggactactcagaaactcaggttattatccgcgtgattgtagactacaagaataaactgcagaagaaccatgctttgatcaaccgcgtaacggcggccacgagcgaggcggaacagaaagaccttatgcgtatctcatcgaactcgcagatccaggcaactttgctgcccatccgatcagtgggcgtgcaaggtgataaacggtcatatagctacgtagtaggcctatccacgagccaggagcccaactggcaggatcttctcttcctcgccaaaatcataccgcgaattctgcacaacgtgaacagggtgtgctatatcttcggcgaacccgtacagtatctagtgacggatattacgcacaccacactgaatactgtagttctttcgcagctgaggcaagccgatgatattgccaatgaaatcataatgcaagctggactataccggaagatctcgcagatgcctgttgttctcatacccgtgcactttgaccgcgatcccattaaccgcacaccctcgtgcagaaggtcggtagtgctgcgtccgttcataacgaacgactttatgactggtgtgccggctgagcccggatccgtgcaaatgcctttgcaagtcctaaatcaaattgtacgcgatatatccaagctggatggaatctcgagggtgctgtacgacttgacagccaagccgccgggcaccaccgaatgggaatga

SEQ ID NO: 78926 - protein, 683 aa, Drosophila melanogaster
MNSNIFLGTAENGLRHDKIVILDAGAQYGKVIDRKVRELFVETDILPLDTPAATIRNNGYRGIIISGGPNSVYAEDAPSYDPDLFKLKIPMLGICYGMQLINKEFGGTVLKKDVREDGQQNIEIETSCPLFSRLSRTQSVLLTHGDSVERVGENLKIGGWSTNRIVTAIYNEVLRIYGVQFHPEVDLTINGKQMLSNFLYEICELTPNFTMGSRKEECIRYIREKVGNNKVLLLVSGGVDSSVCAALLRRALYPHQIIAVHVDNGFMRKKESEKVERSLRDIGIDLIVRKEGYTFLKGTTQVKRPGQYSVVETPMLCQTYNPEEKRKIIGDIFVKVTNDVVAELKLKPEEVMLAQGTLRPDLIESASSMVSTNAETIKTHHNDTDLIRELRNAGRVVEPLCDFHKDEVRDLGNDLGLPQELVERQPFPGPGLAIRVLCAEEAYMEKDYSETQVIIRVIVDYKNKLQKNHALINRVTAATSEAEQKDLMRISSNSQIQATLLPIRSVGVQGDKRSYSYVVGLSTSQEPNWQDLLFLAKIIPRILHNVNRVCYIFGEPVQYLVTDITHTTLNTVVLSQLRQADDIANEIIMQAGLYRKISQMPVVLIPVHFDRDPINRTPSCRRSVVLRPFITNDFMTGVPAEPGSVQMPLQVLNQIVRDISKLDGISRVLYDLTAKPPGTTEWE

SEQ ID NO: 78927 - DNA, 2163 bp, Drosophila melanogaster
  CDS (1)..(2163)
atgaactcaaacatttttctgggcacagcagagaatggcctgcggcatgataagattgttatacttgatgcgggagcacagtacggcaaggttatcgaccgtaaggtacgcgaactcttcgttgagacggatatccttcctctggatacgccagctgccacgatacgcaacaatggctatcgaggcatcatcatctccggcggacccaactcagtctacgctgaggatgcgcccagctatgatcccgatctgttcaagctaaaaatacctatgctgggcatctgctacggcatgcagctaatcaacaaagagttcgggggcacagtgctcaagaaggatgttcgagaggatggccaacaaaatatcgagatcgagacctcgtgcccgctctttagtcgcctcagtcgcacacagtccgtgctgttaacccacggagatagcgttgagagggtgggcgagaatctgaagattggtggctggtctacaaaccgcattgtgacagccatttacaatgaagtactacgcatctacggcgtacagttccatcctgaggtggacctcactatcaatggcaaacagatgctatcgaacttcctgtacgaaatctgcgaactgacacctaactttaccatgggtagtcgaaaggaggagtgcatacgctatatccgtgagaaagtgggcaacaataaggtgttgctcctggtcagcggcggcgtggattcgagtgtctgtgcagctttgctccgccgtgctttgtaccctcatcagataattgccgtgcatgtagataatggtttcatgcgcaagaaggaaagtgaaaaggtggagcgttcactgcgcgatattggcattgatttaatcgtccgaaaagaaggctacacgttccttaaaggcaccacgcaggtcaagaggcccggacagtactccgtggtggaaacgccgatgttatgtcagacatacaatccggaggaaaaacgcaagataattggtgatatattcgtcaaggtgaccaatgatgtagtagccgaattgaaactaaagcccgaagaagttatgttggcccagggaaccctccgaccagatctgatcgagtccgcctctagcatggtgagcacgaatgcagaaacaatcaaaacgcaccacaatgacacggatctgatcagagagcttcgtaacgcaggacgtgtggttgagcccctttgcgactttcataaggatgaagtgcgcgaccttggcaatgatcttggcctgcctcaagagcttgtggagaggcaaccctttccgggtcctggcctggcaatccgcgtcctttgcgctgaggaggcatacatggaaaaggactactcagaaactcaggttattatccgcgtgattgtagactacaagaataaactacagaagaaccatgctttgatcaaccgcgtaacggcggccacgagcgaggcggaacagaaagaccttatgcgtatctcatcgaactcgcagatccaggcaactttgctgcccatccgatcagtgggcgtgcaaggtgataaacggtcatatagctacgtagtaggcctatccacgagccaggagcccaactggcaggatcttctcttcctcgccaaaatcataccgcgaattctgcacaacgtgaacagggtgtgctatatcttcggcgaacccgtacagtatctagtgacggatattacgcacaccacactgaatactgtagttctttcgcagctgaggcaagccgatgatattgccaatgaagtaagtggatttgtcatagaaataaataaaatgtattatatcataaccgttttagatcataatgcaagctggactatacggaagatctcgcagatgcctgttgttctcatacccgtgcactttgaccgcgatcccattaaccgcacaccctcgtgcagaaggtcggtagtgctgcgtccgttcataacgaacgactttatgactggtgtgccggctgagcccggatccgggcaaatgcctttgcaagtgagtcagttttcaatctttctgaaaaatgtatatttaatcttttcctgctcaaaggtcctaaatcaaattgtacgcgatatatccaagctggatggaatctcgagggtgctgtacgacttgacagccaagccgccgggcaccaccgaatgggaatga

SEQ ID NO: 78928 - protein, 720 aa, Drosophila melanogaster
MNSNIFLGTAENGLRHDKIVILDAGAQYGKVIDRKVRELFVETDILPLDTPAATIRNNGYRGIIISGGPNSVYAEDAPSYDPDLFKLKIPMLGICYGMQLINKEFGGTVLKKDVREDGQQNIEIETSCPLFSRLSRTQSVLLTHGDSVERVGENLKIGGWSTNRIVTAIYNEVLRIYGVQFHPEVDLTINGKQMLSNFLYEICELTPNFTMGSRKEECIRYIREKVGNNKVLLLVSGGVDSSVCAALLRRALYPHQIIAVHVDNGFMRKKESEKVERSLRDIGIDLIVRKEGYTFLKGTTQVKRPGQYSVVETPMLCQTYNPEEKRKIIGDIFVKVTNDVVAELKLKPEEVMLAQGTLRPDLIESASSMVSTNAETIKTHHNDTDLIRELRNAGRVVEPLCDFHKDEVRDLGNDLGLPQELVERQPFPGPGLAIRVLCAEEAYMEKDYSETQVIIRVIVDYKNKLQKNHALINRVTAATSEAEQKDLMRISSNSQIQATLLPIRSVGVQGDKRSYSYVVGLSTSQEPNWQDLLFLAKIIPRILHNVNRVCYIFGEPVQYLVTDITHTTLNTVVLSQLRQADDIANEVSGFVIEINKMYYIITVLDHNASWTIRKISQMPVVLIPVHFDRDPINRTPSCRRSVVLRPFITNDFMTGVPAEPGSGQMPLQVSQFSIFLKNVYLIFSCSKVLNQIVRDISKLDGISRVLYDLTAKPPGTTEWE

SEQ ID NO: 78929 - DNA, 1668 bp, Plasmodium falciparum
  CDS (1)..(1668)
atggaaggagaggaatatgacaagattttggtattgaatttcggttctcaatacttccatttgattgttaaaagattaaaccatattaaaatatttagtgaaactaaagattatggtgttgaattaaaagatattaaggatatgaatataaaaggtgttatattatctggtggtccatattcagtaacagaggctggttctccacatttaaagaaagaagtgtttgaatattttttagaaaagaagattccaatttttggtatatgttatggtatgcaagagatagcagtacagatgaatggtgaggttaagaaatctaagacatccgaatatggatgtactgatgtaaacatattaagaaatgataatattaataatataacatattgtagaaattttggtgatagttcatctgctatggatttatattctaattataaattaatgaatgagacttgttgtttatttgaaaatattaaaagtgacataacaacggtttggatgaatcataatgatgaagttacaaaaattccagaaaatttttatttagttagctcaagtgaaaattgtttaatatgttctatatataataaagaatataatatatatggtgttcaatatcatccagaggtgtatgaatcattagatggagaattaatgttttataactttgcttataatatatgtaaatgtaaaaaacaatttgatccaatacgttatcatgaattagaattaaaaaatattgagaaatataaacatgatcattatgttatagcagccatgtctggaggtatagatagtactgttgctgctgcatatacacataaaatttttaaagaacgattttttggtattttcatagataatggattattaagaaaaaatgaagcggaaaatgtttatacctttttaaaatctacatttcctgatatgaatataacaaaaattgatgcttctgaaaatttcctatcaaatctacaaggagttacagatcccagaacaaaaaaggaaaattataggggaaattatttattgaagaatttgaaaaggcgtaaatatattgatatagaatataaacaaacatttttattacaaggtactctatatccagatattattgaaagtaaatgttcaaaaaatttatcagatactattaaaactcatcataatgtaggaggcttaccaaaaaatttaaaatttaaattgtttgaacctttcaaatatttatttaaagatgatgttaaaacattatctagagaattaaatttaccagaagaaattactaatagacatcctttcccaggacctggattagcgatcagagttattggagaaataaataaacacaaattaaatatattaagagaagttgatgatatttttataaacgatttaaaacaatatggattatataatcaaatcagtcaagcttttgctgtacttttatcatcaaaatctgtaggtgtaagaggtgatgcaaggtcatatgattatgtttgtgttcttagagctgtcaaaacatcatcttttatgacagcaaattggtatcaaataccttatgatattctcgataaaataactactagaatattgagtgaagtaaagggcgtcaacagaatattatatgatgtatcatcaaaaccaccagcaacgattgaattcgaatga

SEQ ID NO: 78930 - protein, 555 aa, Plasmodium falciparum
MEGEEYDKILVLNFGSQYFHLIVKRLNHIKIFSETKDYGVELKDIKDMNIKGVILSGGPYSVTEAGSPHLKKEVFEYFLEKKIPIFGICYGMQEIAVQMNGEVKKSKTSEYGCTDVNILRNDNINNITYCRNFGDSSSAMDLYSNYKLMNETCCLFENIKSDITTVWMNHNDEVTKIPENFYLVSSSENCLICSIYNKEYNIYGVQYHPEVYESLDGELMFYNFAYNICKCKKQFDPIRYHELELKNIEKYKHDHYVIAAMSGGIDSTVAAAYTHKIFKERFFGIFIDNGLLRKNEAENVYTFLKSTFPDMNITKIDASENFLSNLQGVTDPRTKKENYRGNYLLKNLKRRKYIDIEYKQTFLLQGTLYPDIIESKCSKNLSDTIKTHHNVGGLPKNLKFKLFEPFKYLFKDDVKTLSRELNLPEEITNRHPFPGPGLAIRVIGEINKHKLNILREVDDIFINDLKQYGLYNQISQAFAVLLSSKSVGVRGDARSYDYVCVLRAVKTSSFMTANWYQIPYDILDKITTRILSEVKGVNRILYDVSSKPPATIEFE

SEQ ID NO: 78931 - DNA, 1308 bp, Bacteroides thetaiotaomicron
  CDS (1)..(1308): transl_table=11
atgaaacaggacatgattgttatccttgacttgggtagtcacgagaatacggtattggcgcgcgccatccgtgcattaggagtttatagtgagatttatcctcacgacatcacagtagaagaactgaaagcattgcccaacgtaaagggtattattatcaatggtggactgaacaacgtgatcgacggtgttgctattgacgtgaatccgtctatttatacgatggggattcctgttatggctgccggtcacgataaagcgacttgcgcagtgaagcttccggcatttacagatgatatcgaggctattaaggctgctataaagtctttcgtatttgatacttgtcaggctgaagctaactggaatatggcgaactttgtcaatgaccagatcgagctgatcagacgtcaggtgggtgataagaaagtattgctggcattgtcgggtggtgttgacagctcagtggtagctgctttacttttgaaggcaatcggtgaaaatttggtatgcgtgcacgtaaatcacggcttgatgcgtaaaggtgagtctgaagatgttgttgaagtattcagcaaccaattgaaagcaaatctggtttatgtagatgtaacagaccgcttcctggataaattggcaggtgtggaagatcccgaacagaaacgtaagattatcggtggtgagtttatccgtgtgttcgaagaagaagcacgtaaactggatggtatcgatttcttaggtcagggtactatttatccggatattgtagagagcggaacgaagactgccaagatggtgaaatctcatcataatgtaggcggtctgcctgaagatcttaagttccagcttgtagagcccttgcgccagttgttcaaggatgaagtgcgtgcttgtggtctggagttggggttgccttatgagatggtttaccgtcagccgttccccggtcctggtttaggtgtacgttgtctgggtgctatcacacgcgatcgtctggaagcagtacgtgagtctgacgccattttgcgtgaagaattccagattgccggcctggataaaaaggtatggcaatactttaccgtagtgcctgactttaaatctgttggtgtacgcgataatgcccgttctttcgattggccggtgattatccgcgctgtcaatacggtagatgctatgacagctactattgaaccggtagactggcctatcctgatgaaaatcacagaccgtattctgaaagaagtgaagaatgtgaatcgtgtttgctatgatatgtcgccgaaacctaatgcgactattgaatgggaataa

SEQ ID NO: 78932 - protein, 435 aa, Bacteroides thetaiotaomicron
MKQDMIVILDLGSHENTVLARAIRALGVYSEIYPHDITVEELKALPNVKGIIINGGLNNVIDGVAIDVNPSIYTMGIPVMAAGHDKATCAVKLPAFTDDIEAIKAAIKSFVFDTCQAEANWNMANFVNDQIELIRRQVGDKKVLLALSGGVDSSVVAALLLKAIGENLVCVHVNHGLMRKGESEDVVEVFSNQLKANLVYVDVTDRFLDKLAGVEDPEQKRKIIGGEFIRVFEEEARKLDGIDFLGQGTIYPDIVESGTKTAKMVKSHHNVGGLPEDLKFQLVEPLRQLFKDEVRACGLELGLPYEMVYRQPFPGPGLGVRCLGAITRDRLEAVRESDAILREEFQIAGLDKKVWQYFTVVPDFKSVGVRDNARSFDWPVIIRAVNTVDAMTATIEPVDWPILMKITDRILKEVKNVNRVCYDMSPKPNATIEWE

SEQ ID NO: 78933 - DNA, 1539 bp, Aeropyrum pernix
  CDS (1)..(1539)
atggctaaaaccctggattcccccggcgtcttggtcgttgatttcggaggccagtacgcccaccttattgctcgtcggataagggagcttggtgtgtacagcgagattgtgccggctacaagcctcgatgctctgggggaggctcttccacgcgccgccggagttgtcttgagcggcgggcctggcagcgtctgggggtcacgtcacgacgaggcggcggccatggttctccaactcggcaagccggtccttggtatatgctatggacatcagctgctcgccaaagtcctgggaggcgaggtgggtaggagccccctgccagagtttgggcctacagaggttgaggtcctcgattacggcatcctgttaaacggcctcccatccaggtttaaggtttggatgagccattacgacgcggttctaaggccccccggagaggctaaagtgttagccagaaccccgggaagccctgtagcggccatggagctgtggggccgcgtgtttggtgtgcagtggcatcccgaggtcaggcatacccagtatggtagggaggtcctcgacaactggctctcgcttgtgggcgcgcctaggacctggaggcctggggatatggtatccgagctggtggagagcgttaagaaggaggttggtgacgccctggctgtggctgcggtgagcggaggtgtcgacagtactgtggcagctcttattgccaagaaagctataggaagtaggctttacccggtattcatagatcatgggctgcatcccgagggggaggttgaaagggttgtgaaactgctttccagacttggtttagagcctgttatggtcgatgcaggggaagagtttctcgctgctctagaaggcgtgggagatcccgaggagaagaggcgtgttgtggggcgggtttacgccgaggttctagagcgggcggctcgagatataggagccgaatatctagtacaggggactatatatccggatgttatagaaagcggggcaagaccgggggcggacaccataaagacacaccacaacgtgggagggctgccgaaagacatgaggctgaagctagtggagcctcttaggtatttctacaaggatgaggtaaggcttctggcagagaagctcggggtccctagggagctaatatggaagcagcctgtacccggtccggggctagccgtcagggtggaggggcctataacgcgggagaagctgagaatagtcaggcgtgccgacgctatagttagagaggaggttgaggctgctgggctaggtggtaagctctggcagtacttcgcagttctcacggcttcaatggcgacgggcgttaggggggactccaggagctatggctatgtagtcgccgtgagggctgtggaaagcgtggacgccatgacggccaaaccggctgaactgccctggtggcttcttgagaggatcgcccggcgtataactagtgagatacctgaggttgtcagggtggtttacgacataaccagcaagcccccctctacgatagagtgggagtag

SEQ ID NO: 78934 - protein, 512 aa, Aeropyrum pernix
MAKTLDSPGVLVVDFGGQYAHLIARRIRELGVYSEIVPATSLDALGEALPRAAGVVLSGGPGSVWGSRHDEAAAMVLQLGKPVLGICYGHQLLAKVLGGEVGRSPLPEFGPTEVEVLDYGILLNGLPSRFKVWMSHYDAVLRPPGEAKVLARTPGSPVAAMELWGRVFGVQWHPEVRHTQYGREVLDNWLSLVGAPRTWRPGDMVSELVESVKKEVGDALAVAAVSGGVDSTVAALIAKKAIGSRLYPVFIDHGLHPEGEVERVVKLLSRLGLEPVMVDAGEEFLAALEGVGDPEEKRRVVGRVYAEVLERAARDIGAEYLVQGTIYPDVIESGARPGADTIKTHHNVGGLPKDMRLKLVEPLRYFYKDEVRLLAEKLGVPRELIWKQPVPGPGLAVRVEGPITREKLRIVRRADAIVREEVEAAGLGGKLWQYFAVLTASMATGVRGDSRSYGYVVAVRAVESVDAMTAKPAELPWWLLERIARRITSEIPEVVRVVYDITSKPPSTIEWE

SEQ ID NO: 78935 - DNA, 1578 bp, Agrobacterium tumefaciens
  CDS (1)..(1578): transl_table=11
atgacccagatagcccatcccgacagcattctcatcatcgatttcggcagccaggtgacgcagctgattgcgcgccgcatccgcgaagccggggtctattgcgaaatccacccgttccagaatgccgcagaggctttcgagaagcttcagcccaagggcgtgatcttctccggcggccccgcatccgtaacggctgaaggcagcccgcgcgcgccgcaggcggtgttcgacagcaaggttccgatcctcggcatctgctacggccagcagacgctctgcacgcagctcggcggtgtggtcgaaggtggccacgcggcggaattcggccgtgcggatatcgatatcaagaaggctagcccgctgttcgaaggtttctgggaacagggcaagagctacccggtgtggatgagccatggcgaccgcgtaacaaagctgccggaaggtttcgaggtcatcgcgacctccgagaacgctcctttcgccatcgcggctgacgagaagcgtcactattacaccaccatgttccacccggaggtggtgcatacgcctgacggcggcaagctgctctccaatttcgtgcacaagatcgtcggcctcaaatccgactggacgatggctgcctaccgcgccgagatgatccgcaagatccgcgagcaggtcggcactggccgggtgctctgcgcactttccggcggcgtcgattcctcggttgcagccattctcattcatgaggcgatcggtgatcagctgacctgcgtttatgtcgaccacggcctgatgcggcttggcgaaagcgagcaggtcgtcggcatgttccgcgatcactacaatattccgcttgttcacgtcgacgccgccgatctgttcctcggcgaattgtctggcgtttccgatccggaagtgaagcgcaagaccatcggccgcctgttcatcgaggtgttcgaagctgaggcggccaagattgccgccgatggcaagggtgcgcccaagttcctcgctcagggcacgctttaccctgacgtcatcgaaagtgtatccttctccggtggcccttcggtcaccatcaagagtcaccacaatgtcggtggccttcccgagcgcatgaacatgcagctcgtcgagccgctgcgtgaactcttcaaggatgaagtgcgcgcacttggccgcgaactcggcctgccggaaagcttcatcggtcgtcatcccttccccggtccaggtctcgcgatccgctgcccgggcgcgatcactcgtgagaagctcgatatcctgcgcaaggcggatgcgatctatctcgacgaaatccgcaaggccggtctctacgataccatctggcaggcctttgccgtgctgctgccggtgcagaccgtgggcgtgatgggcgactaccgcacctacgacttcgtctgcgcgctgcgcgccgtgacgtcagtggatggcatgacggcggatttctatccctacgacatgaacttcctcggtcgtgcggcaacccgcatcatcaacgaagtgcgcggcattaaccgtgtggtctacgacgtgacgagcaagccgcccggcacgatcgagtgggagtaa

SEQ ID NO: 78936 - protein, 525 aa, Agrobacterium tumefaciens
MTQIAHPDSILIIDFGSQVTQLIARRIREAGVYCEIHPFQNAAEAFEKLQPKGVIFSGGPASVTAEGSPRAPQAVFDSKVPILGICYGQQTLCTQLGGVVEGGHAAEFGRADIDIKKASPLFEGFWEQGKSYPVWMSHGDRVTKLPEGFEVIATSENAPFAIAADEKRHYYTTMFHPEVVHTPDGGKLLSNFVHKIVGLKSDWTMAAYRAEMIRKIREQVGTGRVLCALSGGVDSSVAAILIHEAIGDQLTCVYVDHGLMRLGESEQVVGMFRDHYNIPLVHVDAADLFLGELSGVSDPEVKRKTIGRLFIEVFEAEAAKIAADGKGAPKFLAQGTLYPDVIESVSFSGGPSVTIKSHHNVGGLPERMNMQLVEPLRELFKDEVRALGRELGLPESFIGRHPFPGPGLAIRCPGAITREKLDILRKADAIYLDEIRKAGLYDTIWQAFAVLLPVQTVGVMGDYRTYDFVCALRAVTSVDGMTADFYPYDMNFLGRAATRIINEVRGINRVVYDVTSKPPGTIEWE

SEQ ID NO: 78937 - DNA, 1533 bp, Aquifex aeolicus
  CDS (1)..(1533): transl_table=11
atgcagagaagacctatactcgtcgttaatttcggttctcaatacgttcagctcatcgcaagaagggtaagggagcttggtgtttacagtgaaattgtccactgggacacccctgtggaagaaattaagaagaaaaatccctacgggattatattctcgggaggtcccgcatccgtttacgccgagggtgctcccctacccgacaaaaggatttacgagctcggtgttcccatacttgggatttgttacgggcttcaagtgattacacaccagcttggcggtaaagtagttcgctctgaaaagcaggagtacggaagggcgagactcaggattattaaggaagatgtgatatttgagggtataccgaaggagagtgatgtgtggatgtcccacgcggacaaggttgtagagcttccagagggctttgaggttctggcggtatccgaaaactccccctacgcggttatagcaaacagggagaagaaaatttacggctttcaattccaccctgaggtcacgcacacagtcttcggaaaggagatgctcgcaaactttatatacggcgtatgcaaggcggaaaagaactgggaaatgggtgacttcatccatgagaaaatagaggagataaggaagaccgtgggagacgctaaggtgatagccgcgctctcagggggggtggattctacggtagccgcggttttaacccacagggctataggagataaacttcactgcttctttatagaccacggactcttgaggtacaaagagagggaagaagttgagaagaacttaaggtccttgggccttcctctcacggtcgtggacgcctcggaagagttcctcgaaaaattaaaaggcgttgaggatccagaagaaaagagaaagataatagggagaacctttatagaagtctttgagagggaggctaaaaagatagagggtgcggagttcttacttcagggaaccctttaccctgacgttgtggaaagtgccggaataaagggaagtgctaagataaagactcaccacaacgtgggcgggcttcccgagcgaatgaacttaaaactacttgaacctttcagggaactctttaaagacgaggtgagaaaaatcgggaaacttctcggcgttcccgaggaaatcctcaggagacatcccttcccaggtcccggactcgccataaggattatcggtgaggtgaataaaaaggacttagaaatcctgaggaaggcggattacatattcatacaggaactaaaaaaggaagggctttacgacagagtctggcaggctttcgctgttctacttcccgtgaaatccgtgggtgttatgggagatgttagaacttacgagaaagtcgtagccctcagggctgttgagagtgtggacggtatgacagcggattgggcgagacttccctacgacttcctggacagggttatgagaaggataataaacgaagtggaaggggtgaacagggttgtttacgacatatcctcaaaacccccttctaccatagagtgggagtaa

SEQ ID NO: 78938 - protein, 510 aa, Aquifex aeolicus
MQRRPILVVNFGSQYVQLIARRVRELGVYSEIVHWDTPVEEIKKKNPYGIIFSGGPASVYAEGAPLPDKRIYELGVPILGICYGLQVITHQLGGKVVRSEKQEYGRARLRIIKEDVIFEGIPKESDVWMSHADKVVELPEGFEVLAVSENSPYAVIANREKKIYGFQFHPEVTHTVFGKEMLANFIYGVCKAEKNWEMGDFIHEKIEEIRKTVGDAKVIAALSGGVDSTVAAVLTHRAIGDKLHCFFIDHGLLRYKEREEVEKNLRSLGLPLTVVDASEEFLEKLKGVEDPEEKRKIIGRTFIEVFEREAKKIEGAEFLLQGTLYPDVVESAGIKGSAKIKTHHNVGGLPERMNLKLLEPFRELFKDEVRKIGKLLGVPEEILRRHPFPGPGLAIRIIGEVNKKDLEILRKADYIFIQELKKEGLYDRVWQAFAVLLPVKSVGVMGDVRTYEKVVALRAVESVDGMTADWARLPYDFLDRVMRRIINEVEGVNRVVYDISSKPPSTIEWE

SEQ ID NO: 78939 - DNA, 1548 bp, Bacillus cereus
  CDS (1)..(1548): transl_table=11
gtgattattttgaagaaacaacacgatacaattatcgttttagattttggaagtcaatacaatcagttaatagcacgtcgaattcgtgagttcggtgtatacagtgaacttcatccacatacaattactgcagaagaaattaaagcaatgaacccaaaagggattattttctctggtggaccaaatagtgtatacggtgaaggtgcattacattgtgatgaaaaaatctttgaactaggtttaccaatcttcggtatttgttacggtatgcagcttatgacgcaacaattcggtggtaaagtagagcgtgcaaatcaccgtgagtacggaaaagctgttcttaaagtagagaacgaatcaaaattatatgcgaaccttccagaagagcaagttgtatggatgagccatggcgacttagtaactggtttacctgaaggattcgtagtagatgcaacaagtgagtcttgcccaattgctggtatgagcaatgaagcgaaaaacttatacggtgtacaattccacccagaagtacgtcactctgagcacggtaacgatttaattaaaaacttcgtattcggtgtatgtggttgttctgaaggatggaacatggagaactttattgaagtagaattagaaaagattcgtgaaactgttggagacaaaaaagtactatgcgcacttagtggcggtgtagactcttctgttgtagcagtattaattcataaagcaattggtgatcaattaacatgtattttcgttgaccacggtttacttcgtaaaggtgaagcagaaggcgttatgaaaacatttagcgaaggcttccatatgaacgttattaaagtggatgcaagagaccgcttcatggacaagttaaaaggtgtagaagatccagaacaaaaacgtaaaatcatcggtaacgaattcatttacgtatttgatgatgaagcgtcaaaattacaaggtatggacttcttagcgcaaggtacactttacacagatatcgttgagagtggtacagcaactgcgcaaacaattaaatctcaccataacgttggtggacttccagaagacatgcagttcaaattaattgagcctttaaacacgttatttaaagacgaagtacgtgtattaggatctgaattaggaattcctgatgaaatcgtatggcgtcaaccattcccaggaccgggtcttggtattcgtgtattaggtgaaatcacagaagagaaattagaaatcgttcgtgaatctgatgcgattttacgtgaagaaattattaaagcgggcttagaccgtgaaatctggcaatacttcactgcgcttcctggtatgcgtagcgtaggtgttatgggtgacgagcgtacttacgattacacagtaggtatccgtgcggtaacatctatcgacggtatgacagctgactgggcacgtatcccttgggacgtattagagaaaatctctgtacgtatcgtaaacgaagtaaaacacgttaaccgtatcgtgtatgatgtaacgagtaagccaccagcaactattgagtgggaatag

SEQ ID NO: 78940 - protein, 515 aa, Bacillus cereus
MIILKKQHDTIIVLDFGSQYNQLIARRIREFGVYSELHPHTITAEEIKAMNPKGIIFSGGPNSVYGEGALHCDEKIFELGLPIFGICYGMQLMTQQFGGKVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDARDRFMDKLKGVEDPEQKRKIIGNEFIYVFDDEASKLQGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 78941 - DNA, 1521 bp, Bdellovibrio bacteriovorus
  CDS (1)..(1521): transl_table=11
atgcgtggttttgtcattcttgattttggttcccagttcacacaattgattgcccgtcgtctgcgcgagatgggtttttattcagaaattcattccttcgaatatcccacggaagaaatccgtaagaaaaatccttacggcatcatcttaagcggcggtccgaattcagtttatgaagccggttcaccgcaaagaaatgtggctgaacttcgtaacataagtcctgtgatgggcgtttgttatggaatgcagcttttgactcaccagttaggcggcaaggtgactcgcgctgaacaccgtgagtatggtctgaattatgtaacatggtccagtccggtccagggtgttcctgaaagacaaaaagtttggatgagtcacggcgacgtggttgaaaaagcccccgagggttttaaaatcatcgcaaattccgacggccatcatcccgcagccatgcagggtcccggcgttttggcggtgcagttccatcccgaggtggcgcacaccgatcacggaatggatctgttgaaatatttcgcgcaaggcatgtgtaaagctccggcggactgggatgctcctcacatcaaggatattttgatcaaggaagcgcaagacaaagtcggacctacggatcatgttctggtgggtttaagtggcggcgttgattccacggtggtggcgactctgctgaccaaggctttgggtgctgagcgtgttcactgcgtgtttgttgataacggtcttttgcgtaaaaacgagtacgaagcagtgcttgagtcttatcatcgcattgggctgaatgtgcgcggtgtggatgcttctgaagagtttctttcagcccttcaaggaaagtctgatcctgaagacaagcgtaaaaccatcggacgtgtgtttattgaagtctttgataaaagctatgatcacaaacttccgatcaaatggctggcgcaaggaacactttatccggatgtgattgaaagtgtgtcgtcagtgggcggcagtgtgaccatcaagtcgcaccacaatgtgggtggtctgccggaaaaaatgaaattgggtctggtggagccagttcgcgaattgttcaaagatgaagtgcgcgctctgggggcacagcttggacttccaaaagaaatgctgtggcgtcatccgttcccggggccgggcttggcaattcgtgtgttgggtgaagtgacgaaagaaaaactgcaaattcttaaagaagcagatgatgtttatatttcagaacttcgccgccgcggcctttacgaaaaaatctggcaggcgttctgtgttttgcttccggtaaaaaccgtgggcgtgcagggggactccagaacttacgatcacgttctggccttgcgtgcagtcacctccagtgacggcatgaccgcagactggtatcctttcgaattccagttcctgcgtgaggtctccaatctgatcactaacaaagtcaaaggcgtcaaccgcgtcgtctacgacgtcaccagcaaaccccccggcaccatcgagtgggaataa

SEQ ID NO: 78942 - protein, 506 aa, Bdellovibrio bacteriovorus
MRGFVILDFGSQFTQLIARRLREMGFYSEIHSFEYPTEEIRKKNPYGIILSGGPNSVYEAGSPQRNVAELRNISPVMGVCYGMQLLTHQLGGKVTRAEHREYGLNYVTWSSPVQGVPERQKVWMSHGDVVEKAPEGFKIIANSDGHHPAAMQGPGVLAVQFHPEVAHTDHGMDLLKYFAQGMCKAPADWDAPHIKDILIKEAQDKVGPTDHVLVGLSGGVDSTVVATLLTKALGAERVHCVFVDNGLLRKNEYEAVLESYHRIGLNVRGVDASEEFLSALQGKSDPEDKRKTIGRVFIEVFDKSYDHKLPIKWLAQGTLYPDVIESVSSVGGSVTIKSHHNVGGLPEKMKLGLVEPVRELFKDEVRALGAQLGLPKEMLWRHPFPGPGLAIRVLGEVTKEKLQILKEADDVYISELRRRGLYEKIWQAFCVLLPVKTVGVQGDSRTYDHVLALRAVTSSDGMTADWYPFEFQFLREVSNLITNKVKGVNRVVYDVTSKPPGTIEWE

SEQ ID NO: 78943 - DNA, 1608 bp, Bifidobacterium longum
  CDS (1)..(1608)
atgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcacgttcgagaaggcccagcgccaagtgcttgaagaggccggcgcgcgcggcaaggaagtcaagttcctcgtgcagggcaccctctaccccgacgtcgtcgaatccggcggcggcgacggcgcggccaacatcaagtcccaccacaacgtcggtggcctgcctaaggacatcaagttccagctcatcgaaccgctgcgcaccctgttcaaggacgaggtgcgcgccatcggaaccgaactcggactgccggatgagatcgtctggcgccagcccttccccggcccgggtctgggcatccgtatcatcggcgagatcaccaaggagcgtctcgacctgttgcgcgaggccgacgccatcgcccgcgaggagctctccaaggccggcctcgaccgtgacatctggcagtgcccggtcgtgctgctcgccgacgttcactcggttggcgtccaaggcgacgagcgcacctacggctcccccatcgtgctgcgtccggtgagctcggaggacgccatgaccgccgactggtctcgcgtgccctacgacgtgctcgccacgatctccacgcgcatcaccaacgaatgccgacagatcaaccgcgtcgttctcgattgcacgagcaagcctccggccacaattgaatgggagtaa

SEQ ID NO: 78944 - protein, 535 aa, Bifidobacterium longum
MFSPRKIPMNVRGISMANGPVLVVDFGAQYAQLIARRVREAGVYSELVPHSMPVDEILAKDPKAIILSGGPASVFEPGAPTIDTKVFESGVPVLGICYGFQVMAYELGGKVDKAALGEYGKTSATIDDAAGILADSPAEQTTWMSHGVAVEQAPAGFEVLAHTEGAPVAAMADESRKLYGVQWHPEVKHSPLGQKLIENFLHRCAALPNDWDASSIIEDQVKKIREQVGDAEVICGLSGGVDSAVAAALVHKAIGDQLTCVFVDHGLLRKGEVEQVKHDFVAATGIRLITVDAADDFLDALAGVSEPERKRKIIGEKFIRTFEKAQRQVLEEAGARGKEVKFLVQGTLYPDVVESGGGDGAANIKSHHNVGGLPKDIKFQLIEPLRTLFKDEVRAIGTELGLPDEIVWRQPFPGPGLGIRIIGEITKERLDLLREADAIAREELSKAGLDRDIWQCPVVLLADVHSVGVQGDERTYGSPIVLRPVSSEDAMTADWSRVPYDVLATISTRITNECRQINRVVLDCTSKPPATIEWE

SEQ ID NO: 78945 - DNA, 1593 bp, Bordetella pertussis
  CDS (1)..(1593): transl_table=11
atgcaccagcgcatcctcattcttgactacggttcgcaagtcacccagctgatcgcccgccgcgtccgcgaagccggcgtctactccgaaatccacgccggcgacgtcgacgatgccttcgtgcgcgaccaggtcgcgcagggcctcaagggcatcatcctctcgggcagccacgcgtcggcctacgaagaaggctcgatgcgcgtgccggcggccgtgttcgacgtgggcgtgcccgtgctgggcatctgctacggcatgcagtccatggcgcaacagctgggcggcaccgtcagcttcagcgaccaccgcgaattcggctacgccgaagtgcgcgcccatggccacaccaaactgctcgacggtctggccgacttcaccaccgacgaaggccacggcatgctcaaggtgtggatgagccatggcgacaaggtcaccgaactgccgcccggcttcaagctgatggcctccaccgcctcgtgccccatcgccggcatggccgatgaaagccgcggcttctacgccgtgcagttccaccccgaagtcacccacaccgtccagggcaaggccatgctggcgcgcttcgtcaaggacatctgcggctgcgagggcgactggaacatgcccgactacatctcggaagcggtcgcccgcatccgcgaacaggtcggcagcgacgaagtcatcctcggcctgtccggcggcgtcgactcctcggtggccgccgcgctcatccaccgcgccatcggcgaccagctcacctgcgtcttcgtcgaccacggcctgctgcgactggacgaaggcaaacaggtcatgcagaccttcaccgagaacatgggcgtcaagatcgtccacgtcgacgccaccagccagttcatgggcaagctgaccggcgtcgccgaccccgaagccaagcgcaagatcatcggccgcgaattcgtcgaagtctttcaggacgaagccggcaagctgcaaggcgccaaatggctggcgcaaggcaccatctaccccgacgtcatcgaatcggccggcgccaagaccggcaaggccacctcgatcaaatcgcaccacaacgtcggcggcctgcccgacacgctcaacctgcaactgctcgagccgctgcgcgaactgttcaaggacgaagtgcgcgaactgggcgtggccctgggcctgccgccgcagatggtctatcgccacccgttccccggccccggcctgggcgtgcgcatcctgggcgaagtcaagcacgagtacgccgaactgctgcgccgcgccgacgccatcttcatcgaggaactgcgcaacgccaaggacccggccagcggcctgacctggtacgaactcacctcgcaagccttcgccgtcttcctgcccgtcaaatcggtcggcgtcatgggcgacggccgcacctacgaatacgtcgtcgccctgcgcgccgtgcagaccttcgacttcatgaccgccgactgggcgcccctgccgcacccgctgctggcgcgcgtctcctcgcgcatcatcaacgaagtgcgcggcatcaaccgggtggtgtacgacgtatcgagcaagccgcctgcgacgattgagtgggagtga

SEQ ID NO: 78946 - protein, 530 aa, Bordetella pertussis
MHQRILILDYGSQVTQLIARRVREAGVYSEIHAGDVDDAFVRDQVAQGLKGIILSGSHASAYEEGSMRVPAAVFDVGVPVLGICYGMQSMAQQLGGTVSFSDHREFGYAEVRAHGHTKLLDGLADFTTDEGHGMLKVWMSHGDKVTELPPGFKLMASTASCPIAGMADESRGFYAVQFHPEVTHTVQGKAMLARFVKDICGCEGDWNMPDYISEAVARIREQVGSDEVILGLSGGVDSSVAAALIHRAIGDQLTCVFVDHGLLRLDEGKQVMQTFTENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 78947 - DNA, 1656 bp, Bradyrhizobium japonicum
  CDS (1)..(1656)
atgggcgtgcaaacctgcgcggttgcgggccggggcgtggtcgcgtatctgcttgccatgacagcagcacagaacgaccgctccgcgtcgacgccctccgtggcctcggcgcatgacaagattctcatcgtcgacttcggcagccaggtgacgcagctgatcgcgcgtcgcgtgcgcgaggacggcgtctattgcgagatcgtcccgttcaacaaggccgaagaggccttcaaggagatgaagccgaaggcggtgatcctctccggcgggccggaatcggtgcacgaggccggctctccgcgcgccccgcaattgatcttcgcctccggcgtgcccgtgatgggcatctgctacggccagatgaccatggcggcgcagctcggcggtgaggtcgagggcggccatcaccgcgaattcggccgcgccgatgtcgaggtgaaggcgcagagcaagctgttcgaggacgtctggtcatcaggcagcaagaaccaggtctggatgagccatggcgaccgcatcaccaagatgccgccgggcttctcggtggccggcacctcgccgaacgcgcccttcgcgatcatccaggacgagaagcgcaaatattacggcctgatgttccaccccgaagtggtgcacacgcccgacggcgccaagctgatccgcaacttcgtgcgcaagatcgccggcctcaccggcgactggaccatgcgcgccttccgcgaggaggagattgccaagatccgcgcccaggtcggcaagggcaaggtgatctgcggcctctccggcggcgtcgattcggccgtcgcggccgtgctgatccacgaagccatcggcgaccagctgacgtgtgtgttcgtcgatcacggcttgatgcgcctcaacgaggccgagcaggtggttgacctgttccgccaccactacaacatcccgctcgtgcacgtggatgcgtcgaagcagtttttgggcgaactcgaaggcgtcaccgaccccgagaccaagcgcaagaccatcggccgcctcttcatcgaggtgttcgaggccgaggccaagaagatcggcggcgccgacttcctcgcgcaaggcacgctctatcctgatgtgatcgagagcgtctcgttcaccggcggaccttcagtcaccatcaagtcgcaccacaatgtcggcggtctccctgaacgcatgaacatgaagctcgtcgagcccctgcgcgagctgttcaaggacgaggtgcgcaagttagggcgcgagctcggcctgcccgaaatcttcgtcggccgccacccgttcccgggcccgggcctcgccatccgctgccccggcgacatcacaagcgacaagctcgacatcctgcgcaaggccgatgccgtctacatcgaccagatccgcaagcacggcctctacgacgacatctggcaggcttttgcggtgctgctccccgtgaagacggtgggcgtcatgggcgacggccgcacctacgactacgtcgtgggtctgcgcgccgtcacctccaccgacggcatgaccgcggacttctaccagttcgacatgaagttcttaggcgagaccgccacgcgcatcatcaacgaggtgaagggcgtgaaccgggtggtgtacgacgtgaccagcaagccgcccgggacgattgagtgggagtag

SEQ ID NO: 78948 - protein, 551 aa, Bradyrhizobium japonicum
MGVQTCAVAGRGVVAYLLAMTAAQNDRSASTPSVASAHDKILIVDFGSQVTQLIARRVREDGVYCEIVPFNKAEEAFKEMKPKAVILSGGPESVHEAGSPRAPQLIFASGVPVMGICYGQMTMAAQLGGEVEGGHHREFGRADVEVKAQSKLFEDVWSSGSKNQVWMSHGDRITKMPPGFSVAGTSPNAPFAIIQDEKRKYYGLMFHPEVVHTPDGAKLIRNFVRKIAGLTGDWTMRAFREEEIAKIRAQVGKGKVICGLSGGVDSAVAAVLIHEAIGDQLTCVFVDHGLMRLNEAEQVVDLFRHHYNIPLVHVDASKQFLGELEGVTDPETKRKTIGRLFIEVFEAEAKKIGGADFLAQGTLYPDVIESVSFTGGPSVTIKSHHNVGGLPERMNMKLVEPLRELFKDEVRKLGRELGLPEIFVGRHPFPGPGLAIRCPGDITSDKLDILRKADAVYIDQIRKHGLYDDIWQAFAVLLPVKTVGVMGDGRTYDYVVGLRAVTSTDGMTADFYQFDMKFLGETATRIINEVKGVNRVVYDVTSKPPGTIEWE

SEQ ID NO: 78949 - DNA, 1536 bp, Campylobacter jejuni
  CDS (1)..(1536): transl_table=11
atgaaaaaagcagatattttagttttagactttggctctcaatacactcagcttatagcaagacgcttaagggaacaaggagtttatgcagaaattttaccttttaatgtaagcttagctgatattaaggcaaaagaaccaaaaggtattattttaagcggaggtccagcaagtgtatatgcaactgatgcgtatttttgcgataaaggtatatttgacttaaatctacctgttcttggaatttgttatggtatgcagcttatggcacatcattacaaagctacagtagcacctgcaggacataaagaatacggcaaagcaaacatagaaattaaaaaagataacgctttgtttaaaaatcttccaaaaaaacaaaccgtttggatgagtcattctgataaagtagaaaatttacctcaaggttttgaagttttagccacaagtgaaaatagccctttttgtgtttttggaaacgaagataagaaattctttgctctacaatttcacccagaagtacaacacagcgaatttggcaaaaatatcttaaaaaattttgctaaatatgcttgcaattgtgaaagtatttggaatatgggttcttttgcaaaaactcaagcagaaaaaatccgtgaagaagtaggcaatgataaagtgctttgtgctgtaagtggcggagtagatagtagcgtagttgctgcacttttagctagtgctataaaagagcaaattatagtagtttttgtagataatggacttttaagaagtggagaaaaagaacaagttgaatttatgtttaaaaacactttaggcatcgatctcatcagcattgatgcaagtgaaattttcttaagtcgcttagttaatgtcacagatcctgaacaaaaaagaaaaatcataggaaatacctttatagaagtttttgaagaagaagcaaaaaaacataaagatgtaaaatatcttgctcaaggcacactttatactgatatcatagaaagttctgttgtaggtgcaagcaaaaccattaaaagccatcataatgtagggggcttacctgaaaaaatgaatcttaaactcatagagcctttaaaagaaatttttaaagatgaagtgcgtgccttaggacttgagcttggacttagcaaagaagtagtttatcgtcatcctttccctgggccaggtcttgctatacgcattatgggagaagtaaatcgcgctagcttagaactattacgcaaggctgatgtaattttacttgaggaacttaaaagtacaggttggtatgataaaacttggcaagcattttgcgtacttttaaatgttaaaagcgttggagttatgggggataaccgcacttatgataatgcagtttgtatacgcgttgtagatgcaagtgatggtatgacagctaccttctcgcatttaccttacgaaattttagaaaacataagtcgccgtatcatcaatgaagtagaaggtataaatcgcgttgtttatgatatctcaagcaaaccacctgcaactatagaatgggaataa

SEQ ID NO: 78950 - protein, 511 aa, Campylobacter jejuni
MKKADILVLDFGSQYTQLIARRLREQGVYAEILPFNVSLADIKAKEPKGIILSGGPASVYATDAYFCDKGIFDLNLPVLGICYGMQLMAHHYKATVAPAGHKEYGKANIEIKKDNALFKNLPKKQTVWMSHSDKVENLPQGFEVLATSENSPFCVFGNEDKKFFALQFHPEVQHSEFGKNILKNFAKYACNCESIWNMGSFAKTQAEKIREEVGNDKVLCAVSGGVDSSVVAALLASAIKEQIIVVFVDNGLLRSGEKEQVEFMFKNTLGIDLISIDASEIFLSRLVNVTDPEQKRKIIGNTFIEVFEEEAKKHKDVKYLAQGTLYTDIIESSVVGASKTIKSHHNVGGLPEKMNLKLIEPLKEIFKDEVRALGLELGLSKEVVYRHPFPGPGLAIRIMGEVNRASLELLRKADVILLEELKSTGWYDKTWQAFCVLLNVKSVGVMGDNRTYDNAVCIRVVDASDGMTATFSHLPYEILENISRRIINEVEGINRVVYDISSKPPATIEWE

SEQ ID NO: 78951 - DNA, 1581 bp, Candidatus Blochmannia floridanus
  CDS (1)..(1581): transl_table=11
atgaaacaatgtactagacagtgtattttgattatagattttggatctcagtatacgcaattattattaagacgaattcgagaattaggaatatatgctaaagtatgcgattggaatattagtcaagatctattggttagtttaaatcctaatgggattattttttctggaggtccagatagtgtaacgaataaacactcgtcaagtatatcaaaagtcgttttcaaaattggtgttccaatattaggaatttgttatggaatgcaaattttggttagtcaatgcggagggaatatccgatctgtatctaataaaggagaatttggttatgctcaggttgaaatactatctcaaaaaaatacattaattggtaatctttatgattatatcaatgatcaaggtcattgtgtattagaggtatggatgagtcataaagatatagtggaaactatgccacaaggctttactgttattgggattactgaaaatcagcaaattgctattataatcaatgaaaaatgtcgttggtatggtatacagtttcatccagaggttacgcatactaaaaaaggaaaagatattttaaaaaggtttgctgtagatatttgcagatgtgaggttacatggaaacctgtatatattgttaaaaatattattaaaactattaaaaaggtagtaggtcaagatagagtagttcttgctttttctggaggaattgattctttggtgacggctttgttattaaaatatgcaattaatcatgaacagtttgtttgtgtatttgtaaataatggattattatgttgtaatgaaattaatcgaattagtaatttttgtaaaaaatatcaagatttaaatattattcatttatcagaagagaagcgttttttaagtgctttaactggtgttattgatccagaagaaaaaagaaaaataatagggaaaatatttgtagaaatatttcaagcgcaaattagtcagttaaaaaatattaaatggttggctcaaggtactatatattcagatgttattgaatctggaatgtcatgtgcttctgctaatataattaaatcgcatcataatgttggaggatttccaagttctgttaatattcagttgttagagcctataaaagatttatttaaggatgaagttcgtaatattgggttgtatttaggattaccgttaaatgtagtcaatcaatatccatgtccaggtcctggaatggctattagaatattaggagaagtacgggaagaatattgtaatatattacgaagagttgattatatttttatggaagagttgaataaatcagatttgtataatactgttgatcaagcatttgcagtgtttttgccagttcaatcagtaggggtacaaggagatcaacgtaaatataaatgggttattgtgttacgagcgatagaaactgaagattttatgacggcacaatgggttcggcttccatatacttttttaaataaagtatctaatcgtattgttaatgaggttgaggaagtgtcaagagtggtttatgatatttcttgtaaacctccagctacaattgaatgggagtaa

SEQ ID NO: 78952 - protein, 526 aa, Candidatus Blochmannia floridanus
MKQCTRQCILIIDFGSQYTQLLLRRIRELGIYAKVCDWNISQDLLVSLNPNGIIFSGGPDSVTNKHSSSISKVVFKIGVPILGICYGMQILVSQCGGNIRSVSNKGEFGYAQVEILSQKNTLIGNLYDYINDQGHCVLEVWMSHKDIVETMPQGFTVIGITENQQIAIIINEKCRWYGIQFHPEVTHTKKGKDILKRFAVDICRCEVTWKPVYIVKNIIKTIKKVVGQDRVVLAFSGGIDSLVTALLLKYAINHEQFVCVFVNNGLLCCNEINRISNFCKKYQDLNIIHLSEEKRFLSALTGVIDPEEKRKIIGKIFVEIFQAQISQLKNIKWLAQGTIYSDVIESGMSCASANIIKSHHNVGGFPSSVNIQLLEPIKDLFKDEVRNIGLYLGLPLNVVNQYPCPGPGMAIRILGEVREEYCNILRRVDYIFMEELNKSDLYNTVDQAFAVFLPVQSVGVQGDQRKYKWVIVLRAIETEDFMTAQWVRLPYTFLNKVSNRIVNEVEEVSRVVYDISCKPPATIEWE

SEQ ID NO: 78953 - DNA, 1563 bp, Caulobacter crescentus
  CDS (1)..(1563): transl_table=11
atgactcagaaaaccgaccaccagcgcgtcctgatcgtcgacttcggcagccaggtcacccaactgatcgcccgccgagtgcgcgaggcgggggtctattgcgagatccatccgttcgacaaggccgaggccattgtcgacgagtacgcgccctcggcgatcatcctgtcgggcggtccggccagtgtgctggaggcggacagcccgcgcatcggtcgcaagctgttcgatctgggcctgccgctgctggccatctgctacggccagcaactgctgtgcgacgtcttgagcggcaaggtcgagggtggtcacgcgggcgaattcggccgcgccgagctgaccatcggcaaggatagcccgatgttccaaggcctggccggtgtcggcggcgtcgagacggtgtggatgagccacggcgatcgcgtcacggcgatcccggaaggcttcgaggtgatcggtacgtcgaccggcgcgccgttcgcggcgatcgccaatgacgccaagaagatctacgccctgcagttccatcctgaggtctatcacacggtcaacggaccggcgatgtaccgcaatttcctgttcaatatcgcggggctgaagggcgactggacgatggcggcgttccgccaggagatggtccagaagatccgcgaccaggtcggagacggcaaggtgatctgcggcctgtcgggcggcgtcgacagctcggtggccgccgtgctgatccacgaggcgatcggcgaccagctgacctgcgtgttcgtcgacacgggcctcttgcgcaagaacgaggccgaccaggtcgtgaccctgttccgcgaccactacaacatcccgctggtccacgtggacgccggcgacctgttcctgggcgagctggccggcgtcagcgatcccgaaaccaagcgcaagaccatcggccgcctgttcatcgacgtgttcgacaaggaagccgccaagatcgagggcgcgacgttcctggcccagggcacgctctatccggacgtcgtcgagagcgtctcggcccgcggcggcccctcggcggtgatcaagagccaccacaacgtcggcggcttgcccgactacatgaagctgaagctggtcgagccgctgcgcgagctgttcaaggacgaggttcgcgccctgggtgtcgagctgggcctggccccggccttcgtcggccgccatccgttccccggaccgggcctcgccatccgtatcccgggcgagatcacgcccgagaaggtcaaggtcctgcaggacgccgacgccatctatctggaagagatccgcaacgccggcctctatgaccagatctggcaggccttcgcggtgctgctgcccgtgaagacggtgggcgtgatgggcgatgcgcggacctacgagaacgttctggccctgcgcgcggtgacctcgaccgacggcatgaccgccgacttcttcgagttcccgtggccggttctgggcaagaccgccacgcgcatcatcaacgaggtgcgcggcgtcaaccgcgtcgtctatgacgtgaccagcaagccgccgggcacgattgagtgggagtag

SEQ ID NO: 78954 - protein, 520 aa, Caulobacter crescentus
MTQKTDHQRVLIVDFGSQVTQLIARRVREAGVYCEIHPFDKAEAIVDEYAPSAIILSGGPASVLEADSPRIGRKLFDLGLPLLAICYGQQLLCDVLSGKVEGGHAGEFGRAELTIGKDSPMFQGLAGVGGVETVWMSHGDRVTAIPEGFEVIGTSTGAPFAAIANDAKKIYALQFHPEVYHTVNGPAMYRNFLFNIAGLKGDWTMAAFRQEMVQKIRDQVGDGKVICGLSGGVDSSVAAVLIHEAIGDQLTCVFVDTGLLRKNEADQVVTLFRDHYNIPLVHVDAGDLFLGELAGVSDPETKRKTIGRLFIDVFDKEAAKIEGATFLAQGTLYPDVVESVSARGGPSAVIKSHHNVGGLPDYMKLKLVEPLRELFKDEVRALGVELGLAPAFVGRHPFPGPGLAIRIPGEITPEKVKVLQDADAIYLEEIRNAGLYDQIWQAFAVLLPVKTVGVMGDARTYENVLALRAVTSTDGMTADFFEFPWPVLGKTATRIINEVRGVNRVVYDVTSKPPGTIEWE

SEQ ID NO: 78955 - DNA, 1539 bp, Chlamydia muridarum
  CDS (1)..(1539): transl_table=11
ttgagtaatattctcattcttgattttggctcccaatatacgaatgttctagcaaaaaaaatacgtctgctttccgttttttgtgaggttctcccttggaatacacctttagaaaagattcttcaaaagtctccctcaggtttaattttttcaggaggaccacattcggtttatcagaataatagtccagaagttgataaggaaatctataacagcaacatccctatacttggagtgtgctatggcatgcagctgattgctagagattttggaagtgaagttcagggggggaagagcgaatttggttatacacctatagtgttttatccaagcgaactttttaaaggtcttgctgatcaggatgcttttcatacagaaattcgaatgagtcattgtgattgtgttgttgttcctcctaaagatttctttgttatagcgagttctcagcactgtcccattgccgctatagaatgcccaaagaaaaaactttttggtcttcaatttcatcctgaagtttcagattctcaagacataggggataaaattttatcaaattttgtgaagcatatttgccagacttcagaaacttggaaaattgaaacaatagaaaaacaacttattcaaggcattagagaaaaagtgggagaaacagaacgtgtccttctcggcctatctggaggcgtagattcttctgttttagctgttttacttcataatgctctaggtgatcgtctgtcttgtgtcttcgttgatactggactattacgaaaaaatgaagtggaagaagttaaacaacaattttcttctctagggttagagatccttgtggtagatgcttctgaaaaatttttccatgacctatccggaatagaagatcctgagcaaaaacgtaaagtcataggagccgcctttatcgaagtttttgatgaagcctctaaaaatctcgatgttcaatggttagctcaggggactatttattctgatgtaattgaatctgcaaaatcttgtgatgcaacacaagtaatcaagtctcaccataatgtaggtggacttccagaaaagttgaatttgaagcttttagaacctctgcgttttctttttaaagatgaagtcagagctttaggtaaagttctgggtttgccggacgtcctaatatcccgacatccttttcctggtcctggtttaggagtccgagttcttggagaagttcgtcgggaatatgtagaaatagtaaaaaacgcggacagcatttttattgaagaactaaaaaaagcgaatttataccacaaggttagccaagcatttgctgttttcttgccatgtaaatctgttgctgtaaaaggtgactgccgtcattacggttatacgatagctttacgtgcagtagaatctactgattttatgacagcatgctggccatctttatctagagaatttcttaaccgttgttcctcacgtatcattaatgaaatccctgaagtttgcagggtagtttacgatatttccgataaaccaccggcaactattgagtgggaataa

SEQ ID NO: 78956 - protein, 512 aa, Chlamydia muridarum
MSNILILDFGSQYTNVLAKKIRLLSVFCEVLPWNTPLEKILQKSPSGLIFSGGPHSVYQNNSPEVDKEIYNSNIPILGVCYGMQLIARDFGSEVQGGKSEFGYTPIVFYPSELFKGLADQDAFHTEIRMSHCDCVVVPPKDFFVIASSQHCPIAAIECPKKKLFGLQFHPEVSDSQDIGDKILSNFVKHICQTSETWKIETIEKQLIQGIREKVGETERVLLGLSGGVDSSVLAVLLHNALGDRLSCVFVDTGLLRKNEVEEVKQQFSSLGLEILVVDASEKFFHDLSGIEDPEQKRKVIGAAFIEVFDEASKNLDVQWLAQGTIYSDVIESAKSCDATQVIKSHHNVGGLPEKLNLKLLEPLRFLFKDEVRALGKVLGLPDVLISRHPFPGPGLGVRVLGEVRREYVEIVKNADSIFIEELKKANLYHKVSQAFAVFLPCKSVAVKGDCRHYGYTIALRAVESTDFMTACWPSLSREFLNRCSSRIINEIPEVCRVVYDISDKPPATIEWE

SEQ ID NO: 78957 - DNA, 1290 bp, Chlamydia pneumoniae
  CDS (1)..(1290): transl_table=11
ttgcagagtgcaaggagacatttgaacaccatatttattctagattttggatctcaatatacttatgtattagcaaagcaagtgcggaagttatttgtatattgcgaagttcttccctggaatatctctgtgcaatgtttaaaagaaagagcgcctttggggatcattctctcaggaggtcctcactctgtctatgaaaacaaggctccacatttagatcctgaaatctataaacttggcattccaattctagctatttgctatggcatgcagcttatggctagagattttggagggactgtaagccctggtgtaggagaatttggatatacgcccatccatctgtatccttgtgagctcttcaaacacatcgtcgactgcgaatctctagacacagagattcggatgagccatcgggatcatgttacgacaattcctgaaggatttaatgtaatcgcatccacctcacaatgctcgatctcaggaatagaaaataccaaacaacggttgtacgggctgcaatttcatcccgaggtttctgactccactccaacgggaaataagattctagaaacttttgttcaagagatctgttctgctcccacactatggaatcccttgtatattcagcaagaccttgtaagtaaaattcaagataccgttattgaagtatttgatgaagtcgctcagtcattagacgtacaatggttagctcaaggaaccatctactcagatgttattgagtcctcacgctctggacatgcctccgaagtaataaaatcacatcataatgtaggggggcttccaaaaaatcttaagctgaagttagtcgagcccttacgttatttatttaaagatgaagttcgaattttaggagaagccctaggactttctagctatctcttggacaggcatccttttcctggacctggcttgacaattcgtgtgattggagagatccttcctgaatatctagccattttacgacgggcggacctcatctttatagaagagcttaggaaagcaaaactctacgataaaataagccaagcctttgctctatttcttcctataaaatcagtatctgtaaaaggagattgtagaagctatggttataccatagcattacgtgctgtagaatctacagatttcatgacaggacgatgggcctaccttccatgcgatgttctcagttcttgctcatcgcgaattattaatgaaatacccgaggtaagccgagtggtctatgatatttctgacaagccaccagcaactatagaatgggaatag

SEQ ID NO: 78958 - protein, 429 aa, Chlamydia pneumoniae
MQSARRHLNTIFILDFGSQYTYVLAKQVRKLFVYCEVLPWNISVQCLKERAPLGIILSGGPHSVYENKAPHLDPEIYKLGIPILAICYGMQLMARDFGGTVSPGVGEFGYTPIHLYPCELFKHIVDCESLDTEIRMSHRDHVTTIPEGFNVIASTSQCSISGIENTKQRLYGLQFHPEVSDSTPTGNKILETFVQEICSAPTLWNPLYIQQDLVSKIQDTVIEVFDEVAQSLDVQWLAQGTIYSDVIESSRSGHASEVIKSHHNVGGLPKNLKLKLVEPLRYLFKDEVRILGEALGLSSYLLDRHPFPGPGLTIRVIGEILPEYLAILRRADLIFIEELRKAKLYDKISQAFALFLPIKSVSVKGDCRSYGYTIALRAVESTDFMTGRWAYLPCDVLSSCSSRIINEIPEVSRVVYDISDKPPATIEWE

SEQ ID NO: 78959 - DNA, 1551 bp, Chlorobium tepidum
  CDS (1)..(1551): transl_table=11
atggcaacatccctgcaatcggtcatcgtcctcgatttcggttcacagtacactcagctcatcgcacggcgcatccgcgagatcggcatctactccgagatttttccgtaccacacaaaggccgaaaccatccgggcgcatcagccgaaagcgatcatcctctccggcggcccgaacagcgtctatgacgaaaaagcattcatgcccgacccggaggtgttcagcctcggcgtgccggtgctcggcatctgctacggcctgcaggccatcgccaagcacttcggcggcaacgtcgaaagctcctcgaagcaggagttcggacgcgccaagatgctggtgaaccacgacgagagcgagagcctgctcttccgcgacatccccgattcggacgtctggatgagccatggcgacaaggtgacgcagctgccggagggcttccgcgtgacggcgagcaccgcgaatgccgaggtgtgcgccatcgagagcttcggcagcaaagccgcgctcaaggtctatggcttgcagtttcaccccgaagtgcaacactcgctctacggcaagcagctgctctcgaactttttgatcgacatcgcgggcatcacgccggactggtcgccgaagagcttcatccagcaccagatcgaggagatcaagcgggttgcgggcgactcgaccgtggtgtgcggcatcagcggcggcgtcgattccacggtggccgccgtgctcgtcagcaaggcgatcggcgacaagctgcactgcgtctttgttgacaacggcctgctccgcaaggatgaagcggtgaaggtgatggagttcctcaagccgctcggtctgaacatttcgctcgtcgacgccagcgatctctttttagggcgactcaaaggcgtagcctcgccagagaagaagcgcaagatcatcgggcgcaccttcattcaggtgttcgaaaagaacattcacgacgagaagttcctcgtgcagggcacgctctacccggacgtgatcgagagcgtcagcgtgaaaggaccgtccgagacgatcaagtcgcaccacaacgtcggcggcctgccgaagcgcatgaagctcaagctcatcgagccgctgcgcgagctgttcaaggatgaagtccgcgccgtcggacgcgagcttggcatcgccgaggacatcctgatgcgccaccccttccccggccccggcctcgccgtgcgcgtgctcggctcgctcacgcgggagcgcctcgacgtgctgcgcgacgccgaccagattttcatcgacgagctgaagtcgagcggcctctactcgaaggtgtggcaggccttctcggtgctcctgccggtgcagtcggtcggcgtgatgggcgacaaacgcacctacgaaaacgtgctcgccttgcgagccgtggaatccaccgacggcatgaccgccgactgggcgcacctcccccacgacttcctcgccaaagtctcgaaccgcatcatcaacgaagtgagaggcatcaaccgtgtggtatacgatatttcctcgaaaccgccagccacgatcgagtgggagtga

SEQ ID NO: 78960 - protein, 516 aa, Chlorobium tepidum
MATSLQSVIVLDFGSQYTQLIARRIREIGIYSEIFPYHTKAETIRAHQPKAIILSGGPNSVYDEKAFMPDPEVFSLGVPVLGICYGLQAIAKHFGGNVESSSKQEFGRAKMLVNHDESESLLFRDIPDSDVWMSHGDKVTQLPEGFRVTASTANAEVCAIESFGSKAALKVYGLQFHPEVQHSLYGKQLLSNFLIDIAGITPDWSPKSFIQHQIEEIKRVAGDSTVVCGISGGVDSTVAAVLVSKAIGDKLHCVFVDNGLLRKDEAVKVMEFLKPLGLNISLVDASDLFLGRLKGVASPEKKRKIIGRTFIQVFEKNIHDEKFLVQGTLYPDVIESVSVKGPSETIKSHHNVGGLPKRMKLKLIEPLRELFKDEVRAVGRELGIAEDILMRHPFPGPGLAVRVLGSLTRERLDVLRDADQIFIDELKSSGLYSKVWQAFSVLLPVQSVGVMGDKRTYENVLALRAVESTDGMTADWAHLPHDFLAKVSNRIINEVRGINRVVYDISSKPPATIEWE

SEQ ID NO: 78961 - DNA, 1578 bp, Chromobacterium violaceum
  CDS (1)..(1578): transl_table=11
atggacaagatcctcattctcgacttcggctcccaggtcacccagctgatcgcccgccgcgtacgcgaagctcacgtttactgtgagcttcattctttcgacatgcccatcgaagagatccaggccttcgcgcccaaggccatcatcctgtccggcggccccaactcggtgtatgaatccgactaccaggccgatcccaagctgttcgagctgggcgtgccggtgctgggcatctgctacggcatgcagttcatggcccagaccctgggcggcaaggtggaaagcggcgacaagcgcgagttcggctacgcccagatcaaggcccgccaccactccaagctgctggaaggcctgcaggaccagatcgacgacgccggcaacggcttcctcgacgtgtggatgagccacggcgacaaggtgacccagcttccggccggcttccaggtgatcgccgagaccccgtcctgcccgtacgcggcgatggctgacgaagcccgcggcttctacggcgtgcagttccacccggaagtgacccacaccaagcgcggcaccgagatgatccaccgcttcgtgctgcacgtggccggctgcaagcccagctggaccatgcccaactacatcgacgaagcggtgaagaagatccgcgagcaagtcggcgacgaagaagtcatcctcggcctgtccggcggcgtggactcctcggtggccgccgcgctgatccaccgcgccatcggcgaccagctgacctgcgtcttcgtcgaccacggcctgctgcgcctgaacgaaggcaagatggtgatggaaatgttcgcccagaacctgggcgtcaaggtggtccacgtgcaggccgaggccgacttcatggccaagctggccggcgagaccgacccggagaagaagcgcaagatcatcggcgcggaattcatcgaagtgttcgaccgcgaatccggcaagctgaccaacgccaagtggctggcccagggcaccatctatccggacgtgatcgaatcggccggcgccaagaccaagaaggcgcacaccatcaagagccaccacaatgtgggcggcctgccggaagacatgaacctgaagctcttggagccgctgcgcgagctgttcaaggacgaagtgcgccagctgggcgtagcgctcggcctgccgcacgacatggtctaccgccacccgttcccgggcccgggcctgggcgtgcgcatcctcggcgaagtgaagaaggaatacgcggatctcttgcgccaggccgacgccatcttcatcgaagagctgcgcaacaccgtggacgagaagaccggcaaaaactggtacgagctgaccagccaggccttcgccgtgttcctgccggtgaagtccgtcggcgtgatgggcgacggccgcacctacgactacgtggtggcattgcgcgccgtggtgaccagcgacttcatgaccgcgcactgggccgagctgccgtacagcctgctgggccgcgcctccaaccgcatcatcaacgaagtccgcggcatcaaccgcgtggtctacgacgtcagcggcaagccgccagcgaccatcgagtgggaataa

SEQ ID NO: 78962 - protein, 525 aa, Chromobacterium violaceum
MDKILILDFGSQVTQLIARRVREAHVYCELHSFDMPIEEIQAFAPKAIILSGGPNSVYESDYQADPKLFELGVPVLGICYGMQFMAQTLGGKVESGDKREFGYAQIKARHHSKLLEGLQDQIDDAGNGFLDVWMSHGDKVTQLPAGFQVIAETPSCPYAAMADEARGFYGVQFHPEVTHTKRGTEMIHRFVLHVAGCKPSWTMPNYIDEAVKKIREQVGDEEVILGLSGGVDSSVAAALIHRAIGDQLTCVFVDHGLLRLNEGKMVMEMFAQNLGVKVVHVQAEADFMAKLAGETDPEKKRKIIGAEFIEVFDRESGKLTNAKWLAQGTIYPDVIESAGAKTKKAHTIKSHHNVGGLPEDMNLKLLEPLRELFKDEVRQLGVALGLPHDMVYRHPFPGPGLGVRILGEVKKEYADLLRQADAIFIEELRNTVDEKTGKNWYELTSQAFAVFLPVKSVGVMGDGRTYDYVVALRAVVTSDFMTAHWAELPYSLLGRASNRIINEVRGINRVVYDVSGKPPATIEWE

SEQ ID NO: 78963 - DNA, 1533 bp, Clostridium tetani
  CDS (1)..(1533): transl_table=11
atgaaaaaagaattagtttttataatagatttcggaggacaatatagtcaacttatagcaagacgtgtaagagaaaataatgtgtattgtgagataattccatacagtacttcaatagaaaaaataaaggaaaagaatccaaagggtataatatttagtggtggtcctaatagtgtttatggagaaaattctcctagaataagcaaagaaatttttgaaatagatgtaccagttttaggcatatgttatggtcaacaactagcatcatttattttaggtggcaaagttgaaagtgctaaggtaagggaatatggaaagactgccgtaaatttagataataaatgtgctttatttgaaggtatagataaagtacaagaatgttggatgagtcatacagactacgtttcagagataccttcagggtttaatatagtagcctatacagatggatgcaaagtggcagctatggcaaatgaagataaaaaaatatatggagttcaattccatccagaagtagaacacactccttttggaaagaaaatgttgaaaaattttctttttaatatatgtgaattaaagggagattggtctgtaacttcttttgcagaagaaaagataaaagaaattagagaacttgttggggacaaaaaagtaatttgtgcattatctggtggagtagattcttctgtagcagctgtaatagttcataaagcaataggagatcaacttacatgcatatttgtagaccatggtttacttagaaaagatgaaggagaccaagttgaaagtatatttaaagaaaaattccaaatgaatttaataagggtaaatgctcaagatagattcctaggaaaattaaaaggtgtaacagaaccagaaagaaagagaaaaataattggtgaagaatttataagagtttttgaagaagaagctaacaaactagggaagatagattatttagtacaaggaactatatatcctgatgtagtagaaagtggtacagatacttctgcaactataaaaagtcaccataatgtaggtggattaccagaagatatagaatttgaacttatagaaccattaagagagttatttaaagatgaggttagaagagttggagaagaattgggaatacctcataaattagtttggagacagcctttcccaggaccaggtttaggaataagagttttaggcgaagtaacagaagaaaaattagaaattgttagagaagcagatgctatttttagagaggaaatcgcaaatgcaggattagacgaaaagatatggcaatactttgcatgtctacctaatataagatccgttggagtaatgggagatgaaagaacttactctcatacaattggactaagagcagtaaactcctctgatggaatgacttcagattgggctaaaataccttatgaagttttagacaaagtaagtataagaatagtaaatgaagttaagggagttaacagaattgtttatgatataacttcaaaaccaccttcaactatcgaatgggaatag

SEQ ID NO: 78964 - protein, 510 aa, Clostridium tetani
MKKELVFIIDFGGQYSQLIARRVRENNVYCEIIPYSTSIEKIKEKNPKGIIFSGGPNSVYGENSPRISKEIFEIDVPVLGICYGQQLASFILGGKVESAKVREYGKTAVNLDNKCALFEGIDKVQECWMSHTDYVSEIPSGFNIVAYTDGCKVAAMANEDKKIYGVQFHPEVEHTPFGKKMLKNFLFNICELKGDWSVTSFAEEKIKEIRELVGDKKVICALSGGVDSSVAAVIVHKAIGDQLTCIFVDHGLLRKDEGDQVESIFKEKFQMNLIRVNAQDRFLGKLKGVTEPERKRKIIGEEFIRVFEEEANKLGKIDYLVQGTIYPDVVESGTDTSATIKSHHNVGGLPEDIEFELIEPLRELFKDEVRRVGEELGIPHKLVWRQPFPGPGLGIRVLGEVTEEKLEIVREADAIFREEIANAGLDEKIWQYFACLPNIRSVGVMGDERTYSHTIGLRAVNSSDGMTSDWAKIPYEVLDKVSIRIVNEVKGVNRIVYDITSKPPSTIEWE

SEQ ID NO: 78965 - DNA, 1578 bp, Corynebacterium diphtheriae
  CDS (1)..(1578): transl_table=11
gtgacgcagcaaacttcccaaaaacacaatccagtcttggttgtagactttggcgcgcaatacgcccagctgatcgctcggcgcgtgcgcgaagccaacatctactccgaggtcgtcccgcataccgccacggttgaagagatcaaggccaaaaacccggcggcgttaatcctgtccggtggcccatcatcggtttacgccgacggcgcaccatcgcttgacccacaggttctcgaactcggcatccccgtcttcggcatctgctacggcttccaagctatgacccacgccctaggcggcaccgtggccaacaccggcaaccgtgaatacggtcgcaccgaaatgaccgtcgatggcggcattctccacgctgacctcgaagaaacccacaaagtatggatgagccacggtgacgctgtctccgttgcaccagagggattcgttgtcaccgcccactccgaaggtgcacccgtcgcagccttcgaatgcgccgaaaagcgcatggcaggcgtgcaataccacccagaggttctgcactcgccacacggccaagaagtcatggtgcgcttcctcaccgagatcgccggccttgagcaaaactggaccgcagccaacatcgccgaagagcttatcgacgcagtctgcgcacaggtcggaccagaaggccgcgctatctgtggtctttccggtggtgttgactctgcagtcgcagcagcactcgtccagcgcgccatcggcgaccgcctcacctgcgtattcgtcgaccatggcttgctgcgtgcaggcgaacgcgaacaggtccaaaccgatttcgtcgccgcaaccggcgcaaaactcgtcaccgttgacgagcgcgaagcattcctgaacaagctcgcaggtgtcaccgaaccagaagctaagcgcaaagccatcggcgcagaattcatccgctccttcgaacgcgcagtcgccggcattctcgacgacgcccccgaaggctccaccgtggactttctcgtccaaggcaccctctacccagacgttgtagaatccggcggcggctctggtaccgccaacatcaagagccaccacaacgtgggcggcctgcccgacgacgtagaattccaactcgtcgaaccactacgcttactgttcaaagacgaagtacgcgcagtgggtcgcgaactcggtctgcctgaagaaatcgtcaaccgccagcccttcccaggccccggcctcggcatccgcatcatcggcgaagtcaccgaagagcgcctggaaacactacgcgcagccgacctcatcgcccgcaccgagctgaccgcagctggcctcgacagcgaaatctggcagtgcccagtagttttgcttgccgacgtccgctccgtcggcgtccaaggcgacggccgcacttacggacatcccatcgtcctacgccccgtctcctccgaagacgccatgaccgcagactggacccgactgccctacgacgtgctcgagaaaatctccacacgtatcaccaacgaggtctcagacgtcaaccgcgtcgtcctcgactgcacctccaagccaccaggaaccatcgagtgggaataa

SEQ ID NO: 78966 - protein, 525 aa, Corynebacterium diphtheriae
MTQQTSQKHNPVLVVDFGAQYAQLIARRVREANIYSEVVPHTATVEEIKAKNPAALILSGGPSSVYADGAPSLDPQVLELGIPVFGICYGFQAMTHALGGTVANTGNREYGRTEMTVDGGILHADLEETHKVWMSHGDAVSVAPEGFVVTAHSEGAPVAAFECAEKRMAGVQYHPEVLHSPHGQEVMVRFLTEIAGLEQNWTAANIAEELIDAVCAQVGPEGRAICGLSGGVDSAVAAALVQRAIGDRLTCVFVDHGLLRAGEREQVQTDFVAATGAKLVTVDEREAFLNKLAGVTEPEAKRKAIGAEFIRSFERAVAGILDDAPEGSTVDFLVQGTLYPDVVESGGGSGTANIKSHHNVGGLPDDVEFQLVEPLRLLFKDEVRAVGRELGLPEEIVNRQPFPGPGLGIRIIGEVTEERLETLRAADLIARTELTAAGLDSEIWQCPVVLLADVRSVGVQGDGRTYGHPIVLRPVSSEDAMTADWTRLPYDVLEKISTRITNEVSDVNRVVLDCTSKPPGTIEWE

SEQ ID NO: 78967 - DNA, 1572 bp, Corynebacterium efficiens
  CDS (1)..(1572)
atgagccttacacctaatcatcgcccagtactcgttgtcgactacggtgcacagtacgcgcagctgatcgcacgacgagtgcgtgaggccggcatctactccgaagtcatcccgcacaccgccaccccgcaggagattcaggaaaagaaccctgttgcgctggtgttgtccggtggaccgtcgtctgtgtatgcagaggacgcgccgggtatcgatccggacatcctgaagttggggctgccggtcttcggcatctgctacggcttccaggccatgacccacgcgctgggtggcaaggttgccgccaccggcaagcgtgagtacggccgtactgatcttgaggtcaagggtggtgttctgcacgacggtctggagctgtcccacaaggtgtggatgagccatggcgatgctgtgtccgaggcccctgagggtttcaccgtcaccgcttcctccgaggcggcaccggtcgcggctttcgagaatgtcgaggccaagatggctggtgtccagtaccaccccgaggtgctgcactccccgcatggtcagcaggttctcacccgcttcctcaccgagatcgccggcctggagcagaactggactgcggccaacattgcggaggaactcgtcgagaagatccgtgagcaggtcggccctgagggtcgtgccatctgtggtctgtccggtggcgtggattccgccgttgccgcagccctggtgcagcgcgccatcggtgaccgcctgacctgtgtctttgttgaccacggtctgctgcgcgccggtgagcgtgagcaggtggagaaggatttcgtggctgccaccggcgcgaagctggtcaccgtcgatgagcgtaaggcgttcctggataagctggccggtgtcaccgagccggaggccaagcgcaaggccatcggtgcggagttcatccgttccttcgagcgcgctgtcgccggtgtgctggaggattccccggagggttccaccgtggacttcctggtccagggcaccctctacccggatgtggtggagtccggcggcggtgccggtaccgccaacatcaagagccaccacaacgtgggcgggctgcctgatgatgtcgagttcgagctcgtcgagcccctgcgcctgctgttcaaggacgaggtccgtgcggttggccgcgagctcggcctgcccgaggtcatcgttgcccgtcagccgttcccgggaccgggcctgggtatccgcatcatcggtgaggtcaccgaggagcgtctggagaccctccgccacgccgatctgatcgcccgcaccgagctcaccgcagccggcctggatggcatcatctggcagtgcccggtggtcctgctcgccgatgtccgttctgtcggtgtccagggtgacggccgcacttacggtcacccgatcgtgctgcgcccggtgtcctccgaggatgccatgaccgccgactggacccgcctgccgtatgaggtcctggagcgtatctccacccgcatcaccaatgaggtcgccgacgtcaaccgcgttgtgctcgacgtgacctcgaagccaccgggaaccatcgagtgggagtag

SEQ ID NO: 78968 - protein, 523 aa, Corynebacterium efficiens
MSLTPNHRPVLVVDYGAQYAQLIARRVREAGIYSEVIPHTATPQEIQEKNPVALVLSGGPSSVYAEDAPGIDPDILKLGLPVFGICYGFQAMTHALGGKVAATGKREYGRTDLEVKGGVLHDGLELSHKVWMSHGDAVSEAPEGFTVTASSEAAPVAAFENVEAKMAGVQYHPEVLHSPHGQQVLTRFLTEIAGLEQNWTAANIAEELVEKIREQVGPEGRAICGLSGGVDSAVAAALVQRAIGDRLTCVFVDHGLLRAGEREQVEKDFVAATGAKLVTVDERKAFLDKLAGVTEPEAKRKAIGAEFIRSFERAVAGVLEDSPEGSTVDFLVQGTLYPDVVESGGGAGTANIKSHHNVGGLPDDVEFELVEPLRLLFKDEVRAVGRELGLPEVIVARQPFPGPGLGIRIIGEVTEERLETLRHADLIARTELTAAGLDGIIWQCPVVLLADVRSVGVQGDGRTYGHPIVLRPVSSEDAMTADWTRLPYEVLERISTRITNEVADVNRVVLDVTSKPPGTIEWE

SEQ ID NO: 78969 - DNA, 1575 bp, Coxiella burnetii
  CDS (1)..(1575): transl_table=11
atgctaaaagatatccatcaacatcgcattttaattcttgatttcggttcgcaatacgctcaattaatcgcgcggcgagtgcgggaaattggcgtttattgtgaattaatgccctgtgatatcgatgaggaaactattcgcgactttaatccacacggcattattctttcaggtgggccggagaccgtcacgttaagtcatacgcttcgcgcacccgcttttatttttgaaattggttgcccggtgctgggtatttgttatggtatgcaaacgatggcatatcagctcggcggaaaagttaataggacggctaaagctgaatttggacatgcgcaattgcgggtattaaatcccgcttttttatttgacggtattgaagatcaagtttcgcctcaaggcgaacctttgttagacgtttggatgagccatggtgatattgttagcgaattaccgccaggctttgaagccacagcttgcaccgacaattcgcctctagcggcgatggcggatttcaaacggcgatttttcggtttgcaatttcatcctgaagtcacgcacacccctcaagggcatcgtattttagcgcattttgtaattcacatttgtcaatgcatacccaattggactactaaacatattatcgaagacagcattcgagatattcaggaaaaagtcggcaaagaacaggttattgtgggattatccgggggcgtggattccgcggtgacagcgacgctggttcataaagccatcggcgatcaattagtttgtgttttagtcgacaccggattgttgcggttgaatgaagtggatgaagttttgaatgtatttcaaaaacatttaggagccaaggttatttgcgttgatgcaaaagatcgttttatgaaagcgttgaaaggaatttcagaccctgaggagaagcgcaaaattgccggcgaacaatttattcgtgtatttgaggaacaagctaaaaaattaaatgtaaaatggctggggcaagggactatttatcccgacgttattgaatctgcaaaaacaaaaacgggaaaaggccatattattaaaacgcaccataatgtgggtggactgccgttaaatatggaattgaaactcatcgagccgctacgggaattgtttaaagatgaagtgcgcaaattaggacttgaattaggattgcccgcagatttaatttaccgacatccgtttcccggtcccggactcgcgatccgcattttgggagaagtaagtgcagaatatattaatattttgaaacaggctgatgccatttttattgaagaattaaaaaaatccgattactaccaccaagtcagtcaagcctttgctgtttttatgcctttgaaatccgtgggcgttaaaggagatgcgcggcattatggctatattatcgctttgcgcgctgtaaaaacggtggattttatgacagcacaatgggcggatttgccgcatgaatttttatctaaggtaagtcatcgaatagtgaatgaaattaaagaagtctcccgcgttgtttatgacatgactaataaaccgccggcgacgattgaatgggagtaa

SEQ ID NO: 78970 - protein, 524 aa, Coxiella burnetii
MLKDIHQHRILILDFGSQYAQLIARRVREIGVYCELMPCDIDEETIRDFNPHGIILSGGPETVTLSHTLRAPAFIFEIGCPVLGICYGMQTMAYQLGGKVNRTAKAEFGHAQLRVLNPAFLFDGIEDQVSPQGEPLLDVWMSHGDIVSELPPGFEATACTDNSPLAAMADFKRRFFGLQFHPEVTHTPQGHRILAHFVIHICQCIPNWTTKHIIEDSIRDIQEKVGKEQVIVGLSGGVDSAVTATLVHKAIGDQLVCVLVDTGLLRLNEVDEVLNVFQKHLGAKVICVDAKDRFMKALKGISDPEEKRKIAGEQFIRVFEEQAKKLNVKWLGQGTIYPDVIESAKTKTGKGHIIKTHHNVGGLPLNMELKLIEPLRELFKDEVRKLGLELGLPADLIYRHPFPGPGLAIRILGEVSAEYINILKQADAIFIEELKKSDYYHQVSQAFAVFMPLKSVGVKGDARHYGYIIALRAVKTVDFMTAQWADLPHEFLSKVSHRIVNEIKEVSRVVYDMTNKPPATIEWE

SEQ ID NO: 78971 - DNA, 1521 bp, Deinococcus radiodurans
  CDS (1)..(1521): transl_table=11
gtgagcatcgtcattctggatttcggcagccagttcactcgcctgattacccggcgcttccgcgaactcggcgcatactcggtgattttgcccggcaccgcgagcctggagcgcatccagcaggaaaacccccagggcatcgtgctttcgggcgggccgagcagcgtgtacgacgaaggcgccccgcgcccggcccccggcgtgctcgacctgaacgtgccaattctgggcgtgtgctacggcatgcagtacctcgcgcacgaggcgggcggcgacgtgaagcgcgcgggcaagcgcgagtacggcaaggccgacctgaccgagtacggcgggcggctgttcgaggggattcagggcgagttcgtggcctggatgagccactccgactcggtgacgcagcttccgcagggctaccaggtggtggcccgcaccgagcacacccccgtcaccgccatcgagaacaacgacacacggcgctacggcgtgcagtttcaccccgaagtcgtccacacccccaaaggtgggcagatgctcgccaacttcctcgacatctgcggcgtgacccgcgactggaacgccgagcacatcgtggacgaactcatcgagggcgtgcgggcacaggtgggcgacacgggccgggtgctgctcggcatctcgggcggggtggactcctccacgctggcgctgctgctggcgaaggcggtgggcgagcggctgaccgccgtgtttatcgaccacggcctgctgcgcctcggcgagcgcgaacaggtggaagcggccctgacccctctcggcgtcaatctggtcacggtggacgccaaagacgaattcctcggccagcttgcgggcgtgagcgaccccgagcagaagcgcaaaatcatcgggcgcgagttcatccgggccttcgagcgcgaaacggccaagctcggcgacttcgagtttctggcgcagggcacgctgtaccccgacgtgatcgagtcggcgggcggtgagggcgcagccaacatcaagagccaccacaacgtaggcggcctccccgatgacgtgcagttcaaactcgtcgagcccttccgcaccctgttcaaggacgaggtgcgcgagattgcccgcctgctggggctgcccgaccacatccgcatgcgtcaccccttccccggccccggcctggcgattcgctgcctcggcgaagtcaccgcggagaaggtggacatcctccagcgggtagacgacatcttcatttccggcctgcgcgagttcggcctctacgacggctgctcgcaggcgctggcggtgctgacccccattcagtcggtcggcgtgatgggcgacgagcgcacctactcgtacacggcggcgctgcgggccgtgaccaccgacgacttcatgactgccgaatgggcgcgcctgccctacgatttcctggcgaccatgagcaaccgcatcgtcaatcaggtccacgaaattaaccgggtggtctacgacatcaccggcaagccgccggccacgattgagtgggaataa

SEQ ID NO: 78972 - protein, 506 aa, Deinococcus radiodurans
MSIVILDFGSQFTRLITRRFRELGAYSVILPGTASLERIQQENPQGIVLSGGPSSVYDEGAPRPAPGVLDLNVPILGVCYGMQYLAHEAGGDVKRAGKREYGKADLTEYGGRLFEGIQGEFVAWMSHSDSVTQLPQGYQVVARTEHTPVTAIENNDTRRYGVQFHPEVVHTPKGGQMLANFLDICGVTRDWNAEHIVDELIEGVRAQVGDTGRVLLGISGGVDSSTLALLLAKAVGERLTAVFIDHGLLRLGEREQVEAALTPLGVNLVTVDAKDEFLGQLAGVSDPEQKRKIIGREFIRAFERETAKLGDFEFLAQGTLYPDVIESAGGEGAANIKSHHNVGGLPDDVQFKLVEPFRTLFKDEVREIARLLGLPDHIRMRHPFPGPGLAIRCLGEVTAEKVDILQRVDDIFISGLREFGLYDGCSQALAVLTPIQSVGVMGDERTYSYTAALRAVTTDDFMTAEWARLPYDFLATMSNRIVNQVHEINRVVYDITGKPPATIEWE

SEQ ID NO: 78973 - DNA, 1548 bp, Desulfovibrio vulgaris
  CDS (1)..(1548): transl_table=11
atggacgcacagaccaaggtcatcatcatcgactacggctcgcaggttacgcagctcatcgcacggcgcgtacgcgaagccggtgtctactccgagatacacccctgcatcgtcaccgccgagcaggtacgggccatgaagcccgccgccatcatcctttccggcggccctgccagcgtcggcgagaaggacgcacccgccctcgagaaggggctgctcgaccttggcgtgccggtgctcggcatctgctacggcatgcagcttctggggcaggacctcggcggcgagcttgccacctccgagacccgcgaatacgggcctgccgacctcaccctcaccgccccctgccccctgtgggacggtctcgacctcggcaccacctcgcgcgtgtggatgtcccatggcgacaaggtgaagacgccgccccccggcttcaaggtcgtgggccgtaccgccaccctcgaagtggccgccatggccgacgaggcccggcgcatctacgccgtccagtttcatcccgaagtgcaccactccgaggacggggcccgcatcatcaacaacttcctcttccacgtggccaagctgaaggccgactggaccatgtcgtcgttcgtcgaacgcgccgtgaaggagatggccgaagtcgtgggtgacaggcatgtcgtctgcgccctctccggcggcatcgactccaccgtggtcgccgtgctgctgcacaaggccataggcaagcaactgcactgcatcttcgttgacaacggcgtgctgcgcctcaacgagggacaggaagtggtcgactacctgcgcgagcatttcgacctcaacctcaagtacgtgcaggcacaggagcgtttcctctccaagctgcatggcgtcgacgaccccgaacagaagcgcaagatcatcggctacaccttcatcgaggtgttcgacgaagaggccaaggccctcggacatgtcgacttcctcgcgcagggcacgctgtaccccgacgtcatcgaatcggtgtcgcacaagggtccctctgcggtcatcaagagccatcacaacgtgggtggtctgcccgagaagatgaacctgaagctcatcgaaccgctgcgcgaactcttcaaggacgaggtccgcaaggtcgccgccgaactgggcctgcccgacttcatcatctggcgtcaccccttccccggcccggggcttgccatccgggtcatcggcgagataaccgaagagaggctcgacatcctccgccgtgccgacaaggtcgtgcagcaggaactcatgtcctccggctggtaccgcaaggtgtggcagggcttcgccgtgctgctgccgctcaagaccgtgggcgtcatgggtgacgggcgtacttacgaacacgtcatcgccctgcgcatcgtcgacagcgtcgatgccatgaccgccgactgggcacgcttgccttccgaactgcttgagcgtatctccagccggataatcaacgaagtcaagggcgtgaaccgggtggtctacgacatctcgtccaagcccccgagcaccatagaatgggagtaa

SEQ ID NO: 78974 - protein, 515 aa, Desulfovibrio vulgaris
MDAQTKVIIIDYGSQVTQLIARRVREAGVYSEIHPCIVTAEQVRAMKPAAIILSGGPASVGEKDAPALEKGLLDLGVPVLGICYGMQLLGQDLGGELATSETREYGPADLTLTAPCPLWDGLDLGTTSRVWMSHGDKVKTPPPGFKVVGRTATLEVAAMADEARRIYAVQFHPEVHHSEDGARIINNFLFHVAKLKADWTMSSFVERAVKEMAEVVGDRHVVCALSGGIDSTVVAVLLHKAIGKQLHCIFVDNGVLRLNEGQEVVDYLREHFDLNLKYVQAQERFLSKLHGVDDPEQKRKIIGYTFIEVFDEEAKALGHVDFLAQGTLYPDVIESVSHKGPSAVIKSHHNVGGLPEKMNLKLIEPLRELFKDEVRKVAAELGLPDFIIWRHPFPGPGLAIRVIGEITEERLDILRRADKVVQQELMSSGWYRKVWQGFAVLLPLKTVGVMGDGRTYEHVIALRIVDSVDAMTADWARLPSELLERISSRIINEVKGVNRVVYDISSKPPSTIEWE

SEQ ID NO: 78975 - DNA, 2157 bp, Dictyostelium discoideum
  CDS (1)..(2157)
atgacaataacaagtccagtaattaaaacgccaccattaaattcagagattagacttgaatcaaatttaacagttgaatcaggtgatattgaaattaatgaaaaagatattgtaaatgcatcggaagtaatagtaattttagatgcaggatcgcaatatagtaaagtgattgatagaagagttagagaattaaatgttgcatcagaaattcatccattaaatatagatttattagaattaattaagattaaatcaaaatcaggatcaactattaaaggtataattatctctggtggtccagagagtgtctatggtgagaatgcaccaaaattcgataaatcattattctctgagaaattaaatttaccaatatttggtatttgttatggtatgcaattaatgaattatatatttggtggaaaggttgaaagtaattcacaacgtgaagatggtgtgcacaatattgagattttaaaagatgaaaatcaacaacttgtttcaaaactatttaaaaatttaaatcaaaccgagcaagttttattaacacatggtgatagtgttacaaagattgcagatggatttaaaatcatttgtaaatcagacgatggtattgtatcaggtattgagaatgaaagattgggctattatggcgtgcaattccatccagaggttgatttaactaccaacggtaagaaaatgttttcaaactttttaattgacatttgtggttgtagtgcaaattatacattggatgatcgtgaacaacaagcaatcacctatatcaaatctatagtttcaaataaaaaagtattggttttagtatcgggtggtgtagattcaacagtttgtgcagcattaatttcaaaagcaattggtcctgaaaatgttattgcattacatattgataatggtttcatgagaaaagatgagagtttaaatgttgaaaaggcattatcagtattgggtctacatttgattgttgttgacgcatctcaaacattttataattcaaccaccactatcaaaggccatttaacctcatcgttgaaagaaacaatatcaccagaagaaagaagaaaaatcattggtgatacttttatgagagttgcagagaatgaagttaagaaattaggtttacaaccagaggatgtttatttagcccagggtacacttcgtccagatttaattgaatcttcaagtaaaacagttagtggtgttgccgatgttattaaaactcatcataatgatacagaattggttagaatccttagagattcaggtagagtagttgagccattaaaagattatcataaagatgaagttagagaattaggtaaatcattaggtctttcagattctttggtatggcgtcaacctttccctggcccaggtttagcaattcgtatcatttgtgctgatgaaccttatctagtgaattatgattttacaaataatgtcgtgcaatatttagtaaccggtgaagcttcctcagagttggaatcagaagttaaaattaaaattgataaacaattaacagagatgaaatgtaaacgtcaagataaaattacaattaaaccagttttattaccaattcaaactgttgttgttcaaggtgatggtagaacttattcttatttattaggtctttatagttcagagaattcaacaatcgaccaaattccttggtcttatattttcaatttagctagaactataccaaagatttgtcataatataaatagagtggttttcattttctctcaaaatgctactaaacatacaaatattaaagtttcaaatgaaccagttaaacatatcacaccaactcgtttaactcctgatgttattaaacaacttcaacatgctgattcaatagtttcagaacaactctataaatataatttaattaaatcactatcccaagttcccgttgtatcattaccaatagatttcggtgttacaggtaatagatcaatcgcaattcgtacttttattacaaatgatttcatgactggtgttcctgcgattcctggtaaaaatattagtttcgattgtttacaagaaattacaaataatattttaacttctgtaaatggtatttcaaaagttttatttgattgtacttcaaaaccacctggtactactgaattcttataa

SEQ ID NO: 78976 - protein, 718 aa, Dictyostelium discoideum
MTITSPVIKTPPLNSEIRLESNLTVESGDIEINEKDIVNASEVIVILDAGSQYSKVIDRRVRELNVASEIHPLNIDLLELIKIKSKSGSTIKGIIISGGPESVYGENAPKFDKSLFSEKLNLPIFGICYGMQLMNYIFGGKVESNSQREDGVHNIEILKDENQQLVSKLFKNLNQTEQVLLTHGDSVTKIADGFKIICKSDDGIVSGIENERLGYYGVQFHPEVDLTTNGKKMFSNFLIDICGCSANYTLDDREQQAITYIKSIVSNKKVLVLVSGGVDSTVCAALISKAIGPENVIALHIDNGFMRKDESLNVEKALSVLGLHLIVVDASQTFYNSTTTIKGHLTSSLKETISPEERRKIIGDTFMRVAENEVKKLGLQPEDVYLAQGTLRPDLIESSSKTVSGVADVIKTHHNDTELVRILRDSGRVVEPLKDYHKDEVRELGKSLGLSDSLVWRQPFPGPGLAIRIICADEPYLVNYDFTNNVVQYLVTGEASSELESEVKIKIDKQLTEMKCKRQDKITIKPVLLPIQTVVVQGDGRTYSYLLGLYSSENSTIDQIPWSYIFNLARTIPKICHNINRVVFIFSQNATKHTNIKVSNEPVKHITPTRLTPDVIKQLQHADSIVSEQLYKYNLIKSLSQVPVVSLPIDFGVTGNRSIAIRTFITNDFMTGVPAIPGKNISFDCLQEITNNILTSVNGISKVLFDCTSKPPGTTEFL

SEQ ID NO: 78977 - DNA, 1563 bp, Enterococcus faecalis
  CDS (1)..(1563): transl_table=11
gtgactaacgttgccgatttgacatctgtcgaaaaaattattgttttagactttggtagtcagtttaaccaattgattactcgtcgtattcgtgaatttggcgtattctctgagttattaagccaccgaactacggcagaagaaattcgcaaaatcgcgcctaaaggaatcatcttctcaggtggaccaaacagcgtgtatgacaaagatgcttttagcattgatccagaaatttatgagttaggaattcccattcttggcatctgctacggtatgcaattaatgactcataacttaggcggaaaagtagaacctgccgcaaaccgtgaatacggaaaagcagaattagaaatccttggtgatgcgacattattccaaggaacacctgcgaaacaaaccgtttggatgagccacggtgatttagtaacagaaatcgctcctggattcgaaaaagttgggacaagcaacgattgtccaatcgcttctatcgaagatgccaaccgcaaattctacggcgtacaatttcacccagaagttcgtcattcagaatatggtaacgacttattacgtcattttgcttttgatgtgtgtggctgtactggtgactggagcatggaaaacttcatcgatatggaagtcgctaaaatccgtgaacaagtaggcgataaaaaagtcttacttggtttatcaggtggcgttgactcaagtgttgtcggcgtgcttttacaaaaagccattggcgaccaattaacttgtatcttcgttgaccatggattattacgtaaaggtgaagcagaacaagtaatggaaagtttaggcggtaaatttggcttaaacattattaaagtagatgcgaaagaacgcttcttaagcaaattagcaggcgtttctgaccctgaacaaaaacgtaaaatcatcggtaacgaatttgtgtatgtttttgatgacgaagcaactaaacttgctggggaagaaggcgtttcattcctagcacaaggaactctttacacagatgtcatcgaatctggtacagaaactgcgcaaacaattaaatcacatcacaacgttggtggtcttcctgaagacatgcaatttgaattaattgaacctttaaatacattattcaaagacgaagttcgtgccttaggaactgaacttggcatgcctgatgcaatcgtttggcgccaaccattcccaggaccaggattaggtattcgtgtgcttggtgaaattacagaagataagttacaaatcgttcgtgattcagatgctatcctacgtgaagaaatcgcagcagctggcttagatcgtgacatttggcagtactttactgtcttacctggcatccgctcagtaggcgttatgggcgatggccgtacctacgattacacagtcggtatccgtgctgtgacttctatcgacggcatgaccgctgactttgcccgtatcccttgggatgttttacaaaaaatctctgtgcgcatcgtgaacgaagttgcacatgtaaaccgtatcgtgtacgatattacttcaaaaccacctgcaactgtggagtgggaataa

SEQ ID NO: 78978 - protein, 520 aa, Enterococcus faecalis
MTNVADLTSVEKIIVLDFGSQFNQLITRRIREFGVFSELLSHRTTAEEIRKIAPKGIIFSGGPNSVYDKDAFSIDPEIYELGIPILGICYGMQLMTHNLGGKVEPAANREYGKAELEILGDATLFQGTPAKQTVWMSHGDLVTEIAPGFEKVGTSNDCPIASIEDANRKFYGVQFHPEVRHSEYGNDLLRHFAFDVCGCTGDWSMENFIDMEVAKIREQVGDKKVLLGLSGGVDSSVVGVLLQKAIGDQLTCIFVDHGLLRKGEAEQVMESLGGKFGLNIIKVDAKERFLSKLAGVSDPEQKRKIIGNEFVYVFDDEATKLAGEEGVSFLAQGTLYTDVIESGTETAQTIKSHHNVGGLPEDMQFELIEPLNTLFKDEVRALGTELGMPDAIVWRQPFPGPGLGIRVLGEITEDKLQIVRDSDAILREEIAAAGLDRDIWQYFTVLPGIRSVGVMGDGRTYDYTVGIRAVTSIDGMTADFARIPWDVLQKISVRIVNEVAHVNRIVYDITSKPPATVEWE

SEQ ID NO: 78979 - DNA, 1539 bp, Fusobacterium nucleatum
  CDS (1)..(1539): transl_table=11
atgaaaaaaggtggaattgttatacttgactttggttctcaatacaatcaacttattgcaagaagagtcagagaaatgggtgtctatgctgaagttgttccttttcatgaagatgttgataaaattttagctagagagccaaaaggaattattctttctggtggacctgcttctgtttatgctgagggggctccaagtttggatataaaattatttcaaaataatattccaattcttggactttgttatggtatgcaattaattactcatttacatggtggaaaagttgcaagagctgataaacaagagtttggtaaggccgaactagaacttgatgataaaaatcatatactatataaaaatattccaaataagactactgtttggatgagccatggagaccatgttactgaaatggcacctgattttaaaattattgctcacactgattcttcaatagcagctattgaaaacagtgataaaaatatctatgctttccaatatcacccagaagttactcactcacaacatggttttgatatgcttaaaaattttatttttggtatagcaaaagctgaaaaaaactggtctatggaaaactatattgaatcaactgttaagcaaataaaagaaagagttggaaataaacaagtaatactcggtttatctggtggggttgattcatctgttgctgctgcacttatcaataaagcaataggtagacaattaacttgtatttttgttgatactggtttacttagaaaagatgaagctaaacaagttatggaagtttatgctaaaaactttgatatgaatattaaatgtataaatgcagaagaaagatttttaacaaaacttgctggagtaactgatcctgaaactaagagaaaaattataggaaaagaatttgttgaagtatttaatgaagaagctaaaaagattgaaggtgctgaatttttagcacagggtacaatctatccagatgttattgagtctgtttctgttaaaggaccatctgttactataaaatctcatcataatgttggaggtttaccagaagacttaaaatttgaattacttgaacctttaagagagctatttaaagatgaagttagaaaagttggtagagaattaggtattcctgattatatggtagatagacatccattcccaggacctggtttaggaattagaattttaggagaagttacaaaagaaaaagctgatattttaagagaagctgatgcaatatttatagaagaattaagaaaggctgatttatataataaagttagccaagcttttgttgttttacttcctgtaaaatctgttggagttatgggagatgaaagaacttatgaatatacagctgttttaagatctgctaatacaatagattttatgactgctacttggtctcacttaccttatgaatttttagaaaaggtttctaatagaattttgaatgaggttaaaggaattaatagattaacttatgatatttcttctaaaccacctgctactattgagtgggaatag

SEQ ID NO: 78980 - protein, 512 aa, Fusobacterium nucleatum
MKKGGIVILDFGSQYNQLIARRVREMGVYAEVVPFHEDVDKILAREPKGIILSGGPASVYAEGAPSLDIKLFQNNIPILGLCYGMQLITHLHGGKVARADKQEFGKAELELDDKNHILYKNIPNKTTVWMSHGDHVTEMAPDFKIIAHTDSSIAAIENSDKNIYAFQYHPEVTHSQHGFDMLKNFIFGIAKAEKNWSMENYIESTVKQIKERVGNKQVILGLSGGVDSSVAAALINKAIGRQLTCIFVDTGLLRKDEAKQVMEVYAKNFDMNIKCINAEERFLTKLAGVTDPETKRKIIGKEFVEVFNEEAKKIEGAEFLAQGTIYPDVIESVSVKGPSVTIKSHHNVGGLPEDLKFELLEPLRELFKDEVRKVGRELGIPDYMVDRHPFPGPGLGIRILGEVTKEKADILREADAIFIEELRKADLYNKVSQAFVVLLPVKSVGVMGDERTYEYTAVLRSANTIDFMTATWSHLPYEFLEKVSNRILNEVKGINRLTYDISSKPPATIEWE

SEQ ID NO: 78981 - DNA, 1563 bp, Geobacter sulfurreducens
  CDS (1)..(1563): transl_table=11
atgagcaccgacatccatactgaaaaaatcctgatcctggacttcggctcccagtacacccagcttattgcccggcgggtgcgcgaggctcacgtctactgcgagcttcacccctttgacatggggctggaagccatccgcgccttcgctcccaagggaatcatcctctcgggggggcccaagtcggtctacgaagaaggggcgccggctgtggaagaggcgttgtttgatctgggggtgccggtgctcggcatctgctacggcatgcagctcatgagccgccacttcggcggcgaggtagtacccgcgggcaagcgcgagttcggccacgccgacctcttggccgcgggaactcccggtcctctcttcgaagggttcttcgtggaagggaaaagcccggtctggatgagccacggcgaccatgtctcccggatgccccaagggttccaggtggtggcggagacggccaacgcgccggtctgcgccatccaggacacggcgcgcaacctttacggcgtccagttccacccggaggtaaatcacacgccccggggcgagatcctcatcgatacctttgtccgcaagatctgcggctgcaccggccagtggacccccggacacatcatcgaggacgccgtgaaccgtatccgggcccaggtgggccgggagcgggtcatcctcgggctttcgggcggcgtcgattcgtcggtggcggcggcccttatccatcgggccatcggcgaccagctcacctgcgtcttcgtggacaacggcctgctgcgcctcgccgagggtgaccaggtgatggccacctttgccgagaacctgggcgtcaaggtgatccgggtcgatgccgagcagcggttcctgaccgccctggccgatgaggcagacccggagaaaaagcgcaagatcatcggcaatctcttcgtggagatcttcgaagaggagtcgagccgcatcgagggtgccacctggctggcccaggggaccatctatccggatgtcatcgagagcgccggggccaaaaccggcaaggcccacaacatcaagagccatcacaacgtgggcgggcttcccgagtacatgaagctcaagctcctcgaacccctgcgggagctgttcaaggacgaggtgcgggccatcggtgaggaacttggactgccccgccagatggtctggcgccatcccttcccggggccggggctgggggtcaggattctgggcgaggtgaagaaagagtacgccgatatcctgcgccgggccgacgccatctatatcgaggagctctacgccgccggccactatgacaagatcagtcaggcctttgccgtcttcctccccgtcaagagcgtgggggtcatgggggatggccggacctacgagtacgtgatcgctctgcgggccgtggagaccaaggacttcatgaccgcgggctggtatcctttgccctacgaggacatggcccgcatctcgggccggatcatcaacgaggtcaagggggtcaatcgggtcgtgtacgacatctccagcaagcctcccgccaccatcgagtgggaatag

SEQ ID NO: 78982 - protein, 520 aa, Geobacter sulfurreducens
MSTDIHTEKILILDFGSQYTQLIARRVREAHVYCELHPFDMGLEAIRAFAPKGIILSGGPKSVYEEGAPAVEEALFDLGVPVLGICYGMQLMSRHFGGEVVPAGKREFGHADLLAAGTPGPLFEGFFVEGKSPVWMSHGDHVSRMPQGFQVVAETANAPVCAIQDTARNLYGVQFHPEVNHTPRGEILIDTFVRKICGCTGQWTPGHIIEDAVNRIRAQVGRERVILGLSGGVDSSVAAALIHRAIGDQLTCVFVDNGLLRLAEGDQVMATFAENLGVKVIRVDAEQRFLTALADEADPEKKRKIIGNLFVEIFEEESSRIEGATWLAQGTIYPDVIESAGAKTGKAHNIKSHHNVGGLPEYMKLKLLEPLRELFKDEVRAIGEELGLPRQMVWRHPFPGPGLGVRILGEVKKEYADILRRADAIYIEELYAAGHYDKISQAFAVFLPVKSVGVMGDGRTYEYVIALRAVETKDFMTAGWYPLPYEDMARISGRIINEVKGVNRVVYDISSKPPATIEWE

SEQ ID NO: 78983 - DNA, 1656 bp, Gloeobacter violaceus
  CDS (1)..(1656)
atgacctccagcccgaccgccgctgcacggaccgaaggggaagccgcccccaccgtgccgacccaggtcgaaagcggaaccgcccagcgccctgggctcgcccgcgagatggtcgcgatcctcgatttcggttcgcagtactcggagttgatcgcccgccgcatccgcgagaccaaagtctactccgaggtgctgagctaccagacgccaatcgccgaaatccggcgcctggcccccaaggggatcatcctctccggcggtcccaattcggtctacgaggcctacgcgccccagtgcgatccggccctgtgggagctgggcattccgatcttgggcgtctgctacgggatgcaactgatggtccagcaattgggcggggcggtcgagcgggctgagcgggccgagtacggcaaagcttcgctgtttatcaacgatccgacggacctgttcaccaacgtcgaagacggcaccaccatgtggatgagccacgccgactcggtcctgcggatgcccgagggttttgagctgttggcccacaccgagaacaccccctgcgccgccatcgcccaccacagccgccacctctacggtgtgcagttccacccggaggtggtccactcgcgcggcggcatggccctgttgcgcaacttcgtctaccacatctgcggctgcgaacccgagtggacgaccgccgcctttatcgaggaggcgatccgcgaggtgcgcgcccgggtgggcgacaaacgggtgttactcgccctttccggcggggtcgattcttcgacgctcgcctttttgctgcaccgggcgatcggcgacaacttgacgtgtatgttcatcgaccagggcttcatgcgcaagaacgagcccgagcggttggtcaagcttttcaaagaacagttccacatcccggtggcctacgtcgatgcggccgagcgctttattgtccggctggagggggtgagcgacccagagcaaaagcgcaagattatcggcgccgaatttatccgggtattcgagtcggagtcccagcggctcgggccttttgactatctggcccagggcacgctctatcccgacatcatcgagtcggcgggcgaaaatatcgacccgaagaccggcgagcgggtggccgtcaagatcaaatcccaccacaacgtcggcggcttgcccgaaaatttgcgcttcaagctggtcgaaccgctcaagcgactcttcaaagacgaagtgcgccaggtgggccgcgccctggggctgccggaggaaatcgtccagcgccagccttttccaggaccgggtcttgccatccgtgtgctgggagaactcaccaaggacaaagtcgacatcctgcgcgaggccgacttcatcttgcgccaggaagtgaaccgctccggccgctacaacgactactggcagtcgtttgcggtgctgctgccggtcaagaccgtgggggtgatgggcgaccggcgcacctacgcctacgccctcgccctgcgctttgtgaccagcgaagacggcatgaccgccgactgggcgcgggttccctacgacctgctggagcaaatcgccaaccgcatcgtcaacgaggtgccgggcatcaaccgggtggtgctggacatcacctccaagccgcccggcacgatcgagtgggagtaa

SEQ ID NO: 78984 - protein, 551 aa, Gloeobacter violaceus
MTSSPTAAARTEGEAAPTVPTQVESGTAQRPGLAREMVAILDFGSQYSELIARRIRETKVYSEVLSYQTPIAEIRRLAPKGIILSGGPNSVYEAYAPQCDPALWELGIPILGVCYGMQLMVQQLGGAVERAERAEYGKASLFINDPTDLFTNVEDGTTMWMSHADSVLRMPEGFELLAHTENTPCAAIAHHSRHLYGVQFHPEVVHSRGGMALLRNFVYHICGCEPEWTTAAFIEEAIREVRARVGDKRVLLALSGGVDSSTLAFLLHRAIGDNLTCMFIDQGFMRKNEPERLVKLFKEQFHIPVAYVDAAERFIVRLEGVSDPEQKRKIIGAEFIRVFESESQRLGPFDYLAQGTLYPDIIESAGENIDPKTGERVAVKIKSHHNVGGLPENLRFKLVEPLKRLFKDEVRQVGRALGLPEEIVQRQPFPGPGLAIRVLGELTKDKVDILREADFILRQEVNRSGRYNDYWQSFAVLLPVKTVGVMGDRRTYAYALALRFVTSEDGMTADWARVPYDLLEQIANRIVNEVPGINRVVLDITSKPPGTIEWE

SEQ ID NO: 78985 - DNA, 1572 bp, Haemophilus ducreyi
  CDS (1)..(1572): transl_table=11
atgaataacattcacaatcataaaatcctaattttagatttcggttcacaatacacgcaattaattgcacgtcgcatacgtgaaattggagtctactgtgaactttgggcatgggacgtaacagaaaaacagatccgtgaatttaacccaaccggcatcattctttcgggcggccctgaaagtaccaccgaaactaatagcccgcatgcacctgaatatgtctttaaggcaggcgtacccgtattaggcatctgctatggtatgcaaactatggcaatgcaattaggcggtttaaccgaagcttctgaacagcgcgaatttggctatgccgctgttgaattacaacatgcagatcaattattcgcaaaattaaatgatgatttaaccgcttcacaacctaaattagatgtttggatgagccatggcgataaagtcacacgcctacctgcaggctttcaaactactgcagtaactccaacttgccctattgcagctatgtctgatgaaaaacgacgtttctacggcgtacaattccaccctgaagtcacacacacgaaaagtggtttagcattgctgactaattttgtagaaaatatttgtggttgtgcacgtagctggacacctgaaaatattattgaagatgccgttgctaaaattaaacaaaaagtaggcaatgaccaagttattttaggactatccggtggcgtagactcatcagtcactgccctattattacaccgcgcaatcggtaaaaatttacattgcgtatttgtcgataacggcttgctccgcttaaatgaaggcgatcaagtaatggaaatgtttggcgataaatttggcttaaacatcattcgcgttaacgcggaagaacgcttcttagaagcgcttaaaggtattgatgaaccagaagcaaaacgaaaaattattggtaaagtatttattgatatatttgatgatgaagccaaaaaactcactgacgtaaaatggttagcacaaggcacgatctaccctgatgtcattgaatcagcagcaagcaaaacaggcaaagcacacgtgatcaaatcacatcataacgtaggtggcttaccagactacatgaagcttggcttagtcgaaccattacgtgagctttttaaagatgaagtacgtaaaattggcctcacattaggcctgcctgctgaaatgctcaatcgccaccctttcccaggccccggtttaggcgtacgtgtactaggtgaaatcaaaaaagaatactgcgatttattacgcaatgcagatgccatttttattgaagaactttataaatcaggctggtattacaaagtgagccaagcatttaccgtcttcttacccgtgaaatctgtaggcgtaatgggcgatggacgcaaatacgactgggtcgtatctctacgtgcggtagaaaccattgattttatgaccgctcattgggcacatttaccctatgaattactaggtaaaatctcaaaccgcatcatcaacgaagtaaatggcatttctcgcgtcgtatatgacgtgtcaggcaaacctcctgcgactattgagtgggaatag

SEQ ID NO: 78986 - protein, 523 aa, Haemophilus ducreyi
MNNIHNHKILILDFGSQYTQLIARRIREIGVYCELWAWDVTEKQIREFNPTGIILSGGPESTTETNSPHAPEYVFKAGVPVLGICYGMQTMAMQLGGLTEASEQREFGYAAVELQHADQLFAKLNDDLTASQPKLDVWMSHGDKVTRLPAGFQTTAVTPTCPIAAMSDEKRRFYGVQFHPEVTHTKSGLALLTNFVENICGCARSWTPENIIEDAVAKIKQKVGNDQVILGLSGGVDSSVTALLLHRAIGKNLHCVFVDNGLLRLNEGDQVMEMFGDKFGLNIIRVNAEERFLEALKGIDEPEAKRKIIGKVFIDIFDDEAKKLTDVKWLAQGTIYPDVIESAASKTGKAHVIKSHHNVGGLPDYMKLGLVEPLRELFKDEVRKIGLTLGLPAEMLNRHPFPGPGLGVRVLGEIKKEYCDLLRNADAIFIEELYKSGWYYKVSQAFTVFLPVKSVGVMGDGRKYDWVVSLRAVETIDFMTAHWAHLPYELLGKISNRIINEVNGISRVVYDVSGKPPATIEWE

SEQ ID NO: 78987 - DNA, 1527 bp, Helicobacter pylori J99
  CDS (1)..(1527): transl_table=11
atgattttagtattagattttgggagccaatacacgcagctgatcgctagaagattgagagagagtgggatttatgcagagatagtccctttttttgaaagcgtagaaaacattcaaaaaaaagcccctaaaggtttgattttgagtggggggccagcgagcgtgtatgctaaagacgcttacaagcccagtgaaaaaatctttgatttgaatttaccaattttagggatttgctacggcatgcagtatctggtggatttttttgggggggtagtggcctatgcgaatgagcaagaatttggtaaggctattttagaaatcgttcaaaattctgtgatttttgaaggcgtgaagattaaaagccttgtgtggatgagccacatggataaagtcatagaattgccaaaaggctttactacccttgcaaaaagccctaattcgccctattgcgcgattgaaagcgataagatttttggcttgcaattccacccagaagtcattcaaagcgaagaagggggtaagattttagaaaattttgcccttttagtttgcggctgtgaaaaaacttgggggatgcagcatttcgctcaaagagaaatagtgcggttgaaagaaaaaatcgctaacgctaaggtgttgtgcgcggtgagtgggggcgtggattctacggtggtcgctacgctattgcacagagccattaaggataatttgatcgctgtttttgtggatcatggcttgttgcgtaaaaatgaaaaagaaaaagtccaagcgatgtttaaagacttgcaaatccctttgaacacgatagacgctaaagaagtctttttgtctaaattaaagggcgtgagcgagcctgaattgaagcgaaaaatcatcggcgagacctttattgaagtgtttgaaaaagaagccaaaaaacaccatttaaaaggcaagattgaatttttagcccaaggcactttataccctgatgtgattgaatccgtgagcgttaaagggccttcaaaagtgatcaaaacgcaccataatgtgggcggactgcctgaatggatggactttaaactcatagagcctttaagggaattgtttaaagatgaggtgcgtttgttgggtaaagaattgggcgttagtcaggattttttaatgcgccacccctttccagggcctgggcttgcaataaggattttaggcgagattaacgaaaataagatcaaacgcttgcaagaagcggatgctatttttatagaggagcttaaaaaagccaatttgtatgacaaggtttggcaagctttttgcgtgctgttgaatgtcaattctgtgggggttatgggggataatcgcacttatgaaaacgctatttgtttaagagcggtaaatgcgagcgatggcatgacagcgagcttttcatttttagagcattcttttttagaaaaggtttctaaccgcatcactaatgaagtgaatggtattaatagggtggtgtatgatattacctctaaaccaccaggaacgattgaatgggaatga

SEQ ID NO: 78988 - protein, 508 aa, Helicobacter pylori J99
MILVLDFGSQYTQLIARRLRESGIYAEIVPFFESVENIQKKAPKGLILSGGPASVYAKDAYKPSEKIFDLNLPILGICYGMQYLVDFFGGVVAYANEQEFGKAILEIVQNSVIFEGVKIKSLVWMSHMDKVIELPKGFTTLAKSPNSPYCAIESDKIFGLQFHPEVIQSEEGGKILENFALLVCGCEKTWGMQHFAQREIVRLKEKIANAKVLCAVSGGVDSTVVATLLHRAIKDNLIAVFVDHGLLRKNEKEKVQAMFKDLQIPLNTIDAKEVFLSKLKGVSEPELKRKIIGETFIEVFEKEAKKHHLKGKIEFLAQGTLYPDVIESVSVKGPSKVIKTHHNVGGLPEWMDFKLIEPLRELFKDEVRLLGKELGVSQDFLMRHPFPGPGLAIRILGEINENKIKRLQEADAIFIEELKKANLYDKVWQAFCVLLNVNSVGVMGDNRTYENAICLRAVNASDGMTASFSFLEHSFLEKVSNRITNEVNGINRVVYDITSKPPGTIEWE

SEQ ID NO: 78989 - DNA, 2082 bp, Homo sapiens
  CDS (1)..(2082)
atggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaa

SEQ ID NO: 78990 - protein, 693 aa, Homo sapiens
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 78991 - DNA, 1554 bp, Lactobacillus rhamnosus
  CDS (1)..(1554): transl_table=11
gtggcaaatgaccagaacaaggattacgacaagatcatcgtcctcgattatggtagtcagtataatcagttaatcacccggcgtatccgggaatttggtatctactctgaattaaagcctcataccatcacagcggctgaagtcaagaaaatcgcgcctaagggaattatcttctctggtggtccgaacagtgtctatgacgaaggtgcgctcggggttgatgaggacattttcaaacttggcattccgattctaggcgtgtgttatggtatgcagctgatggcccaacgactcggcggtgatgttgaaccggcagacaaccgcgaatacggcaaggccgacatcgaagtcaccgatgctagcgccaaactcttccatgatctgccaaaagaccagaccgtctggatgagccacggcgatctagtcacccgcgttccggatggtttccgcaccacggccaccagcgtcaactgcccaatcagtgcgatggacgacgatgaccggaaattctacggcattcaattccacgccgaagtacaaaacacccaatacggccacgaaatcctacaccattttgccttcgacgtctgccacgccgaagccaactggagcatggacgacttcatcaccaaacaaatcgccaaaatccgggccgaagtcggtgacaagcgcgtcctcctcggcctctccggcggggtcgactcatccgttgtcggcgttttgctacacaaagcaatcggcacccagctaaccagcatcttcgttgatcacggcctgctgcgaaaaggcgaagctgaacaagttatggacagtctcaaaggtaaatttggcctcaacatcatcaaagttaacgccaaagaccgcttcctcaatgacctaagaggcgtcactgaccccgaaaagaaacggaaaatcatcggccgcgacttcatcgaggtgttcaacgaagaagctgccaaactcaacggcatcgaattcctcgcccaaggtacgctatacaccgacgtggttgaatccggaaccgacaccgcgcaaacaatcaagtcccaccataacgtcggcggcctaccagaagacctcaagttcaaactaatcgaaccactgaacaaactcttcaaagatgaagtccgcgaactaggcgaaaaactcggcatgccacattccctcgtctggcgccaaccattcccgggcccaggcctcggcatccgggttatcggcgaagtgaccgaagataaactggagattgtgcgcgactccgactatatcttgcgggaagaaatcgctaagcatgggttggataaggatatttggcaatactttacggtgttgccagggattcgttccgtgggtgtaatgggcgacggtcgcacctacgactacaccatcggcatccgcgccatcacctcaatcgacggcatgaccgccgactttgctaggattgactgggatgtgctgcaggagatctctagtcggattgttaatgaagtgaagcatgttaatcgcgttgtgtatgatatcacttctaagccaccggcaacgattgagtgggaataa

SEQ ID NO: 78992 - protein, 517 aa, Lactobacillus rhamnosus
MANDQNKDYDKIIVLDYGSQYNQLITRRIREFGIYSELKPHTITAAEVKKIAPKGIIFSGGPNSVYDEGALGVDEDIFKLGIPILGVCYGMQLMAQRLGGDVEPADNREYGKADIEVTDASAKLFHDLPKDQTVWMSHGDLVTRVPDGFRTTATSVNCPISAMDDDDRKFYGIQFHAEVQNTQYGHEILHHFAFDVCHAEANWSMDDFITKQIAKIRAEVGDKRVLLGLSGGVDSSVVGVLLHKAIGTQLTSIFVDHGLLRKGEAEQVMDSLKGKFGLNIIKVNAKDRFLNDLRGVTDPEKKRKIIGRDFIEVFNEEAAKLNGIEFLAQGTLYTDVVESGTDTAQTIKSHHNVGGLPEDLKFKLIEPLNKLFKDEVRELGEKLGMPHSLVWRQPFPGPGLGIRVIGEVTEDKLEIVRDSDYILREEIAKHGLDKDIWQYFTVLPGIRSVGVMGDGRTYDYTIGIRAITSIDGMTADFARIDWDVLQEISSRIVNEVKHVNRVVYDITSKPPATIEWE

SEQ ID NO: 78993 - DNA, 1812 bp, Leptospira interrogans
  CDS (1)..(1812): transl_table=11
atggttatccataaaaaaatcgccgtggttgattttggcggacaatatgctcatttaattgcttctagaattagaagacttggggcatatacggaaattctttctaacgaagaacctatttctaattatcaaaagtattcaggtatcattctttccggtggtccggaaagcgtttatgagccaaattctcctaccgttacaactagaatttttgatttaggaattcctatacttggaatctgttacggtcatcaacttattatgaaattattaggcggtgttgtagaacgttctggaactggagaatacggtcctgcttctctacaacttcatggaaccaatggaaattctattttgaaaaatttcgtaggtggggagcaggtttggatgaaccacgcggatgaagttgtaaaacttccagaaggtttttctaaaattgctttttctaaagattgcggttatgcggttgttgcaaattcatctaagaaaatttttggaattcagtttcatgcagaagttagtcatagcgaaaaaggttcggttcttttagataatttcattcaaatttgtggggtttctaaaacttggggaatcgatcagtttttaaaagaaaaaatcaaagagattcaagaaacagttaaacaagaacagaaaatttttatgctcgtttctggaggtgtggattctacggtttcttaccttcttttgtgtaaggctcttggtgctgaaagagttttaggttttttgattgatactggttttatgagaaaagacgaagttgtttctcttcaaaaaaaattaacttttcagaatattcacctaacagtgagagacgaatcctctcttttttataaaagtttaaaagataaatccgatccggaagaaaaaagaaaaattgtaggtaatttatttttagaagcgagagatcgtgctgtaaaagatttagatctggaatacggagattggcttttaggtcaaggtactatttatccggatacgatcgaatctggtggaaccaaacattcgcataccattaaaacgcatcacaatcgggtagaagcgattcaaaaactgattgaacaaggaaaagtaatagaaccgattcgggatctttataaagacgaggtaagggatttaggtgtccttctgggtttggaatcggaatgggtagggcgtcatccgtttccaggaccggggcttgtggttcgtatgctcgcagtagaaaaaaaaggaaccgataaggatcagttggaaattgattcctatctttcgacccaagatgggttgtccggaaaaattcttccgattgcaagtgtgggtgtcaaaggagacagaaggtcttatgccaattgtgttgtgttaaacgacattgaaacagattggaacactttagatcgtgtagctactcatctttcaaaccgattttcttttatcaatcgagtggttcttttaccttttgaatcggatcttaaaaaatggaactttcaatttactggaatgcagttagataaaaaatgttcggacttactccgtgaagctgattttacagttgaatccgtgattcgtaaattgggactttataataaaatctggcagatgcctgtggttttacttccgattggagaaaaggagaatgaaaaaagtatcgtccttcgtcctgtagaatctcaagaagcgatgactgctaatttttttaggatggaacgttctgttttacaagaaattaaaatagaagttctaaaaattcctgaaattcgttatctattttttgatctcacgaacaaacctcccggaacgatcgagtgggaataa

SEQ ID NO: 78994 - protein, 603 aa, Leptospira interrogans
MVIHKKIAVVDFGGQYAHLIASRIRRLGAYTEILSNEEPISNYQKYSGIILSGGPESVYEPNSPTVTTRIFDLGIPILGICYGHQLIMKLLGGVVERSGTGEYGPASLQLHGTNGNSILKNFVGGEQVWMNHADEVVKLPEGFSKIAFSKDCGYAVVANSSKKIFGIQFHAEVSHSEKGSVLLDNFIQICGVSKTWGIDQFLKEKIKEIQETVKQEQKIFMLVSGGVDSTVSYLLLCKALGAERVLGFLIDTGFMRKDEVVSLQKKLTFQNIHLTVRDESSLFYKSLKDKSDPEEKRKIVGNLFLEARDRAVKDLDLEYGDWLLGQGTIYPDTIESGGTKHSHTIKTHHNRVEAIQKLIEQGKVIEPIRDLYKDEVRDLGVLLGLESEWVGRHPFPGPGLVVRMLAVEKKGTDKDQLEIDSYLSTQDGLSGKILPIASVGVKGDRRSYANCVVLNDIETDWNTLDRVATHLSNRFSFINRVVLLPFESDLKKWNFQFTGMQLDKKCSDLLREADFTVESVIRKLGLYNKIWQMPVVLLPIGEKENEKSIVLRPVESQEAMTANFFRMERSVLQEIKIEVLKIPEIRYLFFDLTNKPPGTIEWE

SEQ ID NO: 78995 - DNA, 1557 bp, Listeria innocua
  CDS (1)..(1557): transl_table=11
ttgtttaaaattatgaaagactttaccgagcaagagaaaattatcgttctagattttggtagtcagtacaatcaactaattacgcgccgcattcgtgaattcggtgtgtatagtgaattacatccgcatactattacagttgaagaaatgaaagcactaaatccaacggggattattttttcaggaggacctaacagtgtgtatgacgaagatgccttccgcgcagacgaaagaatctttgacatgggaattccgattttaggaatttgttacggcatgcaattaatgacaacgcacttcggtggcaaagtagaacgtgcgaaagaccgcgaatacgggaaagcggacattcacgttgaaaacccaagccgtttatttgctggactaccaaccgatcaagttgtttggatgagtcatggcgatttagttgtcgaggaaccagctggatttgaagtaacagctactagtaagtcttgcccaattgcaggtattgcggacgaagatcgtttgctttacggcgtgcaattccacccagaagtacgtcactcagcttacggcaacgaattactgaagaattttgcattaaacatttgtggctgtaaaggcgactggacaatggaaaactttagtgaagtagaaatcgctaaaatccaagaaatcgtaggcgacaaaaaagtcttgcttgcactttctggcggcgtagattcctctgttgttggtgtgttaattcataaagcaattggcgaccaattaacatgtattttcgttgaccacggacttcttcgcaaaggggaagctgaccaagtaatggcaacattacaaggcgaattcaacatgaacatcatcaaagtagatgcgaaaaaacgcttcatggacaaacttgctggcgtttccgatccagaacaaaaacgtaaaatcatcggtaacgaattcatttacgtattcgacgacgaagccaacaaactagacggcgtagaattccttgcacaaggaacactttacacagacatcatcgaaagtggtacagcaactgcccaaacaatcaagtctcaccacaacgttggcggcttaccagaagatatgcaatttaaactaatcgaaccattaaatacacttttcaaagatgaagttcgcgcactaggaacagaacttggcatgcctgacgcaatcgtttggcgccaaccattcccaggcccaggcttaggaatccgcgttcttggcgaaattacggaagagaaattagagattgttcgcgattctgattacatcttgcgcgaagaaatcaaaaacgcaggcctagaacgcgaaatctggcaatactttactgctcttccaaatatccgtagcgttggtgttatgggtgatggtagaacgtatgaccatactgtggttgttcgtgcagtgacgagtattgatggtatgacagccgattgggcacgtattccgtgggatgtactggagaaaatttcggtacggattgtgaatgaagtggatcatgtgaatcgtgttgtttatgatattacgagtaagccaccagctacggttgagtgggaataa

SEQ ID NO: 78996 - protein, 518 aa, Listeria innocua
MFKIMKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVENPSRLFAGLPTDQVVWMSHGDLVVEEPAGFEVTATSKSCPIAGIADEDRLLYGVQFHPEVRHSAYGNELLKNFALNICGCKGDWTMENFSEVEIAKIQEIVGDKKVLLALSGGVDSSVVGVLIHKAIGDQLTCIFVDHGLLRKGEADQVMATLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 78997 - DNA, 1590 bp, Mycobacterium leprae
  CDS (1)..(1590): transl_table=11
gtggctgactctgctggcctcgaccagcccgaaccctcgccccgccccgtgttggtggtcgacttcggtgcgcagtatgcacagcttattgcccgccgggttcgagaagcacgggttttttccgaggtaattccgcacaccacctcgatcgaggagatcaccgcccgtgatccgctggcgattgtgctttctggtggaccggccagtgtctatacggaaggtgctccgcagctcgatccagcgctgtttgacctcggtttgccggtgttcgggatctgctacgggtttcaggccatggctcaggtgctcggcgggactgtcgcccgaaccaagaccagtgaatacggccggacggaactgaaagtccttggcggtgatctgcattcgggtcttcctggtgtccagccggtctggatgagtcacggtgacgcggtcaccgccgcgcccgatggattcgacgtggctgccagcagctcgggtgccccagtggccgccttcgagaaccgggaccggcgtctggccggggtgcagtatcacccggaggtgatgcacaccccgcacgggcaacaagtactcagccggttcttgcacgatttcgctgggcttgacgcggattggacggctgccaacatcgctggtgtgctggtcgagcaggtgcgtgcccagatcggcaacggccatgcgatctgcggactgtctggaggtgtggattccgcagtggccgcagcactggtgcaacgcgccatcggagaccgattgacctgtatctttgtcgatcatggtctgctgcgtgacggtgagcgcggacaggtgcagcgtgattttgtcgccgctactggcgctaagctggttaccgtcgacgcggccgagactttccttcaggcgctgtcgggtgtgaccaaccccgaaggcaagcgtaagattatcggacgccagttcatccgggcatttgaaggtgcagtacgggatttgttgggtgacagcacttttgattccgggatcgagttcttggttcagggcacactgtatccggatgtggtggagtccggtgggggcagtggcactgcgaacatcaagagccaccacaatgttggtggtcttcccgacaacctaaggttcaagctcgttgagccgctgcggctgctattcaaagacgaggtgcgtgcggtcggtcgacagttggacctgccggaggaaattgttgctcgccaaccatttccgggtcctggcctgggcatccggatcgttggtgaggtgactgccgaacggctggacacgctgcggcgggccgactcgatagcgcgtgaggagctgaccacggcgggtctggactaccagatttggcagtgcccggtagtgctgctggccgacgtacgttcggtcggtgtgcagggggataatcgcagttacggacacccgatcgtgctgcggccagtgtctagcgaggatgccatgacagccgattggacctgggttccttatgaggtgttggagtgcatctcgacgcgtatcaccaacgaggttgctgaggttaaccgcgtggtgttggacatcaccaacaaaccgcccggcaccatcgagtgggaatag

SEQ ID NO: 78998 - protein, 529 aa, Mycobacterium leprae
MADSAGLDQPEPSPRPVLVVDFGAQYAQLIARRVREARVFSEVIPHTTSIEEITARDPLAIVLSGGPASVYTEGAPQLDPALFDLGLPVFGICYGFQAMAQVLGGTVARTKTSEYGRTELKVLGGDLHSGLPGVQPVWMSHGDAVTAAPDGFDVAASSSGAPVAAFENRDRRLAGVQYHPEVMHTPHGQQVLSRFLHDFAGLDADWTAANIAGVLVEQVRAQIGNGHAICGLSGGVDSAVAAALVQRAIGDRLTCIFVDHGLLRDGERGQVQRDFVAATGAKLVTVDAAETFLQALSGVTNPEGKRKIIGRQFIRAFEGAVRDLLGDSTFDSGIEFLVQGTLYPDVVESGGGSGTANIKSHHNVGGLPDNLRFKLVEPLRLLFKDEVRAVGRQLDLPEEIVARQPFPGPGLGIRIVGEVTAERLDTLRRADSIAREELTTAGLDYQIWQCPVVLLADVRSVGVQGDNRSYGHPIVLRPVSSEDAMTADWTWVPYEVLECISTRITNEVAEVNRVVLDITNKPPGTIEWE

SEQ ID NO: 78999 - DNA, 1566 bp, Neisseria meningitidis
  CDS (1)..(1566): transl_table=11
atgacccaagacaaaatcctcatccttgacttcggttcgcaagttacccagctcatcgcccgccgcgtgcgcgaagcccacgtttactgcgagctgcattccttcgatatgcctttggacgaaatcaaagccttcaaccccaaaggcatcatcctttccggcggccctaattccgtttacgaatccgactatcaagccgataccggtatctttgacttgggcattccgattttgggcatttgctacggcatgcaatttatggcgcaccacttgggtggtgaagtgcaacccggcaaccagcgcgaattcggttacgcgcaagtcaaaaccatcgacagcgagctgacacgcggcattcaagacgatacgccaaacacgctcgacgtatggatgagccacggcgataaagtttccaaactgcctaccggtttcaccgtcatcggcgacacgccgtcctgcccgattgccatgatggaaaacgccgaaaaacaattctacggcatccaattccaccccgaagtaacccacaccaaacaaggccgcgccctgttgaaccgctttgttttggatatttgcggcgcacaaccgggctggacaatgccgaactacatcgaagaagccgttgccaaaatccgcgaacaagtcggcagcgacgaagtgattttaggcttgtccggcggcgtggactcttccgtagccgccgcgctgatccaccgcgccatcggcgaccaactgacctgcgtgttcgtcgatcacggtttgttgcgcctgaacgaaggcaaaatggtgatggatatgttcgcccgcaacttgggtgtgaaagtgattcacgtcgatgccgaagggcagtttatggcgaaactcgccggcgttaccgaccctgagaaaaaacgcaaaatcatcggcgcggaatttatcgaagtatttgatgccgaagagaaaaaactcaccaacgccaaatggctggcgcaaggcacgatttaccccgacgtaatcgaatccgcaggcgcgaaaaccaaaaaagcccacgccatcaaatcccaccacaatgtcggcggcctgcctgaaaacatgaagctcaagctgcttgagccgttgcgcgacttgtttaaagacgaagtgcgcgaactgggcgttgctttgggtctgccgcgcgaaatggtgtaccgccatccgttccccggccccggtttgggcgtgcgcatcttgggcgaagtgaaaaaagaatacgccgacttattgcgtcaagcagacgatattttcatccaagaattacgcaacaccaccgacgaaaacggcacatcttggtacgacctgaccagccaggcatttgccgtattcctgcctgtgaaatccgtcggcgtaatgggcgacggacgcacttacgactacgtcgtcgcactgcgcgcagtcatcaccagcgacttcatgaccgcacactgggcagaactgccttactcactgctcggacgcgtgtccaaccgcatcatcaacgaagtcaaaggcatcaaccgcgtggtttatgatgtgagcggcaaaccgcctgccaccatcgagtgggaataa

SEQ ID NO: 79000 - protein, 521 aa, Neisseria meningitidis
MTQDKILILDFGSQVTQLIARRVREAHVYCELHSFDMPLDEIKAFNPKGIILSGGPNSVYESDYQADTGIFDLGIPILGICYGMQFMAHHLGGEVQPGNQREFGYAQVKTIDSELTRGIQDDTPNTLDVWMSHGDKVSKLPTGFTVIGDTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNEGKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 79001 - DNA, 1560 bp, Nitrosomonas europaea
  CDS (1)..(1560): transl_table=11
atgcattcagccattctcatcctggattttggctcgcaatacacccggctgattgcccggcgcattcgcgagaccaatgtttactgtgaactccatccctttgatgtcagcccgcaattcatccgggaatttgcacctatcggtattattctctccggcgggccagcttcgactttcactgaggatgcgccacgtgtgccgcaaatcgtgttcgagctgggggttcccgtcctcggtatttgttatggaatgcaagccatggcagctcagctcggtggagaagtggaagatgcacagacgcgtgaattcggttacgcagaactgctgactgcgccgtgcaagctgttccatggcatacaggaccgcattaactccgatggcaaaccggctcttgacgtctggatgagccatggcgaccgtgtcaacaaactgccaccgggtttcactgccattgcctccaatgcagcgactcccttcgctgccatggcggatgaaacgcgcaacttttacggagtacagtttcaccctgaagtcacccacacacgacagggcaaggcaattctcgatcacttcgtgcacgatatctgcagtgcaggctatgactggaacatgcctgattacgtggaagaagccattggccggattcgtgcccgtgtcgggaatgataaagtcgtcctggggctatctggaggggtggattcatccgtagccgctgcactcattcatcgtgccattggcgatcaactggtatgcgtattcgtggacaacggcctgcttcgcctgaacgaagccaagcagatcatggaaaccttcagccggaaccttgcggtcaatgtcatttacatcgatgccggcaggcagtttctggaacaactgaaaggaatcaccgaccctgaacagaaacgtcgcaccatcggccgtgagttcgtggaaatcttccagcaggaagctgaaaagatcgaaaatgcaaaatggctggcacagggcaccatctatcctgatgtcattgaatccgctggcagccacaccaagaaagcaggcgttatcaaatcccaccataacgtgggcggtttaccggaaacacttcatctcaaactgctggagccactgcgcgaactgttcaaggatgaagtacgtgaacttggcctggcactgggattgccgcatgatctggtgttccgccatccattccccggcccgggactgggtgtccgtattctgggagaagtcaaatacgaatacaccgagttactgcgtcaggctgatgccattttcatcgaagaactgagaaatgccggctggtacgaaaaaacctctcaggcatttgccgttttcctgccgataaaatcagttggcgtcatgggagacaatcgcagttatgaatatgtagtcgccttacgcgctgttcagaccgaagatttcatgaccgcacactgggcagaactgccctacaccctcctctccagaatctcaaatcgcatcatcaatgaaatccgcggtatcaaccgtgtggtctacgatatatcaggcaaacccccggcaacgatcgagtgggagtag

SEQ ID NO: 79002 - protein, 519 aa, Nitrosomonas europaea
MHSAILILDFGSQYTRLIARRIRETNVYCELHPFDVSPQFIREFAPIGIILSGGPASTFTEDAPRVPQIVFELGVPVLGICYGMQAMAAQLGGEVEDAQTREFGYAELLTAPCKLFHGIQDRINSDGKPALDVWMSHGDRVNKLPPGFTAIASNAATPFAAMADETRNFYGVQFHPEVTHTRQGKAILDHFVHDICSAGYDWNMPDYVEEAIGRIRARVGNDKVVLGLSGGVDSSVAAALIHRAIGDQLVCVFVDNGLLRLNEAKQIMETFSRNLAVNVIYIDAGRQFLEQLKGITDPEQKRRTIGREFVEIFQQEAEKIENAKWLAQGTIYPDVIESAGSHTKKAGVIKSHHNVGGLPETLHLKLLEPLRELFKDEVRELGLALGLPHDLVFRHPFPGPGLGVRILGEVKYEYTELLRQADAIFIEELRNAGWYEKTSQAFAVFLPIKSVGVMGDNRSYEYVVALRAVQTEDFMTAHWAELPYTLLSRISNRIINEIRGINRVVYDISGKPPATIEWE

SEQ ID NO: 79003 - DNA, 1536 bp, Oceanobacillus iheyensis
  CDS (1)..(1536)
atggaaaataatgagttagtacttgtacttgattttggaagtcaatacaatcagttaattacacgtcgaattagagaatttggcgtttatagtgaacttcattctcataaattaactgctgaagaaatcaaagaaatgaatccaaaaggaattattctttctggtggaccgcatagtgtttatgatgaaaatagttttcgctgtgatgaaggtatttttgaattaggaattcctgtattaggaatttgttatggaatgcagttaatgtcacttcattatgacggtaaggttgaacgctctaaaaaccgtgagtatggtaaagcattgatcgaactagatggagagcctgtactatttaaagacactccaaaaggacagacggtttggatgagtcatggagataaagtcactgcagcaccaccatctttcaacattgatgcaacaagcccttctacaccaattgcagcaattagtaatgtagaaaagaacttgtatggtgttcaattccatccagaagttcgccacacggaatacggaaatgatttattaaatcgctttgtattcgatgtatgcggatgtactggagattggtcaattgagaacttcattgatatggaagtggagaaaattcaagaaaccgttggcgatcgtaaagtattatgtgcgctaagtggtggagtagactcctctgtagttgctgctttgattcataaagcgattggtgatcaactaacttgtattttcgtagatcacggtcttcttcgtaaaaatgaaggagatgatgtcatgaaagtatttgcagaagactttcagatgaatattatcaaagtcgatgcaaaagatcgtttcctatttaaattagagggtgtatctgacccagaattaaaacgtaaaattattggtaatgaatttatctatgtatttgatgatgaagcatcaaaactgaaagatatcgacttcctggcacaaggtactctatatacggatgttattgaaagtggtacggatacagcgcaaaccattaaatctcatcacaacgtaggtggattaccagaagatatgcagtttacgctaatcgagcctttaaatacgttatttaaagatgaagttcgtgaactaggatctcaattaggcgtacctgaccgtattgtctggcgccaaccattcccaggacctggattagctatccgtatccttggtgaagtaaccgaagaacatttagaaatcgttcgtgaatcggatgcaatcctacgtgaagaaattgcaaaagcgggtctagatcgtgatatttggcaatacttcaccgtcctaccgaacattaaaagtgttggagtaatgggggatgcacgtacgtatgctcatacaatcggtatccgtgcggtaacttcgattgatggaatgacttccgattgggcacgtatcccatgggacgtattagaaagaatttctacacgtcttgtgaatgatgtagataatattaaccgcgttgtgtatgacgtaacgagtaagccgcctgctacgattgagtgggagtag

SEQ ID NO: 79004 - protein, 511 aa, Oceanobacillus iheyensis
MENNELVLVLDFGSQYNQLITRRIREFGVYSELHSHKLTAEEIKEMNPKGIILSGGPHSVYDENSFRCDEGIFELGIPVLGICYGMQLMSLHYDGKVERSKNREYGKALIELDGEPVLFKDTPKGQTVWMSHGDKVTAAPPSFNIDATSPSTPIAAISNVEKNLYGVQFHPEVRHTEYGNDLLNRFVFDVCGCTGDWSIENFIDMEVEKIQETVGDRKVLCALSGGVDSSVVAALIHKAIGDQLTCIFVDHGLLRKNEGDDVMKVFAEDFQMNIIKVDAKDRFLFKLEGVSDPELKRKIIGNEFIYVFDDEASKLKDIDFLAQGTLYTDVIESGTDTAQTIKSHHNVGGLPEDMQFTLIEPLNTLFKDEVRELGSQLGVPDRIVWRQPFPGPGLAIRILGEVTEEHLEIVRESDAILREEIAKAGLDRDIWQYFTVLPNIKSVGVMGDARTYAHTIGIRAVTSIDGMTSDWARIPWDVLERISTRLVNDVDNINRVVYDVTSKPPATIEWE

SEQ ID NO: 79005 - DNA, 1572 bp, Pasteurella multocida
  CDS (1)..(1572): transl_table=11
atgaacaacattcacaaccataaaattttaattttggacttcggttcacaatatacccagttgattgcccgccgtgtacgtgaaattggcgtgtactgcgaactttgggcatgggatgtttccgaagccgatattcgtgagtttaatccaactgggattattctttctggtggtcctgaaagtaccactgaagaaaacagcccacgagctcccgaatacgtattcaacgccggtgtacccgtattagggatctgttatggtatgcaaaccatggcgatgcaactaggtggtttaactgaaacttctactcaccgagaatttggttatgcatcagtgaatctaaaagcagcggacgcgttatttgctcaattaaatgatgatgtcacaagttcacagcccaaattagacgtttggatgagccatggcgataaagtgacgcgtttgccagatcatttccaagtcaccgcaatgacctcaacctgtccaattgcagctatgtcggatgaacgtcgtcgtttttatggtgtccaattccacccagaagtgactcatacaaaaagcgggcttgaattattaacgaattttgtggtgaagatctgtggttgtgaacgtaactggacaccagaaaatatcattgaagatgccgttgctcgtcttaaagcacaagtgggtgatgatgaagtgatcttaggattatctggtggcgttgactcttctgtcactgcactactcttacatcgtgcgattggtaaaaacttacactgtgttttcgtagataacggtttattacgtctcaacgaagcggaacaagtgatggagatgtttggcgataaatttggtttaaacattatccacgtaaaagcagaagatcgtttcttagatgcgttaaaaggcatcgatgagcccgaagcaaaacgtaaaatgattggtaaagtctttgtggatgtttttgatgatgaatcgaaaaaactcaccagcgtcaaatggttagcccaaggcacgatttatccagatgttattgagtctgcggcaagtaaaacaggtaaagcacatgtgattaaatcacaccataacgtcggtggtttacctgactacatgaagctaggacttgttgaaccacttcgtgaattatttaaagatgaagtacgtaaaattggtttagcattaggtttaccagccgaaatgttaaatcgtcacccattcccaggacctggtttaggtgtccgtgttttaggtgaaatcaaaaaagaatactgtgatttagtccgccttgctgatgcgatctttatggaagagttgcatgcttctggttggtactacaaagtcagccaagccttcacggtatttttaccagtaaaatccgtaggtgtcatgggtgatgggcgtaaatatgactgggtagtttccctccgtgcagtggaaacaatcgattttatgaccgcacattgggcacacctgccttatgatctcttaggtaaaatttccaatcgtattattaatgaagtcaatgggatttctcgcgttgtttatgacgttagcggtaagccgccagcaacaattgagtgggaataa

SEQ ID NO: 79006 - protein, 523 aa, Pasteurella multocida
MNNIHNHKILILDFGSQYTQLIARRVREIGVYCELWAWDVSEADIREFNPTGIILSGGPESTTEENSPRAPEYVFNAGVPVLGICYGMQTMAMQLGGLTETSTHREFGYASVNLKAADALFAQLNDDVTSSQPKLDVWMSHGDKVTRLPDHFQVTAMTSTCPIAAMSDERRRFYGVQFHPEVTHTKSGLELLTNFVVKICGCERNWTPENIIEDAVARLKAQVGDDEVILGLSGGVDSSVTALLLHRAIGKNLHCVFVDNGLLRLNEAEQVMEMFGDKFGLNIIHVKAEDRFLDALKGIDEPEAKRKMIGKVFVDVFDDESKKLTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLVRLADAIFMEELHASGWYYKVSQAFTVFLPVKSVGVMGDGRKYDWVVSLRAVETIDFMTAHWAHLPYDLLGKISNRIINEVNGISRVVYDVSGKPPATIEWE

SEQ ID NO: 79007 - DNA, 1578 bp, Photorhabdus luminescens
  CDS (1)..(1578): transl_table=11
atgacaactaatatccatcagcaccgcattcttatccttgattttggttcgcaatatactcaattgattgctcgccgtatccgtgaaatcggggtttattgtgaactttgggcatgggatgtcactgaagagcaaatccgcgaatttaacccaagcggcattattctttccggtggcccggaaagtaccacagcacaaggaagtccacgtgctcctgaatatgttttcaacgctggcgttccggttctgggggtctgctatggcatgcaaacgatgtcagtacagtttggtggtaaggtagaagattctactgagcgtgaatttgggtatgctcaggttgagattaaagcggaaagtgcattattccgtgggatccaagattcattaaatgagcaaggtaaaccatcattggatgtatggatgagtcacggtgataaagttactgcaattcccgaggactttatcactatcgccagcactgatacctgtccatttgccatcatagcaaatgaagaaaaacgtttttatggcgtgcaattccacccggaagtcactcatacccatcagggacagcgtatattggaacgttttgtactggatgtatgccaatgtgaagcgttgtggacgcctgcttctattatcgaagataccgttgtacgcctgcgtgaacaggttggtgaggatcacgttattttggggctgtccggtggtgttgattcctctgtcactgcattgttactgcatcgtgcaattggtaaccgcctgacctgtgtatttgttgataatggtttactgcgtttgaatgaagccactcaagtgatggaaatgtttgccggcaaatttggactgaatattgttcatgttcccgcagaagatcgcttcctgactgcactggctggcattaatgatccggaagagaagcgtaaaacaattggccgtgtgtttgttgaagtctttgatgaagaggcgagcaaacaggctcaggttaaatggctggcacaaggcactatttacccagatgttatcgaatcagcggcatctgcgaccggcaaagcacacgttatcaaatctcatcataacgtaggtggtttgccggaagagatgaaattgggtctggtggaaccgctgaaagagttgttcaaagatgaagtacgtaaaattggtttggaattgggattgccttatgacatgttgaaccgtcatccattcccaggcccaggtttgggcgttcgtgtactgggtgaagtgaagaaagagtactgcgatctgttacggcaggctgatgctattttcatcgaagagctgcacaaagctgatttgtacaataaagtcagtcaggcgtttaccgtattcttgccagttcgctccgtgggtgtgatgggggatggtcgtaaatatgactgggttgtttcgttgcgagcagtagaaacgattgattttatgaccgcacattgggcgcatttaccatacgatttcctaggccgggtttctaaccggatcatcaatgaagtcaatgggatatcaagagttgtctatgatgtcagcggcaaaccacctgcgactattgagtgggaatga

SEQ ID NO: 79008 - protein, 525 aa, Photorhabdus luminescens
MTTNIHQHRILILDFGSQYTQLIARRIREIGVYCELWAWDVTEEQIREFNPSGIILSGGPESTTAQGSPRAPEYVFNAGVPVLGVCYGMQTMSVQFGGKVEDSTEREFGYAQVEIKAESALFRGIQDSLNEQGKPSLDVWMSHGDKVTAIPEDFITIASTDTCPFAIIANEEKRFYGVQFHPEVTHTHQGQRILERFVLDVCQCEALWTPASIIEDTVVRLREQVGEDHVILGLSGGVDSSVTALLLHRAIGNRLTCVFVDNGLLRLNEATQVMEMFAGKFGLNIVHVPAEDRFLTALAGINDPEEKRKTIGRVFVEVFDEEASKQAQVKWLAQGTIYPDVIESAASATGKAHVIKSHHNVGGLPEEMKLGLVEPLKELFKDEVRKIGLELGLPYDMLNRHPFPGPGLGVRVLGEVKKEYCDLLRQADAIFIEELHKADLYNKVSQAFTVFLPVRSVGVMGDGRKYDWVVSLRAVETIDFMTAHWAHLPYDFLGRVSNRIINEVNGISRVVYDVSGKPPATIEWE

SEQ ID NO: 79009 - DNA, 1584 bp, Photobacterium profundum
  CDS (1)..(1584): transl_table=11
atgactacatctactaatattcatgaccagcgtatccttattctggattttggttctcaatatactcagctaatcgcacgtcgtatccgtgaaatcggtgtttattgtgagctttggagctgggacgttgatgaagccgatattcgtgacttcaacccgaacggtatcatcctttctggtgggccggagagcgtaaccggagatgaatcacctcgcgcaccacaatatgtgtttgaagcgggtgtacctgtatttggtgtgtgttacggcatgcaaaccatggccgagcagcttggcggtaaagttgccggctcttcaatgcgtgaatttggttacgcacaagtcgaaattgttgaaccaacatcattctttaaaaatattgaagatgcagtagccgaagatggtaatgggttgctggatgtatggatgagccacggtgataaagtggtcgaaatcccgtctgattttgttaaggttgcccaaactgatacttgcccgtttgcggcaattgccaacgaagagaagcatttctacggtgtgcagttccacccggaagtgacccatacccgccagggcatgcgtattatcgagaactttgttcttaatatctgtggctgtgagaacctttggacatcagcaaacatcatagaagacgccattgctaacatcaaagagcaagtgggtgatgatgaagttatcttaggcttatctggcggtgtagattcatctgttgtggctatgctgcttcaccgtgctattggtgacaaactaacctgtgtattcgttgataacggtttgcttcgtttaaacgagggtgagcaagtgatggatatgttcggtgaccattttggtttgaacattgtgcatgttaaagctgaagatcgtttcttaaacgcactggctggtgagaacgatcctgaagcgaagcgtaagattatcggtcacgcctttattgatgtattcgatgaagaatcgaagaagctgaaaaatgctaagtggttggctcaaggtactatctaccctgatgtcatcgagtctgctgcctctaaaaatggtaaagcgcatgtgattaaatctcaccataacgttggcggtctgccagatgatatggaaatgggattagttgagcctctacgtgaattgtttaaagatgaagtacgtaagattggtctagaactaggtcttccgtacaatatgctttaccgccacccgttccctggaccaggtctaggtgtacgtgtactaggtgaagtaaagaaagagtactgtgacttactacgtcgtgcagatgctatcttcattgaagagctacacagtgcagatctttacaacaaagtgtctcaagcatttacggtattcctaccagtacgctcggttggcgtaatgggtgatggtcgtaaatatgattgggttgtatcactgcgtgctgttgaaacgattgatttcatgactgcgcattgggcacaccttccatacgatttcttaggtaaggtttctaaccgtatcattaacgaagttgatggcatttcacgtgttgtttacgatatttctggtaagccaccagcaactatcgagtgggaataa

SEQ ID NO: 79010 - protein, 527 aa, Photobacterium profundum
MTTSTNIHDQRILILDFGSQYTQLIARRIREIGVYCELWSWDVDEADIRDFNPNGIILSGGPESVTGDESPRAPQYVFEAGVPVFGVCYGMQTMAEQLGGKVAGSSMREFGYAQVEIVEPTSFFKNIEDAVAEDGNGLLDVWMSHGDKVVEIPSDFVKVAQTDTCPFAAIANEEKHFYGVQFHPEVTHTRQGMRIIENFVLNICGCENLWTSANIIEDAIANIKEQVGDDEVILGLSGGVDSSVVAMLLHRAIGDKLTCVFVDNGLLRLNEGEQVMDMFGDHFGLNIVHVKAEDRFLNALAGENDPEAKRKIIGHAFIDVFDEESKKLKNAKWLAQGTIYPDVIESAASKNGKAHVIKSHHNVGGLPDDMEMGLVEPLRELFKDEVRKIGLELGLPYNMLYRHPFPGPGLGVRVLGEVKKEYCDLLRRADAIFIEELHSADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 79011 - DNA, 1521 bp, Porphyromonas gingivalis
  CDS (1)..(1521): transl_table=11
atgttggaaaagctcattattctggatttcggttctcaaaccacacagctcatcgccagacgaattcgcgagctgaacacctactgcgaggtttatccctacaacaaactgccggaagacctctcaggagtgcgaggcatcatcctgtcggggagcccttattccgtgtatgacagcaaggcctttcgtatcgaactgagcgaattacggggcaagttgcctctcttgggtatctgctacggtgcacagagccttgtccatcaagccggtggcaaagtagagccgtgcgacagtcgcgaatacgggcgaacacatctgaccctccggcagcctgatgatgcactgctgacaggcctgcaatccggcactacggtatggatgtcccacggcgataccattacgtcattgcctgaaggattcgaggtcatagcaggtaccgaggatgtacccaatgcagcatttcgcatccgaggggagaaaacgtggggcgtacagttccatcccgagatctaccactcggaagaaggtaccaaactgcttggcaacttcctcgatatatgcggtatgaagcgtgattggactccggcttctttcatcgaagcgactgtgcaggaacttcgcgaacgcttaggtgatgacaaggtgatcctggcactctccggaggtgtggacagttcggtggtggcggtgcttctgaacaaagctatcggccgcaacctgacttgtatattcgtcgatcacggcttgctgcgtaagggcgaattcgagcgcgtacttcaggactacgagcacttgggtctcaatgtaatcggggtgaatgcaaaagaaaaattcttcgcagcccttagcggcgttaccgatcccgagcaaaaacggaagattatcggtcgcggcttcatcgaagtgttcgacgaagaagcccggaagctgaaagatatcaaatggcttggtcagggcacgatctaccccgatgtcattgaaagtctgagtatcaccggtatggtgatcaagagtcaccacaatgtgggaggactgcccgagcggatgaatctccgcctcgtggaaccgctccgtatgctcttcaaggacgaagtccgtcgcgtgggactcgagctcggcatgatgccgcacctgatccatcgccatcctttccccggtcccggtctcggcatccgtattctcggagagatcacggaagagaaagctaccatcttgcagaacgccgatgacatctatatgagccttatgcgcgagtgggggctgtatgatcaggtgtggcaggccggagccatcctgctgccggttcggtccgtaggcgtaatgggcgacgagcgtacctacgaatacaccgtggcactgcgtgccgtgacttctatggatgccatgagtgccgattgggtgcatttgccgtatgattttctggccaaggtgtcgaacgaaataatcaataaagtgcgtggcgtaaaccgcgtagtctacgacatctcctccaaaccccccagcacaatcgaatgggaataa

SEQ ID NO: 79012 - protein, 506 aa, Porphyromonas gingivalis
MLEKLIILDFGSQTTQLIARRIRELNTYCEVYPYNKLPEDLSGVRGIILSGSPYSVYDSKAFRIELSELRGKLPLLGICYGAQSLVHQAGGKVEPCDSREYGRTHLTLRQPDDALLTGLQSGTTVWMSHGDTITSLPEGFEVIAGTEDVPNAAFRIRGEKTWGVQFHPEIYHSEEGTKLLGNFLDICGMKRDWTPASFIEATVQELRERLGDDKVILALSGGVDSSVVAVLLNKAIGRNLTCIFVDHGLLRKGEFERVLQDYEHLGLNVIGVNAKEKFFAALSGVTDPEQKRKIIGRGFIEVFDEEARKLKDIKWLGQGTIYPDVIESLSITGMVIKSHHNVGGLPERMNLRLVEPLRMLFKDEVRRVGLELGMMPHLIHRHPFPGPGLGIRILGEITEEKATILQNADDIYMSLMREWGLYDQVWQAGAILLPVRSVGVMGDERTYEYTVALRAVTSMDAMSADWVHLPYDFLAKVSNEIINKVRGVNRVVYDISSKPPSTIEWE

SEQ ID NO: 79013 - DNA, 1587 bp, Prochlorococcus marinus subsp
  CDS (1)..(1587): transl_table=11
atgagtaaaaaattactaaaaaaagagagagatccctcaatattaattctagattttggatctcaatattctgaattaattgcaaggagaataagagaagcagatgtattttctcttgtagtaagtaactttacctctgtcaaggagattcaggatataaatccaaaagggattatattaagtggtggcccaagttctgtttatgaagataatgcacctaaatgtgatgcaaagatttttgatttaggtattccaattttgggtatatgttatggaatgcaattaatggttaaagaattaggaggtgaagttaccccagcaattaataaagctgaatatggcagagcaccaataaatattgattgcgaaagtgatttgctatctaatgtccaagataaatctattatgtggatgagtcatggagattctataaataacttgcctgaaggatttattaagatttctcatacagaaaataccctgcatgctgcaatatcaaacaaacaaaagaaattatttggtgttcaatttcatcctgaagttattcattcagaattcggaatgacggttattaaaaactttgtttattctattgctaaatgtaaggccgattggactactgaaacttttttagaggaaacaattccaagaattaagcaacaagtaggtgataagagagttttacttgctctttctggcggcgtagattcatcaaccctcgcttttcttctcaataaagctattggtaaaaagcttacttgtatgtttattgatcaaggctttatgagaaaaggtgaacctgaatttttaatggaattttttgataaaaaatttcatataaaagttgaatatattaacgctagggaaagatttattgataaattaaatggaataactgacccagaagaaaaacgcaagattattggtagagaatttattagagtttttgaagaggagagtaatagattaggtcctttccaatatttggctcaaggtactctttacccagacgttattgagagtgctggaacgaatttagatccaaagactggtgagcgaattgcagtaaaaataaaaagtcatcataacgtaggcggtttgccaaaagatttacaatttaaattagttgaaccattaagaaaactttttaaagatgaagtaagaaaggttggaggtgctttaggattgccagatgaaatcataaaaagacatccatttcctggccctggcttagcaataagaattttaggtgatgtttctcatgaaaaactaaactgtttgagagatgcagactggatagtaagagatgaaataaaaaaagcaggtctttataatgatatatggcaagcatttgcagttcttttacctgttaagactgtcggtgtaatgggagataaacggacttatgcttggccaatagttttacgatgcgtatcaagcgaagatgggatgacggctgattggtcgagaattccttatgaaaccttagagagaatttctaatagaatcgttaatgaagtagagcaggttaatagggttgttttcgatattactagtaagcctccaggaacaattgagtgggaataa

SEQ ID NO: 79014 - protein, 528 aa, Prochlorococcus marinus subsp
MSKKLLKKERDPSILILDFGSQYSELIARRIREADVFSLVVSNFTSVKEIQDINPKGIILSGGPSSVYEDNAPKCDAKIFDLGIPILGICYGMQLMVKELGGEVTPAINKAEYGRAPINIDCESDLLSNVQDKSIMWMSHGDSINNLPEGFIKISHTENTLHAAISNKQKKLFGVQFHPEVIHSEFGMTVIKNFVYSIAKCKADWTTETFLEETIPRIKQQVGDKRVLLALSGGVDSSTLAFLLNKAIGKKLTCMFIDQGFMRKGEPEFLMEFFDKKFHIKVEYINARERFIDKLNGITDPEEKRKIIGREFIRVFEEESNRLGPFQYLAQGTLYPDVIESAGTNLDPKTGERIAVKIKSHHNVGGLPKDLQFKLVEPLRKLFKDEVRKVGGALGLPDEIIKRHPFPGPGLAIRILGDVSHEKLNCLRDADWIVRDEIKKAGLYNDIWQAFAVLLPVKTVGVMGDKRTYAWPIVLRCVSSEDGMTADWSRIPYETLERISNRIVNEVEQVNRVVFDITSKPPGTIEWE

SEQ ID NO: 79015 - DNA, 1518 bp, Pyrobaculum aerophilum
  CDS (1)..(1518): transl_table=11
gtggagaaggtcctcgttgtcaacttcggcgggcaatacgctcacctgatcgccaggagaattagagaggttggcgtctacgccgaaatagccagccctgaggaggcggtaatcaaggcgagtaaagaagaggtaaaggctgttatcctctctggcgggcctagctctgtctacgagcctggagcgccggatattgacgaggggattttcgccttgtctaaaccagtgttggggatatgttatggtcaccaaatgatcgcaaagaaactaggaggaaaagtggagcgcggcaagggggagtacgggaagacaattgtaaaaattctagtcaacgacccgttgtttgacggctggaaaccagaagaggcggtgtggatgagccacagcgactttgttgaggagccgccgcctggattccacgtattggcaataagtgaaaacggctatattgccgcaatgagaaaggggttaatatacggcgtgcagttccacccggaggttcaccacaccagtaaggggagggtaatgttcgagaacttcttgagaaaaatagctaggatatccgacgtctggcggcccgaggatcaaattacgcgtatagtagaagagataaggagtagggtaaagggcggcgacgtcatagttggagtgagcgggggagtagacagcacggtaactgccgtgttgttgtacaaagccgtgggccaaagggtaaaggctgtttttattgaccacgggctattcagagagggggagcccgaagaggcagcctctttacttaaatctattggaatagacgtggtgtatatagacgcgaaagagcgctttctcaaaagactagagggagtggctgactgcgaggaaaaaaggcgcatcattggggaaactttcgccgaggtgttttccgacgcggtaaagcagatgcccaacgtcaaatacctagcgcagggcacgttatacccagatgtggtggaaagcggggcggtaaagggcgccgacaaaataaaaagccaccacaacgtgggggggctaccgccgtggtttcaattagagcttatagaaccgcttcgagagttttataaagacgaagtgaggcggattgccaaagccctaggccttccggaggacgtggtatatagacatccctttcccggcccgggccttgcggtaaggattattggcccctttactagagaaaaactagccattgtgaggaaagccactaaaatagtggaagaggagttgaggaaagccggtcttttcagaaaagtctggcaagccttcgccacggtgggggaggataagtgggttggggtaaagggcgatagaagagctatggggtacatcgtgacggtaagaattgtggaaagcgaagacgcaatgacggcggactggtcaagaataccctttgaaatccttgagaaaatatcctctagaattacgtcggaaataccagaggttaccatggtgacctacgccgtaacttctaagcctccgtctacaatagagccttgttaa

SEQ ID NO: 79016 - protein, 505 aa, Pyrobaculum aerophilum
MEKVLVVNFGGQYAHLIARRIREVGVYAEIASPEEAVIKASKEEVKAVILSGGPSSVYEPGAPDIDEGIFALSKPVLGICYGHQMIAKKLGGKVERGKGEYGKTIVKILVNDPLFDGWKPEEAVWMSHSDFVEEPPPGFHVLAISENGYIAAMRKGLIYGVQFHPEVHHTSKGRVMFENFLRKIARISDVWRPEDQITRIVEEIRSRVKGGDVIVGVSGGVDSTVTAVLLYKAVGQRVKAVFIDHGLFREGEPEEAASLLKSIGIDVVYIDAKERFLKRLEGVADCEEKRRIIGETFAEVFSDAVKQMPNVKYLAQGTLYPDVVESGAVKGADKIKSHHNVGGLPPWFQLELIEPLREFYKDEVRRIAKALGLPEDVVYRHPFPGPGLAVRIIGPFTREKLAIVRKATKIVEEELRKAGLFRKVWQAFATVGEDKWVGVKGDRRAMGYIVTVRIVESEDAMTADWSRIPFEILEKISSRITSEIPEVTMVTYAVTSKPPSTIEPC

SEQ ID NO: 79017 - DNA, 1563 bp, Rhizobium meliloti
  CDS (1)..(1563): transl_table=11
atgacccagacagcccatcccgataccgtcctcatcgtcgatttcggcagccaggtgacgcagctcatcgcccggcgcgtgcgcgaatccggcgtctattgcgagatcgtgccgttccagtcggccgaggaaggcttccatcgtctgaagccgaaggcggtgatcctgtccggcagcccggcctcgacgctggataccggctcgccccgcgcgccctccgtcatcttcgacagcggcctgccggtcttcggcatctgctacggccagcagaccatgtgcgcccagctcggcggcaaggtcgagagcggccatcaccgggaattcggccgggccttcctcgaggtcgaaaaggattgcccgctcttcgacggcctctggtcgctcggttcgcgccaccaggtgtggatgtcgcatggcgaccgggttaccgcattgcccgagggcttcgaagtcgtcgccacctcgtccaatgcgcccttcgccttcatcgccgatgaaaagcgcaagtactatgccgtccagttccacccggaagtggtgcatacgcctgacggcgcgaagctcatcgccaacttcgtccacaagatcgccggcattaccggcgactggaccatgtcggcctatcgcgccaaggcggtcgaggcgatccgcaagcaggtcggcgacaagaaggtgatctgcgcgctttccggcggcgtcgattcatccgtggcagctctcctcatccacgaagcggtcggggatcagcttacctgcatcctcgtcgaccatggtctgatgcgcaaggacgaggcggcgaacgtcgtcgccatgttcaaggagcactacaacctccatctgctccatatcgacgcttccgatcgcttcatcggcgagctcgaaggcgtcagcgatccggagaccaagcgcaagatcatcggccgtctcttcatcgaggtcttcgaggaagaggccaagaagctcggcggcgccgatttcctcgcccagggcacgctctatcctgacgtcatcgaaagcgtctccttcaccggcggcccctcggtgacgatcaagtcgcaccacaatgtcggcggcctgccggagcgcatgaacatgcagctcgtcgagccgctgcgcgagctcttcaaggacgaagtccgcgtgctcggccgcgaactcggcctgcccgaaagcttcatcggccgccatcccttccccggccccggcctcgcgatccgctgccccggcggcatcacgcgcgagaagctggaaatcctgcgcgaagccgatgcgatctatctcgacgagatccgcaaggccggcctctacgacgctatctggcaggccttcgccgtgctgcttcccgtgcagacggtcggcgtcatgggcgacgggcgcacctacgaattcgtctgcgcgctgcgcgccgtcacctccgtcgacggcatgaccgccgacttctaccactacgacatggaattcctcggccgcgccgccacccgcatcatcaacgaggtccgcggcatcaaccgcgtcgtctacgacgtcacgtcgaagccgccgggcacgatcgagtgggagtga

SEQ ID NO: 79018 - protein, 520 aa, Rhizobium meliloti
MTQTAHPDTVLIVDFGSQVTQLIARRVRESGVYCEIVPFQSAEEGFHRLKPKAVILSGSPASTLDTGSPRAPSVIFDSGLPVFGICYGQQTMCAQLGGKVESGHHREFGRAFLEVEKDCPLFDGLWSLGSRHQVWMSHGDRVTALPEGFEVVATSSNAPFAFIADEKRKYYAVQFHPEVVHTPDGAKLIANFVHKIAGITGDWTMSAYRAKAVEAIRKQVGDKKVICALSGGVDSSVAALLIHEAVGDQLTCILVDHGLMRKDEAANVVAMFKEHYNLHLLHIDASDRFIGELEGVSDPETKRKIIGRLFIEVFEEEAKKLGGADFLAQGTLYPDVIESVSFTGGPSVTIKSHHNVGGLPERMNMQLVEPLRELFKDEVRVLGRELGLPESFIGRHPFPGPGLAIRCPGGITREKLEILREADAIYLDEIRKAGLYDAIWQAFAVLLPVQTVGVMGDGRTYEFVCALRAVTSVDGMTADFYHYDMEFLGRAATRIINEVRGINRVVYDVTSKPPGTIEWE

SEQ ID NO: 79019 - DNA, 1764 bp, Rhodopirellula baltica
  CDS (1)..(1764): transl_table=11
atgcctgcaaccggcatcaccctgccctcgccatccgggcctcccctgccctgctccgccgcaatcttcgtactcgatcatcgctcccgactcccttggcccttccccgtttcccccctgctcttttacactgccgcattggcctttcccgcaatatccggcaagaacacgatgacctcttctgcgaacaccacctcgcccgccatcgctgaaaccacttggctgaccgaccaacgcatcctggtgctcgattttggatcgcaatacgcgcaactgatcgcccgccgcgttcgcgaacaaaacgtttattgccaaattgttcgccacgacatctcggccgaacgcattgcggaactggccccaaaaggcatcatcctttcgggcggcccaaacagcgtttacgaagaaggtgccccgaagtgcgacgaaggattgttcgatctggggatccccgtcctcgggatttgctacgggatgcagctcgcctgccaagcgctcggtggtaaagtcgacaacacacccagccgtgaatatggccgggcgatgtgtgagttcaccgatcgcgattcgatcttccgcggcatgcaagaatcggaacaggtctggatgagccacggcgaccaagtgtcacagatcgccgatcagttcaccgcgatggccaagacatcgacatgcccctacgccgccattcgtcacaacgaacgtccggtctttggaatgcagttccacccggaagtcacgcacacaccacacggcggccaaatccttcgcaactttgtgattgacgtttgcggttgcgacggcagttggaagttaggcgacttcgccgatgccgcgattgaatcgattcgcaaacaagtcggtaacaaacgtgtcatttgcggcctgtccggcggagtcgactcgtcggtcgttgccgcgttgctttacaaagccatcggcccgcagctgtcttgcatcttggtcgacaatggactgctacgaaaaaacgaacaacaaatcgttttggaagagttcagcaaccacttcaagaccgacctgcacatcgtcgaagccgaagaccgattcctggcagacttggcggggatcgatgaaccgcaagagaaacgtcgccgcatcggccacgccttcattgaatgcttcaaagacgaagccgccaaaatcgaagacgctcacttcctggcacaaggcacgctctatcccgacgtgatcgaaagcggtgctgacaaagacggccccgccgccacgatcaagctgcaccacaatgtcggcggacttcctgaagaattggggtttgaattgatcgaacctctgcgagacttgttcaaagacgaagtgcgtcgactcggtctggaacttggattgcccgaacaacttgtttggcgtcatccattccccggtcctggactggccgtgcgttgtctcggcgagatcacccgagacaagctggtcgtgctacgggaagccgacgcgatcgttgtcgaagaaattgaaaacgcgggactataccgagaaaccagccaagcgtttgccgtcttgctgccggtccaaagcgtcggcgtgatgggagatgcccgcacctacgacaatgccgtcgcggttcgctgcgtcaacaccgacgacttcatgaccgcggactggagtcacctgccgtatgaactgctggctcgcatcagcacccgaatcatcaacgaagtcaaaggcgttaaccgagtctgttacgacatcagcagcaaaccgcccgcgaccattgaatgggagtga

SEQ ID NO: 79020 - protein, 587 aa, Rhodopirellula baltica
MPATGITLPSPSGPPLPCSAAIFVLDHRSRLPWPFPVSPLLFYTAALAFPAISGKNTMTSSANTTSPAIAETTWLTDQRILVLDFGSQYAQLIARRVREQNVYCQIVRHDISAERIAELAPKGIILSGGPNSVYEEGAPKCDEGLFDLGIPVLGICYGMQLACQALGGKVDNTPSREYGRAMCEFTDRDSIFRGMQESEQVWMSHGDQVSQIADQFTAMAKTSTCPYAAIRHNERPVFGMQFHPEVTHTPHGGQILRNFVIDVCGCDGSWKLGDFADAAIESIRKQVGNKRVICGLSGGVDSSVVAALLYKAIGPQLSCILVDNGLLRKNEQQIVLEEFSNHFKTDLHIVEAEDRFLADLAGIDEPQEKRRRIGHAFIECFKDEAAKIEDAHFLAQGTLYPDVIESGADKDGPAATIKLHHNVGGLPEELGFELIEPLRDLFKDEVRRLGLELGLPEQLVWRHPFPGPGLAVRCLGEITRDKLVVLREADAIVVEEIENAGLYRETSQAFAVLLPVQSVGVMGDARTYDNAVAVRCVNTDDFMTADWSHLPYELLARISTRIINEVKGVNRVCYDISSKPPATIEWE

SEQ ID NO: 79021 - DNA, 1623 bp, Rhodopseudomonas palustris
  CDS (1)..(1623): transl_table=11
atgacagcccccagcacatcctccgcttcgtccgtcgtcccctctggcgccgatacctcgccgcacgtcgctgcgatccacgagaagatcctgatcgtcgacttcggctcgcaggtcacccagctgatcgcccgccgcgtccgcgaggagggcgtgtattccgaaatcgtgccgttccagaaggcggaggccgccttcgccgagatgaagccgaaagccgtgatcctgtccggcggtccggcctcggtgctggacgacaacgcgcccagcgccccgatgacgatcctggaagccggcgtaccggtgctcggcatctgctacggcgaacagacgctggccaagcagctcggcggcaccgtcgagggcggccaccaccgcgagttcggccgcgcccagatcgagatcaccgatgattgcgcgctgttcgacggcatctggcagaagggcggcaaatacgacgtctggatgagccatggcgatcgcgtcaccaagctgccggcaggtttccgcgcggtggcgcaggcgccgggatcgccgatctcggtgatcgccgacgacacccgcaaattctacgcgatgcagttccaccccgaagtggtgcacacgcccgacggcgccaagctgctaagcaatttcgtccgcaaggtcgcaggcctcaccggcgactggacgatgcgcgccttccgcgaggaagcgatcgagaaaatccgcgcccaggtcggcaccggcaaggtgatctgcggcctgtccggcggcgtcgattccgcggtggcggcggtgctgatccatgaagcgatcggcgatcagctcacttgcgtgttcgtcgaccacggcctcttgcgcaaggacgagggcaagagcgtcgtcgacctgttccgccaccactacaacatcccgctggtgcacgtggatgtgtccgagaccttcctcggcgcgctgaagggcgtcaccgatccggagcagaagcgcaagaccatcggcaaactgttcatcgacgtgttcgaggccgaagccagacgcgtcggcggcgccgacttcctggcgcagggcacgctgtatccggacgtgatcgaaagcgtgtcgttcaccggcggcccgtcggtgacgatcaagtcgcatcacaacgtcggcggcttgcccgaacgtatgaacatgaagctggtcgagcccttgcgcgaattgttcaaggacgaagtccgcgcattggggcgcgagctcgggctgcccgacgtgttcgtcggccgccatccgttcccgggccccggcctcgcgatccgctgccccggcgagatcaccgaggagaagctcgaaatcctgcgcaacgcggacgcggtgtacatcgaccagatccgcaaggcgggcctgtacgatgtcatctggcaggcgttcgccgtgctgctcccggtccgcagcgtcggcgtgatgggcgacggccgcacctacgactacgtcgtcggcctccgcgccgtgacgtccaccgacggcatgaccgccgacttctacccgttcgagatgtccttcctcggcgccaccgcgacgcggatcatcaacgaggtcaagggcgtcaaccgcgtggtgtacgacgtcacgtcgaagccgccggggacgattgagtgggaatga

SEQ ID NO: 79022 - protein, 540 aa, Rhodopseudomonas palustris
MTAPSTSSASSVVPSGADTSPHVAAIHEKILIVDFGSQVTQLIARRVREEGVYSEIVPFQKAEAAFAEMKPKAVILSGGPASVLDDNAPSAPMTILEAGVPVLGICYGEQTLAKQLGGTVEGGHHREFGRAQIEITDDCALFDGIWQKGGKYDVWMSHGDRVTKLPAGFRAVAQAPGSPISVIADDTRKFYAMQFHPEVVHTPDGAKLLSNFVRKVAGLTGDWTMRAFREEAIEKIRAQVGTGKVICGLSGGVDSAVAAVLIHEAIGDQLTCVFVDHGLLRKDEGKSVVDLFRHHYNIPLVHVDVSETFLGALKGVTDPEQKRKTIGKLFIDVFEAEARRVGGADFLAQGTLYPDVIESVSFTGGPSVTIKSHHNVGGLPERMNMKLVEPLRELFKDEVRALGRELGLPDVFVGRHPFPGPGLAIRCPGEITEEKLEILRNADAVYIDQIRKAGLYDVIWQAFAVLLPVRSVGVMGDGRTYDYVVGLRAVTSTDGMTADFYPFEMSFLGATATRIINEVKGVNRVVYDVTSKPPGTIEWE

SEQ ID NO: 79023 - DNA, 1578 bp, Salmonella typhimurium
  CDS (1)..(1578): transl_table=11
atgacggaaaacattcataagcatcgcatcctcattctggacttcggttctcagtacactcaactggttgcgcgccgcgtgcgtgagctgggtgtttactgtgaactgtgggcgtgggatgtgacagaagcacaaattcgtgacttcaacccaagcggcattattctttccggcggcccggaaagcaccaccgaagaaaacagcccgcgcgcgctgcagtatgtctttgaagcaggcgtgccggtatttggcgtttgctatggtatgcagaccatggcgatgcagcttggcggtcatgtagaaggttctaatgagcgtgaatttggttatgcgcaggtcgaagtgttgaccgacagcgcgctggttcgcggtattgaagattccctgaccgcagacggcaaaccgctgctggacgtgtggatgagccacggcgataaagtgacggcgattccgtccgacttcgtgaccgtcgccagcaccgagagctgcccgttcgccattatggccaacgaagaaaaacgcttctacggtgtacagttccacccggaagtgactcacacccgccagggtatgcgcatgctggagcgttttgtacgcgatatctgccagtgtgaagcgttgtggacgccggcgaagatcatcgacgacgccgtggcgcgcattcgcgagcaggtgggcgacgacaaagtgatcctcggcctctctggtggcgtggattcttccgtcaccgcaatgctgctgcaccgcgcgatcggtaaaaatctgacctgtgtattcgtcgacaacggcctgctgcgtctcaacgaagccgagcaggtgatggacatgtttggcgaccattttggcctgaatatcgttcacgtaccggcagaagagcgcttcctgtccgcgctggctggcgagaacgatccggaagccaagcgtaagatcatcggtcgtgtttttgtagaagtgttcgacgaagaagcgctcaaactggaagacgtgaagtggctggcgcaaggcaccatttaccctgacgttatcgaatctgcggcgtctgcaaccggtaaagcgcacgtcatcaaatctcaccacaatgtcggcggcttgccgaaagagatgaagatggggctggttgaaccgctgaaagagctgttcaaagacgaagtgcgtaagattggtctggagctgggcctgccgtatgacatgctgtatcgccatccgttcccggggccgggcctcggcgttcgtgttctgggtgaagtgaagaaagagtactgcgacctgctgcgccgtgctgacgctatcttcattgaagagctgcgcaaagcggatctgtacgacaaagtcagtcaggcgtttaccgtcttcctgccggttcgttccgttggcgttatgggcgatggtcgtaagtatgactgggttgtctctctgcgtgccgtcgaaaccatcgactttatgaccgcacactgggcgcacctgccgtatgacttcctcggtcgcgtttccaaccgcatcatcaatgaagtcaacgggatttcccgtgtggtgtatgacatcagcggtaaaccgccggctaccattgagtgggaataa

SEQ ID NO: 79024 - protein, 525 aa, Salmonella typhimurium
MTENIHKHRILILDFGSQYTQLVARRVRELGVYCELWAWDVTEAQIRDFNPSGIILSGGPESTTEENSPRALQYVFEAGVPVFGVCYGMQTMAMQLGGHVEGSNEREFGYAQVEVLTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEERFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 79025 - DNA, 1578 bp, Shewanella oneidensis
  CDS (1)..(1578): transl_table=11
atgagcgatattcatgagcataagatactgatcctcgattttggctctcagtacacccaactgattgcccgtcgtatccgtgaaattggtgtttactgtgagttatgggcatgggatgtgactgaagcccaaattcgtgagtttgcccctaacggtattatcctcgcgggcggccctgaaagtgtgactgcggataactctccccgcgcacctgaatatgtgtttaatgctggcgtaccagttcttggtatttgctatggcatgcaaaccatgtctgagcagcttggcggtaaagtgatccaaggcgtgggtgaaggcgaatttggttatgcccaaattgaaatgcttgccgaatctgccctgtttaaaggtattgaagatgccgttagcagcgatggcaagtctctgctggatgtatggatgagccatggcgataaagtgtcggcgattccagcaggctttgtggccgtagctaaaaccgatacttgcccattcgcggccatgtcttgtgaggaaaaacgcttctacggcgtgcagttccaccctgaagtgactcatacccgtcaaggcatgcgtatgctgtcgcattttgccttagatatctgtggctgtgccgcaaactggaaaccttcttcaatcatcgaagacgctatcgagcgcttgaaaaagcaagtgggcgatgatgaagtgattttaggtctttcaggtggtgtcgactcttccgttgtagccatgctgctgcaccgcgcaattggtaagaagctgacctgcgtatttgttgataatggtttattacgtttgaacgaagcgaagcaagtgatggaaatgtttggtgaccacttcggtctcaacattgttcatgtggatgcggaaaatcgtttccttgatgcgctgaaaggtgaagccgatccagaagctaaacgtaaaatcattggccgcgtattcgttgaaattttcgatgaagaagccaagaaatgcgttaatgctaaatggttagcccaaggcacaatctacccagacgtgattgaatccgcgggtagcgctacaggtaaagcgcacgtcatcaagtcgcaccataacgttggcggtctgccagatgatatggaattaggtctggttgagccactgcgtgaactctttaaagatgaagtgcgtaagattggtctcgagttaggcctgccatacaacatgctttatcgccacccgttcccaggcccaggtttaggcgtgcgagtactgggcgaagtgaagaaagagtactgcgatcttttgcgccgcgccgatgcgattttcatcgaagagctgcacaaagctgatctttataacaaagtcagccaggcctttaccgtgttcttacccgttcgctctgtaggtgtgatgggtgatggccgtaagtacgattgggtggtgtcactgcgcgccgttgaaaccatcgactttatgaccgcgcactgggcacatctgccatacgatttccttggccgtgtgtctaaccgcatcatcaacgaagtcgatggcatttcccgcgtagtttacgatatttcaggcaagccacctgcaacaatcgagtgggaataa

SEQ ID NO: 79026 - protein, 525 aa, Shewanella oneidensis
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAESALFKGIEDAVSSDGKSLLDVWMSHGDKVSAIPAGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHVDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVDGISRVVYDISGKPPATIEWE

SEQ ID NO: 79027 - DNA, 1539 bp, Spiroplasma kunkelii
  CDS (1)..(1539): transl_table=4
atgaaaacaacaaataaaattattattttagattttgggtcacaatacactcaattaattgcccgtcgtatccgtgacttagaagtatattgtgaagtatgaccatataatacagcattagaaaaaattaaaacaacatcaatgaaaggaattattttatcaggtgggcctgcttctgtttatgaagaagatgcatttttaattgataaacaattgtttgaattaaaagttcctgttttaggaatttgttatggaatgcaaataataagtcatttacatgaagggacagtacaacgagcaacaaaacaagaatttggtttttcagaattaattattgataatcaagaagatttatttgcgaacatccctgttaaatcacaagtgtgaatgagtcatgccgattatattgaaggcatgccaacaaattttattcaaattgctcatagtgaaaattcaattagtgcaattaaacattcagaaaaaaaaatttatggtttacaatttcatccagaagtaacccacactttaattggacaacaattattaagcaattttgtttttaacatttgtggttgtcagccaaaatgaaaaattacagagtttatttcagcagcaataactgagattaagaataaagttggaactgataatgttgttttagcattatcaggtggtgttgattctagtgtttgtgcagttttattacataaagcaattggaaaacaattaacatgtatttttgttgacaccggattattacgccaaaatagtggatgaaatgatttacaaaaatttcaagaaaaatttaaattaaatattattaaaattaatgcgcaagaaagatttttaactgctttaaagggagttactaatccagaagaaaagcgaaaaattattgggaatttatttattgaaatttttaatgaagaagcaataaaaattcaaaatgttaaatgattaggacaaggaacaatttatccagatgtgattgaatctgtctcagtgaagggaccatctgccacaattaaatcgcatcataatgttgggggattaccaaaggatttaccatttcaattaattgaaccattacgtgaattatttaaagatgaagttcgccgaactggtgaagcattgggcattgattttaaatttgtgtataagcatccgtttccaggaccaggtttagcagtccgaattattggtgaaattaccgcagaaaaaatagctttattacaagcagctgatcaaatttttattgatgaattatatcaggcaaatttatatgatcaagttgcacaagcatttgttgttttattacctgttcagtcagttggtgtaatgggcgatgtacgaacatatggatatactgctgttgtgcgcagtgttgatacaactgattttatgacagcaaattgaagtcggctgccatttgaattattggaaaaagtatcagctcgaattgtaagtgaagttcatggaattaatcgaattacttatgatattacatcaaaaccaccaggaacaattgaatgggaataa

SEQ ID NO: 79028 - protein, 512 aa, Spiroplasma kunkelii
MKTTNKIIILDFGSQYTQLIARRIRDLEVYCEVWPYNTALEKIKTTSMKGIILSGGPASVYEEDAFLIDKQLFELKVPVLGICYGMQIISHLHEGTVQRATKQEFGFSELIIDNQEDLFANIPVKSQVWMSHADYIEGMPTNFIQIAHSENSISAIKHSEKKIYGLQFHPEVTHTLIGQQLLSNFVFNICGCQPKWKITEFISAAITEIKNKVGTDNVVLALSGGVDSSVCAVLLHKAIGKQLTCIFVDTGLLRQNSGWNDLQKFQEKFKLNIIKINAQERFLTALKGVTNPEEKRKIIGNLFIEIFNEEAIKIQNVKWLGQGTIYPDVIESVSVKGPSATIKSHHNVGGLPKDLPFQLIEPLRELFKDEVRRTGEALGIDFKFVYKHPFPGPGLAVRIIGEITAEKIALLQAADQIFIDELYQANLYDQVAQAFVVLLPVQSVGVMGDVRTYGYTAVVRSVDTTDFMTANWSRLPFELLEKVSARIVSEVHGINRITYDITSKPPGTIEWE

SEQ ID NO: 79029 - DNA, 1542 bp, Staphylococcus aureus
  CDS (1)..(1542): transl_table=11
atggaaatggcaaaagaacaagagttaatccttgtcttagactttggtagccaatacaaccaattaattacacgccgaattcgtgaaatgggcgtttatagtgaattacacgatcatgaaatttcaattgaagaaattaagaaaatgaatccaaaaggtattatcttatcaggtggtccaaattcagtttatgaagaaggttcatttacaattgatccggaaatatataatttaggaattccagtacttggtatttgttacggcatgcaattaactactaaattactaggtggtaaagttgagcgtgccaatgaacgtgaatacggtaaagcaatcattaatgcgaagtcagatgagttattcgctggcttaccagcagaacaaactgtttggatgagtcattctgataaagttattgaaattccagaaggctttgaagttatcgctgatagcccaagtacagactatgcagcaatcgaagataagaaacgtcgcatttatggtgttcaattccatccagaagtacgtcatacagaatatggtaatgatttgttaaacaacttcgtacgtcgtgtttgtgagtgtaaaggtcaatggacaatggaaaactttatcgaaattgaaattgaaaagattcgtcaacgcgtaggcgaccgtcgtgtattatgtgcgatgagtggtggcgtagattcatctgttgttgctgtattattgcataaagcaattggggatcaactaacatgtatctttgtagaccatggcttacttcgtaaaggtgaaggcgacatggttatggaacaattcggtgaagggttcaacatgaatattattcgtgttaatgcgaaagatcgttttatgaataaattaaaaggtgtttcagatcctgaacaaaaacgtaaaatcattggtaatgaatttgtatatgtatttgatgatgaagcatcaaaactgaaaggtgtagacttccttgcgcaaggaacactttatacagacgttatcgaatcaggtaccaagacagcacaaacaatcaaatcacatcacaatgttggtggattaccagaagacatggaattcgaattaatcgaaccaatcaatacattgtttaaagatgaagtacgtaaattaggtattgaattaggtattccagaacatttagtgtggagacaaccattcccaggacctggtcttggtattcgtgtacttggagaaattactgaagataaactagaaatcgttagagaatcagacgcgattttacgccaagtgattagagaagaaggtcttgaaagagaaatttggcaatacttcacagtgttaccaaacattcaatcagtaggtgttatgggagactaccgtacgtatgatcacacagtaggtattcgtgcagtaacatctatcgacggtatgacaagtgacttcgcacgcatcgattgggaagtcttacaaaagatttctagtcgtatcgtaaacgaagtagatcacgtcaaccgcgtagtctatgacattacatcaaaaccaccaagcacaattgagtgggaataa

SEQ ID NO: 79030 - protein, 513 aa, Staphylococcus aureus
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCECKGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 79031 - DNA, 1578 bp, Streptomyces avermitilis
  CDS (1)..(1578)
atgccatcagcaccctccgccgccgcccccgacaccgttctggtcgtcgacttcggcgcacagtacgcccagctcatcgcccgccgcgtccgcgaggcccgggtctacagcgagatcgtgccgagcaccatgccggtcgcggagatgctcgccaagaacccggcggcgatcatcctctccggcggcccctcgtcggtgtacgcggagggcgccccccgcctcgaccgcgagatcttcgaggccggcgtcccggtcttcggcatgtgctacggcttccagctgatggccacgaccctcggcggcacggtcgacaacaccggcgcccgcgagtacggccgcacgccgctgcacgtcagcaagtccggctcgacgctcttcgagggcacccccgacgagcagccggtctggatgtcgcacggcgacgcctgctccgccgcccccgagggcttcacggtcacggcctccacggacgtcgtcccggtcgcggccttcgagaacgacgagaagcgcctgtacggcgtccagtaccaccccgaggtcatgcactccacgcacggccagcaggtgctggagcacttcctgtaccggggcgcgggcctcaccccgtcctggaccaccggcaacgtcatcgacgagcaggtggagctcatccgcgagcaggtcggcacccggcgcgccatctgcggtctgtccggcggcgtcgactccgccgtggccgccgcgctcgtacagaaggccatcggttcccagctgacctgtgtgtacgtcgaccacggtctgatgcgccagggcgagaccgagcaggtcgagaaggacttcgtggccgcgaccggcgtccagttgaaggtcgtggacgcggaggagcgtttcctcaccgcgctcaagggtgtctcggaccccgaggagaagcggaagatcatcggccgcgagttcatccgggtcttcgagcaggcgcaggcggagatcatcgcggacgagggtcccgaggtggccttcctggtccagggcaccctctacccggacgtggtcgagtccggcggcggtacgggcacggccaacatcaagtcccaccacaacgtgggcggcctgcccgaggacctcgagttcgagctcatcgagccgctgcgcaagctgttcaaggacgaggtccgcatggtcggccaggagctcggcctgccggacgagatcgtccagcgccagccgttccccggcccgggcctcggcatccgcatcgtcggcgaggtcaccaaggagcgtctggacctgctccgcgaggccgacgccatcgcccgcgaggagctgacggccgccggtctcgaccgcgagatctggcagtgcccggtggtcctgctcgcggacgtccgcagcgtcggcgtccagggcgacggccgcacctacggccacccgatcgtgctgcgcccggtgtccagcgaggacgccatgaccgccgactggtcgcgcctcccgtacgacaccctggcgaagatctccacgcggatcacgaacgaggtcgcggacgtcaaccgagtcgtcctcgacgtgacgagcaagccgccgggcaccatcgagtgggagtag

SEQ ID NO: 79032 - protein, 525 aa, Streptomyces avermitilis
MPSAPSAAAPDTVLVVDFGAQYAQLIARRVREARVYSEIVPSTMPVAEMLAKNPAAIILSGGPSSVYAEGAPRLDREIFEAGVPVFGMCYGFQLMATTLGGTVDNTGAREYGRTPLHVSKSGSTLFEGTPDEQPVWMSHGDACSAAPEGFTVTASTDVVPVAAFENDEKRLYGVQYHPEVMHSTHGQQVLEHFLYRGAGLTPSWTTGNVIDEQVELIREQVGTRRAICGLSGGVDSAVAAALVQKAIGSQLTCVYVDHGLMRQGETEQVEKDFVAATGVQLKVVDAEERFLTALKGVSDPEEKRKIIGREFIRVFEQAQAEIIADEGPEVAFLVQGTLYPDVVESGGGTGTANIKSHHNVGGLPEDLEFELIEPLRKLFKDEVRMVGQELGLPDEIVQRQPFPGPGLGIRIVGEVTKERLDLLREADAIAREELTAAGLDREIWQCPVVLLADVRSVGVQGDGRTYGHPIVLRPVSSEDAMTADWSRLPYDTLAKISTRITNEVADVNRVVLDVTSKPPGTIEWE

SEQ ID NO: 79033 - DNA, 1608 bp, Synechococcus elongatus
  CDS (1)..(1608)
atgactcactccaccctccaccaaccggatacagccactggccaaggcctgcaacgccaactcattgtcattctcgattttgggtcgcaatactcggaactgattgcccgccgtattcgtgagacccaagtctattccgaggtcatttcctatcgcaccactgctgagcaactcgcccaattggcacccaagggcattattctctccggtggccccaactctgtctatgacgaaaatgccccccaatgcgatccagagatttggaacctggggattcccattcttggggtgtgctacggcatgcaactgatggtgcaacagttggggggaacggtagagcgagcgatcgccggcgagtatggcaaggcggcgctttttattgatgaccccacagatctgctcaccaatgtcgagcaggaaacaattatgtggatgagtcatggcgatagtgtcaccgagttgccccccggttttcgtgtcttggcgcataccgacaatacgccaatagcagcgatcgcccatcccgagcggaaactctatggagttcagtttcacccagaggtggtgcattctgtggggggcattgccctgatccgcaactttgtctatcacatttgcgattgcgaacccacttggacaactgctgcctttgttgaagaggccatccgggaagtgcgagccaaagtgggggacaaacgggtcctccttgccctgtcggggggggtagattcatcgacgctggcctttttgctccaccgtgccattggcgatcagctcacctgtatgtttattgaccaagggtttatgcgcaaaggggagcccgagcgactcctcaagctctttcaggagcagtttcacatcaaggtggagtacgtcaatgcccgcgatcgcttccttgcccaactggtgggggtcaccgatcctgaagaaaagcgcaaacgcattggccatgaatttatccgcgttttcgaagaagaatcacagcggctaggtcccttcgactacttagcgcagggaaccctttatcccgatgtcattgaatctgcgaataccaacattgacccccaaacgggtgagcgcgtagcggtgaaaattaagagccaccacaatgttggcggcctgccggagaacttgcgttttaagctggtggaacccctacgcaagctctttaaggatgaagtgcgccaagtggggcgatccctggggctacccgaagaaattgtgcagcggcatccctttcccggtcccggtttagcaattcggattctgggggaagtgaccccggaacgtctagagattctacgggatgcggatctgattgtgcggcaggaaattaaccgcgcccagatgtatcacgagctttggcaagcctttgcggtactactgccgattcgcaccgtgggggtcatgggggatcagcgcacctacgcttatccagtggtgctgcgatttgtcaccagcgaagatggcatgaccgcggactgggcacgggttccctacgaccttctggagcgaatttccaaccgcattgtcaacgaagtgccgggggtgaatcgggtggtctatgacattacctccaagccgccgggaaccattgagtgggagtaa

SEQ ID NO: 79034 - protein, 535 aa, Synechococcus elongatus
MTHSTLHQPDTATGQGLQRQLIVILDFGSQYSELIARRIRETQVYSEVISYRTTAEQLAQLAPKGIILSGGPNSVYDENAPQCDPEIWNLGIPILGVCYGMQLMVQQLGGTVERAIAGEYGKAALFIDDPTDLLTNVEQETIMWMSHGDSVTELPPGFRVLAHTDNTPIAAIAHPERKLYGVQFHPEVVHSVGGIALIRNFVYHICDCEPTWTTAAFVEEAIREVRAKVGDKRVLLALSGGVDSSTLAFLLHRAIGDQLTCMFIDQGFMRKGEPERLLKLFQEQFHIKVEYVNARDRFLAQLVGVTDPEEKRKRIGHEFIRVFEEESQRLGPFDYLAQGTLYPDVIESANTNIDPQTGERVAVKIKSHHNVGGLPENLRFKLVEPLRKLFKDEVRQVGRSLGLPEEIVQRHPFPGPGLAIRILGEVTPERLEILRDADLIVRQEINRAQMYHELWQAFAVLLPIRTVGVMGDQRTYAYPVVLRFVTSEDGMTADWARVPYDLLERISNRIVNEVPGVNRVVYDITSKPPGTIEWE

SEQ ID NO: 79035 - DNA, 1587 bp, Synechococcus sp
  CDS (1)..(1587): transl_table=11
atgtcccagtcttcgtccgacggtcagcgtcagccggccatcgtcatccttgatttcggctcccagtactcggagctgatcgcccggcgcgtgcgcgaaaccgaggtgttttcggtggtgctcggttacagcacctcagcggaggagttgcgggcgatgcagccgaaggggatcgtcctcagcggcggtcccagttcggtgtacgccgagcacgcgcccctctgtgatccggcgatctgggagctgggcatcccggtgctgggggtctgttacggcatgcagctgatggtgcagcagctgggaggtgtggtggaagctgccagcggcaaggccgaatacggcaaggcaccgctggaggtggatgatcccaccgatctgctcaccaacgtcaccggtggatccacgatgtggatgagccatggcgactcggtgaaggccctgcccgagggatttgttcgcctggcgcacaccgccaacaccccggaagccgcggttgcccatctgcagcgtcgcctctacggcgtccagttccaccccgaggtggtgcattccacctgcggcatggctctgatccgcaatttcgtataccacatctgtggctgtgagccggactggaccaccagcgccttcatcgatgaggccgtcgcggtggtgcgggagcaggtgggcgagaagcgggttctgctggccctgtccggtggagtcgattcctcaaccctcgctttcctgttgaagaaagcgattggtgatcagctcacctgcatgttcatcgaccagggcttcatgcggaaaggggagccggagttcctgatggacttcttcgatcggaagttcaatattcatgtggagtacatcaatgcccgccaacgcttcatcagcaagctgaaggggatcaccgatccggaggagaagcgcaagatcatcggcacggaattcatccgtgtgttcgaagaggagagcaagcgcctcggaccgttcgactacctggcgcaaggaaccttgtacccggatgtgatcgaaagcgccggtaccaatgtcgatcccaagaccggtgagcgggtggcggtgaagatcaagagccaccacaacgtgggcggtttgcccaaggatctgcagttcaagttggtggaaccgttgcgcaagttgttcaaggacgaggtgcgcaaggtggggcgtgccctgggcctgccggaggagatcgtccgccgccatcccttccccggccctggcttggcgatccgcatcctgggggaggtcaccgacgagaagctcaactgcctgcgggatgccgacctgatcgtgcgggaggaaatccgcgaggccgggctctatcacgagatctggcaggccttcgccgtgttgctgcccgttcgctcagtcggggtgatgggggacaagcggacctatgcctggccgattgtgctgcgctgcgtctccagcgaagacggcatgaccgccgattggtcacggttgccttacgacctgatggagaccatctccaatcgcatcgtgaatgaggtgaagggggtgaaccgggtggtgctggatatcaccagcaaaccgccgggcacgatcgagtgggaatag

SEQ ID NO: 79036 - protein, 528 aa, Synechococcus sp
MSQSSSDGQRQPAIVILDFGSQYSELIARRVRETEVFSVVLGYSTSAEELRAMQPKGIVLSGGPSSVYAEHAPLCDPAIWELGIPVLGVCYGMQLMVQQLGGVVEAASGKAEYGKAPLEVDDPTDLLTNVTGGSTMWMSHGDSVKALPEGFVRLAHTANTPEAAVAHLQRRLYGVQFHPEVVHSTCGMALIRNFVYHICGCEPDWTTSAFIDEAVAVVREQVGEKRVLLALSGGVDSSTLAFLLKKAIGDQLTCMFIDQGFMRKGEPEFLMDFFDRKFNIHVEYINARQRFISKLKGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRALGLPEEIVRRHPFPGPGLAIRILGEVTDEKLNCLRDADLIVREEIREAGLYHEIWQAFAVLLPVRSVGVMGDKRTYAWPIVLRCVSSEDGMTADWSRLPYDLMETISNRIVNEVKGVNRVVLDITSKPPGTIEWE

SEQ ID NO: 79037 - DNA, 1506 bp, Thermotoga maritima
  CDS (1)..(1506): transl_table=11
ttggtactcgtcgtggattacggctctcagtattccagactcataacgagaaggatcagagaaaacgaggtctattccgaagtggttttccccgatgacaaggtggacctttcaaaagtagacgccgtgatcctctccggtggtccaagaagcgtttatgaagaggacgccccaaagcttccagagtggttccaagaatacaaaggcccagtactcgctatttgttatggaatgcagctgatcgtgaaagaactaggaggagaggtcaggagaggacgaggggagtacggaagaaccctcgtggagctctcgagggatccgatattcgaaggaattccggagaaggttcacgtctggatgagccacggcgatgaggtggttaggcttccggaagggttccacccgatcgctgtgtccgaaacgggtgtgatcgccgctgccacagatggaaaaaggttctggctgctccagttccacccggaagtgcaccacaccgagtacggtgatcgtatgatttccaacttcctcttcaatgtgtgtaagcttgagaaaaactggaagataggagacctcgtggaagagaaaataagacacatcaaagagaccatagggaacaaaaaagcgatcctcgcgctttctggaggggtagattcttccgttgcagcggtcctcgtgcacagagcgataggaaagaacctcgtgtgtgtcttcgtggaccacggccttctcagaaagaacgagcgagaagaagtggagagagtcttcaaggaacacttcgacatgaatctggttgttgtggatgccaggaagagatttctcgaaaaactcagaggagtcacggatccggagaagaagaggaagatcataggagaagaattcatacgagtgttcgaagaggaagcgaaaaaacacgatgtggaatttcttgttcagggaacgatctattcagacgtcatagaaagcgccgcatccggaaagacgactgcgaagataaagagccaccacaacgtgggcggtcttccagagaagatgaacctgaaactggtagaacccctcagagacctcttcaaagacgaggtgagaaaagtaggaaagtatctcggcataccggacaggatcataaacaggcatccgttccctggccctggactcgccgtgagggtgctgggagaggtcacggaagaaaagctcgaaatcctgagagaagcggactacatattcatagaaactctcagaaagcatgactactacgataaagtgtggcaggcgtttgcggttcttcttcctataaaaagcgtaggcgtgaagggtgacgcgagggcgtatgagtacgtggtggcgcttcgagccgtgaacagcgtggaggggatgaccgcagactggtccagaattccgcatgatatactggacgaggcagcaagaaggatcacaagagaagtgaaaggtgtcggcagagtggtctacgatataacttcaaaaccgcctgcaaccatagagtgggagtga

SEQ ID NO: 79038 - protein, 501 aa, Thermotoga maritima
MVLVVDYGSQYSRLITRRIRENEVYSEVVFPDDKVDLSKVDAVILSGGPRSVYEEDAPKLPEWFQEYKGPVLAICYGMQLIVKELGGEVRRGRGEYGRTLVELSRDPIFEGIPEKVHVWMSHGDEVVRLPEGFHPIAVSETGVIAAATDGKRFWLLQFHPEVHHTEYGDRMISNFLFNVCKLEKNWKIGDLVEEKIRHIKETIGNKKAILALSGGVDSSVAAVLVHRAIGKNLVCVFVDHGLLRKNEREEVERVFKEHFDMNLVVVDARKRFLEKLRGVTDPEKKRKIIGEEFIRVFEEEAKKHDVEFLVQGTIYSDVIESAASGKTTAKIKSHHNVGGLPEKMNLKLVEPLRDLFKDEVRKVGKYLGIPDRIINRHPFPGPGLAVRVLGEVTEEKLEILREADYIFIETLRKHDYYDKVWQAFAVLLPIKSVGVKGDARAYEYVVALRAVNSVEGMTADWSRIPHDILDEAARRITREVKGVGRVVYDITSKPPATIEWE

SEQ ID NO: 79039 - DNA, 1539 bp, Thermoanaerobacter tengcongensis
  CDS (1)..(1539): transl_table=11
atggggattaagcgcgaaaccattttgattttggactttggtggccagtacactcagttaattgccaggagaataagagaagctaatgtgtattgcgagattgtgccttacgatatttctcctgaagaaataaaaaagatagatccaaagggaattgtgctttcgggcggacctgcaagcgtttatgtgaaaaacgctcctaagtgcgataaagaaatttttgaattgggataccctgttttagggatatgttatggggttcaacttatgactgagcttctaggaggaaaagttgcgcctgctcctgtcagagaatacggcaagacggaggttgtgataaacaatacaattccgctttttaaagggatagagagagataccattgtgtggatgagccacactgaccaaattgaactccctcctccagattttaaagttgtggcttctactgaaaactgtcctattgcagctattgccaatgtagaaaaaaaactctatggtgttcaattccatccagaagtttcccatactcacaggggcacagagataataagaaatttcctgtttgaagtgtgcgattgctccgctgattggacgatggattctttgattgaacagactgtaaaagaagtgagagctaaagtaggtaatcacaaggctgtatgcgctctatcgggcggtgtagattcagctgttgcagcagtccttgtagatagagctatacacgatcagctagtgtgcatatttgtagatactgggcttttgcggacaaacgaaggggatatggtaattgaaactttcagaaagaattacgatatgaatataataagagttgacgcaaaagacagatttctctcgaggcttaaaggagttactgacccggaggagaagaggaagatcattggaaatgttttcatagaagtttttaaagaagaagccatgaagattggcgatgtaaagtttttggttcaggggactttatatcctgatgtgattgaaagcgggcatgggatttcatctaccataaaaagtcatcacaatgtcggcggacttcctgaagatatcggatttgagttaattgagcctttacgaatgctttttaaagatgaagtcagacaagtaggtaaggaattagggattcccgatgagatattgtatagacagcctttccctggccccggactggctgtgagaattgtaggagaagttacagaagaaaaattagaaattttaaggctggctgacagcatagttcagagagagatgaaaagatttggatggtacaataaggtgtggcagtcgtttgctattttgcctggaataaagagtgtgggagtaatgggggacgagaggacatacggttatgctataattttgagggttgtagatagtatggacggtatgacggctgattggacaaaactgccttatgaaattttggaaagcatctctaccagcattacgaatgaagtgccgggagttaacagggttttatacgatataacttcaaagcctcctgctactatagagtgggaataa

SEQ ID NO: 79040 - protein, 512 aa, Thermoanaerobacter tengcongensis
MGIKRETILILDFGGQYTQLIARRIREANVYCEIVPYDISPEEIKKIDPKGIVLSGGPASVYVKNAPKCDKEIFELGYPVLGICYGVQLMTELLGGKVAPAPVREYGKTEVVINNTIPLFKGIERDTIVWMSHTDQIELPPPDFKVVASTENCPIAAIANVEKKLYGVQFHPEVSHTHRGTEIIRNFLFEVCDCSADWTMDSLIEQTVKEVRAKVGNHKAVCALSGGVDSAVAAVLVDRAIHDQLVCIFVDTGLLRTNEGDMVIETFRKNYDMNIIRVDAKDRFLSRLKGVTDPEEKRKIIGNVFIEVFKEEAMKIGDVKFLVQGTLYPDVIESGHGISSTIKSHHNVGGLPEDIGFELIEPLRMLFKDEVRQVGKELGIPDEILYRQPFPGPGLAVRIVGEVTEEKLEILRLADSIVQREMKRFGWYNKVWQSFAILPGIKSVGVMGDERTYGYAIILRVVDSMDGMTADWTKLPYEILESISTSITNEVPGVNRVLYDITSKPPATIEWE

SEQ ID NO: 79041 - DNA, 1512 bp, Tropheryma whipplei
  CDS (1)..(1512): transl_table=11
atgagacctgttcttgtcgttgattttggctctcaatattcgcagcttgtagtccgtgcgataagagagtgcgggtattatgcagagtttgcgtccccgagtatttctgctgctgaatgtcttgccttgtccccgattgccatatttctctctggagggcctgctagtgcatacaaagataatgcccccaagcttgacgaagagatttttaattgtggcattcccatttttggcatttgctacggctttcaactgcttgcacaggcattcggtggatctgtcaaaaaagcaaatgctccggaatacggccctgcggatataacaattgtcaacaaggcgtttttttctggccaacccgaccgccagacagtgtggatgagccatggtgatagtgttatacgcgctcccaaaaatttttgcattctttcaacttctcaggatgctgttctttcattttgcaaccgtgatagaacaattgctggcgtgcaatggcacccggaagtaaagcacagccggtttggtaaacacacaataaaagcctttttatcaagttttgccgcgccaaactgggatccagaacagacaatttgtgggacagttgacagtatccgcaaaactgttggttgtaagagggttttgtgtgctcttagcggaggagttgactctgtcgttgccgcaacactcacacaccgtgcgataggcgataggctgcgatgtgtttttgttgatcatggtcttcttcggttgaatgagagggagcaggttgaggagtattgttcatctcttggtcttaatgtgtctacttatgatgcctcagattgttttttgagcgccctttcagggatacgtgattctgagcaaaagcgtaaggtaattggtcgcgagtttattgcctgtttttcaaaattgcaagagcgatttgatataaagccgcactttctcttacagggcacgctttatccggatctcgttgaatccggagcaaccccgggtggcgcgactataaaaagtcatcataatgttggtggcttgtcggataatcttggttttgaattattagaaccgctgaagtatcttttcaaggatgaagtgcgaaaaattggccttcaactcggtatacctaagcacatagtgcacagacagcccttccctggccctggccttgctataagaataattggtgaggttacaaacaagaagctgtctattctgcgtgcggccgatgcaattgtcaggcatgagttgcgagactggactgatatctggcagtgcccagttatcttactatctgacgtgcaatcagtaggcgttcgcggagatagtagatcatgcggctttccgattgttatccggcccgtttcgtctgatgatgcaatgaccgcggattggtaccgattaccatacgatgttcttgcacgaatttctggtcgtataacaaacgaaattcctgaaatcgtgcgtgttgttcttgatatcacacccaagcccccagcaacgatagagtgggagtag

SEQ ID NO: 79042 - protein, 503 aa, Tropheryma whipplei
MRPVLVVDFGSQYSQLVVRAIRECGYYAEFASPSISAAECLALSPIAIFLSGGPASAYKDNAPKLDEEIFNCGIPIFGICYGFQLLAQAFGGSVKKANAPEYGPADITIVNKAFFSGQPDRQTVWMSHGDSVIRAPKNFCILSTSQDAVLSFCNRDRTIAGVQWHPEVKHSRFGKHTIKAFLSSFAAPNWDPEQTICGTVDSIRKTVGCKRVLCALSGGVDSVVAATLTHRAIGDRLRCVFVDHGLLRLNEREQVEEYCSSLGLNVSTYDASDCFLSALSGIRDSEQKRKVIGREFIACFSKLQERFDIKPHFLLQGTLYPDLVESGATPGGATIKSHHNVGGLSDNLGFELLEPLKYLFKDEVRKIGLQLGIPKHIVHRQPFPGPGLAIRIIGEVTNKKLSILRAADAIVRHELRDWTDIWQCPVILLSDVQSVGVRGDSRSCGFPIVIRPVSSDDAMTADWYRLPYDVLARISGRITNEIPEIVRVVLDITPKPPATIEWE

SEQ ID NO: 79043 - DNA, 1554 bp, Vibrio vulnificus
  CDS (1)..(1554): transl_table=11
atgactaaaaatattcatgaccaacgtattctgatcctagatttcggttcgcagtacactcaacttgttgcgcgccgcgtacgtgaaatcggcgtttactgtgagctttggagctgggatgttgaagaagcggatattcgtgaattcaacccagacggtattattctttctggtggcccagagagcgtgacagaagataactctcctcgcgcacctcaatatgtattcgattcaggcgtgccagtactgggtgtttgttacggcatgcagaccatggctgagcagctaggcggaaaagtatcgacttctgacgagcgcgagtttggctatgcagctgtaaaagtgtctggtgagtcagctattttcaaagatcttgaagctactcaagatgtatggatgagccacggtgacaaagtcgttgagattccagcgggcttcaccaaagtaggtgaaacagacacttgtccttacgctgcaatggcgaacgaagagaagaaatactacggtgttcagttccacccagaagtaacgcacactaaaaatggcttacaaatgctagagaactttgttcttggcatctgtggttgtgagcgtctatggacttcagaatccatcatcgaagatgcggttgctcgtattaaagagcaagtgggtgacgatgaagtgatcctaggtctatctggtggtgtggattcatcagtagtagccatgttggttcaccgtgcaatcggcgacaagctaacgtgtgtcttcgttgataacggtctacttcgtttaaacgaaggtcagcaagtgatggacatgtttggcgacaagtttggcctaaacatcatcaaagttgatgctgaagagcgtttcctaaaagcacttgaaggcaaatctgatcctgaagagaaacgtaagaccatcggtcacgtattcgtcgatgtctttgatgaagaatcgaagaagctgaaaaatgcgaaatggctcgctcaaggtactatctacccagacgtaatcgagtcagcagcctctaagacaggtaaagcgcacgtaatcaaatctcaccataacgtgggcggtctgccagacgatatggaaatgggtcttgttgagccactgcgtgaactgttcaaagatgaagtacgtaagattggcctagaacttggcctaccttacgaaatgctttaccgccacccattccctggtccgggtctaggtgttcgtgttcttggtgaaatcaagaaagagtactgtgatttgctacgtcgtgcggacgctatctttattgaagagctccatgctgcggatctttacaacaaagtatctcaagcgtttacggtattcctaccagtgcgttctgtaggtgtaatgggcgatggccgtaagtatgactgggtggtatcactacgtgccgtagagaccatcgacttcatgacggcgcattgggcacacctaccgtacgatttcctaggtaaggtttctaaccgtattatcaatgaagtaaacggcatctcacgcgtggtttacgatatctctggtaagccaccagcaaccatcgaatgggaataa

SEQ ID NO: 79044 - protein, 517 aa, Vibrio vulnificus
MTKNIHDQRILILDFGSQYTQLVARRVREIGVYCELWSWDVEEADIREFNPDGIILSGGPESVTEDNSPRAPQYVFDSGVPVLGVCYGMQTMAEQLGGKVSTSDEREFGYAAVKVSGESAIFKDLEATQDVWMSHGDKVVEIPAGFTKVGETDTCPYAAMANEEKKYYGVQFHPEVTHTKNGLQMLENFVLGICGCERLWTSESIIEDAVARIKEQVGDDEVILGLSGGVDSSVVAMLVHRAIGDKLTCVFVDNGLLRLNEGQQVMDMFGDKFGLNIIKVDAEERFLKALEGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYEMLYRHPFPGPGLGVRVLGEIKKEYCDLLRRADAIFIEELHAADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 79045 - DNA, 1569 bp, Wigglesworthia glossinidia brevipalpis
  CDS (1)..(1569)
atgaataatcaatatattctaataatagattttggatcgcaatatactaaattagtagcaagaagaatgaaagatattggagcaaagtttattatttctagctgggaaattaaaaaaaaagaacttttaaaaaaaaatataaagggcattttgttatctggtagtccaatgagtgttttagacgataaaagtccttatgtttctaaagatatattaaatatgaaagttccaatattaggaatatgttatggaatgcacactttagtaaaacaattaggcggaaaagtagaaaggaaatcagttagagaatttggatatgcaagtattaaaattttaaaaaatcacagtaatttattctatgataattttgaagtttcagaaaaaaattatactaaaagacaaaaagtttggatgagtcatgaagatagtgtaattaatattccaaaaggattttcaattatagcaagcacaaaaaactgtaaatatgcagctatttttaataaaaaaaataaattttatggagttcaatttcacccagaagttactcattctgaaaaaggatatttgatattgaatagatttgtaaaaaatatatgtaattatactaatgtaattaagtatagtttatccataagaaaaattattttaaaaattaaaaataaagttaatgatgaaaaagtaattttaggattatctggaggaatagattcttttacttctgctattttgatacataaagctataggtaataatttattttgtatttgtattgataatggattattgaggaatgatgaaattttaaaaattaaaaatttaataaagaaagtaggaaaaataaatgttatttatatcaatcataaaaaaagatttttaaaatcattgaacggaataacagatccagaaaaaaaaagaaaaacaattggaaatttattttttaaaatttttcaagaacaagctgatattttaaaagctaaatggttagctcaaggaactatatatcctgatatcatcgaatcttctcaaaataatttattaaaaaaagataattttataaaatctcaccataacgtttgccccctccctaaagggataaaactaaaaattttagaaccattaaaacacttatttaaagatgaagttaaaaaaatagcaaaaaaaataggaatacctaaagaaattatttttcgtcatccatttccaggaccaggtttggctgtaagaattataggagaaataaaagaagaatattgtaatattctcagaatggcagatgaaattttcatttcagaattaaaatcagaaaatttatactttaatattagtcaagcattttctgtacttttaccaattaaatctgtcgctgtaatgggagacatgagaaaatacgaatgggttatttctttgagggctatagaaacattagattttatgagcgctaattgggcaaatataccatataaaatattaaataatgtttctaatcgtattattaatgaagttagaggaatttctcgagtagtttatgatatttcaaataaacctccatctacaattgaatgggaatag

SEQ ID NO: 79046 - protein, 522 aa, Wigglesworthia glossinidia brevipalpis
MNNQYILIIDFGSQYTKLVARRMKDIGAKFIISSWEIKKKELLKKNIKGILLSGSPMSVLDDKSPYVSKDILNMKVPILGICYGMHTLVKQLGGKVERKSVREFGYASIKILKNHSNLFYDNFEVSEKNYTKRQKVWMSHEDSVINIPKGFSIIASTKNCKYAAIFNKKNKFYGVQFHPEVTHSEKGYLILNRFVKNICNYTNVIKYSLSIRKIILKIKNKVNDEKVILGLSGGIDSFTSAILIHKAIGNNLFCICIDNGLLRNDEILKIKNLIKKVGKINVIYINHKKRFLKSLNGITDPEKKRKTIGNLFFKIFQEQADILKAKWLAQGTIYPDIIESSQNNLLKKDNFIKSHHNVCPLPKGIKLKILEPLKHLFKDEVKKIAKKIGIPKEIIFRHPFPGPGLAVRIIGEIKEEYCNILRMADEIFISELKSENLYFNISQAFSVLLPIKSVAVMGDMRKYEWVISLRAIETLDFMSANWANIPYKILNNVSNRIINEVRGISRVVYDISNKPPSTIEWE

SEQ ID NO: 79047 - DNA, 1563 bp, Wolbachia pipientis wMel
  CDS (1)..(1563): transl_table=11
ttgtcagcaattgccattattgattttggttcacagtttacacagcttatcgcaagacaagtaagaggaatgggtgtttattgtgagatatttccaagcaacatcagttttgaaacaatatcaaaattcaatgggtttattctctctggaggaccacaatctgtaaatgatgattgttctgaaacaagtagagtagtacatgaaattataaaacttaatgaggcaacaagcgttcctatacttggaatatgctatggacagcaactcatttgtcattattttggagcaaaagtaaaagagagtttcaaacaggagtttggtagaactaaaatcaagatactaaaagaatcccccattgtaaaggatacctgggatgttaattctgaagtggatgtattaatgaaccatgcggacagtgttgatactataccacagggatttactgttatcgcatcaggtgtgataaatcaaacaattgcaatgattgtcaacgaacagcggaagatttactgtactcagttccatcctgaggttaagcccacaacaaatggcagtaaattgctctctaacttcttggatattgcaaattgcaaaagagactggacaatgaagtcgtttattgaggagcaaaaggaaaaaatcaaaaatgtagtaggagagaaaaaagtaatcgctgcagtaagtggtggggttgattcaagcgttgcagcggctctcacacataaagctataggaaaacaattgaactgtatttttatcgatactgggttgttacgcaagaaccaaaccatcgctatgttgaaagagattccgataaattacgttgataaatcaaatttatttttgagtaggttgaagggaataactgatccagaagaaaagcgaaaaattatcggtaacacttttattgaagtgtttgaagaagaagcaaaaaaaataggtgatgtggattttttgatgcaaggtaccatctactctgatgtagttgagtcagggcatgcctcagacaacactagtacaattaagtctcaccataatgttggtgggttgccagaaaagatgaatctgaagttagtggagcctttacgttacctctttaaagatgaggtaaggctacttggaaaagaaattgggctttcagacgagataatatttcaacatccatttcctggacccggacttgcagtgaggattataagtgaagtcgataaagaaaaggtgcaaatattgcaagaagtagatgaaatatatattaatacgatgaaaaattacgatctatatgataagatatggcaagcttttgctgtattattaccaataaaaactgtaggcgttatgggagatggtcgtacgtatggatatgtttgtgctttaagggctgtaacatcatctgatggtatgacagccgatgcatttccatttgaagataaggatcaacacttgctagtattttgggattttttacgcaatgtcggcagtataattgttaataatgttcccggagtaaatagagttgtttatgatatcacttctaaaccacccgcaactattgagtgggagtaa

SEQ ID NO: 79048 - protein, 520 aa, Wolbachia pipientis wMel
MSAIAIIDFGSQFTQLIARQVRGMGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKDQHLLVFWDFLRNVGSIIVNNVPGVNRVVYDITSKPPATIEWE

SEQ ID NO: 79049 - DNA, 1566 bp, Wolinella succinogenes
  CDS (1)..(1566): transl_table=11
atgagtattcaactacacgataaggtttcgctactgattttggactttgggagccaatacactcagctcatcgcaaggcgactaagggagtatggaatctactgcgaaatcgtcccctaccacgagaagctagaggcgattaaagcacgcgaacccaagggaatcatcctcagcgggggaccagcgagcgtctatgaagaggatgctttcttgattgataaggcggtttttgagcttggaattcctgttcttggaatctgctatggaatgcagctcatgacccactactttggcggtgtggtggccaaggcggagcatcatgaatatggcaaggctgaggtgatttttgatgcccttgaggggagtgagtcgaagctttttgaagggtgccatagcggcaaagtggtctggatgagccatggcgacaaggtggagaaattgcctgaaggattcacaagaatcgcccactccacgaactctccctttgcggcgattgcccaccaagagaagcctttttatgcggtgcagtttcaccccgaggtcgtccactctgaagagggagcgctctatcttaaaaatttcgctctaggaatctgtggctgcgaaaatgattggaatatgcataacttcgccgaggagcagatcaaaaagattcaagagcgcgtcaagtcgggcaaagtgctctgcgccgtctcgggtggggttgattcaagcgtagtggctgcgcttttatatcgcgcgattggggagaagctgattcctgtttttgtcgatcatgggcttttgagggcaggtgagcgcgaggcggtcgagaagatgttcaaagagaatctccatgttcctctgatcacggtggatgcaagcgagattttccttggcaagctcaaaggggtgagcgatccagagacgaagcgtaaaatcatcggcgagaccttcattgaggtgtttgatgtggaggcgaaaaagcatgatggcatccaatatcttgctcaaggcacgctctatcctgatgtgatcgaatcggtctccgtcaagggccccagcaagacgattaagtcccaccacaatgttggcggactgcctgattggatgacctttgagctgattgagcccctaagagagctcttcaaggatgaggtgagggcgcttggagcggagcttgggatgccaagagagatgctcatgcgccatcctttccccggaccggggttagctatccgtatcatgggcgaggtcaactttgaagatttggagcttttgagaaaagcagatgtgatcatgcttgatgagctcaaaaagagtggcttttatgacaaaacttggcaggcgttcaccgtgcttctgaatgtgcgaagcgtaggcgtgatgggcgataaccgcacctatgacaacacggtctgcgttcgcgtggtcgaggcgattgatgggatgactgcgacttttgcgcatctgccccatgagcttttagagagaatgtccacacgaatcatcaacgaagtggatggaatcaaccgcgtggtctatgatatcagctccaagccgcctgccacgattgagtgggagtga

SEQ ID NO: 79050 - protein, 521 aa, Wolinella succinogenes
MSIQLHDKVSLLILDFGSQYTQLIARRLREYGIYCEIVPYHEKLEAIKAREPKGIILSGGPASVYEEDAFLIDKAVFELGIPVLGICYGMQLMTHYFGGVVAKAEHHEYGKAEVIFDALEGSESKLFEGCHSGKVVWMSHGDKVEKLPEGFTRIAHSTNSPFAAIAHQEKPFYAVQFHPEVVHSEEGALYLKNFALGICGCENDWNMHNFAEEQIKKIQERVKSGKVLCAVSGGVDSSVVAALLYRAIGEKLIPVFVDHGLLRAGEREAVEKMFKENLHVPLITVDASEIFLGKLKGVSDPETKRKIIGETFIEVFDVEAKKHDGIQYLAQGTLYPDVIESVSVKGPSKTIKSHHNVGGLPDWMTFELIEPLRELFKDEVRALGAELGMPREMLMRHPFPGPGLAIRIMGEVNFEDLELLRKADVIMLDELKKSGFYDKTWQAFTVLLNVRSVGVMGDNRTYDNTVCVRVVEAIDGMTATFAHLPHELLERMSTRIINEVDGINRVVYDISSKPPATIEWE

SEQ ID NO: 79051 - DNA, 1566 bp, Xanthomonas axonopodis
  CDS (1)..(1566): transl_table=11
atgaccaacatccataccgacaagatcctcatcctcgatttcggcgcgcagtacacccagctgattgcgcggcgtatccgcgagatcggggtctattgcgagatctgggcatgggatcacgatccgtcggagattgccggtttcggtgccaagggcatcatcctgtccggcggcccggagtcgaccacgttgcctggcgcaccggtcgcgccgcaggaagtgttcgatagcggcctgccggtgttcggtatctgctacggcatgcagacgctcgccgcgcagttgggtggtgccaccgaagccgccgatcagcgcgaattcggccatgccgaagtggatgtggtggcggcagatgccttgttcgctggcctcaccgaccatgccggcgcttcgcgcctgaatgtatggatgagccatggcgaccacgtgtcgcaggtgccgccgggcttcaccattaccgccacgaccgaccgcatcccggtggcggccatgtccaacgaagccaagcgctggtacggcgtgcagttccatccggaggtgacgcataccttgcagggccagaccttgctgcgtcgcttcgtggtggatgtctgcggctgccagacactgtggactgcggccaacatcatcgaggaccagatcgcgcgcgtgcgcgaacaggtgggcgacgacgaagtgattctcgggctgtccggcggcgtcgattcgtcggtggttgccgcgctgctgcacaaggcgatcggcgacaagctcacttgtgtgttcgtcgataccggcttgctgcgttggcaggaaggcgaccaggtgatggcgatgttcgccgagcacatgggcgtcaaggtgatccgcgtcaacgcggccgaccgctatttcgccaagctggaaggcgtgcgcgacccggaagccaagcgcaagatcatcggcaacctgttcgtggagatcttcgacgaagaatccaacaagctggccaatgccaagtggctggcgcagggcacgatctatccggacgtgatcgagtcggccggcagcaagaccggcaaggcgcacgtgatcaagagccaccataacgtcggcggcctgcccgagcatatgaagctgggcctggtcgagccgctgcgcgaactgttcaaggacgaagtgcggcgcctgggcgtggagctcggcctgccgcgcaccatggtgtatcgccatccgttcccgggccctggcctgggcgtgcgcatcctcggcgaagtcaagcgcgagtacgccgagctgctggccaaggccgatgcgatcttcatcgacgaactgcgcaaggccgacctgtacgacaccaccagccaggcgttcgcggtgttcctgccggtcaagtcggtgggcgtggtcggcgacgcgcgcgcctacgaatgggtgatcgcactgcgcgcggtggaaaccatcgatttcatgaccgcgcactgggcgcacctgccgtacgacttcctcggcacggtgagcaaccgcatcatcaacgaactgcgcggcgtttcgcgggtggtctacgacatctccggcaagccgccggcgacgatcgagtgggagtga

SEQ ID NO: 79052 - protein, 521 aa, Xanthomonas axonopodis
MTNIHTDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVVAADALFAGLTDHAGASRLNVWMSHGDHVSQVPPGFTITATTDRIPVAAMSNEAKRWYGVQFHPEVTHTLQGQTLLRRFVVDVCGCQTLWTAANIIEDQIARVREQVGDDEVILGLSGGVDSSVVAALLHKAIGDKLTCVFVDTGLLRWQEGDQVMAMFAEHMGVKVIRVNAADRYFAKLEGVRDPEAKRKIIGNLFVEIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDTTSQAFAVFLPVKSVGVVGDARAYEWVIALRAVETIDFMTAHWAHLPYDFLGTVSNRIINELRGVSRVVYDISGKPPATIEWE

SEQ ID NO: 79053 - DNA, 25 bp, Primer
atgacggaaaacattcataagcatc

SEQ ID NO: 79054 - DNA, 25 bp, Primer
ttattcccactcaatggtagctggc

SEQ ID NO: 79055 - protein, 897 aa, consensus
  MISC_FEATURE (1)..(897): consensus for the disclosure of xaa see table XV
DFGXQXXXLIXRRXREXXVXXEXXXXXXXXXXXXXXXXXXXXXXXXXIXSGGPXSVXXXXXXXXXXXXXXXXXXXXXXXPXLGICYGXQXXXXXXXGXXVXXXXXXXXXXEXGXXXXXXXXXXXXXXXXLXXXXXXXXXXXXXXXXXXXXXXXXXXXXXXXXXXXXVWMSHXDXVXXXXXPXXFXXXAXXXXXXXXAXXXXXXXXXXXXXYGXQFHPEVXHXXXXGXXXXXXFXXXXXXXXXXWXXXXXXXXXXXXXXXXVGXXXXXXXXXXXXXXXXXXXXXXXXXXXXXXXXXXXXXXXXXVXXXXSGGVDSXVXAXLXXXAIGXXXXXXXXXDXGXXRXXEXXXVXXXXXXXXXXXXXXXXXAXXXFXXXXXXXXXXXXXXXXXXXXXXXXXXXXXXXXXXXXXXXXLXGXXXPEXKRKXIGXXFXXXFXXXXXXXXXXXXXXXXXXXXXXXXXXXXXXXXXLXQGTXYPDXIESXXXXXXXXXXXXXXXXIKSHHNVGGLPXXXXXXXXXXXLXEPLXXLFKDEVRXXGXXLGXPXXXXXRXPFPGPGLXXRXXGXXXXXXXXXXXXXXXXXXXXXXXXXXXXXXXXXXXXXXXXXXXDXIXXXXXXXXXXXXXXXXXXXXXXXXXXXXXXXXXXXXXXXXXXXQXXXXXXXXXXXXXXXXXXFXXXXXXXXVGVXGDXRXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXVXXXDXMTAXXXXXXXXXXXXXXXXXXXXXXXXXXXXXXXXXLXXXXXRIXNEXXXXXXXXRVXYDXXXKPPXTIEWE

SEQ ID NO: 79056 - protein, 117 aa, consensus
  MISC_FEATURE (1)..(117): consensus for the disclosure of xaa see table XV
XXXXXXGXQXXXXXXXXXRXXXXXXXXXXXXXXXXXXXXXXXXXXXXXXXXXXXGXXXXXXXXXXXXXXXXXXXXXXXXXXXXPXXXXCYGXQXXXXXXGXXXXXXXXXXXXXXEXG

SEQ ID NO: 79057 - protein, 95 aa, consensus
  MISC_FEATURE (1)..(95): consensus for the disclosure of xaa see table XV
XXXXHXDXXXXXXXXXXXXXXXXXXXXXXXXXXXXXXXXXXXXXXXXQXHXEXXXXXXGXXXXXXFXXXXXXXXXXXXXXXXXXXXXXXXXXXXG

SEQ ID NO: 79058 - protein, 126 aa, consensus
  MISC_FEATURE (1)..(126): consensus for the disclosure of xaa see table XV
XXXXXSGGXDSXXXXXXXXXAXXXXXXXXXXXXXGXXRXXXXXXXXXXXXXXXXXXXXXXXXXXXXXXXXXXXXXXXXXXXXXXXXXXXXXXXXXXXXXXXXXXXXXXXXXXXPXXXXXXXGXXXX

SEQ ID NO: 79059 - protein, 95 aa, consensus
  MISC_FEATURE (1)..(95): consensus for the disclosure of xaa see table XV
XXXQGTXXXDXXESXXXXXXXXXXXXXXXXXKXHHNXXXXXXXXXXXXXXXXXXEPXXXXXKDXXXXXXXXXXXXXXXXXXXPFPGPGXXXRXXX

SEQ ID NO: 79060 - protein, 81 aa, consensus
  MISC_FEATURE (1)..(81): consensus for the disclosure of xaa see table XV
XRXXXXXXXMXXXXXXXXXXXXXXXXXXXXXXXXXXXXXXXXXXXXXXXXXXXXXXXXXXXXXXRXXXDXXXKPPXTXEXX

SEQ ID NO: 79061 - DNA, 339 bp, Escherichia coli; identical to SEQ ID NO: 62277
  CDS (1)..(339)

SEQ ID NO: 79062 - protein, 112 aa, Escherichia coli; identical to SEQ ID NO: 62278

SEQ ID NO: 79063 - DNA, 348 bp, Gluconobacter oxydans 621H; identical to SEQ ID NO: 62279
  CDS (1)..(348)

SEQ ID NO: 79064 - protein, 115 aa, Gluconobacter oxydans 621H; identical to SEQ ID NO: 62280

SEQ ID NO: 79065 - DNA, 363 bp, Archaeoglobus fulgidus DSM 4304; identical to SEQ ID NO: 62281
  CDS (1)..(363): transl_table=11

SEQ ID NO: 79066 - protein, 120 aa, Archaeoglobus fulgidus DSM 4304; identical to SEQ ID NO: 62282

SEQ ID NO: 79067 - DNA, 339 bp, Archaeoglobus fulgidus DSM 4304; identical to SEQ ID NO: 62283
  CDS (1)..(339): transl_table=11

SEQ ID NO: 79068 - protein, 112 aa, Archaeoglobus fulgidus DSM 4304; identical to SEQ ID NO: 62284

SEQ ID NO: 79069 - DNA, 339 bp, Mesorhizobium loti MAFF303099; identical to SEQ ID NO: 62285
  CDS (1)..(339): transl_table=11

SEQ ID NO: 79070 - protein, 112 aa, Mesorhizobium loti MAFF303099; identical to SEQ ID NO: 62286

SEQ ID NO: 79071 - DNA, 591 bp, Arabidopsis thaliana; identical to SEQ ID NO: 62287
  CDS (1)..(591)

SEQ ID NO: 79072 - protein, 196 aa, Arabidopsis thaliana; identical to SEQ ID NO: 62288

SEQ ID NO: 79073 - DNA, 618 bp, Aquifex aeolicus VF5; identical to SEQ ID NO: 62289
  CDS (1)..(618): transl_table=11

SEQ ID NO: 79074 - protein, 205 aa, Aquifex aeolicus VF5; identical to SEQ ID NO: 62290

SEQ ID NO: 79075 - DNA, 342 bp, Thermotoga maritima MSB8; identical to SEQ ID NO: 62291
  CDS (1)..(342): transl_table=11

SEQ ID NO: 79076 - protein, 113 aa, Thermotoga maritima MSB8; identical to SEQ ID NO: 62292

SEQ ID NO: 79077 - DNA, 345 bp, Vibrio cholerae O1 biovar eltor str. N16961; identical to SEQ ID NO: 62293
  CDS (1)..(345): transl_table=11

SEQ ID NO: 79078 - protein, 114 aa, Vibrio cholerae O1 biovar eltor str. N16961; identical to SEQ ID NO: 62294

SEQ ID NO: 79079 - DNA, 339 bp, Pseudomonas aeruginosa PAO1; identical to SEQ ID NO: 62295
  CDS (1)..(339): transl_table=11

SEQ ID NO: 79080 - protein, 112 aa, Pseudomonas aeruginosa PAO1; identical to SEQ ID NO: 62296

SEQ ID NO: 79081 - DNA, 342 bp, Lactococcus lactis subsp. lactis Il1403; identical to SEQ ID NO: 62297
  CDS (1)..(342): transl_table=11

SEQ ID NO: 79082 - protein, 113 aa, Lactococcus lactis subsp. lactis Il1403; identical to SEQ ID NO: 62298

SEQ ID NO: 79083 - DNA, 339 bp, Neisseria meningitidis MC58; identical to SEQ ID NO: 62299
  CDS (1)..(339): transl_table=11

SEQ ID NO: 79084 - protein, 112 aa, Neisseria meningitidis MC58; identical to SEQ ID NO: 62300

SEQ ID NO: 79085 - DNA, 327 bp, Methanothermobacter thermautotrophicus str. Delta H; identical to SEQ ID NO: 62301
  CDS (1)..(327): transl_table=11

SEQ ID NO: 79086 - protein, 108 aa, Methanothermobacter thermautotrophicus str. Delta H; identical to SEQ ID NO: 62302

SEQ ID NO: 79087 - DNA, 369 bp, Methanothermobacter thermautotrophicus str. Delta H; identical to SEQ ID NO: 62303
  CDS (1)..(369): transl_table=11

SEQ ID NO: 79088 - protein, 122 aa, Methanothermobacter thermautotrophicus str. Delta H; identical to SEQ ID NO: 62304

SEQ ID NO: 79089 - DNA, 339 bp, Neisseria meningitidis Z2491; identical to SEQ ID NO: 62305
  CDS (1)..(339): transl_table=11

SEQ ID NO: 79090 - protein, 112 aa, Neisseria meningitidis Z2491; identical to SEQ ID NO: 62306

SEQ ID NO: 79091 - DNA, 414 bp, Deinococcus radiodurans R1; identical to SEQ ID NO: 62307
  CDS (1)..(414): transl_table=11

SEQ ID NO: 79092 - protein, 137 aa, Deinococcus radiodurans R1; identical to SEQ ID NO: 62308

SEQ ID NO: 79093 - DNA, 366 bp, Clostridium acetobutylicum ATCC 824; identical to SEQ ID NO: 62309
  CDS (1)..(366): transl_table=11

SEQ ID NO: 79094 - protein, 121 aa, Clostridium acetobutylicum ATCC 824; identical to SEQ ID NO: 62310

SEQ ID NO: 79095 - DNA, 474 bp, Agrobacterium tumefaciens str. C58; identical to SEQ ID NO: 62311
  CDS (1)..(474): transl_table=11

SEQ ID NO: 79096 - protein, 157 aa, Agrobacterium tumefaciens str. C58; identical to SEQ ID NO: 62312

SEQ ID NO: 79097 - DNA, 339 bp, Sinorhizobium meliloti 1021; identical to SEQ ID NO: 62313
  CDS (1)..(339): transl_table=11

SEQ ID NO: 79098 - protein, 112 aa, Sinorhizobium meliloti 1021; identical to SEQ ID NO: 62314

SEQ ID NO: 79099 - DNA, 345 bp, Caulobacter crescentus CB15; identical to SEQ ID NO: 62315
  CDS (1)..(345): transl_table=11

SEQ ID NO: 79100 - protein, 114 aa, Caulobacter crescentus CB15; identical to SEQ ID NO: 62316

SEQ ID NO: 79101 - DNA, 339 bp, Caulobacter crescentus CB15; identical to SEQ ID NO: 62317
  CDS (1)..(339): transl_table=11

SEQ ID NO: 79102 - protein, 112 aa, Caulobacter crescentus CB15; identical to SEQ ID NO: 62318

SEQ ID NO: 79103 - DNA, 339 bp, Caulobacter crescentus CB15; identical to SEQ ID NO: 62319
  CDS (1)..(339): transl_table=11

SEQ ID NO: 79104 - protein, 112 aa, Caulobacter crescentus CB15; identical to SEQ ID NO: 62320

SEQ ID NO: 79105 - DNA, 339 bp, Salmonella typhimurium LT2; identical to SEQ ID NO: 62321
  CDS (1)..(339): transl_table=11

SEQ ID NO: 79106 - protein, 112 aa, Salmonella typhimurium LT2; identical to SEQ ID NO: 62322

SEQ ID NO: 79107 - DNA, 366 bp, Listeria innocua Clip11262; identical to SEQ ID NO: 62323
  CDS (1)..(366): transl_table=11

SEQ ID NO: 79108 - protein, 121 aa, Listeria innocua Clip11262; identical to SEQ ID NO: 62324

SEQ ID NO: 79109 - DNA, 339 bp, Nostoc sp. PCC 7120; identical to SEQ ID NO: 62325
  CDS (1)..(339): transl_table=11

SEQ ID NO: 79110 - protein, 112 aa, Nostoc sp. PCC 7120; identical to SEQ ID NO: 62326

SEQ ID NO: 79111 - DNA, 351 bp, Agrobacterium tumefaciens str. C58; identical to SEQ ID NO: 62327
  CDS (1)..(351): transl_table=11

SEQ ID NO: 79112 - protein, 116 aa, Agrobacterium tumefaciens str. C58; identical to SEQ ID NO: 62328

SEQ ID NO: 79113 - DNA, 339 bp, Corynebacterium glutamicum ATCC 13032; identical to SEQ ID NO: 62329
  CDS (1)..(339): transl_table=11

SEQ ID NO: 79114 - protein, 112 aa, Corynebacterium glutamicum ATCC 13032; identical to SEQ ID NO: 62330

SEQ ID NO: 79115 - DNA, 354 bp, Methanopyrus kandleri AV19; identical to SEQ ID NO: 62331
  CDS (1)..(354): transl_table=11

SEQ ID NO: 79116 - protein, 117 aa, Methanopyrus kandleri AV19; identical to SEQ ID NO: 62332

SEQ ID NO: 79117 - DNA, 372 bp, Methanosarcina acetivorans C2A; identical to SEQ ID NO: 62333
  CDS (1)..(372): transl_table=11

SEQ ID NO: 79118 - protein, 123 aa, Methanosarcina acetivorans C2A; identical to SEQ ID NO: 62334

SEQ ID NO: 79119 - DNA, 339 bp, Methanosarcina acetivorans C2A; identical to SEQ ID NO: 62335
  CDS (1)..(339): transl_table=11

SEQ ID NO: 79120 - protein, 112 aa, Methanosarcina acetivorans C2A; identical to SEQ ID NO: 62336

SEQ ID NO: 79121 - DNA, 354 bp, Methanosarcina mazei Go1; identical to SEQ ID NO: 62337
  CDS (1)..(354): transl_table=11

SEQ ID NO: 79122 - protein, 117 aa, Methanosarcina mazei Go1; identical to SEQ ID NO: 62338

SEQ ID NO: 79123 - DNA, 345 bp, Xanthomonas campestris pv. campestris str. ATCC 33913; identical to SEQ ID NO: 62339
  CDS (1)..(345): transl_table=11

SEQ ID NO: 79124 - protein, 114 aa, Xanthomonas campestris pv. campestris str. ATCC 33913; identical to SEQ ID NO: 62340

SEQ ID NO: 79125 - DNA, 339 bp, Xanthomonas campestris pv. campestris str. ATCC 33913; identical to SEQ ID NO: 62341
  CDS (1)..(339): transl_table=11

SEQ ID NO: 79126 - protein, 112 aa, Xanthomonas campestris pv. campestris str. ATCC 33913; identical to SEQ ID NO: 62342

SEQ ID NO: 79127 - DNA, 339 bp, Xanthomonas axonopodis pv. citri str. 306; identical to SEQ ID NO: 62343
  CDS (1)..(339): transl_table=11

SEQ ID NO: 79128 - protein, 112 aa, Xanthomonas axonopodis pv. citri str. 306; identical to SEQ ID NO: 62344

SEQ ID NO: 79129 - DNA, 354 bp, Chlorobium tepidum TLS; identical to SEQ ID NO: 62345
  CDS (1)..(354): transl_table=11

SEQ ID NO: 79130 - protein, 117 aa, Chlorobium tepidum TLS; identical to SEQ ID NO: 62346

SEQ ID NO: 79131 - DNA, 342 bp, Chlorobium tepidum TLS; identical to SEQ ID NO: 62347
  CDS (1)..(342): transl_table=11

SEQ ID NO: 79132 - protein, 113 aa, Chlorobium tepidum TLS; identical to SEQ ID NO: 62348

SEQ ID NO: 79133 - DNA, 339 bp, Yersinia pestis KIM; identical to SEQ ID NO: 62349
  CDS (1)..(339): transl_table=11

SEQ ID NO: 79134 - protein, 112 aa, Yersinia pestis KIM; identical to SEQ ID NO: 62350

SEQ ID NO: 79135 - DNA, 339 bp, Yersinia pestis KIM; identical to SEQ ID NO: 62351
  CDS (1)..(339): transl_table=11

SEQ ID NO: 79136 - protein, 112 aa, Yersinia pestis KIM; identical to SEQ ID NO: 62352

SEQ ID NO: 79137 - DNA, 339 bp, Thermosynechococcus elongatus BP-1; identical to SEQ ID NO: 62353
  CDS (1)..(339): transl_table=11

SEQ ID NO: 79138 - protein, 112 aa, Thermosynechococcus elongatus BP-1; identical to SEQ ID NO: 62354

SEQ ID NO: 79139 - DNA, 342 bp, Oceanobacillus iheyensis HTE831; identical to SEQ ID NO: 62355
  CDS (1)..(342): transl_table=11

SEQ ID NO: 79140 - protein, 113 aa, Oceanobacillus iheyensis HTE831; identical to SEQ ID NO: 62356

SEQ ID NO: 79141 - DNA, 339 bp, Bifidobacterium longum NCC2705; identical to SEQ ID NO: 62357
  CDS (1)..(339): transl_table=11

SEQ ID NO: 79142 - protein, 112 aa, Bifidobacterium longum NCC2705; identical to SEQ ID NO: 62358

SEQ ID NO: 79143 - DNA, 339 bp, Brucella suis 1330; identical to SEQ ID NO: 62359
  CDS (1)..(339): transl_table=11

SEQ ID NO: 79144 - protein, 112 aa, Brucella suis 1330; identical to SEQ ID NO: 62360

SEQ ID NO: 79145 - DNA, 339 bp, Shewanella oneidensis MR-1; identical to SEQ ID NO: 62361
  CDS (1)..(339): transl_table=11

SEQ ID NO: 79146 - protein, 112 aa, Shewanella oneidensis MR-1; identical to SEQ ID NO: 62362

SEQ ID NO: 79147 - DNA, 339 bp, Shewanella oneidensis MR-1; identical to SEQ ID NO: 62363
  CDS (1)..(339): transl_table=11

SEQ ID NO: 79148 - protein, 112 aa, Shewanella oneidensis MR-1; identical to SEQ ID NO: 62364

SEQ ID NO: 79149 - DNA, 339 bp, Shewanella oneidensis MR-1; identical to SEQ ID NO: 62365
  CDS (1)..(339): transl_table=11

SEQ ID NO: 79150 - protein, 112 aa, Shewanella oneidensis MR-1; identical to SEQ ID NO: 62366

SEQ ID NO: 79151 - DNA, 342 bp, Streptococcus mutans UA159; identical to SEQ ID NO: 62367
  CDS (1)..(342): transl_table=11

SEQ ID NO: 79152 - protein, 113 aa, Streptococcus mutans UA159; identical to SEQ ID NO: 62368

SEQ ID NO: 79153 - DNA, 339 bp, Streptomyces coelicolor A3(2); identical to SEQ ID NO: 62369
  CDS (1)..(339)

SEQ ID NO: 79154 - protein, 112 aa, Streptomyces coelicolor A3(2); identical to SEQ ID NO: 62370

SEQ ID NO: 79155 - DNA, 339 bp, Corynebacterium efficiens YS-314; identical to SEQ ID NO: 62371
  CDS (1)..(339): transl_table=11

SEQ ID NO: 79156 - protein, 112 aa, Corynebacterium efficiens YS-314; identical to SEQ ID NO: 62372

SEQ ID NO: 79157 - DNA, 339 bp, Pseudomonas putida KT2440; identical to SEQ ID NO: 62373
  CDS (1)..(339): transl_table=11

SEQ ID NO: 79158 - protein, 112 aa, Pseudomonas putida KT2440; identical to SEQ ID NO: 62374

SEQ ID NO: 79159 - DNA, 339 bp, Bradyrhizobium japonicum USDA 110; identical to SEQ ID NO: 62375
  CDS (1)..(339)

SEQ ID NO: 79160 - protein, 112 aa, Bradyrhizobium japonicum USDA 110; identical to SEQ ID NO: 62376

SEQ ID NO: 79161 - DNA, 339 bp, Vibrio parahaemolyticus RIMD 2210633; identical to SEQ ID NO: 62377
  CDS (1)..(339): transl_table=11

SEQ ID NO: 79162 - protein, 112 aa, Vibrio parahaemolyticus RIMD 2210633; identical to SEQ ID NO: 62378

SEQ ID NO: 79163 - DNA, 357 bp, Bacteroides thetaiotaomicron VPI-5482; identical to SEQ ID NO: 62379
  CDS (1)..(357): transl_table=11

SEQ ID NO: 79164 - protein, 118 aa, Bacteroides thetaiotaomicron VPI-5482; identical to SEQ ID NO: 62380

SEQ ID NO: 79165 - DNA, 339 bp, Streptomyces avermitilis MA-4680; identical to SEQ ID NO: 62381
  CDS (1)..(339)

SEQ ID NO: 79166 - protein, 112 aa, Streptomyces avermitilis MA-4680; identical to SEQ ID NO: 62382

SEQ ID NO: 79167 - DNA, 402 bp, Rhodopirellula baltica SH 1; identical to SEQ ID NO: 62383
  CDS (1)..(402): transl_table=11

SEQ ID NO: 79168 - protein, 133 aa, Rhodopirellula baltica SH 1; identical to SEQ ID NO: 62384

SEQ ID NO: 79169 - DNA, 477 bp, Rhodopirellula baltica SH 1; identical to SEQ ID NO: 62385
  CDS (1)..(477): transl_table=11

SEQ ID NO: 79170 - protein, 158 aa, Rhodopirellula baltica SH 1; identical to SEQ ID NO: 62386

SEQ ID NO: 79171 - DNA, 318 bp, Rhodopirellula baltica SH 1; identical to SEQ ID NO: 62387
  CDS (1)..(318): transl_table=11

SEQ ID NO: 79172 - protein, 105 aa, Rhodopirellula baltica SH 1; identical to SEQ ID NO: 62388

SEQ ID NO: 79173 - DNA, 339 bp, Prochlorococcus marinus subsp. marinus str. CCMP1375; identical to SEQ ID NO: 62389
  CDS (1)..(339): transl_table=11

SEQ ID NO: 79174 - protein, 112 aa, Prochlorococcus marinus subsp. marinus str. CCMP1375; identical to SEQ ID NO: 62390

SEQ ID NO: 79175 - DNA, 339 bp, Bordetella bronchiseptica RB50; identical to SEQ ID NO: 62391
  CDS (1)..(339): transl_table=11

SEQ ID NO: 79176 - protein, 112 aa, Bordetella bronchiseptica RB50; identical to SEQ ID NO: 62392

SEQ ID NO: 79177 - DNA, 339 bp, Bordetella bronchiseptica RB50; identical to SEQ ID NO: 62393
  CDS (1)..(339): transl_table=11

SEQ ID NO: 79178 - protein, 112 aa, Bordetella bronchiseptica RB50; identical to SEQ ID NO: 62394

SEQ ID NO: 79179 - DNA, 339 bp, Prochlorococcus marinus subsp. pastoris str. CCMP1986; identical to SEQ ID NO: 62395
  CDS (1)..(339): transl_table=11

SEQ ID NO: 79180 - protein, 112 aa, Prochlorococcus marinus subsp. pastoris str. CCMP1986; identical to SEQ ID NO: 62396

SEQ ID NO: 79181 - DNA, 339 bp, Synechococcus sp. WH 8102; identical to SEQ ID NO: 62397
  CDS (1)..(339): transl_table=11

SEQ ID NO: 79182 - protein, 112 aa, Synechococcus sp. WH 8102; identical to SEQ ID NO: 62398

SEQ ID NO: 79183 - DNA, 339 bp, Chromobacterium violaceum ATCC 12472; identical to SEQ ID NO: 62399
  CDS (1)..(339): transl_table=11

SEQ ID NO: 79184 - protein, 112 aa, Chromobacterium violaceum ATCC 12472; identical to SEQ ID NO: 62400

SEQ ID NO: 79185 - DNA, 339 bp, Chromobacterium violaceum ATCC 12472; identical to SEQ ID NO: 62401
  CDS (1)..(339): transl_table=11

SEQ ID NO: 79186 - protein, 112 aa, Chromobacterium violaceum ATCC 12472; identical to SEQ ID NO: 62402

SEQ ID NO: 79187 - DNA, 339 bp, Wolinella succinogenes DSM 1740; identical to SEQ ID NO: 62403
  CDS (1)..(339): transl_table=11

SEQ ID NO: 79188 - protein, 112 aa, Wolinella succinogenes DSM 1740; identical to SEQ ID NO: 62404

SEQ ID NO: 79189 - DNA, 339 bp, Wolinella succinogenes DSM 1740; identical to SEQ ID NO: 62405
  CDS (1)..(339): transl_table=11

SEQ ID NO: 79190 - protein, 112 aa, Wolinella succinogenes DSM 1740; identical to SEQ ID NO: 62406

SEQ ID NO: 79191 - DNA, 339 bp, Gloeobacter violaceus PCC 7421; identical to SEQ ID NO: 62407
  CDS (1)..(339): transl_table=11

SEQ ID NO: 79192 - protein, 112 aa, Gloeobacter violaceus PCC 7421; identical to SEQ ID NO: 62408

SEQ ID NO: 79193 - DNA, 369 bp, Gloeobacter violaceus PCC 7421; identical to SEQ ID NO: 62409
  CDS (1)..(369): transl_table=11

SEQ ID NO: 79194 - protein, 122 aa, Gloeobacter violaceus PCC 7421; identical to SEQ ID NO: 62410

SEQ ID NO: 79195 - DNA, 339 bp, Photorhabdus luminescens subsp. laumondii TTO1; identical to SEQ ID NO: 62411
  CDS (1)..(339): transl_table=11

SEQ ID NO: 79196 - protein, 112 aa, Photorhabdus luminescens subsp. laumondii TTO1; identical to SEQ ID NO: 62412

SEQ ID NO: 79197 - DNA, 339 bp, Photorhabdus luminescens subsp. laumondii TTO1; identical to SEQ ID NO: 62413
  CDS (1)..(339): transl_table=11

SEQ ID NO: 79198 - protein, 112 aa, Photorhabdus luminescens subsp. laumondii TTO1; identical to SEQ ID NO: 62414

SEQ ID NO: 79199 - DNA, 339 bp, Corynebacterium diphtheriae NCTC 13129; identical to SEQ ID NO: 62415
  CDS (1)..(339): transl_table=11

SEQ ID NO: 79200 - protein, 112 aa, Corynebacterium diphtheriae NCTC 13129; identical to SEQ ID NO: 62416

SEQ ID NO: 79201 - DNA, 339 bp, Rhodopseudomonas palustris CGA009; identical to SEQ ID NO: 62417
  CDS (1)..(339): transl_table=11

SEQ ID NO: 79202 - protein, 112 aa, Rhodopseudomonas palustris CGA009; identical to SEQ ID NO: 62418

SEQ ID NO: 79203 - DNA, 339 bp, Rhodopseudomonas palustris CGA009; identical to SEQ ID NO: 62419
  CDS (1)..(339): transl_table=11

SEQ ID NO: 79204 - protein, 112 aa, Rhodopseudomonas palustris CGA009; identical to SEQ ID NO: 62420

SEQ ID NO: 79205 - DNA, 339 bp, Rhodopseudomonas palustris CGA009; identical to SEQ ID NO: 62421
  CDS (1)..(339): transl_table=11

SEQ ID NO: 79206 - protein, 112 aa, Rhodopseudomonas palustris CGA009; identical to SEQ ID NO: 62422

SEQ ID NO: 79207 - DNA, 339 bp, Geobacter sulfurreducens PCA; identical to SEQ ID NO: 62423
  CDS (1)..(339): transl_table=11

SEQ ID NO: 79208 - protein, 112 aa, Geobacter sulfurreducens PCA; identical to SEQ ID NO: 62424

SEQ ID NO: 79209 - DNA, 339 bp, Mycobacterium avium subsp. paratuberculosis str. k10; identical to SEQ ID NO: 62425
  CDS (1)..(339): transl_table=11

SEQ ID NO: 79210 - protein, 112 aa, Mycobacterium avium subsp. paratuberculosis str. k10; identical to SEQ ID NO: 62426

SEQ ID NO: 79211 - DNA, 339 bp, Bdellovibrio bacteriovorus HD100; identical to SEQ ID NO: 62427
  CDS (1)..(339): transl_table=11

SEQ ID NO: 79212 - protein, 112 aa, Bdellovibrio bacteriovorus HD100; identical to SEQ ID NO: 62428

SEQ ID NO: 79213 - DNA, 339 bp, Methanococcus maripaludis S2; identical to SEQ ID NO: 62429
  CDS (1)..(339): transl_table=11

SEQ ID NO: 79214 - protein, 112 aa, Methanococcus maripaludis S2; identical to SEQ ID NO: 62430

SEQ ID NO: 79215 - DNA, 339 bp, Methanococcus maripaludis S2; identical to SEQ ID NO: 62431
  CDS (1)..(339): transl_table=11

SEQ ID NO: 79216 - protein, 112 aa, Methanococcus maripaludis S2; identical to SEQ ID NO: 62432

SEQ ID NO: 79217 - DNA, 339 bp, Methanococcus maripaludis S2; identical to SEQ ID NO: 62433
  CDS (1)..(339): transl_table=11

SEQ ID NO: 79218 - protein, 112 aa, Methanococcus maripaludis S2; identical to SEQ ID NO: 62434

SEQ ID NO: 79219 - DNA, 351 bp, Thermus thermophilus HB27; identical to SEQ ID NO: 62435
  CDS (1)..(351): transl_table=11

SEQ ID NO: 79220 - protein, 116 aa, Thermus thermophilus HB27; identical to SEQ ID NO: 62436

SEQ ID NO: 79221 - DNA, 396 bp, Desulfovibrio vulgaris subsp. vulgaris str. Hildenborough; identical to SEQ ID NO: 62437
  CDS (1)..(396): transl_table=11

SEQ ID NO: 79222 - protein, 131 aa, Desulfovibrio vulgaris subsp. vulgaris str. Hildenborough; identical to SEQ ID NO: 62438

SEQ ID NO: 79223 - DNA, 339 bp, Desulfovibrio vulgaris subsp. vulgaris str. Hildenborough; identical to SEQ ID NO: 62439
  CDS (1)..(339): transl_table=11

SEQ ID NO: 79224 - protein, 112 aa, Desulfovibrio vulgaris subsp. vulgaris str. Hildenborough; identical to SEQ ID NO: 62440

SEQ ID NO: 79225 - DNA, 339 bp, Bartonella quintana str. Toulouse; identical to SEQ ID NO: 62441
  CDS (1)..(339): transl_table=11

SEQ ID NO: 79226 - protein, 112 aa, Bartonella quintana str. Toulouse; identical to SEQ ID NO: 62442

SEQ ID NO: 79227 - DNA, 339 bp, Bartonella henselae str. Houston-1; identical to SEQ ID NO: 62443
  CDS (1)..(339): transl_table=11

SEQ ID NO: 79228 - protein, 112 aa, Bartonella henselae str. Houston-1; identical to SEQ ID NO: 62444

SEQ ID NO: 79229 - DNA, 339 bp, Acinetobacter sp. ADP1; identical to SEQ ID NO: 62445
  CDS (1)..(339): transl_table=11

SEQ ID NO: 79230 - protein, 112 aa, Acinetobacter sp. ADP1; identical to SEQ ID NO: 62446

SEQ ID NO: 79231 - DNA, 339 bp, Erwinia carotovora subsp. atroseptica SCRI1043; identical to SEQ ID NO: 62447
  CDS (1)..(339)

SEQ ID NO: 79232 - protein, 112 aa, Erwinia carotovora subsp. atroseptica SCRI1043; identical to SEQ ID NO: 62448

SEQ ID NO: 79233 - DNA, 345 bp, Desulfotalea psychrophila LSv54; identical to SEQ ID NO: 62449
  CDS (1)..(345): transl_table=11

SEQ ID NO: 79234 - protein, 114 aa, Desulfotalea psychrophila LSv54; identical to SEQ ID NO: 62450

SEQ ID NO: 79235 - DNA, 339 bp, Mannheimia succiniciproducens MBEL55E; identical to SEQ ID NO: 62451
  CDS (1)..(339): transl_table=11

SEQ ID NO: 79236 - protein, 112 aa, Mannheimia succiniciproducens MBEL55E; identical to SEQ ID NO: 62452

SEQ ID NO: 79237 - DNA, 351 bp, Bacillus licheniformis ATCC 14580; identical to SEQ ID NO: 62453
  CDS (1)..(351): transl_table=11

SEQ ID NO: 79238 - protein, 116 aa, Bacillus licheniformis ATCC 14580; identical to SEQ ID NO: 62454

SEQ ID NO: 79239 - DNA, 339 bp, Burkholderia mallei ATCC 23344; identical to SEQ ID NO: 62455
  CDS (1)..(339): transl_table=11

SEQ ID NO: 79240 - protein, 112 aa, Burkholderia mallei ATCC 23344; identical to SEQ ID NO: 62456

SEQ ID NO: 79241 - DNA, 339 bp, Burkholderia mallei ATCC 23344; identical to SEQ ID NO: 62457
  CDS (1)..(339): transl_table=11

SEQ ID NO: 79242 - protein, 112 aa, Burkholderia mallei ATCC 23344; identical to SEQ ID NO: 62458

SEQ ID NO: 79243 - DNA, 339 bp, Methylococcus capsulatus str. Bath; identical to SEQ ID NO: 62459
  CDS (1)..(339): transl_table=11

SEQ ID NO: 79244 - protein, 112 aa, Methylococcus capsulatus str. Bath; identical to SEQ ID NO: 62460

SEQ ID NO: 79245 - DNA, 339 bp, Nocardia farcinica IFM 10152; identical to SEQ ID NO: 62461
  CDS (1)..(339): transl_table=11

SEQ ID NO: 79246 - protein, 112 aa, Nocardia farcinica IFM 10152; identical to SEQ ID NO: 62462

SEQ ID NO: 79247 - DNA, 339 bp, Legionella pneumophila str. Lens; identical to SEQ ID NO: 62463
  CDS (1)..(339): transl_table=11

SEQ ID NO: 79248 - protein, 112 aa, Legionella pneumophila str. Lens; identical to SEQ ID NO: 62464

SEQ ID NO: 79249 - DNA, 339 bp, Photobacterium profundum SS9; identical to SEQ ID NO: 62465
  CDS (1)..(339): transl_table=11

SEQ ID NO: 79250 - protein, 112 aa, Photobacterium profundum SS9; identical to SEQ ID NO: 62466

SEQ ID NO: 79251 - DNA, 339 bp, Photobacterium profundum SS9; identical to SEQ ID NO: 62467
  CDS (1)..(339): transl_table=11

SEQ ID NO: 79252 - protein, 112 aa, Photobacterium profundum SS9; identical to SEQ ID NO: 62468

SEQ ID NO: 79253 - DNA, 366 bp, Haloarcula marismortui ATCC 43049; identical to SEQ ID NO: 62469
  CDS (1)..(366): transl_table=11

SEQ ID NO: 79254 - protein, 121 aa, Haloarcula marismortui ATCC 43049; identical to SEQ ID NO: 62470

SEQ ID NO: 79255 - DNA, 339 bp, Idiomarina loihiensis L2TR; identical to SEQ ID NO: 62471
  CDS (1)..(339): transl_table=11

SEQ ID NO: 79256 - protein, 112 aa, Idiomarina loihiensis L2TR; identical to SEQ ID NO: 62472

SEQ ID NO: 79257 - DNA, 339 bp, Idiomarina loihiensis L2TR; identical to SEQ ID NO: 62473
  CDS (1)..(339): transl_table=11

SEQ ID NO: 79258 - protein, 112 aa, Idiomarina loihiensis L2TR; identical to SEQ ID NO: 62474

SEQ ID NO: 79259 - DNA, 339 bp, Azoarcus sp. EbN1; identical to SEQ ID NO: 62475
  CDS (1)..(339): transl_table=11

SEQ ID NO: 79260 - protein, 112 aa, Azoarcus sp. EbN1; identical to SEQ ID NO: 62476

SEQ ID NO: 79261 - DNA, 339 bp, Azoarcus sp. EbN1; identical to SEQ ID NO: 62477
  CDS (1)..(339): transl_table=11

SEQ ID NO: 79262 - protein, 112 aa, Azoarcus sp. EbN1; identical to SEQ ID NO: 62478

SEQ ID NO: 79263 - DNA, 363 bp, Zymomonas mobilis subsp. mobilis ZM4; identical to SEQ ID NO: 62479
  CDS (1)..(363): transl_table=11

SEQ ID NO: 79264 - protein, 120 aa, Zymomonas mobilis subsp. mobilis ZM4; identical to SEQ ID NO: 62480

SEQ ID NO: 79265 - DNA, 339 bp, Dehalococcoides ethenogenes 195; identical to SEQ ID NO: 62481
  CDS (1)..(339): transl_table=11

SEQ ID NO: 79266 - protein, 112 aa, Dehalococcoides ethenogenes 195; identical to SEQ ID NO: 62482

SEQ ID NO: 79267 - DNA, 393 bp, Dehalococcoides ethenogenes 195; identical to SEQ ID NO: 62483
  CDS (1)..(393): transl_table=11

SEQ ID NO: 79268 - protein, 130 aa, Dehalococcoides ethenogenes 195; identical to SEQ ID NO: 62484

SEQ ID NO: 79269 - DNA, 339 bp, Magnetospirillum magnetotacticum MS-1; identical to SEQ ID NO: 62485
  CDS (1)..(339)

SEQ ID NO: 79270 - protein, 112 aa, Magnetospirillum magnetotacticum MS-1; identical to SEQ ID NO: 62486

SEQ ID NO: 79271 - DNA, 339 bp, Magnetospirillum magnetotacticum MS-1; identical to SEQ ID NO: 62487
  CDS (1)..(339)

SEQ ID NO: 79272 - protein, 112 aa, Magnetospirillum magnetotacticum MS-1; identical to SEQ ID NO: 62488

SEQ ID NO: 79273 - DNA, 339 bp, Magnetospirillum magnetotacticum MS-1; identical to SEQ ID NO: 62489
  CDS (1)..(339)

SEQ ID NO: 79274 - protein, 112 aa, Magnetospirillum magnetotacticum MS-1; identical to SEQ ID NO: 62490

SEQ ID NO: 79275 - DNA, 339 bp, Desulfitobacterium hafniense DCB-2; identical to SEQ ID NO: 62491
  CDS (1)..(339)

SEQ ID NO: 79276 - protein, 112 aa, Desulfitobacterium hafniense DCB-2; identical to SEQ ID NO: 62492

SEQ ID NO: 79277 - DNA, 312 bp, Desulfitobacterium hafniense DCB-2; identical to SEQ ID NO: 62493
  CDS (1)..(312)

SEQ ID NO: 79278 - protein, 103 aa, Desulfitobacterium hafniense DCB-2; identical to SEQ ID NO: 62494

SEQ ID NO: 79279 - DNA, 342 bp, Haemophilus somnus 129PT; identical to SEQ ID NO: 62495
  CDS (1)..(342)

SEQ ID NO: 79280 - protein, 113 aa, Haemophilus somnus 129PT; identical to SEQ ID NO: 62496

SEQ ID NO: 79281 - DNA, 327 bp, Desulfovibrio desulfuricans G20; identical to SEQ ID NO: 62497
  CDS (1)..(327)

SEQ ID NO: 79282 - protein, 108 aa, Desulfovibrio desulfuricans G20; identical to SEQ ID NO: 62498

SEQ ID NO: 79283 - DNA, 339 bp, Actinobacillus pleuropneumoniae serovar 1 str. 4074; identical to SEQ ID NO: 62499
  CDS (1)..(339)

SEQ ID NO: 79284 - protein, 112 aa, Actinobacillus pleuropneumoniae serovar 1 str. 4074; identical to SEQ ID NO: 62500

SEQ ID NO: 79285 - DNA, 339 bp, Psychrobacter sp. 273-4; identical to SEQ ID NO: 62501
  CDS (1)..(339)

SEQ ID NO: 79286 - protein, 112 aa, Psychrobacter sp. 273-4; identical to SEQ ID NO: 62502

SEQ ID NO: 79287 - DNA, 333 bp, Methanococcoides burtonii DSM 6242; identical to SEQ ID NO: 62503
  CDS (1)..(333)

SEQ ID NO: 79288 - protein, 110 aa, Methanococcoides burtonii DSM 6242; identical to SEQ ID NO: 62504

SEQ ID NO: 79289 - DNA, 339 bp, Dechloromonas aromatica RCB; identical to SEQ ID NO: 62505
  CDS (1)..(339)

SEQ ID NO: 79290 - protein, 112 aa, Dechloromonas aromatica RCB; identical to SEQ ID NO: 62506

SEQ ID NO: 79291 - DNA, 339 bp, Dechloromonas aromatica RCB; identical to SEQ ID NO: 62507
  CDS (1)..(339)

SEQ ID NO: 79292 - protein, 112 aa, Dechloromonas aromatica RCB; identical to SEQ ID NO: 62508

SEQ ID NO: 79293 - DNA, 339 bp, Dechloromonas aromatica RCB; identical to SEQ ID NO: 62509
  CDS (1)..(339)

SEQ ID NO: 79294 - protein, 112 aa, Dechloromonas aromatica RCB; identical to SEQ ID NO: 62510

SEQ ID NO: 79295 - DNA, 339 bp, Ralstonia eutropha JMP134; identical to SEQ ID NO: 62511
  CDS (1)..(339)

SEQ ID NO: 79296 - protein, 112 aa, Ralstonia eutropha JMP134; identical to SEQ ID NO: 62512

SEQ ID NO: 79297 - DNA, 339 bp, Methylobacillus flagellatus KT; identical to SEQ ID NO: 62513
  CDS (1)..(339)

SEQ ID NO: 79298 - protein, 112 aa, Methylobacillus flagellatus KT; identical to SEQ ID NO: 62514

SEQ ID NO: 79299 - DNA, 339 bp, Methylobacillus flagellatus KT; identical to SEQ ID NO: 62515
  CDS (1)..(339)

SEQ ID NO: 79300 - protein, 112 aa, Methylobacillus flagellatus KT; identical to SEQ ID NO: 62516

SEQ ID NO: 79301 - DNA, 339 bp, Crocosphaera watsonii WH 8501; identical to SEQ ID NO: 62517
  CDS (1)..(339)

SEQ ID NO: 79302 - protein, 112 aa, Crocosphaera watsonii WH 8501; identical to SEQ ID NO: 62518

SEQ ID NO: 79303 - DNA, 339 bp, Mesorhizobium sp. BNC1; identical to SEQ ID NO: 62519
  CDS (1)..(339)

SEQ ID NO: 79304 - protein, 112 aa, Mesorhizobium sp. BNC1; identical to SEQ ID NO: 62520

SEQ ID NO: 79305 - DNA, 339 bp, Mesorhizobium sp. BNC1; identical to SEQ ID NO: 62521
  CDS (1)..(339)

SEQ ID NO: 79306 - protein, 112 aa, Mesorhizobium sp. BNC1; identical to SEQ ID NO: 62522

SEQ ID NO: 79307 - DNA, 339 bp, Burkholderia cepacia R18194; identical to SEQ ID NO: 62523
  CDS (1)..(339)

SEQ ID NO: 79308 - protein, 112 aa, Burkholderia cepacia R18194; identical to SEQ ID NO: 62524

SEQ ID NO: 79309 - DNA, 339 bp, Rubrivivax gelatinosus PM1; identical to SEQ ID NO: 62525
  CDS (1)..(339)

SEQ ID NO: 79310 - protein, 112 aa, Rubrivivax gelatinosus PM1; identical to SEQ ID NO: 62526

SEQ ID NO: 79311 - DNA, 339 bp, Rubrivivax gelatinosus PM1; identical to SEQ ID NO: 62527
  CDS (1)..(339)

SEQ ID NO: 79312 - protein, 112 aa, Rubrivivax gelatinosus PM1; identical to SEQ ID NO: 62528

SEQ ID NO: 79313 - DNA, 339 bp, Rhodospirillum rubrum; identical to SEQ ID NO: 62529
  CDS (1)..(339)

SEQ ID NO: 79314 - protein, 112 aa, Rhodospirillum rubrum; identical to SEQ ID NO: 62530

SEQ ID NO: 79315 - DNA, 339 bp, Rhodospirillum rubrum; identical to SEQ ID NO: 62531
  CDS (1)..(339)

SEQ ID NO: 79316 - protein, 112 aa, Rhodospirillum rubrum; identical to SEQ ID NO: 62532

SEQ ID NO: 79317 - DNA, 339 bp, Ralstonia metallidurans CH34; identical to SEQ ID NO: 62533
  CDS (1)..(339)

SEQ ID NO: 79318 - protein, 112 aa, Ralstonia metallidurans CH34; identical to SEQ ID NO: 62534

SEQ ID NO: 79319 - DNA, 339 bp, Burkholderia fungorum LB400; identical to SEQ ID NO: 62535
  CDS (1)..(339)

SEQ ID NO: 79320 - protein, 112 aa, Burkholderia fungorum LB400; identical to SEQ ID NO: 62536

SEQ ID NO: 79321 - DNA, 339 bp, Magnetococcus sp. MC-1; identical to SEQ ID NO: 62537
  CDS (1)..(339)

SEQ ID NO: 79322 - protein, 112 aa, Magnetococcus sp. MC-1; identical to SEQ ID NO: 62538

SEQ ID NO: 79323 - DNA, 339 bp, Magnetococcus sp. MC-1; identical to SEQ ID NO: 62539
  CDS (1)..(339)

SEQ ID NO: 79324 - protein, 112 aa, Magnetococcus sp. MC-1; identical to SEQ ID NO: 62540

SEQ ID NO: 79325 - DNA, 339 bp, Geobacter metallireducens GS-15; identical to SEQ ID NO: 62541
  CDS (1)..(339)

SEQ ID NO: 79326 - protein, 112 aa, Geobacter metallireducens GS-15; identical to SEQ ID NO: 62542

SEQ ID NO: 79327 - DNA, 339 bp, Novosphingobium aromaticivorans DSM 12444; identical to SEQ ID NO: 62543
  CDS (1)..(339)

SEQ ID NO: 79328 - protein, 112 aa, Novosphingobium aromaticivorans DSM 12444; identical to SEQ ID NO: 62544

SEQ ID NO: 79329 - DNA, 339 bp, Novosphingobium aromaticivorans DSM 12444; identical to SEQ ID NO: 62545
  CDS (1)..(339)

SEQ ID NO: 79330 - protein, 112 aa, Novosphingobium aromaticivorans DSM 12444; identical to SEQ ID NO: 62546

SEQ ID NO: 79331 - DNA, 342 bp, Cytophaga hutchinsonii; identical to SEQ ID NO: 62547
  CDS (1)..(342)

SEQ ID NO: 79332 - protein, 113 aa, Cytophaga hutchinsonii; identical to SEQ ID NO: 62548

SEQ ID NO: 79333 - DNA, 339 bp, Cytophaga hutchinsonii; identical to SEQ ID NO: 62549
  CDS (1)..(339)

SEQ ID NO: 79334 - protein, 112 aa, Cytophaga hutchinsonii; identical to SEQ ID NO: 62550

SEQ ID NO: 79335 - DNA, 339 bp, Microbulbifer degradans 2-40; identical to SEQ ID NO: 62551
  CDS (1)..(339)

SEQ ID NO: 79336 - protein, 112 aa, Microbulbifer degradans 2-40; identical to SEQ ID NO: 62552

SEQ ID NO: 79337 - DNA, 339 bp, Microbulbifer degradans 2-40; identical to SEQ ID NO: 62553
  CDS (1)..(339)

SEQ ID NO: 79338 - protein, 112 aa, Microbulbifer degradans 2-40; identical to SEQ ID NO: 62554

SEQ ID NO: 79339 - DNA, 348 bp, Trichodesmium erythraeum IMS101; identical to SEQ ID NO: 62555
  CDS (1)..(348)

SEQ ID NO: 79340 - protein, 115 aa, Trichodesmium erythraeum IMS101; identical to SEQ ID NO: 62556

SEQ ID NO: 79341 - DNA, 339 bp, Moorella thermoacetica ATCC 39073; identical to SEQ ID NO: 62557
  CDS (1)..(339)

SEQ ID NO: 79342 - protein, 112 aa, Moorella thermoacetica ATCC 39073; identical to SEQ ID NO: 62558

SEQ ID NO: 79343 - DNA, 339 bp, Moorella thermoacetica ATCC 39073; identical to SEQ ID NO: 62559
  CDS (1)..(339)

SEQ ID NO: 79344 - protein, 112 aa, Moorella thermoacetica ATCC 39073; identical to SEQ ID NO: 62560

SEQ ID NO: 79345 - DNA, 339 bp, Thiobacillus denitrificans ATCC 25259; identical to SEQ ID NO: 62561
  CDS (1)..(339)

SEQ ID NO: 79346 - protein, 112 aa, Thiobacillus denitrificans ATCC 25259; identical to SEQ ID NO: 62562

SEQ ID NO: 79347 - DNA, 339 bp, Thiobacillus denitrificans ATCC 25259; identical to SEQ ID NO: 62563
  CDS (1)..(339)

SEQ ID NO: 79348 - protein, 112 aa, Thiobacillus denitrificans ATCC 25259; identical to SEQ ID NO: 62564

SEQ ID NO: 79349 - DNA, 339 bp, Silicibacter sp. TM1040; identical to SEQ ID NO: 62565
  CDS (1)..(339)

SEQ ID NO: 79350 - protein, 112 aa, Silicibacter sp. TM1040; identical to SEQ ID NO: 62566

SEQ ID NO: 79351 - DNA, 339 bp, Silicibacter sp. TM1040; identical to SEQ ID NO: 62567
  CDS (1)..(339)

SEQ ID NO: 79352 - protein, 112 aa, Silicibacter sp. TM1040; identical to SEQ ID NO: 62568

SEQ ID NO: 79353 - DNA, 339 bp, Methylobacillus flagellatus KT; identical to SEQ ID NO: 62569
  CDS (1)..(339)

SEQ ID NO: 79354 - protein, 112 aa, Methylobacillus flagellatus KT; identical to SEQ ID NO: 62570

SEQ ID NO: 79355 - DNA, 339 bp, Xylella fastidiosa Dixon; identical to SEQ ID NO: 62571
  CDS (1)..(339)

SEQ ID NO: 79356 - protein, 112 aa, Xylella fastidiosa Dixon; identical to SEQ ID NO: 62572

SEQ ID NO: 79357 - DNA, 339 bp, Polaromonas sp. JS666; identical to SEQ ID NO: 62573
  CDS (1)..(339)

SEQ ID NO: 79358 - protein, 112 aa, Polaromonas sp. JS666; identical to SEQ ID NO: 62574

SEQ ID NO: 79359 - DNA, 339 bp, Azospirillum brasilense; identical to SEQ ID NO: 62575
  CDS (1)..(339): transl_table=11

SEQ ID NO: 79360 - protein, 112 aa, Azospirillum brasilense; identical to SEQ ID NO: 62576

SEQ ID NO: 79361 - DNA, 339 bp, Azorhizobium caulinodans; identical to SEQ ID NO: 62577
  CDS (1)..(339): transl_table=11

SEQ ID NO: 79362 - protein, 112 aa, Azorhizobium caulinodans; identical to SEQ ID NO: 62578

SEQ ID NO: 79363 - DNA, 339 bp, Herbaspirillum seropedicae; identical to SEQ ID NO: 62579
  CDS (1)..(339): transl_table=11

SEQ ID NO: 79364 - protein, 112 aa, Herbaspirillum seropedicae; identical to SEQ ID NO: 62580

SEQ ID NO: 79365 - DNA, 339 bp, Clostridium longisporum; identical to SEQ ID NO: 62581
  CDS (1)..(339): transl_table=11

SEQ ID NO: 79366 - protein, 112 aa, Clostridium longisporum; identical to SEQ ID NO: 62582

SEQ ID NO: 79367 - DNA, 639 bp, Oryza sativa; identical to SEQ ID NO: 62583
  CDS (1)..(639)

SEQ ID NO: 79368 - protein, 212 aa, Oryza sativa; identical to SEQ ID NO: 62584

SEQ ID NO: 79369 - DNA, 600 bp, Lycopersicon esculentum; identical to SEQ ID NO: 62585
  CDS (1)..(600)

SEQ ID NO: 79370 - protein, 199 aa, Lycopersicon esculentum; identical to SEQ ID NO: 62586

SEQ ID NO: 79371 - DNA, 348 bp, uncultured crenarchaeote; identical to SEQ ID NO: 62587
  CDS (1)..(348): transl_table=11

SEQ ID NO: 79372 - protein, 115 aa, uncultured crenarchaeote; identical to SEQ ID NO: 62588

SEQ ID NO: 79373 - DNA, 732 bp, Pinus pinaster; identical to SEQ ID NO: 62589
  CDS (1)..(732)

SEQ ID NO: 79374 - protein, 243 aa, Pinus pinaster; identical to SEQ ID NO: 62590

SEQ ID NO: 79375 - DNA, 339 bp, Leptospirillum ferrooxidans; identical to SEQ ID NO: 62591
  CDS (1)..(339): transl_table=11

SEQ ID NO: 79376 - protein, 112 aa, Leptospirillum ferrooxidans; identical to SEQ ID NO: 62592

SEQ ID NO: 79377 - DNA, 339 bp, Acetobacter diazotrophicus; identical to SEQ ID NO: 62593
  CDS (1)..(339): transl_table=11

SEQ ID NO: 79378 - protein, 112 aa, Acetobacter diazotrophicus; identical to SEQ ID NO: 62594

SEQ ID NO: 79379 - DNA, 339 bp, Acetobacter diazotrophicus; identical to SEQ ID NO: 62595
  CDS (1)..(339): transl_table=11

SEQ ID NO: 79380 - protein, 112 aa, Acetobacter diazotrophicus; identical to SEQ ID NO: 62596

SEQ ID NO: 79381 - DNA, 339 bp, Acetobacter diazotrophicus; identical to SEQ ID NO: 62597
  CDS (1)..(339): transl_table=11

SEQ ID NO: 79382 - protein, 112 aa, Acetobacter diazotrophicus; identical to SEQ ID NO: 62598

SEQ ID NO: 79383 - DNA, 378 bp, Methanosarcina mazei; identical to SEQ ID NO: 62599
  CDS (1)..(378): transl_table=11

SEQ ID NO: 79384 - protein, 125 aa, Methanosarcina mazei; identical to SEQ ID NO: 62600

SEQ ID NO: 79385 - DNA, 339 bp, Azospirillum brasilense; identical to SEQ ID NO: 62601
  CDS (1)..(339): transl_table=11

SEQ ID NO: 79386 - protein, 112 aa, Azospirillum brasilense; identical to SEQ ID NO: 62602

SEQ ID NO: 79387 - DNA, 585 bp, Medicago sativa; identical to SEQ ID NO: 62603
  CDS (1)..(585)

SEQ ID NO: 79388 - protein, 194 aa, Medicago sativa; identical to SEQ ID NO: 62604

SEQ ID NO: 79389 - DNA, 405 bp, Methanosarcina barkeri; identical to SEQ ID NO: 62605
  CDS (1)..(405): transl_table=11

SEQ ID NO: 79390 - protein, 134 aa, Methanosarcina barkeri; identical to SEQ ID NO: 62606

SEQ ID NO: 79391 - DNA, 339 bp, Azoarcus sp; identical to SEQ ID NO: 62607
  CDS (1)..(339): transl_table=11

SEQ ID NO: 79392 - protein, 112 aa, Azoarcus sp; identical to SEQ ID NO: 62608

SEQ ID NO: 79393 - DNA, 339 bp, Azoarcus sp; identical to SEQ ID NO: 62609
  CDS (1)..(339): transl_table=11

SEQ ID NO: 79394 - protein, 112 aa, Azoarcus sp; identical to SEQ ID NO: 62610

SEQ ID NO: 79395 - DNA, 342 bp, Streptococcus thermophilus; identical to SEQ ID NO: 62611
  CDS (1)..(342): transl_table=11

SEQ ID NO: 79396 - protein, 113 aa, Streptococcus thermophilus; identical to SEQ ID NO: 62612

SEQ ID NO: 79397 - DNA, 339 bp, Synechococcus sp; identical to SEQ ID NO: 62613
  CDS (1)..(339): transl_table=11

SEQ ID NO: 79398 - protein, 112 aa, Synechococcus sp; identical to SEQ ID NO: 62614

SEQ ID NO: 79399 - DNA, 318 bp, nitrogen fixing bacterium ANFK33; identical to SEQ ID NO: 62615
  CDS (1)..(318): transl_table=11

SEQ ID NO: 79400 - protein, 105 aa, nitrogen fixing bacterium ANFK33; identical to SEQ ID NO: 62616

SEQ ID NO: 79401 - DNA, 339 bp, Klebsiella pneumoniae; identical to SEQ ID NO: 62617
  CDS (1)..(339): transl_table=11

SEQ ID NO: 79402 - protein, 112 aa, Klebsiella pneumoniae; identical to SEQ ID NO: 62618

SEQ ID NO: 79403 - DNA, 318 bp, Methanococcus maripaludis; identical to SEQ ID NO: 62619
  CDS (1)..(318): transl_table=11

SEQ ID NO: 79404 - protein, 105 aa, Methanococcus maripaludis; identical to SEQ ID NO: 62620

SEQ ID NO: 79405 - DNA, 318 bp, Methanococcus thermolithotrophicus; identical to SEQ ID NO: 62621
  CDS (1)..(318): transl_table=11

SEQ ID NO: 79406 - protein, 105 aa, Methanococcus thermolithotrophicus; identical to SEQ ID NO: 62622

SEQ ID NO: 79407 - DNA, 372 bp, Methanosarcina barkeri; identical to SEQ ID NO: 62623
  CDS (1)..(372): transl_table=11

SEQ ID NO: 79408 - protein, 123 aa, Methanosarcina barkeri; identical to SEQ ID NO: 62624

SEQ ID NO: 79409 - DNA, 369 bp, Methanobacterium ivanovii; identical to SEQ ID NO: 62625
  CDS (1)..(369): transl_table=11

SEQ ID NO: 79410 - protein, 122 aa, Methanobacterium ivanovii; identical to SEQ ID NO: 62626

SEQ ID NO: 79411 - DNA, 348 bp, Methanobacterium thermoautotrophicum; identical to SEQ ID NO: 62627
  CDS (1)..(348): transl_table=11

SEQ ID NO: 79412 - protein, 115 aa, Methanobacterium thermoautotrophicum; identical to SEQ ID NO: 62628

SEQ ID NO: 79413 - DNA, 339 bp, Aquifex aeolicus; identical to SEQ ID NO: 62629
  CDS (1)..(339): transl_table=11

SEQ ID NO: 79414 - protein, 112 aa, Aquifex aeolicus; identical to SEQ ID NO: 62630

SEQ ID NO: 79415 - DNA, 339 bp, Azospirillum brasilense; identical to SEQ ID NO: 62631
  CDS (1)..(339): transl_table=11

SEQ ID NO: 79416 - protein, 112 aa, Azospirillum brasilense; identical to SEQ ID NO: 62632

SEQ ID NO: 79417 - DNA, 339 bp, Bradyrhizobium japonicum; identical to SEQ ID NO: 62633
  CDS (1)..(339)

SEQ ID NO: 79418 - protein, 112 aa, Bradyrhizobium japonicum; identical to SEQ ID NO: 62634

SEQ ID NO: 79419 - DNA, 342 bp, Cyanidium caldarium; identical to SEQ ID NO: 62635
  CDS (1)..(342): transl_table=11

SEQ ID NO: 79420 - protein, 113 aa, Cyanidium caldarium; identical to SEQ ID NO: 62636

SEQ ID NO: 79421 - DNA, 339 bp, Fremyella diplosiphon; identical to SEQ ID NO: 62637
  CDS (1)..(339): transl_table=11

SEQ ID NO: 79422 - protein, 112 aa, Fremyella diplosiphon; identical to SEQ ID NO: 62638

SEQ ID NO: 79423 - DNA, 339 bp, Haemophilus influenzae; identical to SEQ ID NO: 62639
  CDS (1)..(339): transl_table=11

SEQ ID NO: 79424 - protein, 112 aa, Haemophilus influenzae; identical to SEQ ID NO: 62640

SEQ ID NO: 79425 - DNA, 339 bp, Mycobacterium bovis; identical to SEQ ID NO: 62641
  CDS (1)..(339): transl_table=11

SEQ ID NO: 79426 - protein, 112 aa, Mycobacterium bovis; identical to SEQ ID NO: 62642

SEQ ID NO: 79427 - DNA, 339 bp, Pasteurella multocida; identical to SEQ ID NO: 62643
  CDS (1)..(339): transl_table=11

SEQ ID NO: 79428 - protein, 112 aa, Pasteurella multocida; identical to SEQ ID NO: 62644

SEQ ID NO: 79429 - DNA, 339 bp, Porphyra purpurea; identical to SEQ ID NO: 62645
  CDS (1)..(339)

SEQ ID NO: 79430 - protein, 112 aa, Porphyra purpurea; identical to SEQ ID NO: 62646

SEQ ID NO: 79431 - DNA, 339 bp, Rhizobium meliloti; identical to SEQ ID NO: 62647
  CDS (1)..(339): transl_table=11

SEQ ID NO: 79432 - protein, 112 aa, Rhizobium meliloti; identical to SEQ ID NO: 62648

SEQ ID NO: 79433 - DNA, 339 bp, Rhodobacter capsulatus; identical to SEQ ID NO: 62649
  CDS (1)..(339): transl_table=11

SEQ ID NO: 79434 - protein, 112 aa, Rhodobacter capsulatus; identical to SEQ ID NO: 62650

SEQ ID NO: 79435 - DNA, 339 bp, Rhodobacter sphaeroides; identical to SEQ ID NO: 62651
  CDS (1)..(339): transl_table=11

SEQ ID NO: 79436 - protein, 112 aa, Rhodobacter sphaeroides; identical to SEQ ID NO: 62652

SEQ ID NO: 79437 - DNA, 339 bp, Escherichia coli; identical to SEQ ID NO: 62653
  CDS (1)..(339): transl_table=11

SEQ ID NO: 79438 - protein, 112 aa, Escherichia coli; identical to SEQ ID NO: 62654

SEQ ID NO: 79439 - DNA, 351 bp, Bacillus subtilis; identical to SEQ ID NO: 62655
  CDS (1)..(351): transl_table=11

SEQ ID NO: 79440 - protein, 116 aa, Bacillus subtilis; identical to SEQ ID NO: 62656

SEQ ID NO: 79441 - DNA, 339 bp, Methanococcus jannaschii; identical to SEQ ID NO: 62657
  CDS (1)..(339): transl_table=11

SEQ ID NO: 79442 - protein, 112 aa, Methanococcus jannaschii; identical to SEQ ID NO: 62658

SEQ ID NO: 79443 - DNA, 26 bp, Primer
atgaaaaagattgatgcgattataaa

SEQ ID NO: 79444 - DNA, 23 bp, Primer
ttaaattgccgcgtcgtcctctt

SEQ ID NO: 79445 - protein, 130 aa, consensus; identical to SEQ ID NO: 62661
  MISC_FEATURE (1)..(130): consensus for the disclosure of xaa see table XV

SEQ ID NO: 79446 - protein, 42 aa, consensus; identical to SEQ ID NO: 62662
  MISC_FEATURE (1)..(42): consensus for the disclosure of xaa see table XV

SEQ ID NO: 79447 - protein, 24 aa, consensus
  MISC_FEATURE (1)..(24): consensus for the disclosure of xaa see table XV
XXXXGDGXXXXXXXXXXXXXXTXX

SEQ ID NO: 79448 - DNA, 1967 bp, Escherichia coli
  CDS (460)..(1794)
ggatccactgctgaatatccgccgtatggacgttaatccgctctgcccacggggactggttgatattttcctgcgcctgcgcggcagcttcactttccagttcaactgcatcaatcatcacgctgtcatcggttcgctgcgccagcattaatgccagcaacccgctacccgcgccgatatcaaggcaacgttttaccccagccaccggtgcccatgcgcccaataaaataccatccgttcccactttcatcgcacagcgatcgtgagcaacaaaaaactgtttaaaagtaaatccattacgacgaagcacggatgtagactgtgacatgaaaataaaaccttgcaggaaaaacggcgatagcaccgggtgagaacaatacccgagaagcgatatccatacaaacagatgaagattgcagccgtaacgtctataatcagcgccccacacagaggtagaacatgactgtaacgactttttccgaacttgaactcgacgaaagcctgctggaagccctccaggataaaggtttcactcgcccgaccgccattcaggctgccgccattccgcctgcgctcgatggccgtgatgtactcggttctgcgccgacaggcaccggtaaaacggcggcgtatctgctgccagcgttgcagcacctgctcgatttcccgcgtaagaaatccggtccgccgcgtattttgatcctcaccccaactcgcgagctggcgatgcaggtgtccgatcatgcccgcgaactggcgaaacatacgcatctggatatcgccaccatcaccggcggcgtagcctatatgaaccacgcggaagtgttcagcgaaaatcaggacatcgtggtcgccacgaccggacgtctgctgcaatacataaaagaagagaacttcgattgccgcgcggttgaaacgctgatcctcgacgaagcagaccgtatgctggatatgggcttcgctcaggatatcgaacatattgctggcgaaacgcgctggcgtaaacagaccctgctcttttcggcaacgctggaaggcgatgcgattcaggactttgccgagcgtctgctggaagatccggtggaagtttctgccaatccctccacccgtgagcgcaaaaaaattcatcagtggtattaccgcgccgatgatcttgagcataaaaccgcgttgctggtgcatctgttaaaacagccggaagcgacccgctcaattgtgtttgtgcgtaagcgtgagcgtgtgcatgagctggcaaactggctgcgcgaagcgggcatcaacaactgctatctcgaaggtgagatggtacagggcaagcgtaacgaagcgatcaagcgtttgaccgaaggtcgcgtaaacgtactggtcgcaaccgatgttgccgcgcgcggtatcgacattcctgacgtcagccacgtctttaacttcgatatgccgcgcagtggcgatacttatttgcaccgtatcggacgtaccgcgcgcgccggtcgtaaaggcaccgcaatttcgctggtggaagcccatgaccatctgctgctgggtaaagtaggccgctatattgaagagccaattaaagctcgcgttattgatgagttacgcccgaaaacgcgtgcgccaagcgaaaagcagaccggcaagccatcgaagaaagtactggctaaacgtgctgagaagaaaaaagctaaagagaaagagaagccgcgggtgaaaaaacgccatcgcgacaccaaaaatattggtaagcgccgtaaaccaagcggaacgggcgtgccaccgcaaacgacagaagagtaatctcaatgccaggtttaagcctggtattaaaagtgctggcaaacgcaaaactgcctgatgcgctacgcttatcaggcctacgtggctcatgcaatatattgaatttgcacgatcttgtaggccggataagcgttcacgccgcatccggcatgaataaagcgcactttgtcgac

SEQ ID NO: 79449 - protein, 444 aa, Escherichia coli
MTVTTFSELELDESLLEALQDKGFTRPTAIQAAAIPPALDGRDVLGSAPTGTGKTAAYLLPALQHLLDFPRKKSGPPRILILTPTRELAMQVSDHARELAKHTHLDIATITGGVAYMNHAEVFSENQDIVVATTGRLLQYIKEENFDCRAVETLILDEADRMLDMGFAQDIEHIAGETRWRKQTLLFSATLEGDAIQDFAERLLEDPVEVSANPSTRERKKIHQWYYRADDLEHKTALLVHLLKQPEATRSIVFVRKRERVHELANWLREAGINNCYLEGEMVQGKRNEAIKRLTEGRVNVLVATDVAARGIDIPDVSHVFNFDMPRSGDTYLHRIGRTARAGRKGTAISLVEAHDHLLLGKVGRYIEEPIKARVIDELRPKTRAPSEKQTGKPSKKVLAKRAEKKKAKEKEKPRVKKRHRDTKNIGKRRKPSGTGVPPQTTEE

SEQ ID NO: 79450 - DNA, 1404 bp, Mesorhizobium loti MAFF303099
  CDS (1)..(1404): transl_table=11
ttgcccagcaacgtcaccgcggaactctccggtttcgcagcgctgggaatcacgggtgcgctgctcaaggccacccacaatgccggattcaccgaaccgaagccgatccagatgcaggcaatcccgccgcagctggaaggccgtgacattttcggcatcgcgcagaccggctccggcaagaccgcggcctttgcgctgcccatcctgtcgaagatcatcgcgctcggcaccaagcggcgcgccaagacgacccgcgcgctgatcctggcgccgacccgcgaactcgccgtgcagatcgaggataccatcaagatcctcgccaagggcgcccatgtctcgacggcactcgtgctgggaggcgtctcgcgcttcagccaggtgaagaaggttgctcccggcgtcgatatcctgattgccacgcccggccggttgaccgacctggtgcgcgagggcgacctcatcctctccgataccaaatggctggtgctggacgagggcgaccgcatgctcgacatgggcttcatcaacgacgtcaagcgcatcgccaaggcgaccgcgcctgaccgccagacggcgctgttctcggccaccatgccggacgagatcgccgaactggcaaagggcctgttgaagaaccccgtccgcatcgaagtctcgccgcaaagcaccgcggcggctgagatcgtccagggcgtcgtcttcgcccgcaccaagcagaagcgccaggtgctgtcgacgatgctcgcagacgaggcgatgaagtccgtcatcattttttcccgtaccaagcatggcgccgacagggtgaccaaggacctcgagcgcgatggcttcaaggccgccgtcatccatggcaacaagtcgcagaatgcccgtcagaaggcgctgaacgatttccgtgagggatcggtccgcattctggtcgcgacggacatcgcggcgcgcggcatcgacgtacccggcatcagccatgtcgtgaatttcgacctgccggacgaggctgaaagctacgtccaccgcatcggccgcaccggccgcaacggcatggacggcatcgcgatcacgctttgcgatccttcggagaacagcaagctgcgccaggtcgagcgcatcatccgcaccaagctgccgatcgttgccgaccatctcggcagccccgatccgcagcgcaatccggctgaaaagaacgagcgcttcgagcccgccaatgatcgcaacgaccgcaatggccgtcgcgacggcaggcggccgggcggcgagaacaagggcaacggctttggcaagaagcgcttcggcgacaagccggcctttgccggtgagcgcaagccggaaggcgccaagcccttcaagggcaacaacaagcgccgtttcggcggcaagcgtccggcagcgcgggctgcttaa

SEQ ID NO: 79451 - protein, 467 aa, Mesorhizobium loti MAFF303099
MPSNVTAELSGFAALGITGALLKATHNAGFTEPKPIQMQAIPPQLEGRDIFGIAQTGSGKTAAFALPILSKIIALGTKRRAKTTRALILAPTRELAVQIEDTIKILAKGAHVSTALVLGGVSRFSQVKKVAPGVDILIATPGRLTDLVREGDLILSDTKWLVLDEGDRMLDMGFINDVKRIAKATAPDRQTALFSATMPDEIAELAKGLLKNPVRIEVSPQSTAAAEIVQGVVFARTKQKRQVLSTMLADEAMKSVIIFSRTKHGADRVTKDLERDGFKAAVIHGNKSQNARQKALNDFREGSVRILVATDIAARGIDVPGISHVVNFDLPDEAESYVHRIGRTGRNGMDGIAITLCDPSENSKLRQVERIIRTKLPIVADHLGSPDPQRNPAEKNERFEPANDRNDRNGRRDGRRPGGENKGNGFGKKRFGDKPAFAGERKPEGAKPFKGNNKRRFGGKRPAARAA

SEQ ID NO: 79452 - DNA, 1479 bp, Helicobacter pylori 26695; identical to SEQ ID NO: 38493
  CDS (1)..(1479): transl_table=11

SEQ ID NO: 79453 - protein, 492 aa, Helicobacter pylori 26695; identical to SEQ ID NO: 38494

SEQ ID NO: 79454 - DNA, 1476 bp, Helicobacter pylori J99; identical to SEQ ID NO: 38497
  CDS (1)..(1476): transl_table=11

SEQ ID NO: 79455 - protein, 491 aa, Helicobacter pylori J99; identical to SEQ ID NO: 38498

SEQ ID NO: 79456 - DNA, 1272 bp, Vibrio cholerae O1 biovar eltor str. N16961
  CDS (1)..(1272): transl_table=11
gtgattaaaacctttgccgacctcgaactcgatccaattttgcttgaagcgatcgaagaaatgggctttagccgcccaacccaagttcaggctgaagcaatcccgcaagcactggatggtcgcgatgtcttagcctcagccccaacaggcacgggtaaaacggcggctttcgtgatcccagcgctgcaatatttgctcgatttcccacgccgtaaagcgggtcctgcgcggattttgatcctcactccgactcgtgaactggcgatgcaagtagctgaacaagcacaggcgctggccaaaaatactcgtctgaacattttcaccattaccggtggtgttcagtaccaagagcacgccgatattctggccacgactcaagatatcgtggtcgccacaccaggacgtctgctggaatacattgacgccgagcgctttgattgtcgtgcgattgagtggctgatcctcgatgaagcggaccgcatgttggacatgggctttggcccaaccgttgatcgcctttcgaccgagtgtcgctggcgtaaacagacactgctcttttcagcaaccctagaaggccgcggtgtggaaggctttactgccgatctgttaaaagatcccgcccatgtcgatgccgagccaccccgtcgtgagcgtaagaaaatttcgcagtggtaccaccgcgccgatgatatgccacacaaagtggaactgctgaaaaagatcctaaccgagcaagctgaacgttctatcgtgtttttgaaaactcgtgagcgtctcgcagacctgcgtgctgagctggagaaagcccagatcccttgtgcttggattcaaggtgaaatgccgcaagatcgccgtaacaatgcgatcagccgtttccgtgaaggcgatgtcaatattctgctggctaccgatgtggcggcgcgtggtattgatgtgccagacattagccatgtgatcaactttgacttgccacgcagtgctgacgtttacctacaccgtattggtcgcaccggacgtgcagggaaaaaaggtattgctatttcactggttgaagcgcacgaccagccgatgatggcgcgtgttgaacgttacatcaaagaagaagtcaaagagcgctttattgatggtttacgccctaagcacaaaaagcctgtgtttaagaaaaagaaaaaagacatcaagaaaaccgcagacaaaggcgcggtgaaaaagaaaaccaccagcaagccaaaagcaaaagcgaccaagaagaaagccgcgaccaaagcctaa

SEQ ID NO: 79457 - protein, 423 aa, Vibrio cholerae O1 biovar eltor str. N16961
MIKTFADLELDPILLEAIEEMGFSRPTQVQAEAIPQALDGRDVLASAPTGTGKTAAFVIPALQYLLDFPRRKAGPARILILTPTRELAMQVAEQAQALAKNTRLNIFTITGGVQYQEHADILATTQDIVVATPGRLLEYIDAERFDCRAIEWLILDEADRMLDMGFGPTVDRLSTECRWRKQTLLFSATLEGRGVEGFTADLLKDPAHVDAEPPRRERKKISQWYHRADDMPHKVELLKKILTEQAERSIVFLKTRERLADLRAELEKAQIPCAWIQGEMPQDRRNNAISRFREGDVNILLATDVAARGIDVPDISHVINFDLPRSADVYLHRIGRTGRAGKKGIAISLVEAHDQPMMARVERYIKEEVKERFIDGLRPKHKKPVFKKKKKDIKKTADKGAVKKKTTSKPKAKATKKKAATKA

SEQ ID NO: 79458 - DNA, 1620 bp, Bacillus halodurans C-125
  CDS (1)..(1620): transl_table=11
atgaacgaagcaatgataaagtttaatgagttacaaattggagaagaaattaaaaaggcgattattgagatgggatttgaagagccatctcctatccaagcaaaggcgattcctgcaatccttgcaggtggtgatgtcattggccaagcccaaacaggaacaggaaaaacagctgcatttggcataccagtagtggaaaaagtgtcgacgggccgccatgtacaggctcttatcttaacacctacacgagagctagcaatccaagtgtcaggagaaattcaaaagctttccaagcacaaaaaaattcgtacccttccgatttatgggggacaatcgattgttcatcaaatcaaagctttaaaacaaggagttcaagtcgtcattgggacaccgggtcgtattatcgatcatctgcgtcggaaaacgttaattttagaccacgttaatacagtgattttagacgaagctgatgaaatgcttgatatgggctttatcgatgatatcgagtccattctgcgccaggtgaaaaatgagcgccaaaccttgcttttctctgcgacgatgccgccagcgattaaaaagctatctcgcaaatatatgaacgatccacaaaccgtatccatcaatcgacgagaagtgacagcaccttctatcgatcaattttattataaagtgttagagcggaataaattagattctctttgccggattattgacagcgagcagattgatcttggaattttgttttgccggacgaaaaaaggtgtggcagagctaacggaagcattgcaagctcgcggttacattgccgatggattacacggtgatttaacacaatctcagcgtgatgcagttatgcggaaattccgtgactcatcgattgaattcttgattgccaccgatgtggcggcgagagggattgacgtggggaacgtctctcacgtgatcaattatgatattccccaagatccagaaagctatgttcaccggatcggtcgtacaggccgtgcaggacgtaaagggcttgcacttacgcttgtcacgccaagggaaatgaaacatctccgttcgatcgaacaagaaattaaaatgtcaatcccgtctcaagaagtgccgacgattgaagatgtggtggaaaaacaaaaagaatcatggaagaagcaaatcgcccatcgaattgagaaaggctctaaccaaaagcacctcttcgagcaaatgactgaagagttgatggcagagtacgattcaaaagaggtgatctctgctctccttcaattaaactacgcgatggacacagctcctgaggatgcgggatatagctttggggaaaccggtggtgccaaaggcatggtccgtttctttatcaatgttggtagaaatgtgaatatgagtccaaagattcttgtcgaggagattgcagagcttgttggcattcctggtaaggcgatcggccgaatcgacatctttgaaaaattcacgtttgttgaagtgcctgaagaagtggctccgtttgtttatgaagcgcttcgttactcaaggatcaacggtgctcgtgtgaaccttgagccagcaaaacctcgtccaaagcgggaatcacagcgaagaacatttcaaaaatag

SEQ ID NO: 79459 - protein, 539 aa, Bacillus halodurans C-125
MNEAMIKFNELQIGEEIKKAIIEMGFEEPSPIQAKAIPAILAGGDVIGQAQTGTGKTAAFGIPVVEKVSTGRHVQALILTPTRELAIQVSGEIQKLSKHKKIRTLPIYGGQSIVHQIKALKQGVQVVIGTPGRIIDHLRRKTLILDHVNTVILDEADEMLDMGFIDDIESILRQVKNERQTLLFSATMPPAIKKLSRKYMNDPQTVSINRREVTAPSIDQFYYKVLERNKLDSLCRIIDSEQIDLGILFCRTKKGVAELTEALQARGYIADGLHGDLTQSQRDAVMRKFRDSSIEFLIATDVAARGIDVGNVSHVINYDIPQDPESYVHRIGRTGRAGRKGLALTLVTPREMKHLRSIEQEIKMSIPSQEVPTIEDVVEKQKESWKKQIAHRIEKGSNQKHLFEQMTEELMAEYDSKEVISALLQLNYAMDTAPEDAGYSFGETGGAKGMVRFFINVGRNVNMSPKILVEEIAELVGIPGKAIGRIDIFEKFTFVEVPEEVAPFVYEALRYSRINGARVNLEPAKPRPKRESQRRTFQK

SEQ ID NO: 79460 - DNA, 1329 bp, Pasteurella multocida subsp. multocida str. Pm70
  CDS (1)..(1329): transl_table=11
atgacattagccacttttcaagattttgatctcgctcctgccttactgaaagcactcgctaaaaaaggctacactcgtccaacagcgattcagcaagaaacgattcccgccgccatggaacaacgtgacgtgctaggttctgcaccaacaggtaccggtaaaacagccgcctttttactgccagccattcagcacttactcgattatccacgtcgcaaaccaggcgccccacgtattttaattttaacgccaactcgtgaacttgctatgcaagtagcagagcaggcagaaagctttgcggaattcacgaatttgagtatcgcgaccattaccggtggtgtggcttaccaaaaccatggggaaatttttaacagcaatcaagatatcgtagtggcaaccccaggacgcttattgcaatacattaaagaagaaaactttgattgtcgttccgtcgaaatgctcatcttcgatgaagcggatcgcatgcttcaaatgggttttggacaagatgctgaaaaaattgccgctgaaactcgctggcgtaaacaaaccttgctattttccgccacattagagggcgaattactggtggatttcgccagtcgattattaacagaacccgtgcaaattgacgctgagcccagtcgccgtgagcgtaaaaaaattcagcaatggtattatcatgctgacagcaatgaacacaaaatcaaattattggcacgttttattgatgaagaacaagtgagccgaggtattgtgttcgtacgtcgacgtgaagaggtgcgtgaactgtccgaaactttgcgtaaacgcggtattcgttccacctatttagaaggtgaaatggcacaaactcaacgcaataacgctattgataaacttaaaaatggtattgtgacggtcttagtagcaactgatgtcgccgcacgtgggattgatatcgaagatgtcagccatgtcatgaacttcgacttaccatacagcgcagatacctatttgcaccggattggacgtactgcacgcgcaggtaaaaaaggcgtagcggtgtcttttgtggaagcccatgattataaattgttgggtaaaatcaaacgttacacccaagaattactgaaagcacgtattatcgaaggcttagcccctcgcaccaaagcaccgaaagagggagaagttaaaacggtcagtaaaaagcaaaaagcccgcattaaagcaaaacgtgaagagaagcaaaaacaagagcaaaagaaaaaagtgaaactgcgtcataaagatacaaaaaatattggtaaacgtcgcaaatccaataccccccctgctaacgcagaataa

SEQ ID NO: 79461 - protein, 442 aa, Pasteurella multocida subsp. multocida str. Pm70
MTLATFQDFDLAPALLKALAKKGYTRPTAIQQETIPAAMEQRDVLGSAPTGTGKTAAFLLPAIQHLLDYPRRKPGAPRILILTPTRELAMQVAEQAESFAEFTNLSIATITGGVAYQNHGEIFNSNQDIVVATPGRLLQYIKEENFDCRSVEMLIFDEADRMLQMGFGQDAEKIAAETRWRKQTLLFSATLEGELLVDFASRLLTEPVQIDAEPSRRERKKIQQWYYHADSNEHKIKLLARFIDEEQVSRGIVFVRRREEVRELSETLRKRGIRSTYLEGEMAQTQRNNAIDKLKNGIVTVLVATDVAARGIDIEDVSHVMNFDLPYSADTYLHRIGRTARAGKKGVAVSFVEAHDYKLLGKIKRYTQELLKARIIEGLAPRTKAPKEGEVKTVSKKQKARIKAKREEKQKQEQKKKVKLRHKDTKNIGKRRKSNTPPANAE

SEQ ID NO: 79462 - DNA, 1341 bp, Pseudomonas aeruginosa PAO1
  CDS (1)..(1341): transl_table=11
atgccgaggtctcccttgttcagccaatttcccctccacgaacgcctgctgaaggcactggaaagcctgtccttcagcgagccgacgccggtccaggccgcggccattcccaaggcgctggaggggcacgacctgcgggtcacggcgcagaccggcagcggcaagaccgcggccttcctgctgccgctgctgcaccgcctgctggccgaggacaagccgcgctccctggcgcgcgcgctgatcctcctgccgacccgcgagctggcccagcagaccctcaaggaagtcgagcgcttcgcccagttcaccttcatcaaggcctgcctgatcactggcggcgaggacttcaaggtgcagggcgcgcgcctgcgcaagaacccggagatcatcatcggcacccccggccgcctgctcgagcagcgcaacgccggcaacctgccgttgcaggacatcgaggtgctggtgctggacgaggccgaccgcatgctcgacatgggcttcgccgacgacgtgctggccctggccaatgcctgcccggccgagcgccagaccctgctgttctccgccacccacagcggcgccgggttgaacaaggtgatcgcagaggtgctgcgcgagccgcaagtgctgcgcctgaaccaggtcggcgagctgaacgagaacgtccgccagcaggtcatcaccgccgacgacgtggcgcacaaggaacagttgctgcaatggctgctgagcaacgagacctacaccaaggccatcgtcttcaccaatacccgggtctccgccgatcgcctgaccgggcggctgatcgccaaccagcacaaggtcttcgtcctgcatggcgagaaggaccagaaggaccgcaagctggccatcgaacgcctgaagcagggcgcggtgaagatcctcgtcgccaccgacgtcgccgcacgcggcctggacgtcgaaggcctggacctggtgatcaacttcgacatgccgcgcagcggcgacgagtacgtgcaccgcatcggccggaccggtcgcgccggcgccgagggcctggcgatctcgctgatctgccatggcgactggaacctgatgtcgagcgtcgaacgctacctcaagcagaacttcgaacgacgcaacatcaaggaactgaaggccgcctaccaggggccgaagaaactcaaggcgtcgggcaaggccgccggcagcaagaagaaaaagcaggacaggaagggcgccgccgccaagcccgcggccaagcgcaagcccgccgcgcggccgaaggccgggccgtcggcggtggtcagcgccgacggcatggcgccgctcaagcgcaagaagccgacggcggagtga

SEQ ID NO: 79463 - protein, 446 aa, Pseudomonas aeruginosa PAO1
MPRSPLFSQFPLHERLLKALESLSFSEPTPVQAAAIPKALEGHDLRVTAQTGSGKTAAFLLPLLHRLLAEDKPRSLARALILLPTRELAQQTLKEVERFAQFTFIKACLITGGEDFKVQGARLRKNPEIIIGTPGRLLEQRNAGNLPLQDIEVLVLDEADRMLDMGFADDVLALANACPAERQTLLFSATHSGAGLNKVIAEVLREPQVLRLNQVGELNENVRQQVITADDVAHKEQLLQWLLSNETYTKAIVFTNTRVSADRLTGRLIANQHKVFVLHGEKDQKDRKLAIERLKQGAVKILVATDVAARGLDVEGLDLVINFDMPRSGDEYVHRIGRTGRAGAEGLAISLICHGDWNLMSSVERYLKQNFERRNIKELKAAYQGPKKLKASGKAAGSKKKKQDRKGAAAKPAAKRKPAARPKAGPSAVVSADGMAPLKRKKPTAE

SEQ ID NO: 79464 - DNA, 1350 bp, Pseudomonas aeruginosa PAO1
  CDS (1)..(1350): transl_table=11
atgacgttcgcttccctcggtctgctcgaccccctgctcaaggccctcgaagggctcggccacggcacgcctacgccgatccaggcccaagccatacccccggcgctcaagggccgcgacctgctcgccgcagcacagaccggcaccggcaagaccgccggtttcgccctgccgttgctgcagcggctgaccctggaggggccgcaggtcgctgcgaactcggtgcgtgcactggtcctggtcccgacccgcgaactggccgagcaggtccacgccagcgtccgcgactacggccagcacctgccgctgcgtaccgcggtggcctacggtggggtcagcatcaacccgcagatgatgaagctgcgcaagggagtggatatcctcgtcgccactcccgggcggctgctcgacctgtatcggcagaacgcggtgaagttcgcccagctccaggcgttggtgctggacgaagccgatcgcatgctcgacctcggtttcgcccgcgagctggacgaactgttcgccgcgctgccgcgcaagcgccagaccctgctgttttccgcgaccttctccgacgccatccgcacgctggcccgtgaactgctgcgcgacccgctgtccatcgaggtcagtccgcgcaataccgcggcgaagagcgtcaggcaatggctggtgccggtggacaagaagcgcaaggccgagctgttctgccacctgttgcaggccaatcgctggcgccaggcgctggtcttcgccaagacccgcaagagcgtcgaggaactggtcggactgttgcagcggcagggtatcgccgccgactcgatccatggcgacaagccgcagccggcgcggctgcgcgccttgcagcggttcaaggccggcgaggtagacctgctggtagccaccgacgtggccgcgcgtggcctggatatcgaggaaatgccgctggtggtcaacttcgacctgccgatcgtcgccgaggactacgtgcatcgcatcggccgtaccggccgtgccggtgcctccggccaggcggtgtcgctggtctgcgccgacgaagtggagctgctggcggcgatcgaaacactgatcgggcagaccctgcaacgccgcgaggagcccgacttcgagccggagcaccgggtgccgcagaccgcaccgggcggcgtggtgctgaagaaaccgaagaagccgaagaaacccaaggccgcggagagcgtcggcaagcccggcaagatccacttgggcagttggttcgacagcagcgcgccgacggtcaaggcggtgcgcaaggcaccgggcttcggcgcgggtgcggcgggcaagccgaagaagcggccgtccggcaaatag

SEQ ID NO: 79465 - protein, 449 aa, Pseudomonas aeruginosa PAO1
MTFASLGLLDPLLKALEGLGHGTPTPIQAQAIPPALKGRDLLAAAQTGTGKTAGFALPLLQRLTLEGPQVAANSVRALVLVPTRELAEQVHASVRDYGQHLPLRTAVAYGGVSINPQMMKLRKGVDILVATPGRLLDLYRQNAVKFAQLQALVLDEADRMLDLGFARELDELFAALPRKRQTLLFSATFSDAIRTLARELLRDPLSIEVSPRNTAAKSVRQWLVPVDKKRKAELFCHLLQANRWRQALVFAKTRKSVEELVGLLQRQGIAADSIHGDKPQPARLRALQRFKAGEVDLLVATDVAARGLDIEEMPLVVNFDLPIVAEDYVHRIGRTGRAGASGQAVSLVCADEVELLAAIETLIGQTLQRREEPDFEPEHRVPQTAPGGVVLKKPKKPKKPKAAESVGKPGKIHLGSWFDSSAPTVKAVRKAPGFGAGAAGKPKKRPSGK

SEQ ID NO: 79466 - DNA, 1389 bp, Neisseria meningitidis Z2491
  CDS (1)..(1389): transl_table=11
atgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcagcgactgaccaaacgcagcgaaaaaccgggcaaaggcccgcgcgcgttggtgttgacgccgacccgcgaattggcggctcaagtcgagaaaaacgcgctggcgtatgccaaaaatatgcgttggttccgtaccgtcagcatcgtcggtggtgcatcgttcggctaccaaacccgcgccctgagcaaaccggtcgatctgattgtcgccacgccgggccgtctgatggacttgatgcaaagcggcaaagtcgatttcgcccgcttggaagtgctgattttggacgaagccgaccgtatgttggatatgggctttatcgacgacatcgaaaccatcgtcgaagccacgccggaagaccgtcagactttgttgttctccgccacttgggacggcgcggtcggcaaactggcgcgcaaactgaccaaagaccctgaaatcatcgaagtcgaacgcgtggacgaccaaggcaaaatcgaagaacaactgctgtactgcgacgatatgcgccacaaaaaccgcctgctcgatcatatcttgcgcgatgccgacatcgatcaatgcgtgattttcacgtccaccaaagccatgaccgaagtcatcgcggatgaattgtacgaaaaaggtttcgccgccaactgcctgcacggcgatatgccgcaaggctggcgcaaccgcacgctgatggatttgcgcaaaggccgctgcaaaattttggttgccaccgacgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaa

SEQ ID NO: 79467 - protein, 462 aa, Neisseria meningitidis Z2491
MSIKFADLNLDKNILSAVSSEGYESPTPIQAQAIPFALEGRDIMASAQTGSGKTAAFLLPTLQRLTKRSEKPGKGPRALVLTPTRELAAQVEKNALAYAKNMRWFRTVSIVGGASFGYQTRALSKPVDLIVATPGRLMDLMQSGKVDFARLEVLILDEADRMLDMGFIDDIETIVEATPEDRQTLLFSATWDGAVGKLARKLTKDPEIIEVERVDDQGKIEEQLLYCDDMRHKNRLLDHILRDADIDQCVIFTSTKAMTEVIADELYEKGFAANCLHGDMPQGWRNRTLMDLRKGRCKILVATDVAARGIDVPTITHVINYDLPKQAEDYVHRIGRTGRAGRTGIAITFAEVNEYVKVHKIEKYINRKLPELTIEGMEPTRKRKSAGGKPKGKGGWGDRKSGGWRGDHKPSKEGFGGKTRGEGFKKEGFKRDGFKKTGEGFKGKRKAGDSFAGKGERRYKDR

SEQ ID NO: 79468 - DNA, 1341 bp, Xylella fastidiosa 9a5c
  CDS (1)..(1341): transl_table=11
atgaacttcgaaactttgggattgttgccttccttactgcgtgctcttagcgagcaaggttacgaaatcccgaccccaattcagcagcaggcgattccattggcattagctggccacgatttgcttgctgccgcgcaaacagggacaggtaagacggctgcgttcggcttgcctgtattgcaacgattgatggccgcttcatctaatgttggtgcgggtaagccgcgtgctttggtgctgacaccgacccgtgagctggcgactcaggtctacgacagtctacgtggttacgccaagtatcaacgtgtatcaagtgcggtgatttatggtggtgtggggatggggaatcagttggatgtgctgcgccgtggcgtagatttgttgattgcctgcccgggtcgtttgattgatcatattgaacgtcgcagtgtggatttgtcaggcgtcgggattttggtattagatgaggctgatcgcatgcttgacatgggtttcctcccctcaattaaacgtatcctcggcaaactaccgcggcagaatcgccaaactctgctgttctctgcgacatttgctgagccgattaaacagttggcgttagagtttatgtgccgcccacgcgaggtgatggtggcgtcgcataacaccgttgccgagaccattacgcatcgtgtgcatccggtcgatgttagccgcaagcgtgaattgttgttgcatctgttggctcaagatagcagggagcagacactggtgttcgtgcggaccaagcatggcagtgacaagcttgctacgttcttggagaaatacggaatcaagacagcggcgatccacggtaataagactcagggccagcgtctgcgtgccttaaacagtttcaaagcagggcgagttaccgtgctggtggccactgacattgctgcgcgcggaattgatattgaccaattgccaaaggtgatcaattacgatttgcctatggtggctgaggattatgtgcatcgcatcgggcgtactggacgcaatggtgtgcagggagaggcaatttcattagtcactcaggaggacgctaagttattgcgtcagatcgtgcgtttgcttgatcgtgacatggatattcgcgatgtaccggatttcgaacctcaagtcccgatccgttggggtaacagtgctccgggaaagagtaagcagcctgctggacagcacccaccacgtaagagtcaacatcggcgagcattcggcaaagcgtctgtgcagacggcgcatgctttaacaaaacaatcaggcgtacaacatagcaatgggtcccgtaatcgtgatggaatgtttccggttcatcagcgtggttga

SEQ ID NO: 79469 - protein, 446 aa, Xylella fastidiosa 9a5c
MNFETLGLLPSLLRALSEQGYEIPTPIQQQAIPLALAGHDLLAAAQTGTGKTAAFGLPVLQRLMAASSNVGAGKPRALVLTPTRELATQVYDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLHLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVQTAHALTKQSGVQHSNGSRNRDGMFPVHQRG

SEQ ID NO: 79470 - DNA, 1635 bp, Xylella fastidiosa 9a5c
  CDS (1)..(1635): transl_table=11
atgatgagcgataaaccgttgacaaatttaaatttttcttcacttgatctgcatccagcgttgcttactgggctgacaagagcaggatttacactctgtactccgatccaggcgcttactcttccggttgcactggctggtcgtgatattgccggccaagcccaaacgggaaccgggaaaactttggcgtttttggtggtggtagttaaccgtttacttagccgtccggggctagttaatcgtaacccagaagatccgcgtgcgttgattttggcgccaacccgtgagcttgcgattcaaatctataacgatgcagtgaaatttggtggcaatcttgggttgcgttttgcgttgatttatgggggcgttgattacgataagcagcgcgaaatgttgcgcaaaggtgcggatgtggtcattgcgacgccggggcgcttgattgattaccttaagcagcacgaggtggtttcattgcgcgtttgtgagatttgtgttcttgatgaagcagatcggatgtttgacctggggtttatcaaggacattcgctttatattgcggcgcttgcccgagcgttgtagccgtcagactttgctgttctcagccactctcagtcaccgcgtgttggagttggcctatgagtatatgaatgagccagagaagctggtggcggagacggagactgtcactactacgcgggtccgtcaacgtatttatttccctgccgaggaggagaaaatcccattgctgttgggtttgctctcgcgtagcgaggggatgcgtactatggtatttgtcaatacaaaggtgtttgtcgaaggtgttgcgcgcgcactggatgaggctggttaccgggtcggtgtgctgtctggagatgtgccacaaaggaagcgagagactttgcttaatcgtttccagaaagggcaattggaaatactggttgccacagatgtggctgcacgtggattgcacattgatggcgttaattacgtatacaactacgacttaccgtttgatgcagaagattacgttcaccgtattggccgcactgcgcgtttgggagctgatggtgatgcgattagttttgcctgtgagcgttacgcgatgagtttgccggacattgaggcatatatcgagcagaagatcccggttgcagcagtgactgctgagttgctggctccattgtcgcgccctgaacgtgcatcgaatggtaacggtgatactgttggggatatttccccacattctcttgacgtgctggttgctcaggaatggcgtcggggtaagcccaggggtagccctggagagcgcgatggtcgcccccgtgtaggtaaagggccccggtcggatgggggaggtgggcgccgccgcactaaatttcgcttggagaccgagcgtgattctagtgtggatggggcagtcactcctgtatttggagtgtctacggggatagtatctgctccaggtaaagaggtggggcgaaacctcggtcgccgacgtcgtagtcgttcaatggattctggtgaaagtggccatgttgtcgccactaccgcccaagtggctgttaagtcaggtagtcaaccgtcgctcttaggtcgaatagggcaccgtatccgctcgctgttaaatatgttctaa

SEQ ID NO: 79471 - protein, 544 aa, Xylella fastidiosa 9a5c
MMSDKPLTNLNFSSLDLHPALLTGLTRAGFTLCTPIQALTLPVALAGRDIAGQAQTGTGKTLAFLVVVVNRLLSRPGLVNRNPEDPRALILAPTRELAIQIYNDAVKFGGNLGLRFALIYGGVDYDKQREMLRKGADVVIATPGRLIDYLKQHEVVSLRVCEICVLDEADRMFDLGFIKDIRFILRRLPERCSRQTLLFSATLSHRVLELAYEYMNEPEKLVAETETVTTTRVRQRIYFPAEEEKIPLLLGLLSRSEGMRTMVFVNTKVFVEGVARALDEAGYRVGVLSGDVPQRKRETLLNRFQKGQLEILVATDVAARGLHIDGVNYVYNYDLPFDAEDYVHRIGRTARLGADGDAISFACERYAMSLPDIEAYIEQKIPVAAVTAELLAPLSRPERASNGNGDTVGDISPHSLDVLVAQEWRRGKPRGSPGERDGRPRVGKGPRSDGGGGRRRTKFRLETERDSSVDGAVTPVFGVSTGIVSAPGKEVGRNLGRRRRSRSMDSGESGHVVATTAQVAVKSGSQPSLLGRIGHRIRSLLNMF

SEQ ID NO: 79472 - DNA, 1587 bp, Clostridium acetobutylicum ATCC 824
  CDS (1)..(1587): transl_table=11
atggaaaacaaaaaatttagtgatttaaaattgaacagtagtgttctaaaagcaatagatgacatggggtttgaggagccatcgaaaatacaagcagaagctattccagttgttatagatggatatgatatgataggtcaggctcaaacaggaacgggaaagactgttgcattcggagcaccaataataagtaaaataaaagacattgatgaaaaagagggcgtacaggcaattatattaactcctacaagagaacttgccattcaaataactgatgaattaacaagattgtctaaatatgcaagagtaagggtactaccaatatacggtggacagtcaatagaaagacaaatgagagccattaaaagaggagtagatgttatagttgcaactcctggaagaataatggatcatataaaaagaaaaacagtaaaattagataaagttaagtttttggttttagatgaagcggacgaaatgcttgatatgggatttatagatgatatagaaggcataataaagaatataagcggtgataggcaaacaatgcttttctcagctacaatgccagcacctataaagaagttagcatctaattatatgaaaaaagaagttaaacatatagcgataataaaaaattctttaacagtagaaagaatacaacaattttattttgaagtaaagaataaagataaatttgaagctctatgtaggataatagatgtagaagaacctgaaacaaccattatattctgtagaactaagagaggtgtagatgaactagttgaatctatgcaatttagaggatacaatgttgagggtatgcatggagatatgagccaaaatcaaagaataaatacacttaaaaagtttaaagaaaataatattgactttttagttgcgacagatgtagcagctagaggaatagatgttcataatgtatctcatgtaataaactatgatatacctcaagatatggaatcatacgttcatagaataggaagaactggaagagcaaatgcagaaggtatagcttattcattagtaactccaagagagtatgtaatgattaaacaaattgaaaaatttacaaagagcaaaataagaagaaaagaaatacctacaatagatgatatttttgaaactaaatacaatactttgacagataaaataacaaaaaatatcgaaaaagatgattttaaaaagtatatcccatttgtacaaaagcttgatgatgaatttaatttagtagatgtatcagcagctttagtaaaaatgatttttgataaggaaatgggctttgattattctgatgacgataagcttaagagtgatgaaagtgttagattattctttagtgcaggaagaaaagataaactaacagttaaaaaacttcttgagtttatagataatgcatcaggtgttgaaggaaatgagataggagatattgatatccttgataaatttacatttgttgatgttccagagagactaagagatgttataataagaacctgtgatggtaagaaattaaatggaagaaaagtaaatatagaagtagcaaagtctaaaaagaaatctaaataa

SEQ ID NO: 79473 - protein, 528 aa, Clostridium acetobutylicum ATCC 824
MENKKFSDLKLNSSVLKAIDDMGFEEPSKIQAEAIPVVIDGYDMIGQAQTGTGKTVAFGAPIISKIKDIDEKEGVQAIILTPTRELAIQITDELTRLSKYARVRVLPIYGGQSIERQMRAIKRGVDVIVATPGRIMDHIKRKTVKLDKVKFLVLDEADEMLDMGFIDDIEGIIKNISGDRQTMLFSATMPAPIKKLASNYMKKEVKHIAIIKNSLTVERIQQFYFEVKNKDKFEALCRIIDVEEPETTIIFCRTKRGVDELVESMQFRGYNVEGMHGDMSQNQRINTLKKFKENNIDFLVATDVAARGIDVHNVSHVINYDIPQDMESYVHRIGRTGRANAEGIAYSLVTPREYVMIKQIEKFTKSKIRRKEIPTIDDIFETKYNTLTDKITKNIEKDDFKKYIPFVQKLDDEFNLVDVSAALVKMIFDKEMGFDYSDDDKLKSDESVRLFFSAGRKDKLTVKKLLEFIDNASGVEGNEIGDIDILDKFTFVDVPERLRDVIIRTCDGKKLNGRKVNIEVAKSKKKSK

SEQ ID NO: 79474 - DNA, 1500 bp, Sinorhizobium meliloti 1021
  CDS (1)..(1500): transl_table=11
ttgaccaatttcgctgaccttggcctgagccagaaagttctctccgcagttaccgatgcgggctacacgataccgacaccgatccaggttggtgccatcccgccggcgcttcagcgccgcgacattctcggcatcgcccagaccggaaccggcaagaccgcatccttcgtgttgccgatgctgacccttctggaaaagggacgcgcacgcgcacgcatgccgcgtacgctgatcctcgagccgacgcgcgaactcgctgcgcaggttgccgagaacttcgacaaatacggcaagaatcataagctcaacatcgcgcttctgatcggtggcgtttccttcgacgagcaggaccgcaagctcgagcgcggcgccgatgtgctgatctgcacgcccggccgcctgctcgaccattgcgagcgcggcaagctcctgatgacgggggtcgagatcctcgttatcgacgaggccgaccgcatgctcgacatgggcttcattcccgacatcgagcgcatcgcgaagctcattcccttcacgcggcagaccttgttcttctccgcgacgatgccgcccgaaatccagaagcttgcggatcgcttcctgcagaatccggagcggctcgaggtggcacgccggtcctcgacggccataaccgttacgcagcgttttgtcgccgcacacggcaaggattacgagaagcgcgccgtgcttcgtgaactcattcggtcccaggaggacctgaagaacgcgatcatcttctgcaatcgcaagaaggatgtcgccgagctcttccgctcgctcgatcgccatggcttttcggtcggcgcgctgcacggcgacatggatcagcgttcacgcatggccatgcttgccaacttcaaggacggcaacatcaagctgctggtcgcctccgacgtcgcggcgcgaggactcgacattcccgacgtcagccatgtcttcaatttcgacgtgccgatccacgctgaagactatgtccaccgcatcggccgaaccggccgtgctgggcgttccggcgccgctttcacgatcgtcacaaagcgcgagacgaagttttccgatgccatcgagaagctgatcggccagaaggtcgaatggttcaacggcgacctttcggagcttcccgagccgatggagagccacgacagccgtcgcgaccgcggcagcgacgggcgcaaggaccggaagagggagcgtcccggcaaggttcacgccgatcgcaaacctgtcacagcctcaggcaataatacagaagaactcgaaacagtcccggaaagggtcgacgcggtgaagatcgaacgcaatgccgacagcaaggatcgtcataacggccgcagcgaccgtcccggccgcgcgcagaatgcagccaatgacgacaatcgcgaccgtcgccagcgcaaccgccgcgatcatgacgacggcccgacgccggttggtttcggcgacgacattccggccttcatgctgatcgtcggcaaggcctga

SEQ ID NO: 79475 - protein, 499 aa, Sinorhizobium meliloti 1021
MTNFADLGLSQKVLSAVTDAGYTIPTPIQVGAIPPALQRRDILGIAQTGTGKTASFVLPMLTLLEKGRARARMPRTLILEPTRELAAQVAENFDKYGKNHKLNIALLIGGVSFDEQDRKLERGADVLICTPGRLLDHCERGKLLMTGVEILVIDEADRMLDMGFIPDIERIAKLIPFTRQTLFFSATMPPEIQKLADRFLQNPERLEVARRSSTAITVTQRFVAAHGKDYEKRAVLRELIRSQEDLKNAIIFCNRKKDVAELFRSLDRHGFSVGALHGDMDQRSRMAMLANFKDGNIKLLVASDVAARGLDIPDVSHVFNFDVPIHAEDYVHRIGRTGRAGRSGAAFTIVTKRETKFSDAIEKLIGQKVEWFNGDLSELPEPMESHDSRRDRGSDGRKDRKRERPGKVHADRKPVTASGNNTEELETVPERVDAVKIERNADSKDRHNGRSDRPGRAQNAANDDNRDRRQRNRRDHDDGPTPVGFGDDIPAFMLIVGKA

SEQ ID NO: 79476 - DNA, 1995 bp, Yersinia pestis CO92
  CDS (1)..(1995)
atgactactgagcttgaaacctcttttgctgatctggggctgtccgctccaattctttccgctctgactgatcttggttatgaaaaaccatctcctatccagttggaatgtattccacacctgttaaacggccgtgatgttctcggtatggcgcaaacaggcagtggcaaaacagccgcgtttggtctgccgctgttacacaatattaaagctgatctgaagtcgccacaggttctggtgttggcaccaacccgtgaattggctgttcaggttgctgaagcgctgtccagtttctctaaacacattaatggcgtcaacgtggtggccctgtacggcggtcagcgttatgacgttcaattacgcgctttgcgccaggggccacaagttgttgttggtaccccaggtcgtctgttagaccacctgaaacgcggtacccttaacctgtccaacctgagcggtttagtgttggatgaagcagatgaaatgctgcgcatgggctttatcgaagacgttgaaacgattatggcgcagatcccggctgaacatcagaccgcgttgttctctgcaaccatgccagaagcgattcgtcgtattacgcgtcgcttcatgaaagaaccacaggaagtccgcattcaatctagcgtgacgacccgccctgacattagccagagctactggagagtgggtggcggttaccgtaaaaatgaagcgctggtacgtttcctggaagctgaagatttcgatgctgctattattttcgtacgtaccaaaaatgcgaccttggaagtagcagaagcccttgagcgtagcggctacaacagcgcggcactgaatggtgatatgaatcaggcactgcgtgagcagacgctggagcgtttgaaagatggccgtctggatattctgattgcaactgacgtagctgcccgtggcttggacgttgagcgtatcagcttggtcgtaaactatgatatccctatggattcagagtcttatgttcaccgtatcggtcgtactggccgtgcaggtcgtgcaggtcgcgcgttgctgttcgttgagaaccgtgaacgtcgtctgttgcagaacatcgaacgcacgatgaagctgacgatcccagaagttgagttgccaaacgcagatttgctgagcgaacgtcgtttagctaaattcgccgctaaggttagccaacaactggaaagcagtgatttggatatgtaccgcgcattgctggctaagctgcaaccggaagaagagtttgatatcgagactctggctgctgcactgctgaaaatggcgcagggcgaacgtcctctgatcctgccaccagaagccccacgccgtccgcagcgtgaattcaattcacgtgatgaccgtggtaacgatcgtggtagccgtgatcgtggtgacagccgtcgcgataaccgctctgacagccgttctgctgatagccgtgatggtggtgagcgtcctgctcgtcgtgaacgtcgtgatgttggcgagatggagctgtaccgcattgaagtgggccgtgatgatggtgttgaagttcgccatattgttggcgctatcgctaacgaaggtgatatcagcagccgttatatcggtaatatcaagttgtttgcttcccactcaacgattgaactgccaaaaggcatgccgggcgaaatgttatctcacttcacccgtacccgtatcctgaacaagccgctgaacatgcagctgttgggtgatgcacagccacatgaacgccgtgagcgtccagcgggtggtaacggtggtgagcgtcgtggcggtggccgtccattcagtggcgaacgtcgtgaaggcgcaggcgctcctcctcgtcgttcatttagcggcgatcgtgctcctaccggtggtggtgagcgtcgtggtaaccgcgatggtcagcgttctgcggccccacgtcgtgatgatgctgccgcacctgctgctgcagccgccgcaccagcccgtcgtcgcttcggtgatgcataa

SEQ ID NO: 79477 - protein, 664 aa, Yersinia pestis CO92
MTTELETSFADLGLSAPILSALTDLGYEKPSPIQLECIPHLLNGRDVLGMAQTGSGKTAAFGLPLLHNIKADLKSPQVLVLAPTRELAVQVAEALSSFSKHINGVNVVALYGGQRYDVQLRALRQGPQVVVGTPGRLLDHLKRGTLNLSNLSGLVLDEADEMLRMGFIEDVETIMAQIPAEHQTALFSATMPEAIRRITRRFMKEPQEVRIQSSVTTRPDISQSYWRVGGGYRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLQNIERTMKLTIPEVELPNADLLSERRLAKFAAKVSQQLESSDLDMYRALLAKLQPEEEFDIETLAAALLKMAQGERPLILPPEAPRRPQREFNSRDDRGNDRGSRDRGDSRRDNRSDSRSADSRDGGERPARRERRDVGEMELYRIEVGRDDGVEVRHIVGAIANEGDISSRYIGNIKLFASHSTIELPKGMPGEMLSHFTRTRILNKPLNMQLLGDAQPHERRERPAGGNGGERRGGGRPFSGERREGAGAPPRRSFSGDRAPTGGGERRGNRDGQRSAAPRRDDAAAPAAAAAAPARRRFGDA

SEQ ID NO: 79478 - DNA, 1431 bp, Caulobacter crescentus CB15
  CDS (1)..(1431): transl_table=11
gtgactcaattttccgaccttggcctggccaagccgctgctgaaggcgcttgctgaaaagggctacaaggaaccgaccccgatccaggcccaggccattccggtggtgctgcaaggcaaggacctgttgggcatcgcccagacgggcaccggcaagaccgccgccttcgccctgccgatcctgcaacgtctggccgaagaccgtaagcccgcgccgcgccgcggctgccgctgcctggtcctgtccccgacccgcgaactggcgacgcaaatcgccgagaacttcaaggcctacgccgtccacatgggcctgtcggtccacaccatctatggcggcgtgaagtacggcccgcagatgaaggccctggccggcggcatcgacgttctggtcgccacgcccggccgcctgatggaccacatggccgagaagtcggccattgtctcgggcaccgagatcttcgtgctcgacgaagccgaccagatgctggacctgggcttcgtggtgccgatccgcaagatcgccgcccagctgaccaagaaccgccagaacctgttcttctcggccaccatgccgagcgaaatcggcaagctggccggtgagctgctgaacaacccggtgcaggtctcggtcgcgccgcaggccaccacggtcgagcgcatcgaccagcgcgtgctgttcatcgaggcccagcgcaagcgtccgctgctggccgagctgttcgccgacacgagcttctcgcgcaccatcgtcttcacccgcaccaagcgcggcgcggaccgggtggccaagtatctgaacgcggccggtatcgaagccgcctcgatccacggcgacaagacgcagggtcagcgcgaacgcgcgctcgcggccttcaaggccggcgagatgcgggccctggtggccaccgacatcgccgcgcgcggcatcgacgtcaacgacgtcagccacgtgatcaactacgagctgcccaacgtgccggaggcctatgtccaccggatcggccgcaccgcccgcaagggcaaggacggcatcgccatcagcttctgcgccgatgacgagcgtaacctgctgaaggacatccagaaggccacccgccagacgatcccgtccttcgaccgtcgcaacgacaagcagctggccgccgccgccgccgtcgccgacaagctggtcccggccgagaagtatgtcgacccgcgcaaggccgacccgcgcaacaacgtcccgtcggaactgcgccgcaagcgtaaccgcaacggcggcggcggcggcggcggtcgcgccgaaggcgctcagaaggcgcaaggtcgcggccccggacagggcaaggccggcgccaagccgggccagaaggccggtcccggccagaacgagttccgcggtcccaagcgccagtcggccacggccgagaagcgctggtcgcctatcgactaa

SEQ ID NO: 79479 - protein, 476 aa, Caulobacter crescentus CB15
MTQFSDLGLAKPLLKALAEKGYKEPTPIQAQAIPVVLQGKDLLGIAQTGTGKTAAFALPILQRLAEDRKPAPRRGCRCLVLSPTRELATQIAENFKAYAVHMGLSVHTIYGGVKYGPQMKALAGGIDVLVATPGRLMDHMAEKSAIVSGTEIFVLDEADQMLDLGFVVPIRKIAAQLTKNRQNLFFSATMPSEIGKLAGELLNNPVQVSVAPQATTVERIDQRVLFIEAQRKRPLLAELFADTSFSRTIVFTRTKRGADRVAKYLNAAGIEAASIHGDKTQGQRERALAAFKAGEMRALVATDIAARGIDVNDVSHVINYELPNVPEAYVHRIGRTARKGKDGIAISFCADDERNLLKDIQKATRQTIPSFDRRNDKQLAAAAAVADKLVPAEKYVDPRKADPRNNVPSELRRKRNRNGGGGGGGRAEGAQKAQGRGPGQGKAGAKPGQKAGPGQNEFRGPKRQSATAEKRWSPID

SEQ ID NO: 79480 - DNA, 1512 bp, Sinorhizobium meliloti 1021; identical to SEQ ID NO: 38513
  CDS (1)..(1512): transl_table=11

SEQ ID NO: 79481 - protein, 503 aa, Sinorhizobium meliloti 1021; identical to SEQ ID NO: 38514

SEQ ID NO: 79482 - DNA, 1335 bp, Salmonella typhimurium LT2
  CDS (1)..(1335): transl_table=11
atgactgtaacgactttttccgaacttgaactcgacgaaagcctgctggatgccctccaggataaaggtttcactcgcccgaccgccattcaggctgccgccattccgcctgcgctcgatggccgtgatgtactcggttctgcgccgacaggcaccggtaaaacggcggcatatctgctgccggcgttgcagcacctgctcgactttccgcgtaaaaaatcggggccgccgcgcattctgatcctgacgccaacccgcgaactggcaatgcaggttgccgatcacgctcgtgaactggctaagcatactcatctggatatcgccacgattaccggcggcgtggcctatatgaaccatgctgaagtgtttagcgaaaaccaggatatcgtggtcgccacgacgggccgtctgctgcaatatataaaagaagagaactttgactgccgggcggttgaaacactgatccttgacgaagctgaccggatgctcgacatgggcttcgctcaggacattgaacatatcgctggtgagacccgctggcgtaaacaaacgatgctgttctccgccacgctggaaggcgatgcgattaaagattttgccgagcgcctgctggaagacccggttgaggtttctgccaatccgtcaacccgcgagcgtaagaaaattcaccagtggtactaccgtgccgacaatttcgaacataaagttgcgctgttgaagcacctgctaaaacaagacgatgcaacccgttctatcgtgtttgtacgtaaacgtgaacgcgtccatgaattggctgaaacactgcgtctggcagggatcaacaattgctatcttgaaggtgagatggcgcagatcaaacgtaacgaaggtattaagcgtctcaccgacggtcgcgttaacgtgctggtcgcgaccgacgtcgcggcacgcgggattgatattcctgacgtcagccacgtcattaacttcgacatgccgcgcagtggcgatacctatctgcatcgcattggtcgtacaggccgtgctggccgcaaaggcactgcaatctcgctggtagaagcccacgaccatctgttgctgctgaaaatcggtcgctacatcgaagagccgctaaaagcgcgcgtcattgatgagcttcgcccgaccacgcgtgcgcctagcgaaaagttgaccggcaaaccgtcgaaaaaagtgctggcgaaacgcgccgagaagaaaaaagagaaagaaaaagagaagccgcgcgtgaagaaacgtcaccgcgatacaaaaaatatcggtaagcgccgcaagccaagcggtacgaaaatgcaggagcaatccagcgaagagtga

SEQ ID NO: 79483 - protein, 444 aa, Salmonella typhimurium LT2
MTVTTFSELELDESLLDALQDKGFTRPTAIQAAAIPPALDGRDVLGSAPTGTGKTAAYLLPALQHLLDFPRKKSGPPRILILTPTRELAMQVADHARELAKHTHLDIATITGGVAYMNHAEVFSENQDIVVATTGRLLQYIKEENFDCRAVETLILDEADRMLDMGFAQDIEHIAGETRWRKQTMLFSATLEGDAIKDFAERLLEDPVEVSANPSTRERKKIHQWYYRADNFEHKVALLKHLLKQDDATRSIVFVRKRERVHELAETLRLAGINNCYLEGEMAQIKRNEGIKRLTDGRVNVLVATDVAARGIDIPDVSHVINFDMPRSGDTYLHRIGRTGRAGRKGTAISLVEAHDHLLLLKIGRYIEEPLKARVIDELRPTTRAPSEKLTGKPSKKVLAKRAEKKKEKEKEKPRVKKRHRDTKNIGKRRKPSGTKMQEQSSEE

SEQ ID NO: 79484 - DNA, 1890 bp, Salmonella typhimurium LT2; identical to SEQ ID NO: 38519
  CDS (1)..(1890): transl_table=11

SEQ ID NO: 79485 - protein, 629 aa, Salmonella typhimurium LT2; identical to SEQ ID NO: 38520

SEQ ID NO: 79486 - DNA, 1551 bp, Listeria innocua Clip11262
  CDS (1)..(1551): transl_table=11
ttgacaaaattttcggagttcggactggacgaaaaaattgtaaaatcagtaaatcggatggggtttgaagaagcaacgccaatccaagaaaaaacaattccactaggactagcaggtaaagacttaatcggacaagcacaaacaggtactggtaaaacagccgcttttggtcttccaatgatccacaaaatcgaccaaaagagcaacaacgtacaagctttaattattgctccaacgcgtgaacttgcaatccaagtttcagaagagctttataaacttagctatgacaaacatgtacgtgtgctagcggtttacggtggtagtgatattagccgtcaaatccgttcacttaagaaaaacccacaaatcgtagttggtacgccaggacgtattttggatcatattaaccgtcgcacactcaaactagaccacgtggaaacacttgtactagatgaagcagacgaaatgctaaacatgggcttcattgatgatattgaaactatcttaaaagaagtaccagcagaacgtcaaacattactattttctgcaacaatgcctgatccgattcgccgtattggtgaacgtttcatgcacagcccagaacttattcgtattaaagcgaaagaaatgactgcactattaatcgaacaattcttcgtaaaagtgcacgaaaaagaaaaatttgacgtattatctcgtttattagacgttcaagcaccagaactagcaattgtttttggtcgtacgaaacgtcgtgtagacgaactatctcgcgcgcttgatatgcgtggttacgtggctgaaggtatccacggtgacttaacgcaagcaaaacgtatgagcgtactacgcaaatttaaagaaggaaaaattgatgttctagttgcaacagacgtagcagcacgtggacttgatatttccggcgtaacacatgtatataactatgatattccacaagatccagaaagctatgttcaccgtatcggtcgtactggtcgtgctggtaaagaaggtatggcgattactttcgtacaacctcgtgaaatgggttatctacgtattgttgaagaaactacgaaaaaacgtatgcaaccacttcaagctcctacttgggacgaagcatttgcaggccaattacgcgtagcaactgaaaaaattcaagaagcaattacagaagaaaacttagctgactataaaacgtttgctaacgaacttcttgaaaaatacgatgcaactgacatcgcagcagcaatgcttaaaatgttagcgaaagagccagacaaaactcctgtccatattactgaagagcgtccattaccatcccgtggtggcggtggctacaaaggtaaaaatggtaaaggcggtaaaggtggcggctatcgcggcggaagcggtaaaggcggaagctaccgcgatcgtaacaacagcggcaaaggtcgtcgtagcggcggcggaagcggttctggcggtggcggaaatcgtgatcgtcgtggtggcggagaacaacgcagcggcggcaacaaaggcaactactcacaaaaatctaaataa

SEQ ID NO: 79487 - protein, 516 aa, Listeria innocua Clip11262
MTKFSEFGLDEKIVKSVNRMGFEEATPIQEKTIPLGLAGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGSGGGGNRDRRGGGEQRSGGNKGNYSQKSK

SEQ ID NO: 79488 - DNA, 1281 bp, Nostoc sp. PCC 7120; identical to SEQ ID NO: 38525
  CDS (1)..(1281): transl_table=11

SEQ ID NO: 79489 - protein, 426 aa, Nostoc sp. PCC 7120; identical to SEQ ID NO: 38526

SEQ ID NO: 79490 - DNA, 1623 bp, Ralstonia solanacearum GMI1000
  CDS (1)..(1623): transl_table=11
atgtcgttttccgaactcggcttgtcagacaagctggtacgtgccgttgccgaactcggctacgcagaacccaccccgattcaacgccaggccatccccgcgatcctcaagggcggtgacctgcttgccggtgcacagaccggcaccggcaagaccgccggcttcacattgccgctgctgcatcgcctgtccgctgtgcagcccaacaaggtgcagacgccccacggcatgcgctatcccatccgtgcgctggtgctcacacccacgcgcgagctcgccgcgcaggtggaagagagcgtgcgcgcctacggcaagtacctgccgctgaagtcgatggtgatgttcggcggcgtcggcatcaatccgcagatcgatgcgctcaagcgcggcgtcgatatcgtcgtggccacgccgggccgtctgctggaccacgtcggccagcgcaccatcgatctgtcgcacatcgaactgctggtgctggacgaagccgaccgcatgctggacatgggcttcatccacgacatccgcaagatcctcaacatcctgccgcccaagcgccagaacctgctgttctcggcgacgttctcggatgatattcgcgcgctggccgaccgcctgctggatcagcccgcgctgatcgaagtcgcgcgccgcaacaccactgccgagacggtcgaacagcgcatctacccggtcgaccgcgaacgcaagcgcgaactgctcgccaagctcgtgagcgacaacgactggcaccaggtgctggtcttcacgcgcaccaagcacggcgccaaccgcctggccgagcagctcacgcgcgacggcatcccggcgctggccatccacggcaacaagagccagtcggcgcgcacgcgggcgctgtcggagttcaaggccgggacgctgcgcgtgctggtcgccaccgacatcgccgcacgcggcatcgatatcgaccaactgccgcacgtggtcaacttcgacctgcccaacgtgccggaagactatgtgcaccgcatcggccgcaccggccgcgcgggcgcgcagggcgaggcgatctcgctggtgtgcgtggacgagcatggcctgctgcgcgacatcgagcgcctgatcaagcgcgaactgccgcgcaccgtcctggcgggcttcgagccggacccgaccatcgcgccggagccgattccgaacggccgcaacagtgcccgtgcgccgcgccagggtggcggtcgcagtcagccgccgcgccaggccgcgggcaacgccgcgccgcgcgagcctcgtgcgccgcgtgagccgcgccgcgagtcgggcgccagcggtcagggtcaagggcagggtcagggccaaggccgcaatggcggcggccgccagcgtcaggcacaaggccagcgcgatggccaagccgcgccgaagccgcgcggcggtcagggcagcggtaacggcaacggccaatcgcatgcgcgcggccagcgccagggcaacggccaaggcaacgggcagggcggccagcgccgtgcgtccaacacgcaagccgcgcagccgaccaaggtggcgcagcccgcacccaagcagccgttcaacggcctgtttgccaaggcagcggcactgctcggcggccgcaaggcctga

SEQ ID NO: 79491 - protein, 540 aa, Ralstonia solanacearum GMI1000
MSFSELGLSDKLVRAVAELGYAEPTPIQRQAIPAILKGGDLLAGAQTGTGKTAGFTLPLLHRLSAVQPNKVQTPHGMRYPIRALVLTPTRELAAQVEESVRAYGKYLPLKSMVMFGGVGINPQIDALKRGVDIVVATPGRLLDHVGQRTIDLSHIELLVLDEADRMLDMGFIHDIRKILNILPPKRQNLLFSATFSDDIRALADRLLDQPALIEVARRNTTAETVEQRIYPVDRERKRELLAKLVSDNDWHQVLVFTRTKHGANRLAEQLTRDGIPALAIHGNKSQSARTRALSEFKAGTLRVLVATDIAARGIDIDQLPHVVNFDLPNVPEDYVHRIGRTGRAGAQGEAISLVCVDEHGLLRDIERLIKRELPRTVLAGFEPDPTIAPEPIPNGRNSARAPRQGGGRSQPPRQAAGNAAPREPRAPREPRRESGASGQGQGQGQGQGRNGGGRQRQAQGQRDGQAAPKPRGGQGSGNGNGQSHARGQRQGNGQGNGQGGQRRASNTQAAQPTKVAQPAPKQPFNGLFAKAAALLGGRKA

SEQ ID NO: 79492 - DNA, 1827 bp, Ralstonia solanacearum GMI1000
  CDS (1)..(1827): transl_table=11
atgacgcagcctcaaaacggcagcggcgcgattgcgcacgctgaatccgataccgataccctgatcgccaacgccgccacccaggccagcgcttttgccgcgctcggcctggacgaacgcatcgcccgcgcgctcggcgaactgaactacacccagccgacgccggtccaggcccaagcgattcccgcctgcctgtcgggccgcgacctgctggtcacgagccagaccggctcgggcaagaccgcggcgttcatgctgccggccatccagcgcatcagcgaacagcccgagccgcagcgcccgcgcgccgacggcccgcagcagcgcgtcaaaggccgccgtccgcgcccggcgccggccaagccgtcgctgctggtgctcacgcccacgcgcgaactcgccctgcaggtgacgaccgccaccgcacaatacggccgccacctgcgccgcatcgtctgcgcgagcatcctgggcggcatgccctaccccaagcagctcgacatgctggcgcgcatgcctgacatcatcatcgccacgccgggccgcctgctcgaccacatcgactccggccgcatcgacctgtcggcgctcgacatgctggtcttcgacgaggccgaccgcatgctcgacatgggcttcgccgacgacatcgaagccatcgtcggcgccacgccggcgtcgcgccagatgctgatgttctcggccaccatggaccgccgcatcgagcagctcgccgagcgcatgatgcgcgagccgcaacgcatcgagatcgccgccgcgcgtatcgaccaaagccatatcgaagagcgcctgcacttcaccgacgacctgtcgcacaagcagcagttgctcgaccacctgctgcgcgatgcgacgctcaagcaggccatcgtctttaccgccacgaagcgcgatgccgactcgctggccgagcgcctgaccgagaccggtttctccgccggcgccctgcacggcgacatgcaccaaggtgcgcgcaatcgtacgctgacggcgctgcgccgcggccaactgcgcgtgctggtggccaccgacgtggccgcgcgcggcatcgacgtgccggacatcacccacgtggtcaactttgacctgcccaagcaggctgaagactacgtgcaccgcatcggccgcaccggccgcgccggccgcagcggcatcgccatcaacctggtgaaccacggcgatacgttccaatggcgccgcatcgagcgctttgtcgaccgccgcatcgacgcgactgtcgtcgagggcctcgaaccgaagcgctcgcccaagccgcgcagcggcggcccgcgcgccggtggcgaccgcggcggctaccgtggcaatggcggcggcaactggcgtggccagcgtgacggctacgccgcgcgcacgggtaacggcggcaatggcggcaacagcgaaggccgcttccagcgcagcttcggcggtgaccgcgaaagcttcgccccgcgccgcgatgaccgtggcgaccgcggcaccggctatcaaggcggccaacaacgcgactggggcaaccgtgacaacgcggccccgcgccagtcgtacggccagcaaacccgcaacggcgaccgcttcgacccgcgccagccgcgcagccaggaaggccgcagcgattggcagcaacgcccggcacgcggcggttacggcaatagcaacggcaatggcagcagctacggcaaccgcgatggcgccccgcgccgcttcggtgacgacaacagcaacggcgcgccccgccgcagctatggcaacagcaatggcaacagctacggcagcaagggccgctcgcgcgatttcgatcgctga

SEQ ID NO: 79493 - protein, 608 aa, Ralstonia solanacearum GMI1000
MTQPQNGSGAIAHAESDTDTLIANAATQASAFAALGLDERIARALGELNYTQPTPVQAQAIPACLSGRDLLVTSQTGSGKTAAFMLPAIQRISEQPEPQRPRADGPQQRVKGRRPRPAPAKPSLLVLTPTRELALQVTTATAQYGRHLRRIVCASILGGMPYPKQLDMLARMPDIIIATPGRLLDHIDSGRIDLSALDMLVFDEADRMLDMGFADDIEAIVGATPASRQMLMFSATMDRRIEQLAERMMREPQRIEIAAARIDQSHIEERLHFTDDLSHKQQLLDHLLRDATLKQAIVFTATKRDADSLAERLTETGFSAGALHGDMHQGARNRTLTALRRGQLRVLVATDVAARGIDVPDITHVVNFDLPKQAEDYVHRIGRTGRAGRSGIAINLVNHGDTFQWRRIERFVDRRIDATVVEGLEPKRSPKPRSGGPRAGGDRGGYRGNGGGNWRGQRDGYAARTGNGGNGGNSEGRFQRSFGGDRESFAPRRDDRGDRGTGYQGGQQRDWGNRDNAAPRQSYGQQTRNGDRFDPRQPRSQEGRSDWQQRPARGGYGNSNGNGSSYGNRDGAPRRFGDDNSNGAPRRSYGNSNGNSYGSKGRSRDFDR

SEQ ID NO: 79494 - DNA, 1512 bp, Agrobacterium tumefaciens str. C58
  CDS (1)..(1512): transl_table=11
ttgacaacattctctgatcttggcctgagccaaaaagttctttccgctattgcagatgccggctacacgacgccgacacccattcaggccggcgccattccgcccgcgctggaaaagcgtgatatctgcggtatcgcacagaccggcaccggcaaaaccgcgtccttcgttctgccgatgctgacgctgctcgaaaagggccgcgcacgcgccagaatgccgcgcacgctgatcctggagccgacccgcgagcttgcagcgcaggtggcggagaacttcgaaaaatacggcaagaatcacaagctgaacgttgccctgctcatcggtggtgtttccttcgaagaccaggatcgcaagctcgagcgtggcgccgatgtgctgatctgcacccccggccgccttctcgaccattgcgagcgtggcaagctgctgatgaccggcgtggaaattctcgtcatcgacgaagccgaccgcatgctcgacatgggcttcatccccgatatcgagcgtatcgccaaaatgatccccttcacccggcagacgctgttcttctcggccaccatgccgccggaaatccagaagctggctgaccggttcctgcagaacccgacgcggatcgaggtcgccaagccatcctctaccgcaaagacggtaacgcagcgtatcgtcgccgcgcataataaggactatgaaaagcgcgccgtgctgcgcgatctggtccgtgccgaagaagcggaactcaagaacgccatcatcttctgcaatcgcaagaaggatgtcgccgatctgttccgttcgctggatcgtcacggcttttccgttggcgcactgcatggtgacatggatcagcgctcgcgcacgacgatgctgcagaacttccgggatggacagctgacgctgctggtcgcttccgacgttgcagcccgcgggcttgatatccctgatgtcagccacgtcttcaacttcgatgttcccatccatgccgaagactatgtccaccgcatcggccgcaccggtcgtgccggccgttcgggcaaggccttcactctcgtcaccaagagcgacgcgaaatatctcgacgcgattgaaaagctgattgccgaaaagatcgaatggctgagcggcgatctgtcctccctccccgcgcccatggaaagctttgaaagcaattccggccgccggggcaccaaggaacgtagcggcagaggccgcgacagaaaccgtcgcgatgcacctgcatcgccggtggaaaacatcaatcaggacgcacaatccgtagtggatacggacatcgcggctcacggagaagacaaggtgaaggcagaacgcagaccggaaaagaccccgcgcaattccgagcgcaacagccgcaacctgaactcgctgcacgccaatgacgacaaccgcgaccgtcgccgtcattatcgtgaccacgacgatggcccgacaccggttggtttcggcgacgacattcccgccttcatgctgatcgtggctaacgccaaggcctga

SEQ ID NO: 79495 - protein, 503 aa, Agrobacterium tumefaciens str. C58
MTTFSDLGLSQKVLSAIADAGYTTPTPIQAGAIPPALEKRDICGIAQTGTGKTASFVLPMLTLLEKGRARARMPRTLILEPTRELAAQVAENFEKYGKNHKLNVALLIGGVSFEDQDRKLERGADVLICTPGRLLDHCERGKLLMTGVEILVIDEADRMLDMGFIPDIERIAKMIPFTRQTLFFSATMPPEIQKLADRFLQNPTRIEVAKPSSTAKTVTQRIVAAHNKDYEKRAVLRDLVRAEEAELKNAIIFCNRKKDVADLFRSLDRHGFSVGALHGDMDQRSRTTMLQNFRDGQLTLLVASDVAARGLDIPDVSHVFNFDVPIHAEDYVHRIGRTGRAGRSGKAFTLVTKSDAKYLDAIEKLIAEKIEWLSGDLSSLPAPMESFESNSGRRGTKERSGRGRDRNRRDAPASPVENINQDAQSVVDTDIAAHGEDKVKAERRPEKTPRNSERNSRNLNSLHANDDNRDRRRHYRDHDDGPTPVGFGDDIPAFMLIVANAKA

SEQ ID NO: 79496 - DNA, 1509 bp, Agrobacterium tumefaciens str. C58; identical to SEQ ID NO: 38531
  CDS (1)..(1509): transl_table=11

SEQ ID NO: 79497 - protein, 502 aa, Agrobacterium tumefaciens str. C58; identical to SEQ ID NO: 38532

SEQ ID NO: 79498 - DNA, 1449 bp, Brucella melitensis 16M
  CDS (1)..(1449): transl_table=11
ttgacgacatttgccgaactcggtctttccccgaaagtgatcgctgctgtagaagcagcgggatacactgcgcccactccaattcaggctggggccattccgcccgcgcttgagcgcaaggatgtgcttggaattgcacagaccggaacgggcaagacggcttcgttcgttctgccgatgctgacgcttctggaaaagggccgggcgcgggcgcgtatgccgcgcacgctcatccttgagccaacgcgcgaactggcagcgcaggttgaagaaaatttcgtcaaatatggtatcaatcaccgcctcaacgtggccctgcttatcggcggcgtatcgtttgaggagcaggagcgcaagcttgagcgcggcgcggatgttctcatcgcaacgccgggccgtatgctcgatcattttgaacgcggcaagcttctgcttaccggcgtcgagattctcgtcattgatgaagccgaccgtatgctcgatatgggtttcatcccggacatcgaacgtatctgcaagctgatcccctttacccgccagactttgtttttctcggccaccatgccgccggaaatcaccaagctgacggaacagtttttgcattcgcccgtgcgcatcgaggtcgccaaggcttcctccacggccaagaccgtgacccaacgtctggtgaaatcgggcaagaaggattgggacaagcgcgccgtgctgcgcgacctgatccagtccgaaggtgattcactcaagaatgcgatcatcttttgcaaccgcaagaaggacgtctcggagcttttccgctcgctgacgcgccatgaattcgatgccggcgccttgcatggagacatggaccagcgggctcgcatggccatgctgtccagtttcaaggatggcaagctgcgccttctggtagcatccgatgttgccgcacgtggcctcgatattcccgatgtaagccatgtgttcaacttcgatgtccctatccatgcggaagattatgtccatcgcatcggccgcacgggccgtgcgggccgttccggcaaggcgttcactattgtgacctcgtctgacaccaaatatctcgcggcgatcgaaagcatgatcggcgaaaagatcgagtggcacgatggcgatctgtccacgctggccgtatccgaggaggctgatgagcagccacgcaagggacgcaacgcgcgcggcaagggcaaggaaaagccgaaggaaaaggccagcaagcctgttgcggctaaaaccgttgatccggccggacaaccgcagccggttattgaaaatcaacaccgtcgcgaagcgattcgttcatcaaatgaagaacgccgcggcaagccgcagaccgaacagcacaagcgccgccgtgatcgcgatgatgacggtccggctccggttggttttggaaacgatattccggccttcatgctgattccaaccggcgtgtga

SEQ ID NO: 79499 - protein, 482 aa, Brucella melitensis 16M
MTTFAELGLSPKVIAAVEAAGYTAPTPIQAGAIPPALERKDVLGIAQTGTGKTASFVLPMLTLLEKGRARARMPRTLILEPTRELAAQVEENFVKYGINHRLNVALLIGGVSFEEQERKLERGADVLIATPGRMLDHFERGKLLLTGVEILVIDEADRMLDMGFIPDIERICKLIPFTRQTLFFSATMPPEITKLTEQFLHSPVRIEVAKASSTAKTVTQRLVKSGKKDWDKRAVLRDLIQSEGDSLKNAIIFCNRKKDVSELFRSLTRHEFDAGALHGDMDQRARMAMLSSFKDGKLRLLVASDVAARGLDIPDVSHVFNFDVPIHAEDYVHRIGRTGRAGRSGKAFTIVTSSDTKYLAAIESMIGEKIEWHDGDLSTLAVSEEADEQPRKGRNARGKGKEKPKEKASKPVAAKTVDPAGQPQPVIENQHRREAIRSSNEERRGKPQTEQHKRRRDRDDDGPAPVGFGNDIPAFMLIPTGV

SEQ ID NO: 79500 - DNA, 1587 bp, Clostridium perfringens str. 13; identical to SEQ ID NO: 38537
  CDS (1)..(1587): transl_table=11

SEQ ID NO: 79501 - protein, 528 aa, Clostridium perfringens str. 13; identical to SEQ ID NO: 38538

SEQ ID NO: 79502 - DNA, 2199 bp, Corynebacterium glutamicum ATCC 13032; identical to SEQ ID NO: 38547
  CDS (1)..(2199): transl_table=11

SEQ ID NO: 79503 - protein, 732 aa, Corynebacterium glutamicum ATCC 13032; identical to SEQ ID NO: 38548

SEQ ID NO: 79504 - DNA, 1290 bp, Methanosarcina mazei Go1; identical to SEQ ID NO: 38553
  CDS (1)..(1290): transl_table=11

SEQ ID NO: 79505 - protein, 429 aa, Methanosarcina mazei Go1; identical to SEQ ID NO: 38554

SEQ ID NO: 79506 - DNA, 2349 bp, Drosophila melanogaster
  CDS (1)..(2349)
atgggtgcaaccaagaacctggacttgataggcaccatcgaagacgatgccgaggtggagaacttgtcggaggactccgatgcggaggtcgagtaccaacccacaaaactgagacacaagaaggtgacggagtttgagaagggcttcgagttcgtgtcctcagtgaaggagtacaaccaggacacttgggacgacctgatgaagtacgtgaagcgaaaggcgcgcacaaagaccgacgacaagatcgccgcccggctgcaaaagcggggtggcgccgaagctgtggccgcggagcagagcgatggaagtgagatagatctctccgaggacgaattgaagcatgacaacctgcggctaagggagaagaaggaatccaaaaaaaagaagaagaaggctggagaggaggatgaagaggacgagggcgagaagatgcagttcgccgacactgtagaggcgaacgagcagatcacttccttctaccaaatgaacctttcacgtcccctgatgcgtgccatcggtgtgctggggtacatatatcctacgccgatccaggcctctacgattcctgtggctttgctaggtcgcgatatctgcggctgtgctgccacgggaacgggcaaaactgctgcttatatgttgcctactctagaacgtttgctgtatcgtcctcttaacaacaaggccatcaccagggtactggttcttgtgcccactcgtgagctgggcgcccaggtttaccaggtgacaaagcaattgtgccagttcaccactattgatgtgggtctggcaattggtggtctggatgtgaaggctcaggaggcagtacttcgccagaatcccgacattgtcattgcaacgccaggtcgtctaatcgatcacattaaaaatacgcccagttttacattggattccattgaggttctcattctggacgaggccgatcgtatgctggacgagtacttcgccgaacagatgaaggagatcatcaactcctgctgtaagacacgtcagaccatgttgttctccgccacaatgagcgagcaggtcaaagatctggccgccgtatcgctggacaagcccatcaaggtgttcgtcaacaacaaccagcaagtggccttcaatctgcgtcaggaatttattcgcatacgtgaggataaggagggcgaccgtgaacccattctggctagtttgatttgcaggacgttccatgatcattgcatggtatttgtgcaaaccaaaaagcaggcccatcgactgcacattttattgggtctcttgggcgtccgggccggcgaactgcatggcaatctcacccagcaacagcgtctggagtccctcaagaagttcaaggaggagcagattgatgtgcttatcgccacagatgtagctgctcgtggtctcgatattgtgggcgtaaaaacggtaatcaactttgtgatgcccatcaccacagagcactacatccatcgagtgggtcgtacggctcgagctgggcgtgctggtatatccgtttccctggccggtgaaaaggagcgcaagatcgttaaggacattatcaagaatgcggagagtaccattaagaatcgtattattccgccagagattattgaaaaatatcgcaacaaacttacaagcttggagccagagattcaaaacattctggacgaagagcaggctgaacggcagctagccaaaacggagcaacagctctccaaaacggagcgaaagctgctgggacagaccaacgagcgacgtggttggttccagacgaaacagcaacgcgaggcggagaaggatcgcttagcgttgacaaccggcgacgaggataaagcatctggtggaaagggtaagggaaaaacggccggaaagcgtaagcgacccgagtacggaggcgatggcgaggatggaccaccggtcaaggatctcgaggcaaagcgcaacaagaagaagaaggaggagcctcgaaagaagacaccggagcagctggccaaagagcgagccatgaaggagatcgagaaggtgtcccttgtgcgcgccaagatggccaagctgcgcaaacgtccgggcaaactaggagccgccaccgaagttcacagaagcggtgcctccgacggcaaacccaagcgacgcggcggtcagtcggcatttactaacgacttgaccgatgtaagtcgtggcggagctctgcgtctaaggtccgaggccaatcggcacaaaaagatgaccaagatcgctgctaagaaaaaggcgagcagtgtgaagctgacaaacaaggcgggaaagaataagttcaacaagggcaagaacttcggaggacctcgtcacgccaagaaggataaaaagaagtag

SEQ ID NO: 79507 - protein, 782 aa, Drosophila melanogaster
MGATKNLDLIGTIEDDAEVENLSEDSDAEVEYQPTKLRHKKVTEFEKGFEFVSSVKEYNQDTWDDLMKYVKRKARTKTDDKIAARLQKRGGAEAVAAEQSDGSEIDLSEDELKHDNLRLREKKESKKKKKKAGEEDEEDEGEKMQFADTVEANEQITSFYQMNLSRPLMRAIGVLGYIYPTPIQASTIPVALLGRDICGCAATGTGKTAAYMLPTLERLLYRPLNNKAITRVLVLVPTRELGAQVYQVTKQLCQFTTIDVGLAIGGLDVKAQEAVLRQNPDIVIATPGRLIDHIKNTPSFTLDSIEVLILDEADRMLDEYFAEQMKEIINSCCKTRQTMLFSATMSEQVKDLAAVSLDKPIKVFVNNNQQVAFNLRQEFIRIREDKEGDREPILASLICRTFHDHCMVFVQTKKQAHRLHILLGLLGVRAGELHGNLTQQQRLESLKKFKEEQIDVLIATDVAARGLDIVGVKTVINFVMPITTEHYIHRVGRTARAGRAGISVSLAGEKERKIVKDIIKNAESTIKNRIIPPEIIEKYRNKLTSLEPEIQNILDEEQAERQLAKTEQQLSKTERKLLGQTNERRGWFQTKQQREAEKDRLALTTGDEDKASGGKGKGKTAGKRKRPEYGGDGEDGPPVKDLEAKRNKKKKEEPRKKTPEQLAKERAMKEIEKVSLVRAKMAKLRKRPGKLGAATEVHRSGASDGKPKRRGGQSAFTNDLTDVSRGGALRLRSEANRHKKMTKIAAKKKASSVKLTNKAGKNKFNKGKNFGGPRHAKKDKKK

SEQ ID NO: 79508 - DNA, 1326 bp, Yersinia pestis KIM
  CDS (1)..(1326): transl_table=11
atgactgtaaccaatttttccgaactcgatctcgatgaacgtctgattgacgcactgcgcgacaaaggctatgagcgtcctacggctatccaggcttcggcgatcccgccggctatggatgggcgtgacgtattaggttcggctccaacaggtaccggcaaaactgccgcctttttgctgccagccttgcagcatttgctggatttcccccgcaaaaaatccgggccaccgcggatcctgatcctgacgccaacccgtgagttagccatgcaagtggcagaccaagcccgtgaactggcaaagtatactcagttggatatcgccacaataaccggcggcgtggcatatatgaaccatgccgaagtcttcagtgagaatcaggatgttgtcgttgccacgacaggccgcctgctgcaatacatcaaagaagaaaactttgattgtcgtgcggtagagaccctgatcctggatgaagctgaccgtatgctggacatgggttttgcccaagatattgaaaccatctcagccgaaacccgctggcgtaagcaaacactgctgttctctgccactcttgaaggtgaagccatccgcgaatttgcggagcgcattctcaatgagccagtagaacttgaggccgatccatcgcgccgcgaacgcaaaaaaattcagcaatggtactaccgggctgacgacatcaagcataagacagcgttactttgtcatctgctgaaacagcccgatgtctcgaagtccatcatttttgttcgtacccgcgagcgtgtccatgagttagtcagttggctacgtgaggcgggcattaatgcctggttccttgaaggcgaaatggtacaagctaaacgtaccgaagcggtcattcgcttgggtgatggccgggtaaatgtgctggttgccaccgatattgcctcacgcgggttggatattgatgatatcagccatgtattcaactttgatatgccacgcaccgccgatgtttatttacatcgtattggccgtactggccgtgctggccgcaaaggcgtcgccatttccttggttgaagctcatgatcatatcttgttaggcaaaattggccgttatcttaacgaaccactgaaaccacgcgttattgatgagttgcgcccaacgagcaaggcaccaagtgaaaaagcgacgggtaaaccctctaaaaaggttttagcgaagcgtaaagaacaaaaagaatccagcaaagagaaagtaaaggttaaggttcgtcatcgtgatgccaaaaacgttggtaagcggcgtacaccaaaagcaaaacctgataccaagagtgctggttag

SEQ ID NO: 79509 - protein, 441 aa, Yersinia pestis KIM
MTVTNFSELDLDERLIDALRDKGYERPTAIQASAIPPAMDGRDVLGSAPTGTGKTAAFLLPALQHLLDFPRKKSGPPRILILTPTRELAMQVADQARELAKYTQLDIATITGGVAYMNHAEVFSENQDVVVATTGRLLQYIKEENFDCRAVETLILDEADRMLDMGFAQDIETISAETRWRKQTLLFSATLEGEAIREFAERILNEPVELEADPSRRERKKIQQWYYRADDIKHKTALLCHLLKQPDVSKSIIFVRTRERVHELVSWLREAGINAWFLEGEMVQAKRTEAVIRLGDGRVNVLVATDIASRGLDIDDISHVFNFDMPRTADVYLHRIGRTGRAGRKGVAISLVEAHDHILLGKIGRYLNEPLKPRVIDELRPTSKAPSEKATGKPSKKVLAKRKEQKESSKEKVKVKVRHRDAKNVGKRRTPKAKPDTKSAG

SEQ ID NO: 79510 - DNA, 1449 bp, Brucella suis 1330
  CDS (1)..(1449): transl_table=11
ttgacgacatttgccgaactcggtctttccccgaaagtgatcgctgctgtagaagcagcgggatacactgcgcccactccaattcaggctggggccattccgcccgcgcttgagcgcaaggatgtgcttggaattgcacagaccggaacgggcaagacggcttcgttcgttctgccgatgctgacgcttctggaaaagggccgggcgcgggcgcgtatgccgcgcacgctcatccttgagccaacgcgcgaactggcagcgcaggttgaagaaaatttcgtcaaatatggtatcaatcaccgcctcaacgtggccctgcttatcggcggcgtatcgtttgaggagcaggagcgcaagcttgagcgcggcgcggatgttctcatcgcaacgccgggccgtatgctcgatcattttgaacgcggcaagcttctgcttaccggcgtcgagattctcgtcattgatgaagccgaccgtatgctcgatatgggtttcatcccggacatcgaacgtatctgcaagctgatcccctttacccgccagactttgtttttctcggccaccatgccgccggaaatcaccaagctgacggaacagtttttgcattcgcccgtgcgcatcgaagtcgccaaggcttcctccacggccaagaccgtgacccaacgtctggtgaaatcgggcaagaaggattgggacaagcgcgccgtgctgcgcgacctgatccagtccgaaggtgattcactcaagaatgcgatcatcttttgcaaccgcaagaaggacgtctcggagcttttccgctcgctgacgcgccatgaattcgatgccggcgccttgcatggcgacatggaccagcgggctcgcatggccatgctgtccagtttcaaggatggcaagctgcgccttctggtagcatccgatgttgccgcacgtggcctcgatattcccgatgtaagccatgtgttcaacttcgatgtccctatccatgcggaagattatgtccatcgcatcggccgcacgggccgtgcgggccgttccggcaaggcgttcactattgtgacctcgtctgacaccaaatatctcgcggcgatcgaaagcatgatcggcgaaaagatcgagtggcacgatggcgatctgtccacgctggccgtatccgaggaggctgatgagcagccacgcaagggacgcaacgcgcgcggcaagggcaaggaaaagccgaaggaaaaggccagcaagcctgttgcggctgaaaccgttgatccggccggacaaccgcagccggttattgaaaatcaacaccgtcgcgaagcgattcgttcatcaaatgaagaacgccgcggcaagccgcagaccgaacagcacaagcgccgccgtgatcgcgatgatgacggtccggctccggttggttttggaaacgatattccggccttcatgctgattccaaccggcgtgtga

SEQ ID NO: 79511 - protein, 482 aa, Brucella suis 1330
MTTFAELGLSPKVIAAVEAAGYTAPTPIQAGAIPPALERKDVLGIAQTGTGKTASFVLPMLTLLEKGRARARMPRTLILEPTRELAAQVEENFVKYGINHRLNVALLIGGVSFEEQERKLERGADVLIATPGRMLDHFERGKLLLTGVEILVIDEADRMLDMGFIPDIERICKLIPFTRQTLFFSATMPPEITKLTEQFLHSPVRIEVAKASSTAKTVTQRLVKSGKKDWDKRAVLRDLIQSEGDSLKNAIIFCNRKKDVSELFRSLTRHEFDAGALHGDMDQRARMAMLSSFKDGKLRLLVASDVAARGLDIPDVSHVFNFDVPIHAEDYVHRIGRTGRAGRSGKAFTIVTSSDTKYLAAIESMIGEKIEWHDGDLSTLAVSEEADEQPRKGRNARGKGKEKPKEKASKPVAAETVDPAGQPQPVIENQHRREAIRSSNEERRGKPQTEQHKRRRDRDDDGPAPVGFGNDIPAFMLIPTGV

SEQ ID NO: 79512 - DNA, 1221 bp, Shigella flexneri 2a str. 301
  CDS (1)..(1221): transl_table=11
atgtctttcgattctttgggtttaagccctgatatcctgcgcgccgttgccgagcagggttaccgtgaacccacccctattcagcagcaggcgatccctgctgtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcacagattggcgaaaacgtccgtgattacagcaaatacctgaacattcgttcgctggtggtgtttggcggtgtcagcattaacccacaaatgatgaagttgcgcggcggcgttgatgtgctggtggcaacgccgggacgtttgctggacctggaacatcaaaatgcagtgaagctggatcaggttgaaatcctcgtcctcgatgaagctgaccgcatgctcgacatgggctttatccacgatatccgtcgcgtgttaacaaaactgccagcgaaacgccagaacctgctgttctctgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattggtaaagggaactggcagcaggtgctggtgtttacccgtaccaaacacggcgctaaccatctggctgagcagctcaataaagatggcatccgtagtgtggcgatccacgggaataaatcgcaaggtgcgcgtacccgtgcgctggctgattttaaatcgggtgacattcgcgtactggtggcgaccgatatcgctgcgcgcggtctggatatcgaagagttgccgcacgtcgtcaactatgaactgccaaacgtaccggaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcatcaggctgatgaacaaacgcaaaactgcctga

SEQ ID NO: 79513 - protein, 406 aa, Shigella flexneri 2a str. 301
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSVAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGIRLMNKRKTA

SEQ ID NO: 79514 - DNA, 1623 bp, Leptospira interrogans serovar Lai str. 56601
  CDS (1)..(1623): transl_table=11
atgaaatttgaagaactatccatccatccaaaattactttctgccattcaagaaatcggatatacggaactaactccgatccaagagaaatcgattccacatggattggaaggaaaagatattaccggacttgcacaaaccggaaccggaaaaaccgtcgcgtttttaattcctgtcattcataacattctaaccaaaggaatacaaggaattgcagcgctcgtattagctcccacaagagaacttacgatgcagatcgcggaagaggcaaaaaaattactcaaacattccgaaggaatccgatcagtcccgattataggaggaaccgattacaagtcccaaaataaggatttagaaggattaaacggaattatcgtcgctactcccggaagattgatcgatatgattaagtctggttctattgatatatcgaacgtagaattttttgtactcgatgaagcggatcgaatgttggatatgggatttatccaagacatccgttggcttttacataagtgtaagaatcggaaacagaccttgttgtattccgctactttgtctgtggaagtgatgaggctcgcctatcgtttcttaaacgaaccagtagaaattcaaatcaatcctgaaaagattatcaccgaaagaattgatcagaaaattgttcatttgggaagagaagaaaaaattccttatatgaccaatctaatcataaactcaaaagaagaaggtcaagggatcatattcacaaattataaagcgaatattccaaaaattgtatatactctccgtaaatatggggttccagtaaccggaatatcttccgaattggatcagaaaaaaagacttagacttctccgagattttaaatccggaaaatacagatacatggtcgcaaccgacgtcgcttccagaggaattgacgtagaaaatatagatatcgtctataattacgatcttcctcaggataccgaaaattacgtacacagaatcggtagaactgcacgggcgggaagaaaaggaaaagcgattggtttttgttccgaatcagattacgtggaactagaaaagatagaaaaatatctaaaacaaaagatcgaaattttagaagtaaacgaagaatatattcagtttcctgcaggtgattttcaatcttttatcggaggggattcttacgatcgagaaaaagaaactcattttaaacaaaatgggaaacgtcctcacgacaacgatcgtgccccacataaacacgatcgaaatcgcaaaagggataaacgacatacaagtcatacacattctaccgcgaaagattctcacaagaaaaaaccagctgctgcaatccaagaagcagagttatttttgcaaaaggcggattccgttttatcctcagaaccgaaaggaaaaaaatctgcaaaagaccaacatagatttcagaacaaagacaaacagagccgaacggggcgtggtgcacagaatagtcgaaatcagaataaaaatcaacagttcggtaaacaatacgataaaaacaaacggaatctattcgatataaacgatacggtaaaagaagatactaaaaagaaaaaggtttcgatttggcaaaaaatcaaatctatctttgggggctga

SEQ ID NO: 79515 - protein, 540 aa, Leptospira interrogans serovar Lai str. 56601
MKFEELSIHPKLLSAIQEIGYTELTPIQEKSIPHGLEGKDITGLAQTGTGKTVAFLIPVIHNILTKGIQGIAALVLAPTRELTMQIAEEAKKLLKHSEGIRSVPIIGGTDYKSQNKDLEGLNGIIVATPGRLIDMIKSGSIDISNVEFFVLDEADRMLDMGFIQDIRWLLHKCKNRKQTLLYSATLSVEVMRLAYRFLNEPVEIQINPEKIITERIDQKIVHLGREEKIPYMTNLIINSKEEGQGIIFTNYKANIPKIVYTLRKYGVPVTGISSELDQKKRLRLLRDFKSGKYRYMVATDVASRGIDVENIDIVYNYDLPQDTENYVHRIGRTARAGRKGKAIGFCSESDYVELEKIEKYLKQKIEILEVNEEYIQFPAGDFQSFIGGDSYDREKETHFKQNGKRPHDNDRAPHKHDRNRKRDKRHTSHTHSTAKDSHKKKPAAAIQEAELFLQKADSVLSSEPKGKKSAKDQHRFQNKDKQSRTGRGAQNSRNQNKNQQFGKQYDKNKRNLFDINDTVKEDTKKKKVSIWQKIKSIFGG

SEQ ID NO: 79516 - DNA, 1263 bp, Shewanella oneidensis MR-1
  CDS (1)..(1263): transl_table=11
atgcaatttgaagatttccagcttgaccctagcttattagagtcacttaaagccatggggcacctttcgcccaccacaatccaacaagaaacgctgcctcacgccttagagcaaagggacattttagcgcgcgccccgacgggtacaggtaaaaccgccagtttcttattacccgcgctacaacatttaatcgactttccccgtcgttactcgggtcaagcacgcgtgttaattctcaccccaacccgtgagttggcgagccaaattcaccgctatgcctgccatttagccactgaccaagggctgaatatcgccattattactggcggcgtgccctatgcacctcaagaggaagcgctaaagggcaatatcgatattctggtcgcgacacccggtcgcctgatggaatatttagataaaggcaaattcagtgctgaatccgttgacattctgatcatcgacgaagctgaccgtatgctggatatgggattctcggcggtagttaaagccattgcgctcgaagcccaaggccgcaagcagaacatgctgttttctgccacccttgaaggcagtggtgttatccgctttgcccgtgaagtccttaacgatccgattgaaatcgacgttgacgcaccacgcaaagagaaggcaaagatccaccaatggatccacctcgccgatgacaaagaccataagtttgcgctgctgtgccatctgttaaagcaagaagatgtgaaacgcgccatcgtgttcgtcaaaacccgcgatgtagtctctagcctcgaaggccagttacttcaagctggtatcccgtgcgcctttatgcgcggggatatggaacagaagaaacgtttccaagctctgagccgtttcactaagggagaagtgaatgtactgttggcgactgatgttgcagcccgtggtatcgatatcgatgatatcagccatgtgattaacttcgatatgccacgttctgccgatacctatatccaccgcattggtcgtactggccgcgcaggagcaaagggcactgcgatttcactggctgaagcccatgatatgcgcatcgttggtaagattgagcgctatattgagcaaccgcttaagcgccgcatcattgaagagcttcgccctaaacataaagaggcgcgagtaccgacgaagaaaaaggcgaaagtaaaggccaaagaagcggcgaaaaaaaccagcaaaaaagaggctgcgaaaaaggccagcaaaatcgcccgcaaaaaacagtcataa

SEQ ID NO: 79517 - protein, 420 aa, Shewanella oneidensis MR-1
MQFEDFQLDPSLLESLKAMGHLSPTTIQQETLPHALEQRDILARAPTGTGKTASFLLPALQHLIDFPRRYSGQARVLILTPTRELASQIHRYACHLATDQGLNIAIITGGVPYAPQEEALKGNIDILVATPGRLMEYLDKGKFSAESVDILIIDEADRMLDMGFSAVVKAIALEAQGRKQNMLFSATLEGSGVIRFAREVLNDPIEIDVDAPRKEKAKIHQWIHLADDKDHKFALLCHLLKQEDVKRAIVFVKTRDVVSSLEGQLLQAGIPCAFMRGDMEQKKRFQALSRFTKGEVNVLLATDVAARGIDIDDISHVINFDMPRSADTYIHRIGRTGRAGAKGTAISLAEAHDMRIVGKIERYIEQPLKRRIIEELRPKHKEARVPTKKKAKVKAKEAAKKTSKKEAAKKASKIARKKQS

SEQ ID NO: 79518 - DNA, 1302 bp, Shewanella oneidensis MR-1; identical to SEQ ID NO: 38571
  CDS (1)..(1302): transl_table=11

SEQ ID NO: 79519 - protein, 433 aa, Shewanella oneidensis MR-1; identical to SEQ ID NO: 38572

SEQ ID NO: 79520 - DNA, 1350 bp, Shewanella oneidensis MR-1
  CDS (1)..(1350): transl_table=11
ttgcagtttactgatttttctctggaccagcgtctgttacaaagcttaaagcatatggggattgcaaccccaaccgccatccaggaacaagccttacctatcgccttggcaggtaaagatttaatggcatcgtcaaagaccgggtcaggtaagaccttggcgtttttgctgcccgcattgcaaagggttatctccacccgcgccctcagtaagcgcgatcctagagtattaattttattaccgacccgcgaattggcccatcaggtttatagccagttacgtctactggttgctaacacccaatataaggcaattagtgtattgggtggcgaaaactttaacgatcaagccaaagcgctagcaaaagagccgcattttattgtggcaacgccagggcgaatcgccgatcacttagaacaaaaaaatttatttctcaatggattagaactattaatcctcgatgaagccgaccgcatgttggatttaggctttgcgccacagttaaaagctatcaacgaggcagccgatcataaacgtcgtcagaccttaatgttctcagcaacgttagatcatagtgaaatcaatgagattgcggcagcgttactcaagaatccattacatgttgcgattggcactgctcacgctgaacatcaggatatttcgcagcggatttatctgtgcgatcacttagatcacaaagaggccctactcagtcgtttgcttagcgatgagtcacacaaacaagtgatcatttttaccgccacccgtgccgatacagaacgtttagccgcaaaactctcggctcaaggttttgcgaccgccgccttgagtggcgagttaaaacaagcggcacgtaatcagatcatggaccaatttgcccgtggccaacagcaaatactggtaaccacagatgtggcatcccgaggcttagacttactgaatgtctccttagttatcaacttcgacatgccgaaatttgccgaagaatatgtccaccgcattggccgtacgggtcgtgcaggcgcaaaaggtgatgcgatatccttagtcggtccaaaagattgggatagctttaaaaaagtacaacttttcttaagaaaaacctttgaaatcagtgtaattaaagggcttgaagctaaatttactggtttaaaagataagccaaagtccgtcgcgactaaaggtgtggtcaaggcaaacacaaagggtaaatctaagcccaagccgaacgtcgttaaagcagcgccatcacgtgataaacgctttatcacgggtgttgatgtcggtgatgcgccaatgcgcaaaaaacctaaggcacagctgctgcaagagagtgacgacgagatctga

SEQ ID NO: 79521 - protein, 449 aa, Shewanella oneidensis MR-1
MQFTDFSLDQRLLQSLKHMGIATPTAIQEQALPIALAGKDLMASSKTGSGKTLAFLLPALQRVISTRALSKRDPRVLILLPTRELAHQVYSQLRLLVANTQYKAISVLGGENFNDQAKALAKEPHFIVATPGRIADHLEQKNLFLNGLELLILDEADRMLDLGFAPQLKAINEAADHKRRQTLMFSATLDHSEINEIAAALLKNPLHVAIGTAHAEHQDISQRIYLCDHLDHKEALLSRLLSDESHKQVIIFTATRADTERLAAKLSAQGFATAALSGELKQAARNQIMDQFARGQQQILVTTDVASRGLDLLNVSLVINFDMPKFAEEYVHRIGRTGRAGAKGDAISLVGPKDWDSFKKVQLFLRKTFEISVIKGLEAKFTGLKDKPKSVATKGVVKANTKGKSKPKPNVVKAAPSRDKRFITGVDVGDAPMRKKPKAQLLQESDDEI

SEQ ID NO: 79522 - DNA, 1284 bp, Shewanella oneidensis MR-1; identical to SEQ ID NO: 38573
  CDS (1)..(1284): transl_table=11

SEQ ID NO: 79523 - protein, 427 aa, Shewanella oneidensis MR-1; identical to SEQ ID NO: 38574

SEQ ID NO: 79524 - DNA, 1608 bp, Shewanella oneidensis MR-1; identical to SEQ ID NO: 38577
  CDS (1)..(1608): transl_table=11

SEQ ID NO: 79525 - protein, 535 aa, Shewanella oneidensis MR-1; identical to SEQ ID NO: 38578

SEQ ID NO: 79526 - DNA, 2211 bp, Corynebacterium efficiens YS-314
  CDS (1)..(2211): transl_table=11
atgagaaataccgataacgtcaacggcgacgtagaacagccggataacgtcatttcgtcggaatctcaggaaaccccgcagggtgactcagcagcagctgacttcgctctcgacacccccaccaacactgttgaaggcaccgctgtgtctgagggtagcgaagagatcaccagggttgcggaaatttctgaggacgccgactccgccgaagcagcggacagcgcgagcaatgtaatcaatgagaatgtgaatgaggactcctcggaagacgtaacccagtcttcacacgagtcatcctctacggaagcctccaccggcttcgatgcactcggactgccacagcaggttcttgacgctgtgcgcaaggttggtttcgaaactccttcccccatccaggcacagaccatccccgtcctcatggacggacacgatgtggtcggcctcgcacagaccggtaccggtaagaccgcagccttcgcgctgccggttctctcccgcatcgacaagtccgtgcgcagcccccaggctctcgtgcttgcccccacccgtgagctggcgctccaggtcgctgactccttccagtccttcgccgaccacctcggtggtctcaacgtcctgccgatctacggtggacaggcctacggcatccagctgtccggtctgcgtcgcggtgcccacatcgtcgtcggcaccccgggtcgtatcatcgaccacctggagaagggctcactggatatctccggtctgcgcttcctcgtcctcgatgaggccgatgagatgctcaacatgggcttccaggaggatgtcgagcgcatcctcgccgacacccctgatgacaagcaggtggcactgttctccgcgaccatgccgaacggcatccgtcgcctgagcaagcagtacctgaacaacccgcaggagatctcggtcaagtccgagacccgcaccgccaccaacatcacccagcgcttcctgtctgttgcccaccgcaacaagatggacgcactgacccgcatcctcgaggtcaccgagttcgaggcgatgatcatgttcgtgcgcaccaagcacgagaccgaagaggtcgccgagaagctgcgtgcccgtggtttctctgcagctgccatcaacggtgacatcgcccaggcccagcgtgagcgcaccgtcgaccagctcaaggatggccgcctggacatcctggtggccaccgatgtcgccgcccgtggtctcgacgtcgagcgcatctcccatgtgctcaactacgacatcccgaacgacaccgagtcctacgtccaccgcatcggccgcaccggccgtgcaggacgtaccggcgaggccatcctgttcgtcaccccacgtgagcgccgtatgctccgctccatcgagcgggccaccaacgccccactggtggagatggaactgccgaccgtggacgaggtcaacgagtaccgcaaggtcaagttcgccgactccatcaccgaggcactcgagaacccccaggtcgctctcttccgcaccctgatcaaggagtatgccgagaagaacgacgtacccctcgaggatgtcgccgccgcactggccacccaggcacaggccggcaatgacttcttcctcaccgagcaggccgctgaccgcgaccgtggccgtggcgaccgccgccgtgaccgcgacttcgacgaccgtggtggccgtggccgtgaccgtggcgaccgtccgtcccgcttcgaccgtgacgacgcgaacctggccacctaccgcatcgcggtgggcaagcgccagcacgtccgcccgggtgccatcgtcggtgccctggccaacgagggtggtctgaactccaaggacttcggacgcatcaccatcgcagccgaccacaccctggtcgaactgccgaaggatctgccacagagtgtcctggacaacctccgtgacacccgtatctccggccagctcatcaacatcgaacgcgactccggtggacgtccaccacgtcgcttcgagcgcgatgaccgtggcggcgaccgcggtggacgcggtggattccgtggtgaccgtgacgatcgtggtggccgtggtggtttccgcggcggccgtgaccgtgatgatcgcggtggacgcggtggattccgtggtgaccgtgacgatcgtggtggccgtggtggtttccgcggcggccgtgaccgtgatgatcgcggtggacgcggcggctggagggactag

SEQ ID NO: 79527 - protein, 736 aa, Corynebacterium efficiens YS-314
MRNTDNVNGDVEQPDNVISSESQETPQGDSAAADFALDTPTNTVEGTAVSEGSEEITRVAEISEDADSAEAADSASNVINENVNEDSSEDVTQSSHESSSTEASTGFDALGLPQQVLDAVRKVGFETPSPIQAQTIPVLMDGHDVVGLAQTGTGKTAAFALPVLSRIDKSVRSPQALVLAPTRELALQVADSFQSFADHLGGLNVLPIYGGQAYGIQLSGLRRGAHIVVGTPGRIIDHLEKGSLDISGLRFLVLDEADEMLNMGFQEDVERILADTPDDKQVALFSATMPNGIRRLSKQYLNNPQEISVKSETRTATNITQRFLSVAHRNKMDALTRILEVTEFEAMIMFVRTKHETEEVAEKLRARGFSAAAINGDIAQAQRERTVDQLKDGRLDILVATDVAARGLDVERISHVLNYDIPNDTESYVHRIGRTGRAGRTGEAILFVTPRERRMLRSIERATNAPLVEMELPTVDEVNEYRKVKFADSITEALENPQVALFRTLIKEYAEKNDVPLEDVAAALATQAQAGNDFFLTEQAADRDRGRGDRRRDRDFDDRGGRGRDRGDRPSRFDRDDANLATYRIAVGKRQHVRPGAIVGALANEGGLNSKDFGRITIAADHTLVELPKDLPQSVLDNLRDTRISGQLINIERDSGGRPPRRFERDDRGGDRGGRGGFRGDRDDRGGRGGFRGGRDRDDRGGRGGFRGDRDDRGGRGGFRGGRDRDDRGGRGGWRD

SEQ ID NO: 79528 - DNA, 1323 bp, Pseudomonas putida KT2440
  CDS (1)..(1323): transl_table=11
gtgttctcccaattcgccctgcatgaacgcctgcttaaagccgtggccgagcttaaatttgtcgagccaaccccggtgcaggccgcggccatccccctggccctgcaagggcgggatctgcgtgtgactgcgcagaccggcagcggcaagacggcggccttcgtactgccactgctcaaccgtctggtcgacctcagcggtccgcgtgtcgagattcgcgcgttgatcctgctgccgacccgtgaactggcccagcagaccctcaagcaggtgcagctgttctcgcagttcacctacatcaagtcgggcctggtgactggcggcgaagacttcaaggaacaggccgccatgctgcgcaaggtgcctgacgtgctgatcggcaccccgggtcgcctgctcgagcagctcaatgccggcaacctcgacctgtcccacgtgcaggtcctgatcctggacgaagccgaccgcatgctcgacatgggctttgccgaagacatggagcgcctgtgcaaagagtgcgaaaaccgcgagcagaccttgctgttctcggctaccaccggtggcgcggccctgcgcgacatcatcggcaaggtgctgaaagaccctgaacacctgatgctcaacagtgtctcgcaactggctgaaggcacccgccagcagatcattaccgccgaccacgaccagcataaagagcagatcgcgcagtggttgctggccaacgaaaccttcgacaaggcgatcatcttcaccaacacccgcgccatggccgaccgcatctacggtcacctggtggccaaggacgtgaaggctttcgtgctgcatggcgaaaaggaccagaaggaccgcaagctggccatcgagcgcttcaagcagggcagctccaaagtgctggtggcgaccgacgtggcagcccgtggcctggatatcgacggcctggacctggtgatcaacttcgacatgccacgtagcggtgacgagtacgtacaccgtgtgggccgtaccggccgtgccggtggcgaaggcctggcgatctcgttgatcacccacaacgactggaacctgatgtcgagcatcgagcgctacctcaagcagcagttcgagcgccgggtcatcaaggaagtgaagggcacctacaacgggccgaagaaggtcaaggcctcgggcaaggcggccggtagcaagaagaaaaaggtcgagaagaagaccggcgacaagaaagctgccgccaagcgcaagcctactgccaagccgaaagccaatgcgcctctggccagtgcagatggcctggcaccgctgaagaagcgcaagcctgctgctgaataa

SEQ ID NO: 79529 - protein, 440 aa, Pseudomonas putida KT2440
MFSQFALHERLLKAVAELKFVEPTPVQAAAIPLALQGRDLRVTAQTGSGKTAAFVLPLLNRLVDLSGPRVEIRALILLPTRELAQQTLKQVQLFSQFTYIKSGLVTGGEDFKEQAAMLRKVPDVLIGTPGRLLEQLNAGNLDLSHVQVLILDEADRMLDMGFAEDMERLCKECENREQTLLFSATTGGAALRDIIGKVLKDPEHLMLNSVSQLAEGTRQQIITADHDQHKEQIAQWLLANETFDKAIIFTNTRAMADRIYGHLVAKDVKAFVLHGEKDQKDRKLAIERFKQGSSKVLVATDVAARGLDIDGLDLVINFDMPRSGDEYVHRVGRTGRAGGEGLAISLITHNDWNLMSSIERYLKQQFERRVIKEVKGTYNGPKKVKASGKAAGSKKKKVEKKTGDKKAAAKRKPTAKPKANAPLASADGLAPLKKRKPAAE

SEQ ID NO: 79530 - DNA, 1332 bp, Pseudomonas putida KT2440
  CDS (1)..(1332): transl_table=11
atgaatttcgccaaactcggcctgatcgaaccgctgctgcgcacgctgcagcaactggactacaccaccccgaccccggtgcaggccaaagccatccccgccgtgctggccggccgcgacctgatggccgcagcccagaccggtaccggcaagaccgcaggctttgccctgcctgtgctgcagcgcctggcgctggagggcgagaaggtggccagcaactcgatccgcgccttggtgctggtacccactcgcgagctggccgagcaggtgcacaacaacgtgcgcgaatacgccgagaacctgccgctgactacttacgcggtgtatggcggggtcagtatcaatccacagatgatgcgcctgcgccggggtgtcgacctgctggtggctacccctggccgcttgctcgacctgttccggcagaacgccgtgaagttcaaccaggtgcagaccctggtgctggatgaagccgaccgcatgcttgacctgggctttgccgaagagctgcagtcggtgtacgcggcactgccgcgcaagcgccagacgctgctgttttccgccaccttctccgatcagattcgcatgctggcggggctggcgctgaatgaccccctcagtatcgaagtgagcccgcgcaacgccacggccgccagcgtcaagcagtggctggtgcctgtggacaagaagcgcaaggctgacctgttctgccacctgctgcgcaagcagcgctggaagcaggtgctggtgttcgccaagacccgcaatggcgtcgatcagctggtggagcgcttgctggccgaaggcgtgaatgccgacggcatccacggtgaccgcccacaggcaacccgccagcgtgcgctggacagcttcaaggcccgtgaggtgcaagtgctggtggcgaccgatgtggcggcccgtggcctggatatcgatgacttgccgctggtcgtcaacctcgacctgccgatcgttgccgaagactacgtgcaccgcatcgggcgtaccgggcgggcgggcaacaagggcgaggcgatttcgctggtgtgtgcggatgaagtgcaactgctggcggccattgaagtgctgacccggcagaccctgccgcgccatgaagagccggatttcatccccgagcaccgggtgccgatgaccgatgccagtgggcaggttatcaagaaaccgaagaagcccaagaagccgaaagaaaacagcgccaagcgcgggctggggcgttggatggacagcactgaagcggccagtgcggaaccggcggtgaaggctgtacgcaaggtgccgagcttcaatggtgggccgcgcaagcgtaagccgtga

SEQ ID NO: 79531 - protein, 443 aa, Pseudomonas putida KT2440
MNFAKLGLIEPLLRTLQQLDYTTPTPVQAKAIPAVLAGRDLMAAAQTGTGKTAGFALPVLQRLALEGEKVASNSIRALVLVPTRELAEQVHNNVREYAENLPLTTYAVYGGVSINPQMMRLRRGVDLLVATPGRLLDLFRQNAVKFNQVQTLVLDEADRMLDLGFAEELQSVYAALPRKRQTLLFSATFSDQIRMLAGLALNDPLSIEVSPRNATAASVKQWLVPVDKKRKADLFCHLLRKQRWKQVLVFAKTRNGVDQLVERLLAEGVNADGIHGDRPQATRQRALDSFKAREVQVLVATDVAARGLDIDDLPLVVNLDLPIVAEDYVHRIGRTGRAGNKGEAISLVCADEVQLLAAIEVLTRQTLPRHEEPDFIPEHRVPMTDASGQVIKKPKKPKKPKENSAKRGLGRWMDSTEAASAEPAVKAVRKVPSFNGGPRKRKP

SEQ ID NO: 79532 - DNA, 1530 bp, Vibrio vulnificus CMCP6
  CDS (1)..(1530): transl_table=11
atgggttttacctccttaggtctgtctgcaccaatccttaaagctattcaggaaaaaggctatgacaccccttctcccatccaattgcaggccatccctgctattttagaaggcaaagatgtcatggcggcggcacagacaggaacaggtaaaactgcgggcttcacgctgcctattcttgaacgtctggcgaaggggccacgtgtgcgtgcaaaccacattcgtgcgcttatcttaacgccgacccgcgaattagccgcgcaagtacaagaaaacgtctttatgtacagccgccatttggatttaaacagtgcagtggtgtttggtggtgtgaaaatcaacccacaaatgctgcgcctgcgtaaaggtgctgatgtgttggtagcaacaccaggccgcttgatggacttgtacagccaaaatgcagtgaagtttgatcagctcgaagtgctcatactggacgaagccgaccgcatgttggatatgggtttcattcgtgatatccgcaaaattctggctttgttgcctgcaaaacgccaaaacctgctgttctcagccacgttttctgacgaaattcgcgaactggcaaaaggcttggtgaacaaccctatcgagatttcagttaacccagccaactcaacggctcgcaccgtagagcaatgcatctacccagcagacgtaaagaaaaaaccagcgatgcttgccaagctgattaaagacggtgactggcaacaagtactggtgtttactcgcaccaagcatggcgcaaaccgcctcgcggctttccttaccgatcaaggcctgactgccgctgctatccacggcaacaagagccaaggtgcacgtaccaaagcgttggcggattttaaatcaggcgaggttcgcgtattggtagcaaccgacatcgccgcacgcggtatcgacattcctcagcttcctcaagtcgtgaactttgagcttccaaaagtggcggaagattacgtacaccgcattggccgtactggccgcgccggtgaaacgggtaaggcaatttctctagtatgtgcgctcgaagcgcctgaattgtttgccattgagcgtttgattcaagaactgctacctcgtaaagcgctggaaggttacgcaccaaccaacgcagtaccagagtctaaactggatacgcgcccaattaagccgaaaaaaccgaagaagccaaagaaaccgaaagcacctaatgcggaagcagcaggcagtgatgcgagcagcaaaggcaaccaaaaggcgaaagctgcagacaaacctcaagggcaaaaccgtggcaatggcaaagccaaacgtcagttctctgcaccaaaagaaggtaacaacgattcaaccaacaaaggtaagagaccaaatacaaagggctcgaaacctgcgaacaacgcgaatggcaaaacaaacggcaagccaagtcacgccaaaccaaacagcgcgaaaactggtaacagcaagcctgccaatggcaagccatcggctcaacgtcgtaagccacgtccacaaagcgcttaa

SEQ ID NO: 79533 - protein, 509 aa, Vibrio vulnificus CMCP6
MGFTSLGLSAPILKAIQEKGYDTPSPIQLQAIPAILEGKDVMAAAQTGTGKTAGFTLPILERLAKGPRVRANHIRALILTPTRELAAQVQENVFMYSRHLDLNSAVVFGGVKINPQMLRLRKGADVLVATPGRLMDLYSQNAVKFDQLEVLILDEADRMLDMGFIRDIRKILALLPAKRQNLLFSATFSDEIRELAKGLVNNPIEISVNPANSTARTVEQCIYPADVKKKPAMLAKLIKDGDWQQVLVFTRTKHGANRLAAFLTDQGLTAAAIHGNKSQGARTKALADFKSGEVRVLVATDIAARGIDIPQLPQVVNFELPKVAEDYVHRIGRTGRAGETGKAISLVCALEAPELFAIERLIQELLPRKALEGYAPTNAVPESKLDTRPIKPKKPKKPKKPKAPNAEAAGSDASSKGNQKAKAADKPQGQNRGNGKAKRQFSAPKEGNNDSTNKGKRPNTKGSKPANNANGKTNGKPSHAKPNSAKTGNSKPANGKPSAQRRKPRPQSA

SEQ ID NO: 79534 - DNA, 1593 bp, Bradyrhizobium japonicum USDA 110
  CDS (1)..(1593)
atgcgccgggcgcccgcttttgacatggaaagaacccatcttttgacttcgtttcaggacttcggcctcgccgaaccgatcgctcgtgctctctccgaagagaattacgtcacccccacccccatccaggcccagaccattcccacggcgttgaccggccgcgacgtcgtcggcatcgcccagaccggcaccggcaagaccgcgtccttcgcactgccgatcctgcatcgcctgctcgagcaccgcatcaagccgcagccgaagacgacccgcgtcctggttctgtcgcccacccgcgagctgtccggccagatcctcgacagcttcaacgcctatggccgccacatccgcctgtcctcgacgctcgccatcggcggcgtgccgatgggccgccaggtccgctcgctgatgcagggcgtcgaagtgctggtcgccacccccggccgcctgctcgacctcgtgcagagcaacgggctgaagcttggcagcgtcgaattcctcgtgctcgacgaggccgaccgcatgctcgacatgggcttcatcaacgacatccggaagatcgtcgccaaactgccgatcaagcggcagacgctgttcttctcggccaccatgcccaaggacattgccgagctcgccgactccatgctgcgtgatccggcccgtgtcgcggtgaccccggtctcctcgaccgccgagcgcatcaaccagcgtatcctccaggtcgacttctcggccaagcccgccttcctgaccaagctcctgaaggacgagccgatcaaccgcgcactggtcttcacccgtaccaagcacggcgccgacaaggtcgtgaagacgctcgagaaggccggcattgccgccagcgccatccacggcaacaagtcgcagaaccatcgcgagcgcacgctcgcccagttccgctccggcgacatccgcacgctggtcgccaccgacatcgccgcccgtggcatcgatgtcgacggcatcacccacgtcatcaatttcgacctgcccaacgtgcccgagacttacgtccaccgcatcggccgcaccgcgcgcgccggcgctgagggcaccgcgatctcgctggtcgcaggcggcgaggagctcagctatctccgcgacatcgagcggctgatcaaggtggcgctgccgcgcgaagacctccgcaccgatgccggccgccgcgatgcgggtccgcccccgtcgcagcaacgacagggccggccgggccgcccgggccagcgtccgcaaggcgcaaggcatggtgagcgccacggtgacggacggcgtaccgacgaaaggcacggcgacggacgccaccacagcgccggcaagcagggtgatggacggcccggtgaaggccggcatggcgacgcgcgccacgtcgacggaaggcccggcagcggcccgaaggcctcaaaggggtctcgtcgccgccgctccggcggcaagatgcactcttcgcaaaccgaccgccctgaacagcgttccgcgcatagcgctgggacgcctgatgggatacaaggcgttgcctttttgcgccgggacagtcggccgatgggccaaccaactcgcaaaccctattcgcactag

SEQ ID NO: 79535 - protein, 530 aa, Bradyrhizobium japonicum USDA 110
MRRAPAFDMERTHLLTSFQDFGLAEPIARALSEENYVTPTPIQAQTIPTALTGRDVVGIAQTGTGKTASFALPILHRLLEHRIKPQPKTTRVLVLSPTRELSGQILDSFNAYGRHIRLSSTLAIGGVPMGRQVRSLMQGVEVLVATPGRLLDLVQSNGLKLGSVEFLVLDEADRMLDMGFINDIRKIVAKLPIKRQTLFFSATMPKDIAELADSMLRDPARVAVTPVSSTAERINQRILQVDFSAKPAFLTKLLKDEPINRALVFTRTKHGADKVVKTLEKAGIAASAIHGNKSQNHRERTLAQFRSGDIRTLVATDIAARGIDVDGITHVINFDLPNVPETYVHRIGRTARAGAEGTAISLVAGGEELSYLRDIERLIKVALPREDLRTDAGRRDAGPPPSQQRQGRPGRPGQRPQGARHGERHGDGRRTDERHGDGRHHSAGKQGDGRPGEGRHGDARHVDGRPGSGPKASKGSRRRRSGGKMHSSQTDRPEQRSAHSAGTPDGIQGVAFLRRDSRPMGQPTRKPYSH

SEQ ID NO: 79536 - DNA, 1503 bp, Bradyrhizobium japonicum USDA 110
  CDS (1)..(1503)
atgtccttttcaaatctcggactatccgaaaaagtcctcgccgcagtggcggccaccggttacaccacccccacccccattcaggaacaggcgatccctcacgtcctcgcacgcaaggacgtcctcggcatcgcccagaccggcaccggcaagaccgcggccttcgtgctgccgatgctcaccatcctcgaaaagggcagagcccgggcgcgcatgccgcgcaccctgatcctggagccgacccgcgagctcgcggcacaggtcaaagagaattttgatcgctacggcgccggccagaagctcaacgtcgccctgctgatcggcggcgtctcgttcggcgaccaggatgccaagctgacgcgcggtgtcgacgtgctgatcgcaaccccgggccgcctgctcgaccacaccgagcgcggcggcctgctgctcaccggcgtcgagttgctcgtcatcgacgaagccgaccgcatgctggacatgggcttcattcccgacatcgagcgcatctgcaagctcgtcccgttcacgcggcagaccctgttcttcaccgcgaccatgccgccggaaatccggcgcatcaccgagaccttcctgcacaacccgcagaaggttgaagtctccaagcccgccaccaccgccgtcaccgtcacgcagtcccaggtcccggccgggaaaaaggcgcatgaaaagcgcgaactgctccgccgcctgctgcgcgaggcgaaggatctcaagaacgcgatcatcttctgcaatcgcaaacgcgaagtcgcgatcgttcacaaatcgctccagaagcacggcttcagcgtcggcgcgctacacggcgacatggaccagccggcccgcatggccgcactcgagcagttccgcaagggtgagctgccgttgctggtcgcctccgacgtcgcggcccgcggcctcgacatccccgaggtcagccacgtcttcaatttcgacgtccctcatcatcccgacgactacgtccatcgcgtcggccgcaccggccgcgccggccgcagtggtacggcgatctcgatcgtcacgccgctcgaccagaagtcgatggttgcgatcgagaagctgatcggccagagcattccgcgcgctgaaggcgactacgaagtccacgcagaagccggcgatgcgaccgaccgtccgcgcgagcagcgcggccgcgaacgttcacgcggcggacgcggcaagccgcaacgcggccgcgaccgtgagcgcagccacgagccgcgcgaggcgcggccttcagccgaagcacgccccgcccccgaggcgaggcccgcacgcgagccgagacctccgcgcgaagccaggccatcacccgagccgcgtcacggctcgcgcccgcaggccaatgcgtcgcatgtgccgtcgatcggccgtcccgaaccgcgccgccagcgcgaggccgacaccgagccgggcgatcattcccaccttccggcgtttctgttgcgcccggtccgctcccccgccggcgcctga

SEQ ID NO: 79537 - protein, 500 aa, Bradyrhizobium japonicum USDA 110
MSFSNLGLSEKVLAAVAATGYTTPTPIQEQAIPHVLARKDVLGIAQTGTGKTAAFVLPMLTILEKGRARARMPRTLILEPTRELAAQVKENFDRYGAGQKLNVALLIGGVSFGDQDAKLTRGVDVLIATPGRLLDHTERGGLLLTGVELLVIDEADRMLDMGFIPDIERICKLVPFTRQTLFFTATMPPEIRRITETFLHNPQKVEVSKPATTAVTVTQSQVPAGKKAHEKRELLRRLLREAKDLKNAIIFCNRKREVAIVHKSLQKHGFSVGALHGDMDQPARMAALEQFRKGELPLLVASDVAARGLDIPEVSHVFNFDVPHHPDDYVHRVGRTGRAGRSGTAISIVTPLDQKSMVAIEKLIGQSIPRAEGDYEVHAEAGDATDRPREQRGRERSRGGRGKPQRGRDRERSHEPREARPSAEARPAPEARPAREPRPPREARPSPEPRHGSRPQANASHVPSIGRPEPRRQREADTEPGDHSHLPAFLLRPVRSPAGA

SEQ ID NO: 79538 - DNA, 1224 bp, Vibrio parahaemolyticus RIMD 2210633
  CDS (1)..(1224): transl_table=11
gtgatcagaacctttgctgaacttgatctagaccaaaacctacttgaagccattgaagagatgggctacgaacgcccaactaaaattcaggcagaagcgattccacaagcgttggatggtcgtgacattctagcgtcagcgccaacgggtactggtaaaacggcagccttcgttctgccagcattgcaatacttgcaagatttccctcgtcgtaaacctgggcctgcgcgtattttgatccttacgccaactcgcgaactagcgatgcaggttgccgaccaagctcgtgctttggcaaagaacactaagctgaacatcttcacaatcacaggcggcgttcaataccaagaacacgcagacatcctagcaactacgcaagacatcgtagttgcaacaccaggccgtctacgtgagtacattgatgcagaacgttttgattgtcgtgctatcgaatggctggttctcgatgaagcagaccgcatgctggacatgggctttgctccaacggttgaccgtctgtcgaatgaatgtcgctggcgtaagcaaacccttctgttttcagcaacattagaaggtaaaggcgtagaaggcttcacagctgacctactgaacgagccagcagagatcgacgcaaaatcgccactgcgtgagcgtaagaagattgctcaatggtatcaccgtgctgatagcgcagaacacaaactggctctgctgaaacacatcatcacagagcaagctgaacgcactatcgtgttcttaaaaactcgtgaacgcttggcagagctgcgtgcacaacttgagagcgcacaaatcccgtgttcgtggattcaaggcgaaatgcctcaagatcgtcgtaataatgccattgcacgtttccgtgacggcacggtgaacgtgctactagcaactgacgttgcggcgcgtggtatcgaccttcctgatgtttctcacgttatcaactacgacatgccgcgcacggctgacgtataccttcaccgtatcggccgtacagctcgtgcaggtaagaaaggtaacgcaatctcaatcgtagaagcgcacgaccagccaatgatggatcgcgtagcacgttacgtgaaagaagacatcaaagagcgtttcattaaagagatgcgccctaagcacaagaaacctgtgtttaagaagaaaaagaaaaaagaagacaagaagaaaacagcgaaaaagaaaaccgctaagaagaagtaa

SEQ ID NO: 79539 - protein, 407 aa, Vibrio parahaemolyticus RIMD 2210633
MIRTFAELDLDQNLLEAIEEMGYERPTKIQAEAIPQALDGRDILASAPTGTGKTAAFVLPALQYLQDFPRRKPGPARILILTPTRELAMQVADQARALAKNTKLNIFTITGGVQYQEHADILATTQDIVVATPGRLREYIDAERFDCRAIEWLVLDEADRMLDMGFAPTVDRLSNECRWRKQTLLFSATLEGKGVEGFTADLLNEPAEIDAKSPLRERKKIAQWYHRADSAEHKLALLKHIITEQAERTIVFLKTRERLAELRAQLESAQIPCSWIQGEMPQDRRNNAIARFRDGTVNVLLATDVAARGIDLPDVSHVINYDMPRTADVYLHRIGRTARAGKKGNAISIVEAHDQPMMDRVARYVKEDIKERFIKEMRPKHKKPVFKKKKKKEDKKKTAKKKTAKKK

SEQ ID NO: 79540 - DNA, 1266 bp, Vibrio parahaemolyticus RIMD 2210633
  CDS (1)..(1266): transl_table=11
atgaggtttatcatgtccgttaattttgctgatcttggcattgaacaacagttagtcgaaacgttgaacaatatgaatattgtgacgccaacgccagtccaagaaaaatcgattccacacgtactggaaggcaaagatcttcttgcggctgcgcaaacgggtaccggtaaaacggcggcatttggtttgccgattattcaggcggtacagcaaaagaaacgtaatggcacacctcacgctctcatcctagttccaactcgtgaattggcgcagcaagtgtttgacaatttaacgcaatatgcggaacacacggatctacgtattgtttgtgtgtacggcggtacaagtattggcgtgcaaaagaacaagttggaagagggcgcggatattcttattgctacgccgggccgattgttagaccacttgtttaacggcaacgtaaacatttctaaaactggcgtgttggtgcttgatgaagctgaccgaatgttggacatgggtttttggcctgatctgcaacgcattcttcgtcgactaccgaatgacaaacaaatcatgctgttttcggcgacgtttgaaaaacgcattaaaaccatcgcttacaaactgatggattctcctgttgaggtggaagtgtctccagcgaatacaacggcagaaacggttaagcagatggtgtatccagttgataaaaagcgtaagcgtgagttgctagcgtatttaattggctcacgaaactggcaacaagtacttgttttcactaaaaccaaacaaggcagcgacgagcttgcaaaggagctcaaactggatggtatcaaagcggtttcgattaatggtgataaatcgcaaggtgctcgccagcgtgcacttgatgaattcaagcaaggtaaagttcgtgctttaattgcgacagatgtggcggctcgcggtctagatattcaagagcttgaacaagtggtgaactttgatatgccatttaaagccgaagactacgtacatcgtattggtcgtactggccgcgcgggtaaatccggtttggccgtttcattaatgagccgagatgaagaatatctgcttcgtgcgatcgaaacgttgttagaccagcgtttgcctcaagaatggctagaaggattcgaaccaagtctaatcgaagaggtagaacctgagcgtgatggtggcggtcgtcgtaagagtcgttcgtcagaaaagcgcaaactaaaagcaaaactcgcgattcataaaaatcgtggcaagcaccgcaagtaa

SEQ ID NO: 79541 - protein, 421 aa, Vibrio parahaemolyticus RIMD 2210633
MRFIMSVNFADLGIEQQLVETLNNMNIVTPTPVQEKSIPHVLEGKDLLAAAQTGTGKTAAFGLPIIQAVQQKKRNGTPHALILVPTRELAQQVFDNLTQYAEHTDLRIVCVYGGTSIGVQKNKLEEGADILIATPGRLLDHLFNGNVNISKTGVLVLDEADRMLDMGFWPDLQRILRRLPNDKQIMLFSATFEKRIKTIAYKLMDSPVEVEVSPANTTAETVKQMVYPVDKKRKRELLAYLIGSRNWQQVLVFTKTKQGSDELAKELKLDGIKAVSINGDKSQGARQRALDEFKQGKVRALIATDVAARGLDIQELEQVVNFDMPFKAEDYVHRIGRTGRAGKSGLAVSLMSRDEEYLLRAIETLLDQRLPQEWLEGFEPSLIEEVEPERDGGGRRKSRSSEKRKLKAKLAIHKNRGKHRK

SEQ ID NO: 79542 - DNA, 1368 bp, Salmonella enterica subsp. enterica serovar Typhi Ty2
  CDS (1)..(1368): transl_table=11
atgtcttttgattccctgggattaaaccctgatatcctgcgcgccattgccgagcagggttaccgtgaacctacccctattcagcaacaggcgattcccgccgtgctggaaggccgcgatctgatggctagcgcccagaccggaaccggtaaaacggcgggttttaccctgccattgttgcagcatctgattacccatcagccgcacgctaaaggtcgtcgcccggtacgtgcgttgatcctcacgccaacccgcgagctggcggcgcaaattggtgaaaacgtcagagattacagtaaatatctcaatattcgctcgctggtggtatttggcggcgtaagcattaatccgcagatgatgaaactgcgcggcggcgtggatgtgctggtggcgacgccgggacgtctgctcgacctggaacatcaaaatgccgtgaagctggatcagattgagattctggtactggatgaagccgaccgtatgctggatatgggcttcattcacgacattcgtcgcgtgctggcgaaactgccggcgaagcgtcagaatctgctgttctccgccacgttctccgacgacatcaaagcgctcgccgaaaagctgttgcgcaacccgctggaaatcgaagtggcgcgccgcaacacggcctcagagcaggtgacgcagcacgtgcactttgtcgataaaaaacgcaaacgtgaactgttgtcgcagatgattggccagggcaactggcagcaggtgttggtcttcacccgcaccaagcatggcgcgaaccatctggcggaacagcttaataaagacggtattcgcagcgcggcgatccacggtaataaatcgcagggcgcacgtacccgcgcgctggccgattttaaatccggcgatattcgcgtgctggtggcgacggatattgcggcgcgtggtctggatattgaagagctgccgcacgtggtcaactatgaactgccgaacgtgccggaagattatgtacaccgtattggccgtaccggtcgcgcggcggcaactggcgaggcgctgtcgctggtctgtgttgacgagcataaactgttgcgtgatatcgaaaaattgctgaaaaaagagatcccacgcattacgacgccgggctatgagccggacccgtcgattaaagcggagccgattcagaacggccgtcagcagcgcggcggcggtggcggcggtcgtggacgcggacaaaatcaggggggagcggggcgcagtcagcagccgcgacgtcaggatagcggggcggcgaaggcgaaaccaaaaccgcgcacaggcgaggggaaacccgctggcgacaaagcacgtccgccgcgtcgcccgcgcagaatcacgcctgcccagtaa

SEQ ID NO: 79543 - protein, 455 aa, Salmonella enterica subsp. enterica serovar Typhi Ty2
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGGRGRGQNQGGAGRSQQPRRQDSGAAKAKPKPRTGEGKPAGDKARPPRRPRRITPAQ

SEQ ID NO: 79544 - DNA, 1941 bp, Salmonella enterica subsp. enterica serovar Typhi Ty2
  CDS (1)..(1941): transl_table=11
atgatgagttatgtagactggccgccattaattttgaggcacacgtactacatggctgaattcgaaaccacttttgcagatctggggctgaaggctcctatccttgaagcccttaccgatctgggttacgaaaaaccatctccaatccaggcagagtgcattccgcatctgctgggcggtcgcgacgtgctgggcatggcccagaccggtagcggcaaaaccgcagcgttctctttaccgctgctcaacaatcttgatcctgagctgaaggcacctcagattctggtgctggcgccaacccgcgaactggcggtacaggttgccgaagccatgacggatttctctaaacacatgcgcggcgtaaacgtggttgccctgtacggcggtcagcgttatgacgtgcagttacgcgccctgcgtcaggggccgcagatcgttgtcggtacgccgggacgtctgcttgatcacttaaaacgcggcaccctcgacctctctaaactgagtggtctggtgctggatgaagccgacgaaatgctgcgtatgggcttcatcgaagacgttgaaactattatggcgcagatcccggaaggtcatcaaaccgctctgttctccgccaccatgccggaagcgattcgtcgcattacccgccgctttatgaaagagccgcaggaagtgcgcattcagtccagcgtgactacccgtcctgacatcagccagagctactggactgtctggggtatgcgtaaaaacgaagcactggtgcgtttcctggaagcggaagactttgatgcggcgattatcttcgtacgtaccaaaaacgcgaccctggaagtagcagaagcgctggaacgtaacggctacaacagcgccgcgttgaatggcgatatgaaccaggcgctgcgtgagcagactctggaacgcctgaaagatggtcgtctggacatcctgatcgccaccgatgttgcggcacgtggtctggacgttgaacgtatcagcctggtggtgaactacgatattccgatggactccgagtcctacgttcaccgtatcggtcgtaccggtcgtgcgggtcgcgccggtcgcgcgctgctgttcgttgagaaccgcgagcgtcgtctgctgcgcaacatcgaacgcaccatgaagctgaccattccagaagtggaactgccgaacgcagaactgctgggtaaacgccgtctggaaaaattcgccgcgaaagttcagcagcaactggaaagcagcgatctggatcagtaccgtgcgctgctggcgaaaatccagccgtctgccgaaggtgaagagctggatctcgaaacgctggccgccgcactgctgaaaatggcgcagggcgagcgtccgctgattctgccgccggatgcgccgatgcgtcctaagcgtgaattccgtgaccgtgacgaccgtggtccgcgcgatcgtaatgaccgtggcccgcgtggcgatcgtgaagaacgtccgcgtcgtgaacgtcgtgacgttggcgatatgcagttataccgcattgaagtgggccgtgatgacggcgttgaagttcgtcatatcgtgggcgctatcgctaacgaaggcgacattagcagccgttacattggtaacattaagctgttcgcgtctcactccaccatcgagctgccgaaaggtatgccgggcgaagtgctccagcacttcacgcgtactcgcattctgaacaagccgatgaatatgcagctgttgggtgatgcggttccgcacgcgggcggcgaacgtcgcggcggtggtcgtagcttcagtggcgaacgtcgtgaaggcggtcgtaatttcagcggcgaacgtcgtgaaggtggtcgtggtgatggtcgtcgcttcagcggcgaacgtcgtgaaagccgtggtccgcgtcgtgatgactctaccggtcgccgtcgtttcggcggtgatgcgtaa

SEQ ID NO: 79545 - protein, 646 aa, Salmonella enterica subsp. enterica serovar Typhi Ty2
MMSYVDWPPLILRHTYYMAEFETTFADLGLKAPILEALTDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIQPSAEGEELDLETLAAALLKMAQGERPLILPPDAPMRPKREFRDRDDRGPRDRNDRGPRGDREERPRRERRDVGDMQLYRIEVGRDDGVEVRHIVGAIANEGDISSRYIGNIKLFASHSTIELPKGMPGEVLQHFTRTRILNKPMNMQLLGDAVPHAGGERRGGGRSFSGERREGGRNFSGERREGGRGDGRRFSGERRESRGPRRDDSTGRRRFGGDA

SEQ ID NO: 79546 - DNA, 1377 bp, Bacillus cereus ATCC 14579; identical to SEQ ID NO: 38605
  CDS (1)..(1377): transl_table=11

SEQ ID NO: 79547 - protein, 458 aa, Bacillus cereus ATCC 14579; identical to SEQ ID NO: 38606

SEQ ID NO: 79548 - DNA, 1374 bp, Nitrosomonas europaea ATCC 19718; identical to SEQ ID NO: 38609
  CDS (1)..(1374): transl_table=11

SEQ ID NO: 79549 - protein, 457 aa, Nitrosomonas europaea ATCC 19718; identical to SEQ ID NO: 38610

SEQ ID NO: 79550 - DNA, 1497 bp, Nitrosomonas europaea ATCC 19718
  CDS (1)..(1497): transl_table=11
atgagtaatgatgtgacgtttgcccaactgggcttgtccagtgaaattctccatgcagttaatgatgaagggtatgtgaatcccactccgatccaggcccaggtcattccttcgattctggctggtaaggatgtgatggccagtgcgcaaacaggtaccggtaagacagccggctttacattgccgctgctgtaccgtctgcaagcatacgccaatacgagtgtgtctcctgcccggcatcctgttcgtgccctgatcatggcaccgactcgtgaactggcgatgcagatcgacgaaagtgtcaggaaatatggaaaatatcttgccctgagaacggctgtcgtttttggtggtatcaatatcgagccccaaatcgcagcgctgcaggccggggtggagatactggtggctactcccggtcgcctgttggatctggtcgaacaaaaagcagtcaatttttccaaaaccgaaattctggtactagatgaagctgatcgtatgttggatatgggttttttgccggacatcaagcgggtgatggcgctgttatctccacaacggcaaagcctgatgttttctgcaacattctccggtgaaatcaggaaacttgccgacagcctgctgaagcagccggtccgaatcgaagcagcggtacaaaatacagtgaatgaatctatttcacatgtcattcactgggtaaagccagatagcaaatttgccttgctgctacacctcatccgacagcagaatctgaaacaggcacttattttcgtcaaaacgaaacatggtgcttcccatctggcgcagatgctttcccgccacgaaatctcggcggttgccattcacggcgacagaaatcagcagcagcgtacacaggcgctcgctgaattcaagcatggtgacgtgcaaatactggttgctaccgatgtcgccgcgcgcggtatcgacattgaaaagctgtcacatgtcatcaattatgaattacctggtaacccggaagattatgtccatcggatcggacgtaccggccgggccggtagtaaaggaaaggctatttctctggttagcgaacatgaaaaagaactgctggccaatatcgaaaaactgctgaacgccaaactggaaacagaacagattgccggttttgatgcggaacagtttgctcgcagcctgccagatcggaaaaaccggatgtcggccggtaactcccgctacggcaataagccgatggaaaatgggagtgagaaaagcagaagtgagaaacacaggaaactgccatcatcccagaaatactccggttctcgccgagggggaacgcaaaaatacagcgaccccatctttacccagccttacgtgccacaggctaattcgacacagtcgacaacgcccaagcagccagaaatccaatctctgttcctgacatacaggcaggaaaaaaagaccattccggcgttgtttacggccttgtcgaaaagtaaagctggccaggagaactga

SEQ ID NO: 79551 - protein, 498 aa, Nitrosomonas europaea ATCC 19718
MSNDVTFAQLGLSSEILHAVNDEGYVNPTPIQAQVIPSILAGKDVMASAQTGTGKTAGFTLPLLYRLQAYANTSVSPARHPVRALIMAPTRELAMQIDESVRKYGKYLALRTAVVFGGINIEPQIAALQAGVEILVATPGRLLDLVEQKAVNFSKTEILVLDEADRMLDMGFLPDIKRVMALLSPQRQSLMFSATFSGEIRKLADSLLKQPVRIEAAVQNTVNESISHVIHWVKPDSKFALLLHLIRQQNLKQALIFVKTKHGASHLAQMLSRHEISAVAIHGDRNQQQRTQALAEFKHGDVQILVATDVAARGIDIEKLSHVINYELPGNPEDYVHRIGRTGRAGSKGKAISLVSEHEKELLANIEKLLNAKLETEQIAGFDAEQFARSLPDRKNRMSAGNSRYGNKPMENGSEKSRSEKHRKLPSSQKYSGSRRGGTQKYSDPIFTQPYVPQANSTQSTTPKQPEIQSLFLTYRQEKKTIPALFTALSKSKAGQEN

SEQ ID NO: 79552 - DNA, 1812 bp, Prochlorococcus marinus subsp. marinus str. CCMP1375; identical to SEQ ID NO: 38623
  CDS (1)..(1812): transl_table=11

SEQ ID NO: 79553 - protein, 603 aa, Prochlorococcus marinus subsp. marinus str. CCMP1375; identical to SEQ ID NO: 38624

SEQ ID NO: 79554 - DNA, 1725 bp, Bordetella pertussis Tohama I; identical to SEQ ID NO: 38627
  CDS (1)..(1725): transl_table=11

SEQ ID NO: 79555 - protein, 574 aa, Bordetella pertussis Tohama I; identical to SEQ ID NO: 38628

SEQ ID NO: 79556 - DNA, 1434 bp, Bordetella pertussis Tohama I
  CDS (1)..(1434): transl_table=11
atgactgaatctacctcctccgacgcgcctgttaccgacgcgcctacgcgcactttcgcagacttcggcctgcatccgttactgctcaagttgattgccgacaccggctatacgaatcccacgccgattcaggcgcaggcgattccggtcgtagtggaaggccgcgatgtgatgggcgccgcccagaccggcaccggcaagacggcggcattcacgctgccgatcctgcatcgcctgatgccgctggccaataccagcgcatcgccggcgcgccacccggtgcgggccctcattctcacgcccacgcgggaactggccgaccaggtttacgaaagcgtcaagcgctacagcctgcatacgccgctgcgcagcgccgtggtgttcggcggcgtggacatcggtccgcagaaggaagccctgcggcgcggttgcgaagtcctggtggccacgccggggcgcctgctcgatcacgtcgagcagaagaacgtcaacctcagccaggtcggcatcctggtgctcgacgaggccgaccgcatgctcgacatgggctttctgcccgatctcgaacgcatcatccgcctgttgccggcgcagcgccaggggctgctgttctcggccacgttcagcaatgaaatccgcaagctgggccgttcgtacctgaaccacccggtggagatcgaagtcgccgcgcgcaacgccacggccgacaccgtcacgcagatcgcctaccagatgcatggcgataccaagcgggcggcggtggtgcacctggtcaagtcgcgcggcctgaagcaggtcatcgtgttttccaacaccaagatcggcaccgcgaggctggcgcgccagctcgagcgtgacggcgtgaaggccgagtcgatccacggcgacaagacccagggcgaccgcatgaaggcgctcgaggcgttcaaggccggcgatctggaagtgctggtggcgaccgacgtcgcggcgcgcggcctggacgtggccggcgtgccctgcgtcatcaactacgacctgccgtacaacgccgaagactatgtccaccggatcggccgcaccggccgcgccggcgcgtcgggcgaggcgatcgccctgttcaccgccgacgaagagcgctatctgctcgacatcgagaagctgatcaagcgccaggtgccgcgcggcaagctggaactgccggccgacctggttgcgcgcagccatggccgcgaccgcgacgccccgcgcgagcgtggcgccgaccgccaccgcggcgaacgctgcacttcaggcgcggccgcgccgcgccagccggtcgacgaactcttctacaagccttacgagcctgccaacggccagccggcctcgcccgagacgcccgagcaggaagggcgcagcaacgcgcccaagcgccaactggcagtgctgctgggcggcagccgcaagggctga

SEQ ID NO: 79557 - protein, 477 aa, Bordetella pertussis Tohama I
MTESTSSDAPVTDAPTRTFADFGLHPLLLKLIADTGYTNPTPIQAQAIPVVVEGRDVMGAAQTGTGKTAAFTLPILHRLMPLANTSASPARHPVRALILTPTRELADQVYESVKRYSLHTPLRSAVVFGGVDIGPQKEALRRGCEVLVATPGRLLDHVEQKNVNLSQVGILVLDEADRMLDMGFLPDLERIIRLLPAQRQGLLFSATFSNEIRKLGRSYLNHPVEIEVAARNATADTVTQIAYQMHGDTKRAAVVHLVKSRGLKQVIVFSNTKIGTARLARQLERDGVKAESIHGDKTQGDRMKALEAFKAGDLEVLVATDVAARGLDVAGVPCVINYDLPYNAEDYVHRIGRTGRAGASGEAIALFTADEERYLLDIEKLIKRQVPRGKLELPADLVARSHGRDRDAPRERGADRHRGERCTSGAAAPRQPVDELFYKPYEPANGQPASPETPEQEGRSNAPKRQLAVLLGGSRKG

SEQ ID NO: 79558 - DNA, 1446 bp, Bordetella bronchiseptica RB50
  CDS (1)..(1446)
atgcgtgcgatcgccgataccggctatacggcgcccacccccatccaggcgcaagccatcccgctggtgctgcaaggcggcgacctgctggccgccgcgcaaaccggcaccggcaagaccgcggggttcaccctgcccatcctgcaccggctgatgcagaccaagcccgccgcgcgcaagcctggccgcccgcgctgcctgatcctcacccccacccgcgagctcaccgcccaggtggccgaatcggtgcagacctacggcaagtacgccagcctgagctccatggtgatgttcggcggcgtcaacatcaatccgcagatcagcgccctgaaaaagccgctcgacatcctggtggccacgcccggccgcctgctcgaccatgccggccagaaaacggtcgacctctccggcgtggaaatcctggtgctggacgaagccgaccgcatgctggacatgggcttcatccgcgacatccgcaaggtactggcgctgctgcccaagcaacgccagaacctgctgttctccgccaccttctcggacgaaatccgctcgctggcgcgcggcgtgctcaacgatccgggcgaagtctcggtcacgccgcgcaacaccgccaccgaactggtcacccagacggtgcacctggtcgaacagcaccacaagcgcgacctcgtcagccacctgatccgcgaaagcggctggcaccaggtactggtgttcacccgcaccaagcacggcgccaaccggctggccgagaagctggtcaaggacggcctgagcgcggccgccatccatggcaacaagagccagtcggcgcgtacccgcgccctgtcgggcttcaaggacggcagcgtggccgtgctggttgccaccgacatcgccgcgcgcggcctggacatcgaccaactgccgcaagtggtcaacttcgaactgcccaacgtccccgaggactacgtgcaccgcatcggccgcaccggccgtgccggcgccaccggcgcggcggtctcgctggtggacgatagcgagatcaagctgctcaaggccatcgaacgcctgatcaagaagcccatcgaacgccgcgccgtcgacggctggacgccgcctgccggcggcccgaccgccgaggaccgcgccgatcgcgagcgcgaaatgcgcgacgacgatcgcggccgcggccgccgcggtggccgtggcggcgatcgcggccaacgcgccggcggcgacaaccgcgccccccaggcgcgcgacggccagcgccgcgccacgggcgcccatccgcaaggcagcgcgccgcgcaacgccgccggtccgcgcgccgacgccaagcgcaacgacgctggccgcccccaggggcgtgcccccggcgaaacgggtgcggcccgcgcgccggccccggcgcgcaaccggcccgccggcaacggcacgcgcggcgtgttgctgggcaagtaa

SEQ ID NO: 79559 - protein, 481 aa, Bordetella bronchiseptica RB50
MRAIADTGYTAPTPIQAQAIPLVLQGGDLLAAAQTGTGKTAGFTLPILHRLMQTKPAARKPGRPRCLILTPTRELTAQVAESVQTYGKYASLSSMVMFGGVNINPQISALKKPLDILVATPGRLLDHAGQKTVDLSGVEILVLDEADRMLDMGFIRDIRKVLALLPKQRQNLLFSATFSDEIRSLARGVLNDPGEVSVTPRNTATELVTQTVHLVEQHHKRDLVSHLIRESGWHQVLVFTRTKHGANRLAEKLVKDGLSAAAIHGNKSQSARTRALSGFKDGSVAVLVATDIAARGLDIDQLPQVVNFELPNVPEDYVHRIGRTGRAGATGAAVSLVDDSEIKLLKAIERLIKKPIERRAVDGWTPPAGGPTAEDRADREREMRDDDRGRGRRGGRGGDRGQRAGGDNRAPQARDGQRRATGAHPQGSAPRNAAGPRADAKRNDAGRPQGRAPGETGAARAPAPARNRPAGNGTRGVLLGK

SEQ ID NO: 79560 - DNA, 1908 bp, Prochlorococcus marinus str. MIT 9313
  CDS (1)..(1908): transl_table=11
atggggcgttgtctgcctgatttaaaggatcaatcaggtagacaacgccttctctcgatgacccatacaaaagcgcacgaggatgtctcgtgctcccctgaaaagagtgcgtctgagatctcttcaacgagcgcagatgatggtttaaccactgtggctgaggccaccaatcaaaacaattcaggcgatggctcggtctcagtagccgctgaggcctgtgaagagactgaagcgacagagttagtttccgaattcgattgttttggctttagcgagccgttgctcaagacccttgccgaaaagggttataagcaaccctccccaattcagaaagctgctattccagaattgatgctgggtcgtgatctagttggtcaggctcagactggaacaggcaaaacagccgcttttgcgttgcccctgatcgagcggcttcatgatcatggcagtcgtccccaagtgttggtgcttgccccgacccgggagttggcgatgcaggtcgcggattcgttccgtgcttatgccgttggccatccgcatctcaaagttttggcggtatatggcggagccgatttccgctctcagatcaataccctcaagcgtggcgtggatgttgtggtaggcaccccgggccgcttgatggatcacatgcggcagggcactctcgacacctctggtttgaggtgtttggtgcttgacgaagccgatgaaatgctgcgtatgggtttcatcgatgatgtcgaatggatcttggagcagttgcctgaggagcgccagatggtgttgttttcggcaacgatgccatcagagatccgtcgactttcgaagcgttacctacacgaaccagcagagatcacgatcaagagccgtgatcaggaggctcgtctcatccgtcagcgatgtatcactctccagaacagccacaaacttgaagcccttagaagggttcttgaggctttcactggtgagggagtgattatttttgcccgcaccaaggtgatcactctcaccgttgctgaggcactagaagccgctggacacgatgttgccgtactgaacggggatgtccctcaaaaccaacgggaacgaacggttgaacgtttgcgcaaaggcagcgtgaatatcttggttgctactgatgttgccgctcgaggtctagatgtcgatcgcatcagcctggtgatcaactacgacatcccctttgatagcgaagcctatgtgcatcgcatcggacgtaccggccgggctggccgcagtggagaggccattttgttcgtgaaccctcgggaacgtcgctttgtgggcggctttgaacgtgctgtaggtcaacccatcgaaccgatggatatccccaacaatgcagcgattaaccagagtcgtcttgatcgccttcgtcaacgtctcactactgccgctaagacggagagagataactccgaggagacagcccttctccaggagctaatccagcgtgttgtgcaggagctcagcctcagtccagagcaattggctctagcagcattagagtttgctgttggcccaggcccaatcttggtgcaggctgatgagggttggttgcagcagtcaactcagcgaaaccgtcgcaacgatcgtcacgaaagtcgtggaggctctggccgaaggcctgagcgttcatcgagaccgccggaagatcacatggagcgctttcgtgtggaagtcggtcatcgcgatcgtgtcaagcctggcaatctggttggtgccatcgccaatgaatccgggcttgaaggacggatgattggtcgcattcagatttttgagtcgcacagtcttgtggatcttcccaaaggaatgcctgaggatgtttttaaagatctaaaacgtctcaaggtgatgaatcgagagttgcatatccagcgtgcttcttaa

SEQ ID NO: 79561 - protein, 635 aa, Prochlorococcus marinus str. MIT 9313
MGRCLPDLKDQSGRQRLLSMTHTKAHEDVSCSPEKSASEISSTSADDGLTTVAEATNQNNSGDGSVSVAAEACEETEATELVSEFDCFGFSEPLLKTLAEKGYKQPSPIQKAAIPELMLGRDLVGQAQTGTGKTAAFALPLIERLHDHGSRPQVLVLAPTRELAMQVADSFRAYAVGHPHLKVLAVYGGADFRSQINTLKRGVDVVVGTPGRLMDHMRQGTLDTSGLRCLVLDEADEMLRMGFIDDVEWILEQLPEERQMVLFSATMPSEIRRLSKRYLHEPAEITIKSRDQEARLIRQRCITLQNSHKLEALRRVLEAFTGEGVIIFARTKVITLTVAEALEAAGHDVAVLNGDVPQNQRERTVERLRKGSVNILVATDVAARGLDVDRISLVINYDIPFDSEAYVHRIGRTGRAGRSGEAILFVNPRERRFVGGFERAVGQPIEPMDIPNNAAINQSRLDRLRQRLTTAAKTERDNSEETALLQELIQRVVQELSLSPEQLALAALEFAVGPGPILVQADEGWLQQSTQRNRRNDRHESRGGSGRRPERSSRPPEDHMERFRVEVGHRDRVKPGNLVGAIANESGLEGRMIGRIQIFESHSLVDLPKGMPEDVFKDLKRLKVMNRELHIQRAS

SEQ ID NO: 79562 - DNA, 1797 bp, Synechococcus sp. WH 8102; identical to SEQ ID NO: 38633
  CDS (1)..(1797): transl_table=11

SEQ ID NO: 79563 - protein, 598 aa, Synechococcus sp. WH 8102; identical to SEQ ID NO: 38634

SEQ ID NO: 79564 - DNA, 1419 bp, Chromobacterium violaceum ATCC 12472; identical to SEQ ID NO: 38635
  CDS (1)..(1419): transl_table=11

SEQ ID NO: 79565 - protein, 472 aa, Chromobacterium violaceum ATCC 12472; identical to SEQ ID NO: 38636

SEQ ID NO: 79566 - DNA, 1326 bp, Chromobacterium violaceum ATCC 12472; identical to SEQ ID NO: 38637
  CDS (1)..(1326): transl_table=11

SEQ ID NO: 79567 - protein, 441 aa, Chromobacterium violaceum ATCC 12472; identical to SEQ ID NO: 38638

SEQ ID NO: 79568 - DNA, 1263 bp, Chromobacterium violaceum ATCC 12472; identical to SEQ ID NO: 38639
  CDS (1)..(1263): transl_table=11

SEQ ID NO: 79569 - protein, 420 aa, Chromobacterium violaceum ATCC 12472; identical to SEQ ID NO: 38640

SEQ ID NO: 79570 - DNA, 1320 bp, Chromobacterium violaceum ATCC 12472; identical to SEQ ID NO: 38643
  CDS (1)..(1320): transl_table=11

SEQ ID NO: 79571 - protein, 439 aa, Chromobacterium violaceum ATCC 12472; identical to SEQ ID NO: 38644

SEQ ID NO: 79572 - DNA, 1518 bp, Wolinella succinogenes DSM 1740; identical to SEQ ID NO: 38649
  CDS (1)..(1518): transl_table=11

SEQ ID NO: 79573 - protein, 505 aa, Wolinella succinogenes DSM 1740; identical to SEQ ID NO: 38650

SEQ ID NO: 79574 - DNA, 1155 bp, Gloeobacter violaceus PCC 7421; identical to SEQ ID NO: 38659
  CDS (1)..(1155): transl_table=11

SEQ ID NO: 79575 - protein, 384 aa, Gloeobacter violaceus PCC 7421; identical to SEQ ID NO: 38660

SEQ ID NO: 79576 - DNA, 1305 bp, Photorhabdus luminescens subsp. laumondii TTO1; identical to SEQ ID NO: 38663
  CDS (1)..(1305): transl_table=11

SEQ ID NO: 79577 - protein, 434 aa, Photorhabdus luminescens subsp. laumondii TTO1; identical to SEQ ID NO: 38664

SEQ ID NO: 79578 - DNA, 1338 bp, Photorhabdus luminescens subsp. laumondii TTO1
  CDS (1)..(1338): transl_table=11
atgactgcaacaaacttttctgaacttgagcttgatgaacgcctgcttgacgccctgaatgataaaggttattcccgcccaacagcaattcaggctgcggctattccggcagcaatggacgggcgtgatgtactaggatcagcgcctaccggtaccggcaaaactgccgcttacctgctgcccgctatgcaacatttattggattttccacgcaagaaatctggaccaccacgtattttgatcctgacgcccacccgtgagctagccatgcaagtggcagatcaggcaaaagaattcgctgcacatacccatttggatatcgctaccattactggcggcgtagcctatatgaatcacgctgaaattttcagcgaaaatcaagatattgtcgtcgccactacaggccgtctgctgcaatatatcaaggaagaaaactttgattgtcgggcagttgaaacacttatccttgatgaagccgatcgtatgctggatatgggttttgccaacgatattgaaaccatcgcgggtgaaacccgttggcgcaaacagaccatgctgttctctgcgactctggaaggggaagccattcgtgattttgctgaacgtttactggaagatccagttgagattgatgcagaaccgtcacgtcgtgagcgcaaaaaaatccagcaattttactaccgtgccgataattcggcacacaaaacagccctgctttgccatttactaaaacaacccgatgtcactaaatccattatttttgttcgcaaacgtgaacgtgtacacgaacttgcggataaattgcatcaagctggcattaaagcccggtttcttgaaggggaaatggtacaggctaaaaggacggaagcagttaagctcctgaacgatggcagtgtcactgttctggttgcaacagatgtcgctgcccgtggattggatattgatgatatcagccatgttttcaatttcgatttaccacgcaccgccgatgtttatctacaccgtattggccggacagcgcgtgcaggtcgcaaaggtactgcaattaccttagtggaagcgcatgatcatcctttattaggcaaaatcagtcgctatctgaatgaaccactaacgtcgcgagtggttgatgaacttcgcccaaccactaaagcaccaagtgacaaagcccgcaataagccatcgaaaaaagtattggctaaacgtaaagagaaaaagaaagcggaagaatcgaagaaaaaagccaaaatacgtcatcgagatagtaaaaatatcggtaaacgccgtaaaccttctggtaatccaaaaccagaaacgccagtcagtagcgatgcgtaa

SEQ ID NO: 79579 - protein, 445 aa, Photorhabdus luminescens subsp. laumondii TTO1
MTATNFSELELDERLLDALNDKGYSRPTAIQAAAIPAAMDGRDVLGSAPTGTGKTAAYLLPAMQHLLDFPRKKSGPPRILILTPTRELAMQVADQAKEFAAHTHLDIATITGGVAYMNHAEIFSENQDIVVATTGRLLQYIKEENFDCRAVETLILDEADRMLDMGFANDIETIAGETRWRKQTMLFSATLEGEAIRDFAERLLEDPVEIDAEPSRRERKKIQQFYYRADNSAHKTALLCHLLKQPDVTKSIIFVRKRERVHELADKLHQAGIKARFLEGEMVQAKRTEAVKLLNDGSVTVLVATDVAARGLDIDDISHVFNFDLPRTADVYLHRIGRTARAGRKGTAITLVEAHDHPLLGKISRYLNEPLTSRVVDELRPTTKAPSDKARNKPSKKVLAKRKEKKKAEESKKKAKIRHRDSKNIGKRRKPSGNPKPETPVSSDA

SEQ ID NO: 79580 - DNA, 1935 bp, Photorhabdus luminescens subsp. laumondii TTO1; identical to SEQ ID NO: 38665
  CDS (1)..(1935): transl_table=11

SEQ ID NO: 79581 - protein, 644 aa, Photorhabdus luminescens subsp. laumondii TTO1; identical to SEQ ID NO: 38666

SEQ ID NO: 79582 - DNA, 1257 bp, Vibrio vulnificus YJ016
  CDS (1)..(1257): transl_table=11
atgacaaatactttcattgagcttggacttgattcttcgttaagcgatcatctttctcagctaggatttaacacaccaacaccaattcaacagcaagcgattccacatcttttgcaaggtagagatgtgctggctgccgctcaaacagggacaggaaaaaccgccgcttatggcttgccactgatccaaatgttgtcacgacagtcgcgagaagaaacggcacccaaacatcctagagcactgatcttagcgccaacccgagagctggcgcagcaagtgttcgacaatttgaaacagtatgcgcaacacactgagttggctatcgttaccgtatacggtggaaccagtatccgtgttcaacaagaacaattggcaaaaggtgttgatatcctcattgcgacgcctggacgtctattggatcatctttttaccaagaaaacctcattgaaccagttgcaaatgctggtgttagacgaagccgatcgcatgttggatatgggctttttgcccgacattcagcgcattatgaaaagaatgcctgaagagcgtcaaacgctgctgttttccgctacgtttgaaacacgtgtcaaagcattggcttatcgtttaatgaaagagcccgtcgaagttcaagttgccgctgccaacagcaccgccgacaccgttaagcagatggtgtatccggtcgacaaaaaacgcaaaagcgagttgttggcgtatctcattggctctcgtaattggcagcaagtactggtatttaccaaaactaagcaaggcagcgatgctttggtgagtgaattaaagctggatggcatcaaggccgcttccatcaatggcgacaaatcgcaaggtgcacgtcagaaagcgctggatgattttaaatcgggtaaagtacgcgcgttgatcgccaccgatgttgccgcacgcggtttggatattgctcagctagagcaagtcgtaaacttcgatatgccttacaaggcagaagattacgtgcaccgaattggccgaacggggagagcagggcaaacggggctcgcagtgtcttttatgtcacgagatgaagaatacttgctgcaagcgattgaaaatctgctggatacccgtttacctcaagaatggttagcgggatttgagcccagtgaaaaagagaactacgttgaagatacacctagcaagcgcactagtcgttcagcagaaaaacgtaagcttaagcaaaagttaaaaattcaccaaggccgtggtaaaaagcgctga

SEQ ID NO: 79583 - protein, 418 aa, Vibrio vulnificus YJ016
MTNTFIELGLDSSLSDHLSQLGFNTPTPIQQQAIPHLLQGRDVLAAAQTGTGKTAAYGLPLIQMLSRQSREETAPKHPRALILAPTRELAQQVFDNLKQYAQHTELAIVTVYGGTSIRVQQEQLAKGVDILIATPGRLLDHLFTKKTSLNQLQMLVLDEADRMLDMGFLPDIQRIMKRMPEERQTLLFSATFETRVKALAYRLMKEPVEVQVAAANSTADTVKQMVYPVDKKRKSELLAYLIGSRNWQQVLVFTKTKQGSDALVSELKLDGIKAASINGDKSQGARQKALDDFKSGKVRALIATDVAARGLDIAQLEQVVNFDMPYKAEDYVHRIGRTGRAGQTGLAVSFMSRDEEYLLQAIENLLDTRLPQEWLAGFEPSEKENYVEDTPSKRTSRSAEKRKLKQKLKIHQGRGKKR

SEQ ID NO: 79584 - DNA, 2043 bp, Corynebacterium diphtheriae NCTC 13129
  CDS (1)..(2043): transl_table=11
atgagcattaccgataacgccaccagcggcgagaacgagctggacattaagattttgtcggaatctcaggataattcgcaggtagacgaaggcaccaccatcaataatgatgtcgttgccgatgtagacgactccagggttgcgaacacttctgaggccaccgactccgctcagcaagaagcggacagtgcagaaaaagatggattcgaggctctaggtctcccagacgcaatcctgaaggcagtcgctaaggttggcttcgaaacgccatccccaattcaggcgcagaccattccggtgttgatgcaggggcatgacgttatgggcctcgcgcagacgggtacaggtaagacggcagcattcgcgttgccaatcttgtcgcgtatcgacgtcaagaagcgccacccacaggcgttgatcctcgccccaactcgcgaacttgctttgcaggttgcagactccttccagtctttcgcagatcatttgggcgacatccacgtgctgccaatctatggcggtcaggcttacggcattcagctgtccggcctgcgccgtggcgcacagatcatcgtgggtactccaggtcgtgtgatcgaccacttggagaagggctccctcgacatttccaacctccgcttcctcgttctagacgaggcagacgagatgctcaacatgggcttccaagaagacgttgagcgtattttggaggacaccccagaggacaagcaggttgctttgttctctgccaccatgccaaatggtattcgtcgtttgtctcgcgactacatgaaggatcctcatgagatccaggtgaagtcgcagacgcgcaccaacacgaacatcactcagcgttacctcaacgttgcacaccgcaacaagctcgatgccttgacccgtatccttgaggtcaccgagttcgaagccatgatcatgttcgtgcgtaccaagcatgaaactgaagaagtcgctgaaaagcttcgcgcacgcggattctccgctgccgctatcaacggcgacatcgctcaggctcagcgtgagcgcaccgtcgaccagctcaaggacggtcgcctcgacatcctcgttgctaccgacgttgctgcccgtggcctcgacgttgaacgcatcactcacgtgttcaactacgacattccaaacgacacagaatcctacgtccaccgcattggtcgtaccggtcgtgcaggtcgttctggtgaagcaatcttgtttgtcactccacgtgagcgtcgcatgttgcgttccatcgagcgcgccaccaacgcaaagctgatcgaaatggatctgcctaccgttgatgaggtcaatgagtcccgcaaggcaaagtttgctgactccatcaccgagtctcttgaagacgatcaggtagcaatcttccgtagcctgattaagtcctacgcggaagagcacgatgttccactagaagacatcgccgccgcattggctacccaggcacgcgctggttccgaattcttgatgaaggagccaccaccagagaagcgccgcgagcgtcgtgaccgcgacgatcgtcgtggcggacgcgaccgcttcgaccgcgatgaccgacgtggcggccgtgaccgtggctcccgcttcgagcgtaacgacgacatgcagctctaccgcctagcagttggtaagcgccagcatgttcgccctggtgccatcgttggtgctctggcaaacgaaggtggcctgtccaacaaggacttcgggcgcatcaacatcttcgttgatcacaccttggtcgagttgccaaagaacatggatccaagcgtgatcgatcgcctcagcgatacccgtatctccggccaattgatccacatcgaaaaggacaatggccgaccaccacgtcgtaacgacgacggtgaccgcggcggataccgtggcggcgaccgcttcgaccgtgacgatcgtcgtggtggacgtggcggacgcgaccgcggcggataccgtggcggacgtgaccgcaacgaccgtggtgatcgcggtggctaccgtggtggccgcggcggataccgcgactaa

SEQ ID NO: 79585 - protein, 680 aa, Corynebacterium diphtheriae NCTC 13129
MSITDNATSGENELDIKILSESQDNSQVDEGTTINNDVVADVDDSRVANTSEATDSAQQEADSAEKDGFEALGLPDAILKAVAKVGFETPSPIQAQTIPVLMQGHDVMGLAQTGTGKTAAFALPILSRIDVKKRHPQALILAPTRELALQVADSFQSFADHLGDIHVLPIYGGQAYGIQLSGLRRGAQIIVGTPGRVIDHLEKGSLDISNLRFLVLDEADEMLNMGFQEDVERILEDTPEDKQVALFSATMPNGIRRLSRDYMKDPHEIQVKSQTRTNTNITQRYLNVAHRNKLDALTRILEVTEFEAMIMFVRTKHETEEVAEKLRARGFSAAAINGDIAQAQRERTVDQLKDGRLDILVATDVAARGLDVERITHVFNYDIPNDTESYVHRIGRTGRAGRSGEAILFVTPRERRMLRSIERATNAKLIEMDLPTVDEVNESRKAKFADSITESLEDDQVAIFRSLIKSYAEEHDVPLEDIAAALATQARAGSEFLMKEPPPEKRRERRDRDDRRGGRDRFDRDDRRGGRDRGSRFERNDDMQLYRLAVGKRQHVRPGAIVGALANEGGLSNKDFGRINIFVDHTLVELPKNMDPSVIDRLSDTRISGQLIHIEKDNGRPPRRNDDGDRGGYRGGDRFDRDDRRGGRGGRDRGGYRGGRDRNDRGDRGGYRGGRGGYRD

SEQ ID NO: 79586 - DNA, 1419 bp, Rhodopseudomonas palustris CGA009
  CDS (1)..(1419): transl_table=11
atgtctttttccaatctgggactttccgagaaagtccaagccgccgtcgccgccgccggttacgtttcgcccactcccattcagcagcaggcgatcccccacgtcctcgcccgcaaggacgtcctcggcatcgcccagaccggcaccggtaagaccgccgcgttcgtgctgccgatgctgacgatgctggaaaagggccgcgcccgggctcgcatgccccgcacactgatcctcgaaccgacccgcgaactcgccgcccaggtcaaagagcagttcgacaaatacggcgccggacagaagctcaacgtcgccctgctgatcggcggtgtctcgttcggtgaccaggacctcaagctcacccgcggcgtggatgtcctgatcgccaccccgggccgcctgctcgaccacaccgaacgcggcggcctgctgctcaccggcgtcgagatgctgatcatcgacgaagccgaccggatgctcgacatgggtttcatcccggacatcgagcggatctgcaagctggttccctttacccggcagaccctgttcttcaccgcgacgatgccgaccgaaatccggcgcatcaccgagaccttcctgcacaatcccgaaaagatcgaggtcagcaagccggcctccaccgcggtgacggtgacccagtcgcaggtgccgtgcggccgcgagccgcacgagaagcgcgagacgctgcgccggctgatccgcggcgccaccgacctcaagaacgcgatcatcttctgcaaccggaagcgcgaagtcgcgctgctggcgaagtcgctgcagcgccacggcttcagcgtcggcgcgctgcacggcgacatggaccagaccgcgcggacggccgcgctcgaagcgttccgcaaaggtgacctgccgatcctggtcgcttccgacgtcgccgctcgcggcctcgatattccggaagtgagccacgtcttcaacttcgacgtcccgcatcaccccgacgactacgtgcatcggatcggccgcaccggccgcgccggccgcaccggcaccgcggtgacgatcgtcgcgccgtccgaccagaagtcgatggccgcggtcgagaagctgatcggccaggcgatatcccgggccgaagtcggtccgtcggtcgagagcgaggctgccaacaccgaggccgaggccgagcgtccgtcacgctcccgccgcgccgcgccggaagcccgtcagcgcgaaccgcgccgcgagccgcgcgaacagcgcgagcgcaagccgcgccgcgagccccgcagccccgcaagcaccacaggcaccacagcgccccccaccgcccacgcctccttcggctccccccctcccgctcgcgacacgtcgtcggaggcgggggatcattcgcatttgccggcgtttctgttgcgcccggtgcgcgcgcggggctga

SEQ ID NO: 79587 - protein, 472 aa, Rhodopseudomonas palustris CGA009
MSFSNLGLSEKVQAAVAAAGYVSPTPIQQQAIPHVLARKDVLGIAQTGTGKTAAFVLPMLTMLEKGRARARMPRTLILEPTRELAAQVKEQFDKYGAGQKLNVALLIGGVSFGDQDLKLTRGVDVLIATPGRLLDHTERGGLLLTGVEMLIIDEADRMLDMGFIPDIERICKLVPFTRQTLFFTATMPTEIRRITETFLHNPEKIEVSKPASTAVTVTQSQVPCGREPHEKRETLRRLIRGATDLKNAIIFCNRKREVALLAKSLQRHGFSVGALHGDMDQTARTAALEAFRKGDLPILVASDVAARGLDIPEVSHVFNFDVPHHPDDYVHRIGRTGRAGRTGTAVTIVAPSDQKSMAAVEKLIGQAISRAEVGPSVESEAANTEAEAERPSRSRRAAPEARQREPRREPREQRERKPRREPRSPASTTGTTAPPTAHASFGSPPPARDTSSEAGDHSHLPAFLLRPVRARG

SEQ ID NO: 79588 - DNA, 1425 bp, Rhodopseudomonas palustris CGA009; identical to SEQ ID NO: 38671
  CDS (1)..(1425): transl_table=11

SEQ ID NO: 79589 - protein, 474 aa, Rhodopseudomonas palustris CGA009; identical to SEQ ID NO: 38672

SEQ ID NO: 79590 - DNA, 1353 bp, Geobacter sulfurreducens PCA; identical to SEQ ID NO: 38679
  CDS (1)..(1353): transl_table=11

SEQ ID NO: 79591 - protein, 450 aa, Geobacter sulfurreducens PCA; identical to SEQ ID NO: 38680

SEQ ID NO: 79592 - DNA, 1344 bp, Geobacter sulfurreducens PCA
  CDS (1)..(1344): transl_table=11
atggatttcaaatcgttcggttttcatccggccgtggccacgggaatcgcggcggccggctacgaaacccccacaccgatccaggcccaggccatccccgcggtcatggcggggcgcgacgtcatggggttggcccagaccggcaccggcaagacagcggcctttgccctgccgatcctgcatcgcctgcaacagggcgagcgtggccgcgtccgtgccctggtcatcgcccccacccgcgagcttgcggagcagatcaacgacagcttcgtcaccctggggcggcagacccgcctgcggagcgtgacggtctacggcggggtaggggtgaatccccaggtgcagaagctcaaggccggcgccgaagtggtcgtggcctgcccgggtcggctcctggaccacatcgcccaggggaccatcgacctgtcgcgcctggaggtgctcgtcctggacgaggcggaccagatgttcgacatgggctttctgcccgacatccgacgggtgctcaagcatcttcccccccggcggcagacgctgctcttctcggccaccatgcccatcgacatccgcacgctggcccaggatattctggtggacccggtgacggtgcaggtggggaccgtggccccggcggtcaccgtcgcccacgccctctacccggtggaacagcacctgaagaccccgcttctgctggagcttcttcgccacacggacactgagtcggtgctgattttcacgcgcaccaagcaccgggccaagcgcctgggtgaacagttggagaaggccggctaccgggcggcctcgcttcaggggaatctctcccagaaccggcggcaggctgcccttgatggcttccgtgacggcacgttccagatcctggtggccaccgatatcgcggcccgcggcatcgacgtgagccaggtgtcccacgtgatcaactatgacatccccgacacggcagaggcgtacatccaccgtatcggccgcaccggccgcgcggcccgcagcggagacgccttcaccctggtgacctctgacgacggagccatggttcgtgccatcgaacggagcctcggtgcccccatcgagcgccgcaccgtgcagggctttgactactcggtgccggcgccgaaaaaggatgtggagtttgcccgtccgccccgtgagccgcgccaggcccgaccccacgcaaaccagccgaagaaagggggcgcagcggcatccccctcggcgtctggacggccgtcccatcccaaggactcgggccggcggcagccgggccaaggagctcccgcgtcgggtccgtcgcggcaacggcccggaagcccccggcggccccgctga

SEQ ID NO: 79593 - protein, 447 aa, Geobacter sulfurreducens PCA
MDFKSFGFHPAVATGIAAAGYETPTPIQAQAIPAVMAGRDVMGLAQTGTGKTAAFALPILHRLQQGERGRVRALVIAPTRELAEQINDSFVTLGRQTRLRSVTVYGGVGVNPQVQKLKAGAEVVVACPGRLLDHIAQGTIDLSRLEVLVLDEADQMFDMGFLPDIRRVLKHLPPRRQTLLFSATMPIDIRTLAQDILVDPVTVQVGTVAPAVTVAHALYPVEQHLKTPLLLELLRHTDTESVLIFTRTKHRAKRLGEQLEKAGYRAASLQGNLSQNRRQAALDGFRDGTFQILVATDIAARGIDVSQVSHVINYDIPDTAEAYIHRIGRTGRAARSGDAFTLVTSDDGAMVRAIERSLGAPIERRTVQGFDYSVPAPKKDVEFARPPREPRQARPHANQPKKGGAAASPSASGRPSHPKDSGRRQPGQGAPASGPSRQRPGSPRRPR

SEQ ID NO: 79594 - DNA, 1701 bp, Mycobacterium avium subsp. paratuberculosis str. k10
  CDS (1)..(1701): transl_table=11
atgaccctcccggacagctcgactgaggctgcctccccgacatttgccgacctgcagatccatccctcggttttgcgggcgatcgccgacgtcggctacgagacgcccaccggcatccaggccgcgaccatcccggcgttgatggccggttccgacgtcgtcgggctggcccagaccggcaccggcaagacggccgcgttcgcgatcccgatcctgtccaagatcgacgccgccagcaccgccacccaggcgctggtgctggcgcccacccgggagctggcgttgcaggtggccgaggcgttcagccgctacggcgcgcatctgccgaagatcaacgtgctgccgatctacggcggctcgtcctacgccgtgcagctggccggattgaaacgcggcgcccacgtggtggtcggcacgccgggccgggtgatcgaccacctcgagcgcggcacgctggacctgtcgcacgtcgactacctggtgctcgacgaggccgacgagatgctcaccatggggtttgccgaagaggtcgaccgcatcctgtccgagaccccggaatacaagcaggtcgcgctgttctcggcgaccatgccgcccgcgatccgcaagctcaccgccaagtatctgcacgatcccctcgaggtcagcaccaaagcgaaaaccacgaccgccgagaacatttcgcagcgctacatccaggtcgccggcccgcgcaaaatggacgcgctgacccgggtgctggaggtcgagccgttcgaggcgatgatcgtgttcgtccggaccaaacaggccaccgaggaagtcgccgaaaggctcagggcgcgcggcttctcggcggccgcgatcaacggggacatcccgcagggccagcgtgagcggaccgtcgccgccctcaaggacggcggcatcgacatcctggtcgccaccgacgtagccgcccgcggcctggacgtcgaacggatctcacacgtgctcaactacgacatcccgcacgacaccgagtcctacgtgcaccggatcggacgcaccggccgggcgggacgctcgggaaccgcgctgctgttcgtctccccgcgagaacgccacctgctcaaggccattgagaaggcgacccgccagccgctcaccgaagccgagctgcccaccgtcgaggacgtcaacgcccagcgggtggccaagttcgccgactccatcaccgccgcgctcggcgctcccggcatcgatctgttccgcaagttggttcaggactacgaacgcgagcacgacgtcccgatggccgatatcgccgccgcgctggccgtgcagtcacgcgacggcgaggagttcctgatggcgcccgaaccgccgcgggagcgacgcgaacggcacaccgaacggcgcgagcgcaccgagaaacccaggagcacaaggccgttggccacctaccgcatcgcggtgggcaaacggcacaagatcggtccgggcgcgatcgtgggcgccatcgccaacgagggcgggctgcatcgcagcgatttcggccacatcgccatcggacccggcttctcgctggtggagttgccggccaagctgcccaagtcgacgctgaaaaggcttgagcagacccgcatctccggagtgctgatcaacctccagccggaccgggcggcggccaaggcgcgcggtcgggacggcgggaaaccacgcaggaaatacggcggatga

SEQ ID NO: 79595 - protein, 566 aa, Mycobacterium avium subsp. paratuberculosis str. k10
MTLPDSSTEAASPTFADLQIHPSVLRAIADVGYETPTGIQAATIPALMAGSDVVGLAQTGTGKTAAFAIPILSKIDAASTATQALVLAPTRELALQVAEAFSRYGAHLPKINVLPIYGGSSYAVQLAGLKRGAHVVVGTPGRVIDHLERGTLDLSHVDYLVLDEADEMLTMGFAEEVDRILSETPEYKQVALFSATMPPAIRKLTAKYLHDPLEVSTKAKTTTAENISQRYIQVAGPRKMDALTRVLEVEPFEAMIVFVRTKQATEEVAERLRARGFSAAAINGDIPQGQRERTVAALKDGGIDILVATDVAARGLDVERISHVLNYDIPHDTESYVHRIGRTGRAGRSGTALLFVSPRERHLLKAIEKATRQPLTEAELPTVEDVNAQRVAKFADSITAALGAPGIDLFRKLVQDYEREHDVPMADIAAALAVQSRDGEEFLMAPEPPRERRERHTERRERTEKPRSTRPLATYRIAVGKRHKIGPGAIVGAIANEGGLHRSDFGHIAIGPGFSLVELPAKLPKSTLKRLEQTRISGVLINLQPDRAAAKARGRDGGKPRRKYGG

SEQ ID NO: 79596 - DNA, 1455 bp, Lactobacillus johnsonii NCC 533; identical to SEQ ID NO: 38681
  CDS (1)..(1455): transl_table=11

SEQ ID NO: 79597 - protein, 484 aa, Lactobacillus johnsonii NCC 533; identical to SEQ ID NO: 38682

SEQ ID NO: 79598 - DNA, 1518 bp, Bdellovibrio bacteriovorus HD100; identical to SEQ ID NO: 38685
  CDS (1)..(1518): transl_table=11

SEQ ID NO: 79599 - protein, 505 aa, Bdellovibrio bacteriovorus HD100; identical to SEQ ID NO: 38686

SEQ ID NO: 79600 - DNA, 1578 bp, Bacillus cereus ATCC 10987
  CDS (1)..(1578): transl_table=11
ttgacaacatttcgagaattaggattaagtgattctttactgcaatctgttgaaagtatgggctttgaagaggctacgccaattcaagctgaaacaattccacatgcattgcaaggtaaggatattattgggcaagcacaaacaggtacagggaaaacagcagcattcggattaccactattagataaagtggatacacataaagaatcggttcaaggtattgttatcgcgccaacgcgtgaattagcaattcaagttggagaagagctatacaaaattggtaaacataaacgcgttcgtatcttaccaatttacggtggtcaagatattaaccgccaaattcgtgctctaaaaaaacacccacacattattgttggtacgccgggtcgtattttagatcatattaaccgtaaaacacttcgcttacaaaacgtagagacagttgttcttgacgaagcggatgaaatgttaaacatgggcttcattgaagatattgaagcaattttaacagatgtgccagaaacacaccaaacattactattctcagcgacaatgccggatccaatccgtcgtattgctgagcgtttcatgactgagcctcaacacattaaagtaaaagcaaaagaagtaacaatgccaaacattcagcagttctatttagaagtgcaagaaaagaaaaagtttgatgtattgacacgcttattagacattcaatctccagagcttgcgattgtattcggtcgtacaaagcgtcgtgttgatgaattatcagaagcattaaatttacgtggttatgctgcggaaggtatccacggtgatttaactcaggcgaaacgtatgtctgtattacgtaagttcaaagaaggttctattgaagttcttgttgcaacagacgttgctgcgcgtggtcttgatatttcaggtgtaacacacgtatacaacttcgatattccacaagatccagaatcatacgttcaccgtattggacgtactggtcgtgcaggtaaaaaaggtattgcaatgctatttgtaacaccacgtgaatccggacaattaaaaaatatcgagcgtacaacaaaacgtaaaatggaccgcatggatgcaccaacacttgacgaggcactagaaggtcaacaacgtttaatcgctgaaaaacttcaaaacacaattgaaaatgaaaacttagcatactacaagcgtattgcggaagaaatgttagaagagaacgactctgtaacagtagtagctgctgctttaaaaatgatgacaaaagagccagatacaactccaatcgctttaacatcagaaccaccagttgttgcaagaggtgggggttctaaaaaacgcggcggtaacggaggcggataccgtgatggtaaccgtaatcgtagtcgtgatggacgcggtggcgatggtcgtaaccgtgaccgcaatcgtgatggtcgtaatcgtgacggtaaccgtgatcgcaatcgtgatggcggcaaccgtggtcgtcgtggagaaggtcaaggtcgcccaggatcttcaaacggacgcggtgaaagaaaacatcatagccgtaagccacaagcttaa

SEQ ID NO: 79601 - protein, 525 aa, Bacillus cereus ATCC 10987
MTTFRELGLSDSLLQSVESMGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQNTIENENLAYYKRIAEEMLEENDSVTVVAAALKMMTKEPDTTPIALTSEPPVVARGGGSKKRGGNGGGYRDGNRNRSRDGRGGDGRNRDRNRDGRNRDGNRDRNRDGGNRGRRGEGQGRPGSSNGRGERKHHSRKPQA

SEQ ID NO: 79602 - DNA, 2484 bp, Anopheles gambiae str. PEST
  CDS (1)..(2484)
atgaagctaacccaccagctggatttcatgaaaaccctcgaggacgatgcggaggtggaggacttatccgaggagtcggaaacggagatcgaataccaaccgaccaagcagaaaaaccaaaagctgaccgatttcgacggcggcttccagtttgtgtcgtcggtgaaggagtacaaccacgacacctgggacgatttgatgaagtttgtcaagcggaagaaccgtggcgaggtgaacgacaagattgccaacgtcatacgggaccgtacgaaggagaatgcggacgcgctgaaggacgacgatgaggaggacgacgaggatggcaatcgggcgtacaacgaggaggtggatctgtccgacgacgagctgaagcacgattacatgcgggtgaaggagcgcaagggcaaaaaactaaccgaagcggaaaacggtggcccgacggtcgaggtgaaggaggacacggaggacgggacgaaggaggactacttcgaggagatagaggaaaatgcgaacggcgagatccaatcgttctaccagatggatctgtcccggccgctcatgaaagcgatcggggcgcttggctacatctaccctaccccgatccaggcatcgaccataccaatcgcgctgatgggtcgggacatctgtgggtgtgcggccaccggcacgggcaagacggcagcctacatgctgcccacgatcgagcgtctgctgtacaaaccgaacgtggcgcaggcggtgacgcgtgtgctggtcctggtgccgacccgtgaactgggcgcgcaggtgtaccaggtggcgaaacagctaacacagtttaccaacgtggacgtcggcattgcgatcggtgggctggacgtgaaggcgcaggaagcggtgctgcgcaaaaacccggacgtcgtgatagcgacgccgggtcggctgattgatcacatcaagaatacgccgagcttttcgctggattccattgagatcctgattctcgacgaagctgaccgtatgctggacgagtacttcgcggaacagatgaaggaaattatacgcagctgctcggccacgcgccaaacgatgctgttctcggccaccatgacggaggaggtgaaagatttggcggccgtttcgctcaagaagccggtcaaaatcttcgtcaacaacaaccagacggtcgcgttcaacctgcggcaggagtttatccgcattcgcgagggccgggaagcggaccgggaagcgatactggccgcgctggtgtgccgcaccttccacgaccactgcatggtgtttgtgcagacgaagcgcactgcccaccgattgcgcatactgctcgggctgctcggcgtcaagacgggcgagctgcacggcgacctgacccaggcgcagcggctcgagtcgctgaaggagttcaaggacgagcaggtggacatactgatcgcgaccgacgtggcggcccgtggcctggacattagcaccgtcaagacggtcatcaacttcgtcatgccggccacgctggaacactacatccatcgggtcggccgtactgcccgtgccgggaaggcgggcgtgtcggtgtcgctggccggcgagcaggagcgcaaaatcgtgaaggaaatcgtgaagaacgcggtcagctcggtgaagaaccgcatcatcccgctggacattatcgagaagtaccggaacaaggtggccgccctcgagccggaaatcgatcgcgtgctggcggaggagcgggcggaaaagttgctgcgccagacggagcagcagctgaccagtgccgagcggaagttgctcggtaacgcgggcaaggcggcgaaacaggacgttccgccgccgagggagtggttccagacgcagcacgagcggcgggaggaaaagaaccggctggcgggtgaggagcagggcgagaaaaagaaggcggccaagaagcggaagcgccgcgatgacgacgatgaggaagatttcgacccggtacggtaccacgaggagaagaggaagcagcagaaagcggctgctggtggtggtggtgctgttaatggcaagaagaaatctaaggccgatgcgaacgcggacgcaaacaagacagcgaaacagttggcacgcgagcgagcgctcgaggaggtgcgcaaggtgtcgatggtgcaggccaagctggccaagatacgcaaccgtccggggcgcgtgaacgcagcggaagaggagcatggcaacgggccggctgatgggcgtgctggtggaaagagtaacaagaagcgcagcaagaacttctcgcgcttcgagcacgacctgaccgatgtgggcagcaagaacgtgaagaagctgcggtacgatgcgagcaagaagcagcgcatggacaagctggacaagcgcaagcagagcggcatgaagatgagcacggaaaagctgcgcaacaagcacgggctgaacaagcagaccaagggcaaatcgttcggacagaaagcgccgagaaggaaaccgaccgatggctag

SEQ ID NO: 79603 - protein, 827 aa, Anopheles gambiae str. PEST
MKLTHQLDFMKTLEDDAEVEDLSEESETEIEYQPTKQKNQKLTDFDGGFQFVSSVKEYNHDTWDDLMKFVKRKNRGEVNDKIANVIRDRTKENADALKDDDEEDDEDGNRAYNEEVDLSDDELKHDYMRVKERKGKKLTEAENGGPTVEVKEDTEDGTKEDYFEEIEENANGEIQSFYQMDLSRPLMKAIGALGYIYPTPIQASTIPIALMGRDICGCAATGTGKTAAYMLPTIERLLYKPNVAQAVTRVLVLVPTRELGAQVYQVAKQLTQFTNVDVGIAIGGLDVKAQEAVLRKNPDVVIATPGRLIDHIKNTPSFSLDSIEILILDEADRMLDEYFAEQMKEIIRSCSATRQTMLFSATMTEEVKDLAAVSLKKPVKIFVNNNQTVAFNLRQEFIRIREGREADREAILAALVCRTFHDHCMVFVQTKRTAHRLRILLGLLGVKTGELHGDLTQAQRLESLKEFKDEQVDILIATDVAARGLDISTVKTVINFVMPATLEHYIHRVGRTARAGKAGVSVSLAGEQERKIVKEIVKNAVSSVKNRIIPLDIIEKYRNKVAALEPEIDRVLAEERAEKLLRQTEQQLTSAERKLLGNAGKAAKQDVPPPREWFQTQHERREEKNRLAGEEQGEKKKAAKKRKRRDDDDEEDFDPVRYHEEKRKQQKAAAGGGGAVNGKKKSKADANADANKTAKQLARERALEEVRKVSMVQAKLAKIRNRPGRVNAAEEEHGNGPADGRAGGKSNKKRSKNFSRFEHDLTDVGSKNVKKLRYDASKKQRMDKLDKRKQSGMKMSTEKLRNKHGLNKQTKGKSFGQKAPRRKPTDG

SEQ ID NO: 79604 - DNA, 1389 bp, Desulfovibrio vulgaris subsp. vulgaris str. Hildenborough
  CDS (1)..(1389): transl_table=11
gtgactttcgcagacctctccctctctccccggttgctcgccgcgctcgacggcatgggctatcgccagcccacacccgtccagcgtggggccatcccgcccgccttggcgggagaggatgtactggcccttgccgcgacgggaacgggcaagacggcggcattcgtgctgcccatgctgcagcggctcatggatggtccgagaggggcggtgcgcgccctcgtcgtggcccctacgcgtgagcttgcggaacagacccatgaccatgtgcggcgtctcggttcgatgtcgcgcctgcgtagcacgaccatctacggaggcgtgggcgtcgtggcgcaggccttgcggctgcgggccggggtcgaggtggtggtggggtgccccggcaggcttctcgatcatatccggcgtggcaaccttgatctttcgtcccttgaggtcctggtgcttgacgagggcgattccctcttcgacctcggttttctggcggatgtgaggatgctgcttggcatggtgcccgcgacctgccagcggatgctcttttccgcgaccatgcccgacgccgtgcgcgtccttgccgccgaggcgctacgtcagcctgtgacggtgcaggtggacgccgtgcaacccgcatccaccgtgcatcatgccctgtaccccgtgccagcccatttgcggacgcccctgctcaagacgtttttgcgaagcgggcccgaggggtctgtcgttgtcttcgtgcgtacccgccacggggcacgcagactctggcagcaactcgacaacgtggggttcagcgtcacctgccttcaggggaagttgtcgcaacgacggcgacttgccgcgctcgagggcttccgcgacgggcgctacgacgtgctggtggccaccgatgtggcggcacgcgggctggacatctcgcaggtgacgcatgtggtgaactacgatgtgccgtcgacggccgacgcctatatccacagggtggggcgcacagggcgtgctgcccgcaatggaacggccatgacctttgtcaccccggcggatgaggcgcaggtgcggaacatcgaacgggtactgggcaccgtcatcccgcgcgagaggcttgccgatttcgattatggcgcgcctgtgcgcgggccggagggggcgcgtccggccatgcctccccgccagccgcgactgccagcaggcaaacgtccggctgcaccgcaagaggcgcaggaacagccgcgccgcgggcgtccgcgtccgccccgtcatgccgtgcccccggcggcacaccccccgacgattccctcgcgtctcccacgacagacgcctgcgggtgcggaacaggtcgacctcgtcagaagttcccggatgcgggggcagggcggtgattcagacgaatag

SEQ ID NO: 79605 - protein, 462 aa, Desulfovibrio vulgaris subsp. vulgaris str. Hildenborough
MTFADLSLSPRLLAALDGMGYRQPTPVQRGAIPPALAGEDVLALAATGTGKTAAFVLPMLQRLMDGPRGAVRALVVAPTRELAEQTHDHVRRLGSMSRLRSTTIYGGVGVVAQALRLRAGVEVVVGCPGRLLDHIRRGNLDLSSLEVLVLDEGDSLFDLGFLADVRMLLGMVPATCQRMLFSATMPDAVRVLAAEALRQPVTVQVDAVQPASTVHHALYPVPAHLRTPLLKTFLRSGPEGSVVVFVRTRHGARRLWQQLDNVGFSVTCLQGKLSQRRRLAALEGFRDGRYDVLVATDVAARGLDISQVTHVVNYDVPSTADAYIHRVGRTGRAARNGTAMTFVTPADEAQVRNIERVLGTVIPRERLADFDYGAPVRGPEGARPAMPPRQPRLPAGKRPAAPQEAQEQPRRGRPRPPRHAVPPAAHPPTIPSRLPRQTPAGAEQVDLVRSSRMRGQGGDSDE

SEQ ID NO: 79606 - DNA, 1560 bp, Listeria monocytogenes str. 4b F2365
  CDS (1)..(1560): transl_table=11
atgacattgacaaaattttcggagttcggactggacgaaaaaattgtaaaatcagtaaatcggatggggtttgaagaagcaacaccaatccaagaaaagacaattccactaggactagcaggtaaagacttaatcgggcaagcacaaacaggtactggtaaaacagccgcttttggtcttccaatgattcacaaaattgaccaaaagagtaacaacgtacaagctttaattattgctccaacacgtgaacttgcaatccaagtttctgaagagctttataaacttagctatgacaaacatgtacgtgtgctagcggtttacggtggtagcgatatcagccgtcaaatccgttcacttaagaaaaacccacaaatcgtagttggtacgccaggacgtattttggatcatattaaccgtcgcacactgaaactagaccacgtggaaacacttgtactagatgaagcagacgaaatgctaaacatgggcttcattgatgatatcgaaactattctaaaagaagtaccagcagaacgtcaaactttactattttctgcaacaatgcctgatccaattcgccgtatcggtgaacgtttcatgcatagcccagaacttattcgcattaaagcgaaagaaatgactgcactattaattgaacaattcttcgtaaaagtgcatgaaaaagaaaaatttgacgtattatctcgtttattagacgttcaagcaccggaactagctattgttttcggtcgtacgaaacgtcgtgtagacgaactatctcgcgcgcttgatatgcgtggttacgtggctgaaggtatccacggtgacttgacgcaagcaaaacgtatgagtgtactacgcaaatttaaagaaggaaaaattgatgttctagttgcaacagacgtagcagctcgtggacttgatatttccggcgtaacacatgtatataactatgatattccacaagatccagaaagctatgttcaccgtatcggtcgtactggtcgtgctggtaaagaaggtatggcgattactttcgtacaacctcgtgaaatgggttatttacgtattgtggaagaaactacgaaaaaacgtatgcaaccacttcaagctcctacttgggacgaagcatttgcaggccaattacgcgtagcaactgaaaaaattcaagaagcaatcacagaagaaaacttagctgactacaaaacgtttgctaacgaacttcttgaaaaatacgatgcaactgacatcgcagcagcaatgcttaaaatgttagcgaaagagccagacaaaactcctgtccatattactgaagagcgtccattaccatcccgtggtggcggtggctacaaaggtaaaaatggtaaaggcggcaaaggtggcggctatcgcggcggaagcggcaaaggcggaagctaccgcgatcgtaacaacagcggcaaaggtcgtcgtagcggcggcggaagcggttctggcggtggtggcaatcgtgatcgtcgtagtggcggcggagaacaacgcagcggcggcaacaaaggcaactactcacaaaaatctaaataa

SEQ ID NO: 79607 - protein, 519 aa, Listeria monocytogenes str. 4b F2365
MTLTKFSEFGLDEKIVKSVNRMGFEEATPIQEKTIPLGLAGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGSGGGGNRDRRSGGGEQRSGGNKGNYSQKSK

SEQ ID NO: 79608 - DNA, 1383 bp, Bartonella henselae str. Houston-1
  CDS (1)..(1383): transl_table=11
ttgaacgtaaatagagaaaatattttcacaaaattaggcttatctgctcttttggttaaaaacttgaccattgctggtatgagtaaacctaaacctattcaagaacaagctattccaatgatgcttaaaggccatgatattctgggaattgcacagacaggttctggaaagaccttggcatttagtttacctattttaagtcagattttggctttgggtgataagcgttttcctaaaactgcacgcgctttgattttagctcctacgcgtgagcttgctgttcagattgatgaaacaattcgtgcagttgcgaaaggaacacacctttcaacatgtctcatttttggtggggtatcacgtttgaaacaaattaaacgcatggaagcaggtgtggatattttgatagcaacgccaggtcgtttaagggatcttattcgtgaaaaatacgttgatctttctcaatcacgttttttgattctggatgaggcagatcgtatgttagatatgggctttattcatgatatacggcatattgtaaaacttttgcatcaagtacgtcaaaccgcacttttttctgcgacaatgccgaaggaaattaccacacttgcaaagtgtctgctcaatgatccagtaaaaatagaggtttctcctcaagggactacggctgcggaaattgctcaaaaattatattgtgttcctacatgtgaaaaaaagaatgttttaggtaagcttttgacaaatccagattttgtttcggttattgtttttactcgaaccaaatactgtgctgatgctgtcacgcggaatttagcaagtagaggatattctgttgcgacaattcatggaaataaatcacaaagtgctcggcagtctgcattgaaagcttttcgtgaaagatcagtacggattcttgttgcaacagatattgcagcgcgtggtattgatataccaggcataagccacgttattaattacgatttaccagatgaagctgaaagttatgtgcatcgtattggtcgcacaggacgcaatggcgcatctggtgaggcactaacactttttgatgaaggtgtggagcagatgcggttgcgtgctgtagagcgcttgatttgtatgagattggtgcgtgaaactataccagaacagtttgctgcttttccagaaaagcctcttgtgatagaagggatagaaaaagaaaacattaagggacctcattttagaaaatctaagcgtcagaaatggtttaagagtcacaaagataatgcagcacagtcagagggaagaaagtcttcgtctcaaagtgaaagacacagaaaagcaaaagcaatagcaaaacgtgcgaagtcttttcattctcgcaagtcagtaaacaaggtagcttga

SEQ ID NO: 79609 - protein, 460 aa, Bartonella henselae str. Houston-1
MNVNRENIFTKLGLSALLVKNLTIAGMSKPKPIQEQAIPMMLKGHDILGIAQTGSGKTLAFSLPILSQILALGDKRFPKTARALILAPTRELAVQIDETIRAVAKGTHLSTCLIFGGVSRLKQIKRMEAGVDILIATPGRLRDLIREKYVDLSQSRFLILDEADRMLDMGFIHDIRHIVKLLHQVRQTALFSATMPKEITTLAKCLLNDPVKIEVSPQGTTAAEIAQKLYCVPTCEKKNVLGKLLTNPDFVSVIVFTRTKYCADAVTRNLASRGYSVATIHGNKSQSARQSALKAFRERSVRILVATDIAARGIDIPGISHVINYDLPDEAESYVHRIGRTGRNGASGEALTLFDEGVEQMRLRAVERLICMRLVRETIPEQFAAFPEKPLVIEGIEKENIKGPHFRKSKRQKWFKSHKDNAAQSEGRKSSSQSERHRKAKAIAKRAKSFHSRKSVNKVA

SEQ ID NO: 79610 - DNA, 1923 bp, Acinetobacter sp. ADP1; identical to SEQ ID NO: 38785
  CDS (1)..(1923): transl_table=11

SEQ ID NO: 79611 - protein, 640 aa, Acinetobacter sp. ADP1; identical to SEQ ID NO: 38786

SEQ ID NO: 79612 - DNA, 1914 bp, Erwinia carotovora subsp. atroseptica SCRI1043; identical to SEQ ID NO: 38787
  CDS (1)..(1914)

SEQ ID NO: 79613 - protein, 637 aa, Erwinia carotovora subsp. atroseptica SCRI1043; identical to SEQ ID NO: 38788

SEQ ID NO: 79614 - DNA, 1452 bp, Erwinia carotovora subsp. atroseptica SCRI1043
  CDS (1)..(1452)
atgtcatttgattctctcggcctgagtgccgatattctgcgcgcgattgaagagcagggttatcgcgatcctacccccgttcagcgtcaggcaattcctgtcgtgttggaagggcgcgatttaatggccagtgcccaaacgggtacgggtaaaacggcgggctttacgctgccgttattgcaactgctgacgagtcgcgaagcgcagaataaagggaaagggcgccgtccagtacgggcgctgatcctgacgccgacccgtgaactggcggcacagattgatgagaacgtgaaggcgtatagcaaatatttaccccttcgttcactggttgtattcggcggcgtgagcatcaacccgcagatgatgaagttgcgtggcggcgtggatattctggtggcgacgccgggacgtctgctcgatctggaacatcagcgtgctgttgacctgtctcagatcgaaattctggtgctggatgaagcagaccggatgctggatatgggcttcattcacgatattcgccgtgtactggcgaagctgcctgctaaacgccaaaacctgctgttctccgccactttctctgatgagatcaaagcgctggcgaacaaactgttgaccaatccggcttcggtcgaagtcgtgcgtcgtaattctccgtctgaactggtcacgcagaatgtgcattttgttgataagcgccgcaagcgtgaactgctatcgcagctaattggtgaaaataactggcagcaggtactggtctttacccgtaccaagcacggggctaaccacttggctgagctgttggaaaaagacggtatcaccgctgcggctatccacggtaataaaagtcagggtgcgcgtactcgcgcgctggccaacttcaaggacggcggcatccgtgtgctggtcgcgacagatatcgccgcgcgtggtctggatatcgaccagttgccgcacgttgtgaactatgaactgccgaacgtgccggaagattacgttcaccgtatcggccgtaccggtcgtgcagaagcgacgggcgaagcgctgtcgctggtgtgtgtggatgaacacaagctgctgcgtgacatcgaacgtctgctgaagcgtgagattccgcgtatcgctattgaaggctacgagccggatccgtccatcaaggcagaaccgattgtgaatggccgtcagggcagccgtggtggtggtagtggtggtgcgcgtagtgcgtctcctcgtgcaccgtctggcgcaccacgcggtcagtccgaacgcagcgaacgtagtcaaggtcagggcgagcgccgttcagccgatgctaatcgtcagccgcgtaaaccgagcggtaatagcgatagcccatggggtactggcggaaaagggaatagtggcaagggcagtggcgaaggacaacgccgcgcaccgcgaccgcaaaaccgcagcaagccagcggacaagtaa

SEQ ID NO: 79615 - protein, 483 aa, Erwinia carotovora subsp. atroseptica SCRI1043
MSFDSLGLSADILRAIEEQGYRDPTPVQRQAIPVVLEGRDLMASAQTGTGKTAGFTLPLLQLLTSREAQNKGKGRRPVRALILTPTRELAAQIDENVKAYSKYLPLRSLVVFGGVSINPQMMKLRGGVDILVATPGRLLDLEHQRAVDLSQIEILVLDEADRMLDMGFIHDIRRVLAKLPAKRQNLLFSATFSDEIKALANKLLTNPASVEVVRRNSPSELVTQNVHFVDKRRKRELLSQLIGENNWQQVLVFTRTKHGANHLAELLEKDGITAAAIHGNKSQGARTRALANFKDGGIRVLVATDIAARGLDIDQLPHVVNYELPNVPEDYVHRIGRTGRAEATGEALSLVCVDEHKLLRDIERLLKREIPRIAIEGYEPDPSIKAEPIVNGRQGSRGGGSGGARSASPRAPSGAPRGQSERSERSQGQGERRSADANRQPRKPSGNSDSPWGTGGKGNSGKGSGEGQRRAPRPQNRSKPADK

SEQ ID NO: 79616 - DNA, 1326 bp, Erwinia carotovora subsp. atroseptica SCRI1043
  CDS (1)..(1326)
atgactgtaaccaatttttccgagctcgatcttgatgaaagcctgttagacgccctgcgtgatatgggttatgaacgtccgactgcgattcaagccgaggcaatccctccggcgatggaaggccgtgacgtactgggctccgcgccaacaggaacaggtaaaaccgccgcttatctgctgccggttttgcagcatcttatcgattttcctcgtaaaaaatcaggtccacctcgtgttctgatcctcacgccgacccgtgaactcgccatgcaggtggcggatcaagcgcgagcattcgcggcgcatacgcatctggatatcgcgacaatcactggcggcgtggcctacatgaatcatgcggaagtgttcagtgaaaatcaggatgtcgtcgtcgcgacgacgggccgtctgatgcaatacatcaaagaagaaaacttcgattgccgcgcggtagaaacgctgattctggacgaagcggacagaatgctggatatgggcttcgcccaggatattgaacacatcgccggagaaacccgctggcgcaagcaaacgctgctgttttctgcgacgttggaaggaaacgcgatcaaggatttcgccgagcgtctgctcaacgaacccgttgaaatcgagtccgatccatcacgtcgggaacgtaaaaaaattctgcaatggtattaccgtgccgacgatctcaaacacaaaacgaccctgctctgccatcagttaaaacagccagatgttacgcgttctatcatctttgtgcgcaagcgtgagcgggtgcatgagctcgtatcctggctgcatgaagctggcattaactcatgctatctcgaaggcgaaatggtgcaagccaagcgcaacgaggcaatcaaacgcatgagcgacggtcgggttaacgtgctggtggcaacagatatcgccgcgcgtggcatcgatattgacgatgtcagccacgtatttaacttcgacttgccgcgcacagcagatacttaccttcaccgtatcggccgcactggccgcgcgggtcgtaaaggctgtgccatctctttcgttgaagcacacgatcacctgctgctgggaaaaatcagccgctacttgaatgagccgctaaaaccgcgcgtcattgaggaacttcgcccagagaccaaagcgccaagcgccaaaaccacgggcaaaccgtcgaaaaaagtgctcgcgaagcggaaagagaaaaaagagaaggaaaaagaaaaagttaaagtgaaggttcgcgatcgcgacagtaaaaatgttggtaagcgtcgtcaagcaacgcagaaaactgacgaaccgtccgctgaataa

SEQ ID NO: 79617 - protein, 441 aa, Erwinia carotovora subsp. atroseptica SCRI1043
MTVTNFSELDLDESLLDALRDMGYERPTAIQAEAIPPAMEGRDVLGSAPTGTGKTAAYLLPVLQHLIDFPRKKSGPPRVLILTPTRELAMQVADQARAFAAHTHLDIATITGGVAYMNHAEVFSENQDVVVATTGRLMQYIKEENFDCRAVETLILDEADRMLDMGFAQDIEHIAGETRWRKQTLLFSATLEGNAIKDFAERLLNEPVEIESDPSRRERKKILQWYYRADDLKHKTTLLCHQLKQPDVTRSIIFVRKRERVHELVSWLHEAGINSCYLEGEMVQAKRNEAIKRMSDGRVNVLVATDIAARGIDIDDVSHVFNFDLPRTADTYLHRIGRTGRAGRKGCAISFVEAHDHLLLGKISRYLNEPLKPRVIEELRPETKAPSAKTTGKPSKKVLAKRKEKKEKEKEKVKVKVRDRDSKNVGKRRQATQKTDEPSAE

SEQ ID NO: 79618 - DNA, 1770 bp, Leifsonia xyli subsp. xyli str. CTCB07; identical to SEQ ID NO: 38797
  CDS (1)..(1770): transl_table=11

SEQ ID NO: 79619 - protein, 589 aa, Leifsonia xyli subsp. xyli str. CTCB07; identical to SEQ ID NO: 38798

SEQ ID NO: 79620 - DNA, 1272 bp, Desulfotalea psychrophila LSv54
  CDS (1)..(1272): transl_table=11
atgagttttaacaccctgggcctctccgccccgcttcttaaggccgtagccgaaaagggctacgacacaccatcgcccattcaagccaaggcgatccccgtgataatggaaggcaaagacgtcatggctgcggcccaaactggtaccggcaagacggctgcattcaccctgcccatcctggaactactctcccaaagtaagcgccgagtccaggcaaatcaggcaagagtactcatcttaacgcccacccgtgaactggcagcccagattggtgagagcgtcaccacctacggcaagggtctatccctgacctccgccgtaatctttggtggggtgaatataaatccccagatgaagaggttgcgcgggggagttgatattctggtggcaacacccggtcgtctactcgatctccatcgccaaaatgcgataaagtttaacaggttggaaatattagtcttagatgaggccgatcgaatgttagatatgggctttatcaacgatattagaaaagttttagccttcttacccaaggaacgtcagaacctgatgttttctgcgaccttttcctctagcatcaataacctcgctcggggaatgtttaacaatcccgtcgagatttcagtaacgccacccaatagcaccgtagaaataattgatcagtgcatctacccggtggacaagaaacagaaaccagccctgctcatccaactcatccgcgacaataaatggggccagactctggtcttcagcaagacaaaacatggagcaaaccgcctggtaggtcagttacagaaaaagggcatcaatgcggcggcaattcatggcaacaaaagccaaagcgcacgcaccaaggccctggccgaatttaaaaacggtactgtgcaaattttagtggcgacggatattgcggccaggggtctggacattgacctgctcccccatgtggtcaattttgaccttccccatgtacaggaagattatatacaccgaattggacgtacaggccgagcaggtgcctcaggggaggcaatctctttggtctgcgccgatgagtttgcactacttgccgatattgaaagactgatcaaaaaaatacttccacgcaagtccgtggagggttttgagccggttcatcccctgcctgaatcttgtctgaatacacgtccatttcgggctaaaagtcccaaaaagaacaccgagggacggacgcgccgacaaggttccagacctaattcacgtggacccaagaagccaagtggcgacaaatag

SEQ ID NO: 79621 - protein, 423 aa, Desulfotalea psychrophila LSv54
MSFNTLGLSAPLLKAVAEKGYDTPSPIQAKAIPVIMEGKDVMAAAQTGTGKTAAFTLPILELLSQSKRRVQANQARVLILTPTRELAAQIGESVTTYGKGLSLTSAVIFGGVNINPQMKRLRGGVDILVATPGRLLDLHRQNAIKFNRLEILVLDEADRMLDMGFINDIRKVLAFLPKERQNLMFSATFSSSINNLARGMFNNPVEISVTPPNSTVEIIDQCIYPVDKKQKPALLIQLIRDNKWGQTLVFSKTKHGANRLVGQLQKKGINAAAIHGNKSQSARTKALAEFKNGTVQILVATDIAARGLDIDLLPHVVNFDLPHVQEDYIHRIGRTGRAGASGEAISLVCADEFALLADIERLIKKILPRKSVEGFEPVHPLPESCLNTRPFRAKSPKKNTEGRTRRQGSRPNSRGPKKPSGDK

SEQ ID NO: 79622 - DNA, 1899 bp, Desulfotalea psychrophila LSv54
  CDS (1)..(1899): transl_table=11
atgacaacagtttcaacagatgtaacaggttcaacagacacagcaagttcaatagatgcagcagttccatcagctccagtagctccagcagctccagtagctccagcagctccagtagctccagtagctccagtagctccagtagctccagtagctccagcagtttcttttactgattttaatttaaaatcagaccttgtagcaaatcttgtaaaacttggctttagccaacctacacctatccaagagaaggccattcctctccttctagcaggttctgatctgataggtcaggctcaaaccggaacaggtaagaccgcagcttttggtttaccacttctaaataatattgatttttctaaaaaatgtgtgcaggcccttgttcttgctccaacccgtgagcttgcccagcaagtaggtgatgctcttgccacttatagtggtgacgatggtcgcaatgttctggttgtgtatggtggttcgtcttatcaagctcaggtaggtggacttcgcaggggtgcgcgtgttgttgttggtactcctggacgattgcttgacttaatccgtcagggatctctgaagcttgatcagctgaagacccttgttcttgatgaagcggatgagatgctcagtatgggctttattgatgatattgaaacaattttgtcacaaacaccgaaagatcgtcaaacaatgcttttttctgcgaccctttcttctcgtgtaatgagtattgccaatcgttatcttcattcgcctgagtctatctctatcagtccgaagcagatgatcggctcttccattgagcaacgttactatcttattaataatagtgataaaattgctgcaataacaagagtatttgaagtagagactgttgaaagcgccctcatctttgccagaactcgtgcaacggttagtgagcttgcaaacgagcttatttcccgtggatttgctgcagaaggtcttagtggcgatttgagccaagaggctagaacacgagttttgagtcgttttaagaagggtcagatcaaggtacttgtggcaacagatgttgcggctcgtggtcttgatattgacgatatttctcatgttttcaattatgatctgccagaagatcctgaggtttatgttcatcgtattggtcgtaccggtcgtgctggtcgtagtggaaccgctatctcactggtaactcttcgtgatcgttggatgcatcgccgtatagagcaatatactggtaaaaaattgatcaagggcgagcttcccaccgttgagcagattgaagagcatcgcaacactcaatttttagagcgtcttgatgtatggatccgtcgtggtcgttgtcgtggtgagagagagattgtagaggctcttgttgagcagggaatggatcctcttgatgttgctgctgctgccttgaaaattgttcgtaaggatgagaccaagcgtccaattgatccgatcaaacctgttattgaagatgcaggcggaagaaatcgcaagcgcggtgacagaaatgatcgtggtgctaatggtcgaggtgatagaggcggtcgatctgatagccgtggtggacgtccacagggccgtcgcgatgatcgttttgctaagggtggtgatagaggcccaaagaaaaaaggcgatgatgtccgacaggttagcgacaaagatatggtgcctcttacccttgatgctggtaaaaaagacggtgttgcggtaaatcatattgtggcctccttgtctcattttgcaggaatttcttctcgggaacttggaaaaattcgtattaatgaaacccatagtagtatcgacgtgccaaagggtttggttgataaaatgctctcccataacggtagctaccgcatctccaaaaaagcggtaaatcttacccaccaatag

SEQ ID NO: 79623 - protein, 632 aa, Desulfotalea psychrophila LSv54
MTTVSTDVTGSTDTASSIDAAVPSAPVAPAAPVAPAAPVAPVAPVAPVAPVAPAVSFTDFNLKSDLVANLVKLGFSQPTPIQEKAIPLLLAGSDLIGQAQTGTGKTAAFGLPLLNNIDFSKKCVQALVLAPTRELAQQVGDALATYSGDDGRNVLVVYGGSSYQAQVGGLRRGARVVVGTPGRLLDLIRQGSLKLDQLKTLVLDEADEMLSMGFIDDIETILSQTPKDRQTMLFSATLSSRVMSIANRYLHSPESISISPKQMIGSSIEQRYYLINNSDKIAAITRVFEVETVESALIFARTRATVSELANELISRGFAAEGLSGDLSQEARTRVLSRFKKGQIKVLVATDVAARGLDIDDISHVFNYDLPEDPEVYVHRIGRTGRAGRSGTAISLVTLRDRWMHRRIEQYTGKKLIKGELPTVEQIEEHRNTQFLERLDVWIRRGRCRGEREIVEALVEQGMDPLDVAAAALKIVRKDETKRPIDPIKPVIEDAGGRNRKRGDRNDRGANGRGDRGGRSDSRGGRPQGRRDDRFAKGGDRGPKKKGDDVRQVSDKDMVPLTLDAGKKDGVAVNHIVASLSHFAGISSRELGKIRINETHSSIDVPKGLVDKMLSHNGSYRISKKAVNLTHQ

SEQ ID NO: 79624 - DNA, 1581 bp, Symbiobacterium thermophilum IAM 14863; identical to SEQ ID NO: 38805
  CDS (1)..(1581): transl_table=11

SEQ ID NO: 79625 - protein, 526 aa, Symbiobacterium thermophilum IAM 14863; identical to SEQ ID NO: 38806

SEQ ID NO: 79626 - DNA, 1842 bp, Mannheimia succiniciproducens MBEL55E; identical to SEQ ID NO: 38809
  CDS (1)..(1842): transl_table=11

SEQ ID NO: 79627 - protein, 613 aa, Mannheimia succiniciproducens MBEL55E; identical to SEQ ID NO: 38810

SEQ ID NO: 79628 - DNA, 1389 bp, Mannheimia succiniciproducens MBEL55E
  CDS (1)..(1389): transl_table=11
gtgcggtataatttcccccaattttataatcttagccatttgagaatattcatgccacaaccacaatttgaagatttcgatctttctcccgaactgttaaaagccttagcccaaaaaggttatgcgcgccctaccgccattcaatcggaagcgattccggcggcaatggacgagcgcgacgtcttgggttcggcacctacgggaacgggcaaaaccgccgcttttttattaccggcgattcaacatttgttggattatccacgccgtaaacccggtgcgccgcgggttttagtgttaaccccgacccgcgaactcgctatgcaggtggcacagcaagcggaggaattggctcaatttaccaagttgagtattgccaccattacgggcggcgtcgcttatcaaaaccatggcgaaatattcaataaaaatcaggatatcgtcgtggcaacgcccggccgtctgttgcaatatatcaaagaggaaaactttgattgccgtgcggtggaaatccttatttttgatgaagcggatcgtatgttgcaaatgggctttggtcaggatgcggaaaaaatttccgctgaaacccgctggcgtaaacaaacctttttgttctcggcgactttagaaggcgagttactggtggattttgccgaacgcattttaacggatccggtgaaaatcgatgcggaaccaagccgtcgcgaacgcaagaaaatcaaccaatggtattaccatgcggacagctatgaacataaagtcaaactgttagcccgttttattgccgatgagcaggtcagcaaaggaattgtttttgtgcgccgccgcgaagacgtgcgggagctttccgaaattctgcgcaaacgcggtattcgcagtacttatttagaaggcgaaatggcacaaacccaacgaaataatgctatcgataaattaaaaaacggcattgttaccctgttagtcgccactgacgttgccgcccgaggcattgatattgaagatatcagccatgtgatgaacttcgacctgccctacaatgcggatacctatttacaccgtatcggtcgtaccgctcgtgccggcaaaaaaggaaccgcggtatcttttgttgaaggtcatgattataaatatctcggcaaaatcaaacgttataccgaagaattactcaaaccccgaattattgaaggtttagagcctcgtaccaaagcaccgaaagacggcgaaatcaaaactgtatctaaaaaacaaaaagcgtacattcgccaaaaacgggaagaaaagagaaaaacaacacagaaaaaagccaaattgcgccgtcaggatactaaaaatatcggcaaacgccgcacacctaaggcggtatcagaagcgcaggcaaaagaaatacggtga

SEQ ID NO: 79629 - protein, 462 aa, Mannheimia succiniciproducens MBEL55E
MRYNFPQFYNLSHLRIFMPQPQFEDFDLSPELLKALAQKGYARPTAIQSEAIPAAMDERDVLGSAPTGTGKTAAFLLPAIQHLLDYPRRKPGAPRVLVLTPTRELAMQVAQQAEELAQFTKLSIATITGGVAYQNHGEIFNKNQDIVVATPGRLLQYIKEENFDCRAVEILIFDEADRMLQMGFGQDAEKISAETRWRKQTFLFSATLEGELLVDFAERILTDPVKIDAEPSRRERKKINQWYYHADSYEHKVKLLARFIADEQVSKGIVFVRRREDVRELSEILRKRGIRSTYLEGEMAQTQRNNAIDKLKNGIVTLLVATDVAARGIDIEDISHVMNFDLPYNADTYLHRIGRTARAGKKGTAVSFVEGHDYKYLGKIKRYTEELLKPRIIEGLEPRTKAPKDGEIKTVSKKQKAYIRQKREEKRKTTQKKAKLRRQDTKNIGKRRTPKAVSEAQAKEIR

SEQ ID NO: 79630 - DNA, 1284 bp, Bacteroides fragilis YCH46; identical to SEQ ID NO: 38817
  CDS (1)..(1284): transl_table=11

SEQ ID NO: 79631 - protein, 427 aa, Bacteroides fragilis YCH46; identical to SEQ ID NO: 38818

SEQ ID NO: 79632 - DNA, 1551 bp, Burkholderia mallei ATCC 23344
  CDS (1)..(1551): transl_table=11
atgacttcgagccattccctcagcccgctcaacgcgatcgccgacgaggcgctcggcctgcccgccgccgccgctcaaccggccgcgagcgaggccggcgacgcctgcgacgccgcgtcggacgaaccgacgttcgcgtcgctcggcctgtcgccggagatcgtctccgcgctgcaggcggccggctacgtgaagccgacgcccgtgcagcagcgcgcgattccggccggcatcgccggccgcgacctgctcgtgtcgagcccgacgggctccggcaagacggccgcgttcatgctgcccgcgatcgagcgcttcgcgcagttgcaaaaggcgcaggcgcagcagccgcgcgcgccgcgcgaagggcagccgggcgagcgccgcggccgccgcccgcaacccgtcgcgcgccccggcctgctcgtcctcacgccgacgcgcgagctcgcgatgcaggtgacgacggccgcgtcgacgtacggcaagcacctgcgccgcctgcgcacggtcagcatcctcggcggcgtcgcgtacggccagcagttgatgctgctcgcgaagaacccggagatcctcgtcgcgacgccggggcgcctgctcgaccacctcgagcgcggccgcatcgatttgtccgaactgaagatgctcgtgctcgacgaagccgaccgcatgctcgacatgggtttcatcgacgacatcgacacgatcgtcgcggcgacgcccgcgacgcgccagacgatgctgttctcggcgacgctcgacggcaagatcggctcgctcacgaaccgtctgctgaaggatccggagcgcatcgagatcacgcagaagatcgaatcgcgctcgaacatcgcgcaaaccgtgcactacgtcgacgaccgcgatcacaaggatcgcctgctcgatcacctgctgcgcgatgtcgcgctcgatcaggcgatcatcttcaccgcgaccaagatcgacgccgaccagctcgccggccgcctcgccgacgccggcttccagtcggccgcgctgcacggcgacctgccgcagggcgcgcgcaaccgcacgatccgcgcgctgcgcgagcgccgcgtgcgcgtgctcgtcgcaaccgacgtcgccgcgcgcgggatcgacatccccggcatcacgcacgtgttcaactacgacctgccgaagttcgccgaggactacgtgcaccggatcggccgcaccggccgcgcgggccgctccggcaccgcggtgagcctcgtgcatcacgcggagcaaggcgcgctcaagcgcatcgagcgcttcgtgcgcgcgccgctgccggtgaatgtcgtcgaaggcttcgagccgcgcaaggcgccgccgccgcgtaacgatcgcggcaacggccgcggccgtccgggcggcaacggcaatggcggccgccggttcggcggcaagccgggcggcggccatggcggcggccgctccggcggctggagcggcaagccgggtggcggcaaccgtgaagcctacggcgcgcggcgcggcgacggccagcgcaacggcccgcgccgcggcaattccgcggcataa

SEQ ID NO: 79633 - protein, 516 aa, Burkholderia mallei ATCC 23344
MTSSHSLSPLNAIADEALGLPAAAAQPAASEAGDACDAASDEPTFASLGLSPEIVSALQAAGYVKPTPVQQRAIPAGIAGRDLLVSSPTGSGKTAAFMLPAIERFAQLQKAQAQQPRAPREGQPGERRGRRPQPVARPGLLVLTPTRELAMQVTTAASTYGKHLRRLRTVSILGGVAYGQQLMLLAKNPEILVATPGRLLDHLERGRIDLSELKMLVLDEADRMLDMGFIDDIDTIVAATPATRQTMLFSATLDGKIGSLTNRLLKDPERIEITQKIESRSNIAQTVHYVDDRDHKDRLLDHLLRDVALDQAIIFTATKIDADQLAGRLADAGFQSAALHGDLPQGARNRTIRALRERRVRVLVATDVAARGIDIPGITHVFNYDLPKFAEDYVHRIGRTGRAGRSGTAVSLVHHAEQGALKRIERFVRAPLPVNVVEGFEPRKAPPPRNDRGNGRGRPGGNGNGGRRFGGKPGGGHGGGRSGGWSGKPGGGNREAYGARRGDGQRNGPRRGNSAA

SEQ ID NO: 79634 - DNA, 1362 bp, Methylococcus capsulatus str. Bath; identical to SEQ ID NO: 38819
  CDS (1)..(1362): transl_table=11

SEQ ID NO: 79635 - protein, 453 aa, Methylococcus capsulatus str. Bath; identical to SEQ ID NO: 38820

SEQ ID NO: 79636 - DNA, 1809 bp, Nocardia farcinica IFM 10152; identical to SEQ ID NO: 38821
  CDS (1)..(1809): transl_table=11

SEQ ID NO: 79637 - protein, 602 aa, Nocardia farcinica IFM 10152; identical to SEQ ID NO: 38822

SEQ ID NO: 79638 - DNA, 1245 bp, Legionella pneumophila str. Paris
  CDS (1)..(1245): transl_table=11
atgagttttaaacaattagcgctgattgagccgctaaacagggcggttagtgagttaggctatactaaccctaccagtattcaattaaaagccatcccgctcattttaaatgggcatgatttacttggttccgctcaaacaggaacaggaaaaacagcaagctttgtattgcctatcttgcaaaaagccagtcagcaaactcaaaccagccgtaatcgagctaaagtactgattttaacgcccacacgagaattagccatccaggcccacgagagcataatccaatatggcaaatacctaacactgcgctcggctgtgatttacggaggagtaaaaagccacaaccaaattaaacaattagactcaggccttgagatacttgttgcaaccccgggaagattattggatttatatcagcaaggtgctgttaaatttgatgagattgacaccctggtactcgatgaggcggatagaatgctggatatggggtttattcatgatataaaaaaaattatcaaattattacctttaaaaaggcagaacctgcttttttcagcaacctttactcctgaggtacgtactttagccagaaatatactgaataaagcggttgaaattgatatcgcaccgagaaataccgcggtaaaaaccataaaacaaactgtttattcagtagatggaaaccataagttagcccttctgagtcatttacttcataagaataactggggacaaactttggttttttctcgaaccaaacatggagccaataaactggttaagcaactggccgaatcccaaatatattcagttgctattcatggcaacaaatcgcaggctcaacgaacaaaagccctggctgatttcaagtcaggcaaagtacaaacattaattgcaacagacattgcagcacgtggcatagacatcgagaaacttgcctgtgtagtgaattttgacctgcctcatgtgcctgaggactacgttcatcggattggacgaacaggacgggcaggcgcctctggattggctgtatccttggtcagcacagaagaaatcaagctgctgctgtctatagaaaaattaatcaatcaaaaattggagcgcattaaaattaaggattttgagtttttgcataacttttcagatttagtctcagccaaaattcaaaaatttgcgccgccaaaagcgggatataagggcaatatcagcagaaaatccaggacggcttttaataaaagcgcgtaa

SEQ ID NO: 79639 - protein, 414 aa, Legionella pneumophila str. Paris
MSFKQLALIEPLNRAVSELGYTNPTSIQLKAIPLILNGHDLLGSAQTGTGKTASFVLPILQKASQQTQTSRNRAKVLILTPTRELAIQAHESIIQYGKYLTLRSAVIYGGVKSHNQIKQLDSGLEILVATPGRLLDLYQQGAVKFDEIDTLVLDEADRMLDMGFIHDIKKIIKLLPLKRQNLLFSATFTPEVRTLARNILNKAVEIDIAPRNTAVKTIKQTVYSVDGNHKLALLSHLLHKNNWGQTLVFSRTKHGANKLVKQLAESQIYSVAIHGNKSQAQRTKALADFKSGKVQTLIATDIAARGIDIEKLACVVNFDLPHVPEDYVHRIGRTGRAGASGLAVSLVSTEEIKLLLSIEKLINQKLERIKIKDFEFLHNFSDLVSAKIQKFAPPKAGYKGNISRKSRTAFNKSA

SEQ ID NO: 79640 - DNA, 1260 bp, Photobacterium profundum SS9
  CDS (1)..(1260): transl_table=11
gtgaaagacttttccgagttagagttagatagcgcactattaaacgcgattgaagaaatcggctacacccgcccgaccgaagttcaggcacaggctatccctcacgccctggacggtagagacgtattggcttccgctcctacaggtaccggaaaaacagctgcatttcttttaccgatgatccagcacttacttgatttccctcgtaagaagccagggccagcgcgtgtattaattttaaccccaacgcgtgaacttgcgattcaaattgctgaccatgcgcgtgcattagctaaaaatactcacctaaagatcttcacgatcactggcggcatttcatacgatgaccacgctgaacttctaggtaaaacacaagatatcgttgtggcaacaccgggacgtttaatggagtacgttgagagtgagcgtttcgattgccgagcaattgaatgcttaattttagatgaagctgaccgtatgttagatatgggcttcactaaaattgttgagcgtattaaccacgaatgtcgctggcgtcgtcaaagccttctattctctgcaaccttagagggtaaaggcgttcgtgagttttcagaaacaattctgaaagaacctgtagaagtaaactctgcaccttcacgtcgcgaacgtaagaagattcatcagctttacttacgttgtgacgatatggatcacaaattagcattgcttgagcaaatcctgaaacatcaggcagagcgcagcattgtctttgtgaaaacccgtgatcgtctggctatgttgcgtgatcagcttgcatcaatgaacgtgaaatgtagctggattcaaggcgaaatggcgcaattatctcgtaataatgcgatttctcgtttccgtgatggtgatgtcaacattctgattgcaaccgacgttgcggctcgtggtatcgatttacccgacatcagccacgtaatcaactttgatatgccacgtaccgctgacgtgtatttacaccgtattggtcgtactgcacgtgcaggcaagaaaggtattgcgatttcactggttgaagcacacgatcaagcgatgatcgaacgtgtaagccgttatatggaagaagaagtgccagaacgcttcatcaatggtttacgcccagcaagtaaaaaagccaaaaccattaaaaagaaaaaagtaaaaatcgataagaaactgaaagttgctaagcaaaagaaagccgctaaaaagcataagaaagcatcagaaaacaaacctgaagcttaa

SEQ ID NO: 79641 - protein, 419 aa, Photobacterium profundum SS9
MKDFSELELDSALLNAIEEIGYTRPTEVQAQAIPHALDGRDVLASAPTGTGKTAAFLLPMIQHLLDFPRKKPGPARVLILTPTRELAIQIADHARALAKNTHLKIFTITGGISYDDHAELLGKTQDIVVATPGRLMEYVESERFDCRAIECLILDEADRMLDMGFTKIVERINHECRWRRQSLLFSATLEGKGVREFSETILKEPVEVNSAPSRRERKKIHQLYLRCDDMDHKLALLEQILKHQAERSIVFVKTRDRLAMLRDQLASMNVKCSWIQGEMAQLSRNNAISRFRDGDVNILIATDVAARGIDLPDISHVINFDMPRTADVYLHRIGRTARAGKKGIAISLVEAHDQAMIERVSRYMEEEVPERFINGLRPASKKAKTIKKKKVKIDKKLKVAKQKKAAKKHKKASENKPEA

SEQ ID NO: 79642 - DNA, 1269 bp, Photobacterium profundum SS9
  CDS (1)..(1269): transl_table=11
atgtcatttcaagctttaggcctgaatactcagctagttgatactgttacagaactaggctttaaaacaccaacacccattcaagaacaagccattccccaagtattggctggtgatgatattatggctggtgcacaaacaggaaccggtaaaacagcagcattcggcctaccgatgattcaacgattactagcgagtcagcaatcagaacacgacgaaggttatataaaaaagcctgaggcaatccgtgctttagtcttaacaccaacccgtgaacttgcccaacaagtgcatgatagtattttggcatacagtaaaaatacatcgattaaggtggccgttgcctatggcggcaccagtatgggggttcaggtaaaagcattgaagtcgggtgttgatattttgattgccacgccaggtcgattattggatcatgcttttacgggtactgtcgatttatctaagattgagtgtttagtattagatgaagctgatcgtatgctagatatgggttttgtcgttgatattaaacgcatcatgcagcgcatgcctagaaaacgtcagacgttacttttttctgcaacattttctaatcaagtcaaaaaattagcttacgatattttagctgatcccaagctaattgaagttacaccagaaaatatcaccgccgaaagtgttacgcaaatggtgtatccagttgataaacaccgtaagcgtgaattactgtcttaccttattggttctcgaaattggaatcaggttttaatctttactaaaacaaagcaaggttcagatgaattagcaaaagagctgattcttgatggtattaaagcggtttcaatcaatggtgataaaagccaaggtgcacgtcaacgtgcattaagtgattttaaagaaggtaaagtacgcgcgatggttgcgactgacgttgcagctcgaggtttagatattgaacagctaggctatgttgttaacttcgatttaccctttcaagctgaagattatgttcaccgtattggtcgtactggtcgtgcaggtttaacgggcagtgctatttcattaatgagtattgatgaagaatgggctctgcgtgcaattgaagaattgttagacacacgcttacctcaagagtggttggaagggtacgagccggatccaaccattaaagcgcaagataaccgtcgttctagctcgacgtctgaaaaacgccgtataaaagcaaaatctaaaatacataaaaatcgcggacgtaatcaaactaagcgttaa

SEQ ID NO: 79643 - protein, 422 aa, Photobacterium profundum SS9
MSFQALGLNTQLVDTVTELGFKTPTPIQEQAIPQVLAGDDIMAGAQTGTGKTAAFGLPMIQRLLASQQSEHDEGYIKKPEAIRALVLTPTRELAQQVHDSILAYSKNTSIKVAVAYGGTSMGVQVKALKSGVDILIATPGRLLDHAFTGTVDLSKIECLVLDEADRMLDMGFVVDIKRIMQRMPRKRQTLLFSATFSNQVKKLAYDILADPKLIEVTPENITAESVTQMVYPVDKHRKRELLSYLIGSRNWNQVLIFTKTKQGSDELAKELILDGIKAVSINGDKSQGARQRALSDFKEGKVRAMVATDVAARGLDIEQLGYVVNFDLPFQAEDYVHRIGRTGRAGLTGSAISLMSIDEEWALRAIEELLDTRLPQEWLEGYEPDPTIKAQDNRRSSSTSEKRRIKAKSKIHKNRGRNQTKR

SEQ ID NO: 79644 - DNA, 1416 bp, Photobacterium profundum SS9
  CDS (1)..(1416): transl_table=11
atgacaagagatgatcttatgagctttgcctccctgggcctatctgcgccaatccttgaagccgtaactaaacaaggctacgaaacaccttcgccaattcaggctcaagcaattccagctgtaatcgaaggtaaggatgtaatggcagcggcccaaacaggcacgggtaagacagcagctttcacacttcctgttttagagcgtttatctaatggtccacgtgttaagcctaatcaagtgcgtgcgcttgttcttactcctacacgtgaattggcggctcaggttgcagaaagtgttgcgttatacgctaaaaatcttccattgagctcggctgtagtatttggtggcgttaaaattaacccacaaatgatgcgattgcgtcaaggtgctgatgtattagttgcaacaccgggtcgattgcttgacctttataaccagagagctgtgcgttttgaccagatagaagtactggttctggatgaagctgaccgcatgttagacatgggctttattcgtgatatccgtaaattattggcagcaatgccaaagcaacgccagaacttacttttttctgcaacgttctctgatgaaattcgtcagcttgcaaaaggtttggttaataacccggtagaaatttctgttacgccacgtaatgcgacggctccaacagttaaacagtggatttgtcctgtagataaaagccgaaaagcgaacttattaaccaagttattgaaagaaaataactggggtcaggtactggtattcacaaagacaaaacacggtgcgaaccgtttgactacgcaccttgaaggtcgtggtattaaagctgctgcgattcatggtaacaagagtcaaggtgcacgtactaaggcattggcaaacttcaagagtaatgaaattcaagtgcttgttgcaacagatattgctgcacgtggtcttgatattgagcaattaccacaagtggttaactttgaattaccgcacgttgctgaagattacgttcaccgtattggccgaactggccgtgctggttgtgaagggcaggcaatttcattagtgtgtgctgatgaatacaaagatcttgctgctatcgaacgtttgattaagcaagtattaccacgtgaacaggttagtggttttgaagcagtgaataagctgcctgagtctcgcttagatacgcgtgcaattaagccgagtaaaccgaagaaaccaaagacagatcaccgcgacggacaacgttctggtgagaatgctaaaggccataaaccacaaggtaaaaataagcgccatgttggtggtaaaagccaaaacgaaggtacgggtaaaccgtcaaatcgttcaggtgctggtactggcgcacctaaagcaaaacctgcaaagcgtcgtacccctcgtcctgcgagtgttacacgataa

SEQ ID NO: 79645 - protein, 471 aa, Photobacterium profundum SS9
MTRDDLMSFASLGLSAPILEAVTKQGYETPSPIQAQAIPAVIEGKDVMAAAQTGTGKTAAFTLPVLERLSNGPRVKPNQVRALVLTPTRELAAQVAESVALYAKNLPLSSAVVFGGVKINPQMMRLRQGADVLVATPGRLLDLYNQRAVRFDQIEVLVLDEADRMLDMGFIRDIRKLLAAMPKQRQNLLFSATFSDEIRQLAKGLVNNPVEISVTPRNATAPTVKQWICPVDKSRKANLLTKLLKENNWGQVLVFTKTKHGANRLTTHLEGRGIKAAAIHGNKSQGARTKALANFKSNEIQVLVATDIAARGLDIEQLPQVVNFELPHVAEDYVHRIGRTGRAGCEGQAISLVCADEYKDLAAIERLIKQVLPREQVSGFEAVNKLPESRLDTRAIKPSKPKKPKTDHRDGQRSGENAKGHKPQGKNKRHVGGKSQNEGTGKPSNRSGAGTGAPKAKPAKRRTPRPASVTR

SEQ ID NO: 79646 - DNA, 1587 bp, Streptococcus thermophilus CNRZ1066
  CDS (1)..(1587): transl_table=11
ttgaaatttacagatttaaacctatcagaagacatccaatcagctgttgtagctgccggttttgaacaaccatcacctatccaagagttgacaattccacttgctcttgaaggtaaggatgtcattggtcaggcacaaactggtactggtaaaacagctgcctttggtttgcctaccctagataaaattcgtacagaagaaaatacaattcaagccctggttattgccccaacacgtgagttggcagtgcaatctcaagaagagcttttccgttttggccgtgataagggcgttaaggttcgctcagtatacggtggttctagcatcgagaaacaaatcaaggccctccgttcaggtgcccacattgtagtagggacaccaggtcgtctcctagaccttatcaaacgtaaagcccttaaacttaacaatatcgagactttgattttggatgaagctgatgaaatgcttaacatgggcttcctagaagacattgaagcaattatcagtcgagtaccagaggaacgtcaaacccttctcttctcagcaactatgcctgatgccatcaaacgtattggtgttcagttcatgaaagatcctgagcatgtgaaaatcaaggctaaggaattgaccaatgttaacgttgatcaatactttatccgagtgaaggaacaagagaagtttgatactatgactcgtcttatggatgttgaccaacctgaattgtcaatcgtctttggacgtaccaaacgtcgtgtggacgagttaacacgtggtttgaaacttcgtggtttccgtgcagaaggtatccacggagaccttgaccaaaacaaacgtcttcgtattatccgtgacttcaagaacggccaaatcgatatcttggttgcaacagatgttgcggcgcgtggtcttgacatttcaggtgttactcacgtctacaactacgatattccacaagacccagaaagctacgttcatcgtattggacgtacaggccgtgcaggccaatcaggtcaatcgattacgttcgtttctccaaacgaaatgggttacttgggcatcatcgaaaatttgactaagaaacgcatgaaaggccttaagccaccaacagctcaagaagccttccaatctaagaagaaagttgcccttaagaaaattgaacgtgactttgcggatgaagctatccatgctaactttgacaagtttaaggacgatgctgttaaattggctcaagaattcacacctgaagaattggcgctttatatcttgagcttgaccgttcaagatccagagacaatgccagaagtggaaattgcgcgtgaaaaaccattgccatttaaaccatcaggtggtggctttggtggtaaaggtggcaaaggtggccgtggtaaccgtggtcgcgataacaaccgtcgtggtggataccgtggcgaccgtaaccgtgatgatcgagacggtggccgtcgagacttcaaacgcaagtctaagaataacagtcgtgacttcgaaaatcgtggcaacaaacgcccacaccgtgcttcaagcgaaaagaaaaatggctttgttatccgtaacaagggtgataagtaa

SEQ ID NO: 79647 - protein, 528 aa, Streptococcus thermophilus CNRZ1066
MKFTDLNLSEDIQSAVVAAGFEQPSPIQELTIPLALEGKDVIGQAQTGTGKTAAFGLPTLDKIRTEENTIQALVIAPTRELAVQSQEELFRFGRDKGVKVRSVYGGSSIEKQIKALRSGAHIVVGTPGRLLDLIKRKALKLNNIETLILDEADEMLNMGFLEDIEAIISRVPEERQTLLFSATMPDAIKRIGVQFMKDPEHVKIKAKELTNVNVDQYFIRVKEQEKFDTMTRLMDVDQPELSIVFGRTKRRVDELTRGLKLRGFRAEGIHGDLDQNKRLRIIRDFKNGQIDILVATDVAARGLDISGVTHVYNYDIPQDPESYVHRIGRTGRAGQSGQSITFVSPNEMGYLGIIENLTKKRMKGLKPPTAQEAFQSKKKVALKKIERDFADEAIHANFDKFKDDAVKLAQEFTPEELALYILSLTVQDPETMPEVEIAREKPLPFKPSGGGFGGKGGKGGRGNRGRDNNRRGGYRGDRNRDDRDGGRRDFKRKSKNNSRDFENRGNKRPHRASSEKKNGFVIRNKGDK

SEQ ID NO: 79648 - DNA, 1119 bp, Idiomarina loihiensis L2TR
  CDS (1)..(1119): transl_table=11
atgaacttttctgatctcgcactttcccctgaaacccttactgccctatcacgtcaggggtacagcgaatctacccccattcaggcggaagctattccattggtgctggcggggaaggatgtcatggccgcggcgcaaacgggtacgggaaagacaacggcctttaccgcacctcttttagaacttctgaaaagtaatgagcgtgccaaggcaaatacagcgcgtgtgcttattttaacgcccactcgcgagttggcggctcaggtcggtgaaaacgttgcgaacttaagcgcgggtctgccattgaattacgcggtggcgtttggtggtgtaaaaattaatccgcaaatgatgaagcttcgcaaaggcgtggatattctggtggccacacctggccgcctgctggacttatacaaacaaaacgcggttcgctttcctaagttagaagtgctggtactggatgaagccgaccgcatgctcgacatgggctttattcacgacattaagaacattattaagttactgccggctaaacgccaaacgctactgttctcggcaaccttttctgacgacattcgtgcgctggctaaaggcttactgaaaagcccggtcgaaatttcggtggcactacccaacgcaactgccgagcctattgaacaaactttgtatgaggtacaaaaaagccaaaagctggggctgttattaaaactactgaaaagcctcgacctaccccaagtacttgtgttttcacgcaccaaacaaggcgctaaccggttagttaagcagttggataaagccggcttctcagccgccgctattcacagcgctaaaagtcagggcgcccgtactaaagcgttggctgactttaaaagtgccaaagtgcagatgcttatcgccactgacatagcctcacgcggcattgatattgaaaagctgccgtacgtgattaactacgacctcccccacgtcgcggaagactacatacaccgcattggtcgcacaggtcgcgccggccaaacgggtcatgctatatcgttagttacagacgaggacgttgcagcactcaaagctattgaggagcttataggcgagacgattgagcagtgtaaattagagtga

SEQ ID NO: 79649 - protein, 372 aa, Idiomarina loihiensis L2TR
MNFSDLALSPETLTALSRQGYSESTPIQAEAIPLVLAGKDVMAAAQTGTGKTTAFTAPLLELLKSNERAKANTARVLILTPTRELAAQVGENVANLSAGLPLNYAVAFGGVKINPQMMKLRKGVDILVATPGRLLDLYKQNAVRFPKLEVLVLDEADRMLDMGFIHDIKNIIKLLPAKRQTLLFSATFSDDIRALAKGLLKSPVEISVALPNATAEPIEQTLYEVQKSQKLGLLLKLLKSLDLPQVLVFSRTKQGANRLVKQLDKAGFSAAAIHSAKSQGARTKALADFKSAKVQMLIATDIASRGIDIEKLPYVINYDLPHVAEDYIHRIGRTGRAGQTGHAISLVTDEDVAALKAIEELIGETIEQCKLE

SEQ ID NO: 79650 - DNA, 1251 bp, Idiomarina loihiensis L2TR; identical to SEQ ID NO: 38841
  CDS (1)..(1251): transl_table=11

SEQ ID NO: 79651 - protein, 416 aa, Idiomarina loihiensis L2TR; identical to SEQ ID NO: 38842

SEQ ID NO: 79652 - DNA, 1230 bp, Idiomarina loihiensis L2TR
  CDS (1)..(1230): transl_table=11
atgacgccagactgggaagagtttgatctcgatgaccgcttaattgcggttcttcgcgatgctgaactgaacaaaccagcaaaagtacaacaacagagtattcctgccgccctggatggtcgcgacttacttattagtgcaccgaccggaacaggtaaaactttggctttcctgctgccggcactgcaacatttgctggatttcccgcgtcaacaaccgggaccagctcgtatactggtgttggctccaacccgcgaactggctgaacaaatccatgaacaggctaaacagtttgaggccaaaaccgggttaacctctgtggttgtcaccggaggcatcaactatggttcgcagctgtcggtattagagaagacacacgacatactggttgcgacaccgggtcgactaatggacttacttgaagccgaacagtacaacctggaaggcattgagtggctgattattgatgaagccgaccgaatgctggatatgggttttgccgcaacggtaaaagaaatggctctgcaggcacgtcatcgtcagcagtccttgctactgtcagcaacgctgaatagctccggcgtgattaagttttcccgcgagttattaaccgaacccgagtacattgatgtgcagcctcccaaacgtgagcgcggtaaaattcttcagtgggttcatttagcggataccgacgaacataagcgtaaactgttaatgagcgtgcttcaggcgcaccccgggcggcagtttgtctttgtcagaacacgtgaacgcgtagagcttattgcaaactttctgcgcagccagtttggtaccggccgtaaaattgtgacactgcggggcgatatgccgcaaagtgatcgtcagcgcattatgaacgagcttaaacaaacgacggaaattaccttagttgctactgatattgcagcgcgagggctggatgtagacgacatcactttggtggttaattatgaccttcctaagcaagctgatgtttatctgcaccgaattgggcgcacagcccgcggcggacaaaaaggaacggccgtatcgctggtagaagcacatgatgctttactactgggccgtgtcgagcgttacctggacgccaaactagacagacgaactattgaagggttaaaacctcaatataagtttccgtcgacagaaaagtcccgctcgaagaaaaaagtgaagaagaaaacggataaaaagaagaagtcgcgttaa

SEQ ID NO: 79653 - protein, 409 aa, Idiomarina loihiensis L2TR
MTPDWEEFDLDDRLIAVLRDAELNKPAKVQQQSIPAALDGRDLLISAPTGTGKTLAFLLPALQHLLDFPRQQPGPARILVLAPTRELAEQIHEQAKQFEAKTGLTSVVVTGGINYGSQLSVLEKTHDILVATPGRLMDLLEAEQYNLEGIEWLIIDEADRMLDMGFAATVKEMALQARHRQQSLLLSATLNSSGVIKFSRELLTEPEYIDVQPPKRERGKILQWVHLADTDEHKRKLLMSVLQAHPGRQFVFVRTRERVELIANFLRSQFGTGRKIVTLRGDMPQSDRQRIMNELKQTTEITLVATDIAARGLDVDDITLVVNYDLPKQADVYLHRIGRTARGGQKGTAVSLVEAHDALLLGRVERYLDAKLDRRTIEGLKPQYKFPSTEKSRSKKKVKKKTDKKKKSR

SEQ ID NO: 79654 - DNA, 1392 bp, Azoarcus sp. EbN1; identical to SEQ ID NO: 38845
  CDS (1)..(1392): transl_table=11

SEQ ID NO: 79655 - protein, 463 aa, Azoarcus sp. EbN1; identical to SEQ ID NO: 38846

SEQ ID NO: 79656 - DNA, 1527 bp, Azoarcus sp. EbN1; identical to SEQ ID NO: 38847
  CDS (1)..(1527): transl_table=11

SEQ ID NO: 79657 - protein, 508 aa, Azoarcus sp. EbN1; identical to SEQ ID NO: 38848

SEQ ID NO: 79658 - DNA, 1476 bp, Azoarcus sp. EbN1
  CDS (1)..(1476): transl_table=11
atgagtttcgccgacctcggactgatccccgagttgctacgtgcagtagccgaatccggctacaccacccccaccccgatccagcagcaggcgatcccggtggtcctgtccggccgcgacgtcatgggcggcgcccagaccggcaccggcaagaccgccggcttcacgctgccgctgctgcagcgcctcgcgcgccacgccagcacttcgacgagtccggcgcgacacccggtgcgggcgctgatcctcgcgccgacgcgcgaactcgcgatgcaggtcttcgaatccgtcaagacctacagcaagtacgtcccgctgcgcagcacgtgcatctatggcggcgtcgacatgaagccgcagatccaggatttgcgcaacggcatcgagatcgtcgtcgcgacgccgggacggctcctcgaccacgtccagcagaaaaccatccagctcggccaggtcgagatgctcgtgctcgacgaagccgaccgcatgctcgacatggggttcatccccgacatccgccgcatcctcgacctgctgcccgccgcgcgccagagcctgttgttctcggcgacattctcggacgagatcaagaagctcgccgaccagatgctgaaggaaccgcagttgatcgaagtcgcgcgccgcaacatggtgtccgagacgatcacccaccgcgtgcacccggtttcagcgggcctcaagcgcaacctgctcgcgcacctgttgcgccatgagccggacacgcaggcgctggtgttcgtcgcaacgaagctcgcgtgcagccggctcgcgcatttcctcgagcgccacggcatcgccgccgacgcgatccacggcgacaaaggccaggcgcagcgcaccgacacgctcgaagccttcaagtccggcaagctgcgcgtgctcgtcgcgaccgacgtcgcggcgcgcgggctcgacatcgacgacctgccgtcggtgatcaatttcgaacttccgcataccgccgaagactacgtgcaccgcatcggccgcaccgggcgtgccgggcgccagggcaacgcggtgtcgctggtgagcgccgaagagagacaccatcttgcggaaatcgaaaaactcatcaagctgcagattccgcaggaaatcgtgccgggcttcgaccccgagccggattttttcgaaaccggcagccgcagccggcatggccgccgcacggccgccgccagcgctcccgaaccggcgaaggaaaccggccagaaaacgactcctgcgtcgcgccctgcccggcccgcctcggccgcgcggagcggcgaagcccggcggcgccccggacgatcgacgatcgccgcagacgggttcgactacaccaagccatacgaaccggcagcttcgccagccgatccgaatcggctggcggatcaggccgcaggaaagatcggttcgtcgcgtcgcacgcagcgcccgatcgcggtgctgctcggcggcctcggccggaaatag

SEQ ID NO: 79659 - protein, 491 aa, Azoarcus sp. EbN1
MSFADLGLIPELLRAVAESGYTTPTPIQQQAIPVVLSGRDVMGGAQTGTGKTAGFTLPLLQRLARHASTSTSPARHPVRALILAPTRELAMQVFESVKTYSKYVPLRSTCIYGGVDMKPQIQDLRNGIEIVVATPGRLLDHVQQKTIQLGQVEMLVLDEADRMLDMGFIPDIRRILDLLPAARQSLLFSATFSDEIKKLADQMLKEPQLIEVARRNMVSETITHRVHPVSAGLKRNLLAHLLRHEPDTQALVFVATKLACSRLAHFLERHGIAADAIHGDKGQAQRTDTLEAFKSGKLRVLVATDVAARGLDIDDLPSVINFELPHTAEDYVHRIGRTGRAGRQGNAVSLVSAEERHHLAEIEKLIKLQIPQEIVPGFDPEPDFFETGSRSRHGRRTAAASAPEPAKETGQKTTPASRPARPASAARSGEARRRPGRSTIAADGFDYTKPYEPAASPADPNRLADQAAGKIGSSRRTQRPIAVLLGGLGRK

SEQ ID NO: 79660 - DNA, 1479 bp, Zymomonas mobilis subsp. mobilis ZM4; identical to SEQ ID NO: 38851
  CDS (1)..(1479): transl_table=11

SEQ ID NO: 79661 - protein, 492 aa, Zymomonas mobilis subsp. mobilis ZM4; identical to SEQ ID NO: 38852

SEQ ID NO: 79662 - DNA, 1377 bp, Zymomonas mobilis subsp. mobilis ZM4
  CDS (1)..(1377): transl_table=11
atgacggaaacatctgtttcgttcaaaacccttggtctcgactcgtcccttgtgcaggctctggatggtctcggttatagtaagccgaccccgattcaggcacaagctatcccccatttattagaaggcaaggatctttgcggtatcgcccagaccggcaccggtaaaaccgcagcctttgctctgccttctattcattatctcgcaaccaacccgcaggcacggcctcagcgtggttgccgtatgctgattttatcaccgacgcgcgaactggccagccagattgcccgcgcttgcaatgactatacccgtcatctgcgtatgtcggttaatgccgtatttggtggcgttcctattggtcgtcagatgagaatgctggatcgtggcaccgatattttggttgcaacacccggtcgcttgctggatttgatcgaccagcgcgcgcttgtcttaaaagacgtcgaagttttcgtcttggacgaagccgaccagatgctggatcttggttttatccatgcgttgcgtcgcattgataaattgctgccgaagaaccgccagactttgttcttctcggctacgatgccaaaaacgattcaggaattgagcagtcagttcttgtctgatccggtaaccgtttcggttgcgccccagtcttcaacggctgaacgggttgaacaattcggtattttcgttaaccagtctgaaaaacaggctttgttgacgattacgctgaaaaatacccctggccttgatcgggctttggtctttacccgcacgaagcatggtgccgatagagtggttcgccatttggaagccgctggtctgcctgctgccgccattcatggtaacaaaagccagccgcagcgtgaacgcgctttgaatgcgttccgtaatggtcggttaaaaattctggtcgccaccgatattgctgcccgtggtattgacgttccgggtgtcagccatgtcttcaattacgaattgccgaatgttgccgaacaatatgtccatcgtattggccgcactgcccgtgcgggtcgtgatggtcaggctatcagctttattgccaatgacgaacgctcttacttgcgctctatcgaacgtttgactcgtgtcaaattgcagattttgccgctgcctgaaaactttgtcatggaaaaagaattgctgccgcatccggctccgatgcgtccagaacgggatggcagagatggtcgcggtggtcgtggcggtggtcgcggtcgctttggcggcggtgcaaaaccgggtttcaaccactctcatggtaaaggtgatgatcgtggtgatcgcggtggtgaacgtccgcgtcgtccgcgtcgtccgcagatgcgtggtgttcgtgccgttgctcgtagctaa

SEQ ID NO: 79663 - protein, 458 aa, Zymomonas mobilis subsp. mobilis ZM4
MTETSVSFKTLGLDSSLVQALDGLGYSKPTPIQAQAIPHLLEGKDLCGIAQTGTGKTAAFALPSIHYLATNPQARPQRGCRMLILSPTRELASQIARACNDYTRHLRMSVNAVFGGVPIGRQMRMLDRGTDILVATPGRLLDLIDQRALVLKDVEVFVLDEADQMLDLGFIHALRRIDKLLPKNRQTLFFSATMPKTIQELSSQFLSDPVTVSVAPQSSTAERVEQFGIFVNQSEKQALLTITLKNTPGLDRALVFTRTKHGADRVVRHLEAAGLPAAAIHGNKSQPQRERALNAFRNGRLKILVATDIAARGIDVPGVSHVFNYELPNVAEQYVHRIGRTARAGRDGQAISFIANDERSYLRSIERLTRVKLQILPLPENFVMEKELLPHPAPMRPERDGRDGRGGRGGGRGRFGGGAKPGFNHSHGKGDDRGDRGGERPRRPRRPQMRGVRAVARS

SEQ ID NO: 79664 - DNA, 1416 bp, Silicibacter pomeroyi DSS-3; identical to SEQ ID NO: 38853
  CDS (1)..(1416): transl_table=11

SEQ ID NO: 79665 - protein, 471 aa, Silicibacter pomeroyi DSS-3; identical to SEQ ID NO: 38854

SEQ ID NO: 79666 - DNA, 1326 bp, Francisella tularensis subsp. tularensis Schu 4; identical to SEQ ID NO: 38855
  CDS (1)..(1326): transl_table=11

SEQ ID NO: 79667 - protein, 441 aa, Francisella tularensis subsp. tularensis Schu 4; identical to SEQ ID NO: 38856

SEQ ID NO: 79668 - DNA, 1614 bp, Bacillus clausii KSM-K16; identical to SEQ ID NO: 38859
  CDS (1)..(1614): transl_table=11

SEQ ID NO: 79669 - protein, 537 aa, Bacillus clausii KSM-K16; identical to SEQ ID NO: 38860

SEQ ID NO: 79670 - DNA, 2382 bp, Gluconobacter oxydans 621H
  CDS (1)..(2382): transl_table=11
gtgtgcgccgtcaaagagagtctcgagagtcatttgagcgcgaaaacgacctccggtccttccaagccccgtacgactgcaacgcccagacgcggacgcccctctgcttcgcgtgctgccgcagccgcaacttccccgactgttgccgatgaaggcgaaacgtctccggtaacggaaactcctgctgccaaggcaccgcgtacgcgccgcacgaagactgcggctcccgcgacggaaaagacggcggaagtgaagacaccagcacgccggccccgcaaggcagccacgcctgctgccgagtccgcgactgaaagcgaagcccctgctccgaaaacgacaggacgccgcaagaaggctgttacagaaccggaagcagtgaccgagcctgccgaggcggctgcagccgcaccggcccctcgtcgtcgtcgctccacaaaagcagccgagaccgtgacggaagaggtcgaagccgcccccaaacgccgtggccgtccccgcaagacgccggttgtggaacagcccgccgccgaagtcgtgacggaagaaaccgtggaagctcctgccgcgccgcgccgtcgtggccgtccccgcaaggtggatgtcgcagctgccgcagaggccccggtagaagcgcccgtcgaaaagaaggcgtgcccctcccgtcgcaaggcctccgccccggtcgtggaaaccccggaacccgctgccgaagaaacccctgccgttcaggccgagcccacgaagagcgaaaagcctgtacggcgccgccgcaccaaagcggccactgcaacaccggctgtcgttgaagaaaccgttgaggcacccgccgtcgttgagaccgtcgtggttgccgaggacgtgtccgacaggccgcgctttgccgatctgggactgagcgagccgatcatgcgggccatcgaggagctaggttatgaacaccccactcccattcaggcccaggccattcccgaagtcctgaagggccatgacgttctgggtgtcgcccagaccggaaccggcaagacggcctctttcacgctgccgatgctccagaagctggctggctcccgcgcccgcgcccggatgccgcgctcgctgatcctggagcccacgcgtgaactggcattgcaggttgccgagaacttcaagctctacggtaaatatctgcgtctgacccatgcgctgctgatcggtggcgagagcatggccgaacagcgtgacgtgctgaaccgtggcgtggatgtactgatcgcgactccgggccgcctgctcgacctgttcggacgtggcggcctgcttctgacgcagaccagcacgctcgtgatcgacgaagccgaccgcatgctggacatgggcttcattcccgatatcgaaaaaattgtggcactcctgcccgcccatcgccagaccctgttcttctccgccacgatggcgccggaaatccgccgtctggccgatgctttcctccgtcacccggtggaaatcacggtgtcgcgtcaatcttccgtggccacgacgatcgaagaagctctggtcatcgtgccggaggacgagaagcgtcgcacgctcaagaagctgctgcgtcgtgagaacgtccagagcgccatcgtgttctgcaatcgcaagcgcgatgtggacatgatccagcagtatctgaccaagcatgacatcgaagccggacatcttcacggagatctagcccaatccctgcgcttctcgacgctggagcgtttccgctctggtgaactgaagttcctggtatgctcggatgtggcagcgcgcggcatcgatatcggcggcctgtcgcatgttttcaattatgatctgccgttcaacgcggaagattatgtgcatcgcatcggacggaccggtcgtgcaggcaacgaaggccatgccttcagcctggcaaccccgcgcgatcgcagactgctggaagccatcgagaccctgacaggcaaggtaattgcccgtccggttcttgaaggcatcacgaccgttgactgggcgcccgaagagggtgaacgccgcccggccgaaaccgcgacgcccgcaccgcaggacgtggcggaagaaggagagcagcgtccccgcaagcgccgtcgtggcggtcgcaagcgcaatcgtggcgatcgcgacgagagcgagaccgttcagcaggttgctcccacagccgtcgcttctgtcgcggtgatcgaggcccctgtcagccaccgttcggttgaactggcccccgctttcgagaacgatgggccaaagacgggctttggtggtgatacgcccgctttcatgctggtcccgcgccgcaggaaagtcacggtttccggtagcaccgatcctgctgctcctgttcagcatgatgggcgccattacggtaatgaatga

SEQ ID NO: 79671 - protein, 793 aa, Gluconobacter oxydans 621H
MCAVKESLESHLSAKTTSGPSKPRTTATPRRGRPSASRAAAAATSPTVADEGETSPVTETPAAKAPRTRRTKTAAPATEKTAEVKTPARRPRKAATPAAESATESEAPAPKTTGRRKKAVTEPEAVTEPAEAAAAAPAPRRRRSTKAAETVTEEVEAAPKRRGRPRKTPVVEQPAAEVVTEETVEAPAAPRRRGRPRKVDVAAAAEAPVEAPVEKKACPSRRKASAPVVETPEPAAEETPAVQAEPTKSEKPVRRRRTKAATATPAVVEETVEAPAVVETVVVAEDVSDRPRFADLGLSEPIMRAIEELGYEHPTPIQAQAIPEVLKGHDVLGVAQTGTGKTASFTLPMLQKLAGSRARARMPRSLILEPTRELALQVAENFKLYGKYLRLTHALLIGGESMAEQRDVLNRGVDVLIATPGRLLDLFGRGGLLLTQTSTLVIDEADRMLDMGFIPDIEKIVALLPAHRQTLFFSATMAPEIRRLADAFLRHPVEITVSRQSSVATTIEEALVIVPEDEKRRTLKKLLRRENVQSAIVFCNRKRDVDMIQQYLTKHDIEAGHLHGDLAQSLRFSTLERFRSGELKFLVCSDVAARGIDIGGLSHVFNYDLPFNAEDYVHRIGRTGRAGNEGHAFSLATPRDRRLLEAIETLTGKVIARPVLEGITTVDWAPEEGERRPAETATPAPQDVAEEGEQRPRKRRRGGRKRNRGDRDESETVQQVAPTAVASVAVIEAPVSHRSVELAPAFENDGPKTGFGGDTPAFMLVPRRRKVTVSGSTDPAAPVQHDGRHYGNE

SEQ ID NO: 79672 - DNA, 1296 bp, Gluconobacter oxydans 621H
  CDS (1)..(1296): transl_table=11
atgaccagtttcgccgaactcaagcttgccgagccaattcagaaggctctcgcggaagaaggctacaccacgccgaccccgattcaggcaggtgccatcccttatctgctcgaaggtcgcgatcttctcggtctggcccagaccggaaccggcaagacggcagcattcgcgcttcccatcctgaaccatatcttcacgaatcgtcgccctgcgccgccgaagggcgtccgtgccttggttcttgcgcccacgcgtgaactggcgtcgcagatcggtgagagctttgccgcttatgcgcgacacatgaagttctcctatgctgtcgtgttcggtggggtcgggcagggacgccagatcgagaccacccgtcgcggtgtggacgtcctcgtggccgcgcccggccgtctgcttgatctgatcgggcagaaacatatcgatctctccactctggaaatcctcgttctcgatgaggccgaccggatgctggacatgggcttcgtgcgcgatatccagcgcatcatggccctgcttcccaagcagcgtcagaccctgctgttttcggcaaccatgccgccgtccatcagcgatctggcccattcgcttctgaagaacccggcaacggttcaggtcacgcctgaatcgagcacggttgatcgcatcaatcaggctgtcatgttcgttgactcgggcagcaagaaagatgcggctctcatgctgctggaaagcccgagcgttgcccgggctgtggttttcacgctgatgaagcatgaagccaacaaggttgccgagttcctgaacaagaacgggatccgcgcggaagccatccacggcaacaagtcccagggtgcccgtgagcgcgctatggccggtttccgcagtggcgccatcaaggctctggtggcaaccgacatcgcggcccgcggtatcgacgtggacgaggtcagccacgtcttcaattacgatctgccgaatgtaccggaatcctacgttcaccgtatcggccgtacggcccgggcagggcgtgagggttgcgcagtctccctgtgtgacgctgaacagcgcgcatggctcaaggatattgagaagaagatcggcaagcccattccggttgtaacggatcatcccttccattccgaagaggctcgactgtccacgcagcgtccgccggttctgggcggtggtcgtggtggcggcggtggcggacgccgtcgctcgggaccgccctcgggtggtcgcccaggtggcggccgtggtggcgccccgggtcgtggtggtccccgcccaggcgcgcgctga

SEQ ID NO: 79673 - protein, 431 aa, Gluconobacter oxydans 621H
MTSFAELKLAEPIQKALAEEGYTTPTPIQAGAIPYLLEGRDLLGLAQTGTGKTAAFALPILNHIFTNRRPAPPKGVRALVLAPTRELASQIGESFAAYARHMKFSYAVVFGGVGQGRQIETTRRGVDVLVAAPGRLLDLIGQKHIDLSTLEILVLDEADRMLDMGFVRDIQRIMALLPKQRQTLLFSATMPPSISDLAHSLLKNPATVQVTPESSTVDRINQAVMFVDSGSKKDAALMLLESPSVARAVVFTLMKHEANKVAEFLNKNGIRAEAIHGNKSQGARERAMAGFRSGAIKALVATDIAARGIDVDEVSHVFNYDLPNVPESYVHRIGRTARAGREGCAVSLCDAEQRAWLKDIEKKIGKPIPVVTDHPFHSEEARLSTQRPPVLGGGRGGGGGGRRRSGPPSGGRPGGGRGGAPGRGGPRPGAR

SEQ ID NO: 79674 - DNA, 1299 bp, Gluconobacter oxydans 621H
  CDS (1)..(1299): transl_table=11
atgtccccaacttctgcccaggcttttgccgatctcgccctggcgcccacgcttctccgcgcgctggacgaagcgggttacgtcaaacccacgcccattcaggcccagtccattccgctgcttcttgaaggccgtgatctgctcggtctggcccagaccggcaccggcaagacagcctctttcgcgctgcccctgctgcaccggctcgccgcaacgccccgtcccgcacccaaaaacggcgcgcgcgttctggttctggcacccacgcgtgaactggtttcccagattgcggacgggttcgagagcttcagccgtcaccagccggtgcgcgtcaccacgattttcggcggcgtcagtcaggtgcatcaggtcaaggcgcttgaagagggcgtggacatcatcgtcgccgcaccgggacgcctgctggacctgatcgagcagggtctatgcgacctgtcgcagcttgagacgctggttctggacgaagcggaccagatgctggacatgggctttgccaagccgatcgaacgcattgtcgcaacgctccccgaagaccggcacacggtgctgttttccgcaacgatgccgaaatccatcgcagccctcgtcgagagcctcctgcgtaacccggccaaggtcgagatcgcaccgccctcgagcacggtggaccggatcgcgcagtcggtcatgttcctcaacgcatccgacaaaaaagcggcccttctggcgcagctccggacgccgggcatcggtcaggccgtcgtcttcacgctgcagaagaacatcgccaacgacgtctgcaccttcctgacggaatccggcattacggccgaggccctgcacggcaaccgctcgcagggtcagcgcgagcgcgccctgaacgccttccgcgaaggcgacgttcaggttctggtggcgaccgatatcgccgcccgcggcattgacgtcgataccgtcacgcatgtgatcaaccacgacctgccgagcctgccggaaagctatgtgcaccggatcggccgcacgggccgtgcgggccgcagcggttttgccatcacgctctgcgatgctgagcagcgcgcctggctgcatgccgtcgagcgtgaaatcggccggactctggacgttcatgacagccatgaatggcactcggaagaggcccggaactccaccatgcgcccgcccgtgctcggcggcggtccggtcaagcaggtcaagccgcagaaggtgcgcgagcgccgcgtctggaccgaagaggaaaagatggccgcccgggccgcggcggctgccaaagcgtcctga

SEQ ID NO: 79675 - protein, 432 aa, Gluconobacter oxydans 621H
MSPTSAQAFADLALAPTLLRALDEAGYVKPTPIQAQSIPLLLEGRDLLGLAQTGTGKTASFALPLLHRLAATPRPAPKNGARVLVLAPTRELVSQIADGFESFSRHQPVRVTTIFGGVSQVHQVKALEEGVDIIVAAPGRLLDLIEQGLCDLSQLETLVLDEADQMLDMGFAKPIERIVATLPEDRHTVLFSATMPKSIAALVESLLRNPAKVEIAPPSSTVDRIAQSVMFLNASDKKAALLAQLRTPGIGQAVVFTLQKNIANDVCTFLTESGITAEALHGNRSQGQRERALNAFREGDVQVLVATDIAARGIDVDTVTHVINHDLPSLPESYVHRIGRTGRAGRSGFAITLCDAEQRAWLHAVEREIGRTLDVHDSHEWHSEEARNSTMRPPVLGGGPVKQVKPQKVRERRVWTEEEKMAARAAAAAKAS

SEQ ID NO: 79676 - DNA, 1488 bp, Lactobacillus acidophilus NCFM
  CDS (1)..(1488): transl_table=11
ttgaaattttcagaattaggattaaacgaagcgcttcttaaagcgattaaacgctcaggatttgaagaagcaactccaatccaggaacaaactattccccttgctctagagggtaaggatgtaattggccaagcacaaactggtactggtaagactgctgcatttgggttaccaattttacaaataattgataaaaaagaaaaggcaattcaagcaattattattgaaccaactcgtgaacttgctattcagactcaagaagagctctttcgtttaggtcgcgatgaacgtgcacatgtacaagtagtatatggtggtgctgatattggccgtcaaattcgttcattaaagcatcatgtaccatcaattttagtggggacaccaggccgtttacttgatcatttaaagcgtggcacaattgacttagataaagttaagactgtagttttagatgaagcagatgaaatgcttgatatgggatttattcaagatattgaaagtattttgaaatatgctaagaatcgtaatcaaacattgcttttcagtgcaacaatgccaaagccaattttgcgaattggtgaaaagttcatgaacaatcctgaaattgttcaaattaaagctaaagaacttactgcagatttaattgatcaatactttgttcgtgcaaaggaatcagaaaaatttgatattatgtgtcgtttaattgatgtacaaggaccagatttagctgtggtctttggtcgaactaagcgacgcgtagatgaacttacacgcggtttacaagctcgtggctacaatgctgcaggaattcacggtgacttatcacaagcacgtagaatggccgtattgaagcgattccgtgaaggtaagcttgatattttggtcgcaacggacgttgctgctcgtggacttgatatttcaggtgtaactcacgtttataattacgatattccacaggatcctgactcttatgttcaccgtatcggcagaactggacgtgcaggtcaaaacggaatttctgttactttcgtaacacctaatgaaattggctatatgcgtacaattgaacaacttaccaagaagaagatgtcaccacttcgtccaccaacagacgatcaagcacttcgtggtcaattgaaacaagctaaggcacaaattgaagacttaataaatagtgatcttggtaaatatacccaagatgctagtgaacttttggataattattctgcagttgatttagttgctgcatttttaaagaatttatctaaggattcaactgatattaaggttaagattacaccagaaaaaccattaccatacaagggcgatggtcgccgtaatcgtagaggacacggtcgtggccgcaacaataatcgcaatcatggcaattatcgtcgccgtaataataattatcgccataatggtaatcgcggcaaacgtggtcgtggcaatggacacgaatttgttattaaaagcaaagaaaagtaa

SEQ ID NO: 79677 - protein, 495 aa, Lactobacillus acidophilus NCFM
MKFSELGLNEALLKAIKRSGFEEATPIQEQTIPLALEGKDVIGQAQTGTGKTAAFGLPILQIIDKKEKAIQAIIIEPTRELAIQTQEELFRLGRDERAHVQVVYGGADIGRQIRSLKHHVPSILVGTPGRLLDHLKRGTIDLDKVKTVVLDEADEMLDMGFIQDIESILKYAKNRNQTLLFSATMPKPILRIGEKFMNNPEIVQIKAKELTADLIDQYFVRAKESEKFDIMCRLIDVQGPDLAVVFGRTKRRVDELTRGLQARGYNAAGIHGDLSQARRMAVLKRFREGKLDILVATDVAARGLDISGVTHVYNYDIPQDPDSYVHRIGRTGRAGQNGISVTFVTPNEIGYMRTIEQLTKKKMSPLRPPTDDQALRGQLKQAKAQIEDLINSDLGKYTQDASELLDNYSAVDLVAAFLKNLSKDSTDIKVKITPEKPLPYKGDGRRNRRGHGRGRNNNRNHGNYRRRNNNYRHNGNRGKRGRGNGHEFVIKSKEK

SEQ ID NO: 79678 - DNA, 1455 bp, Xanthomonas oryzae pv. oryzae KACC10331
  CDS (1)..(1455): transl_table=11
ttgcttttgcatctgcaatgcgtttgcgctccgggcctggcttggtggcgacgctttacctggagcttcctgatgtcttttgaatccctgggccttgcgcccttcctgctgcgcgcgttggccgagcagggctatgaaacccccactgcaatccagcagcaggcgatcccgttggtgctggccggtcacgacctgctggccggcgcgcagaccggtaccggcaagaccgccgccttcggcctgccgctgctgcagcacctgggcacctcgccgcagccggtcaacggcccgcgcaagccgcgcgcgctgatcctgacccccacccgcgaactggccacccaggtgcatgacagcctgcgcggctacagcaagtacctgcgcattcccagcgcagtgatctacggcggcgtgggcatgggcaaccagctcgacaccctgcgccgtggcgtggacctgctgatcgcctgcccgggccggctgatcgatcatatcgagcgccgcagcgtggacctgtccggcatcgaagtgctgatcctggacgaagccgaccgcatgctcgacatgggcttcttgccgtcgatcaagcgcatcctgaccaagctgccgcgccaggaccgtcagaccctgctgttctccgcgaccttcgaagagaacatcaagcagctggcgctggagttcatgcgcaacccgatgcagatccaggtcaccccgagcaacaccgtggccgagagcatcacccaccgcgtgcacccggtcgatggcgcgcgcaagcgcgatctgctgctgcacctgctggcgcaggacagccgcgaacagaccctggtgttcgcgcgcaccaagcacggcagcgacaagctggcgctgttcctggagaagtcgggcatcaagaccgcggccatccacggcaacaagagccagggccagcgcatgcgtgccctgagcgacttcaaggccggccgcgtgaccgtgctggtcgccaccgatatcgctgcgcgcgggatcgatatcgaccagctgccgaaggtcatcaactacgacctgccgatggtggccgaggattacgtgcaccgcatcggccgcaccggccgtaacggctccaccggcgaggcgatctcgctggtggcgcaggacgaagccaagctgctgcgtcagatcgtgcgcatgctgggccgcgacgtggaaatccgcgacgtgccgggctacgagccgcagacgccgatccgttggggcaacagcgcaccgggtcgcgccgagcagccgggcggcgatcgcgccccgcgcaagagccacgcccgtcgcccgcatggcgatgcaccgcgtcaggcgcacgcgcatgccggcccgaagaagccgggtggccagcgcagcggcgggccgcgtcaggccaacgctggcccgggtgcaggccgtcgcgacggcggtcgcggtggtcagcgtccgagcggtacgcgctaa

SEQ ID NO: 79679 - protein, 484 aa, Xanthomonas oryzae pv. oryzae KACC10331
MLLHLQCVCAPGLAWWRRFTWSFLMSFESLGLAPFLLRALAEQGYETPTAIQQQAIPLVLAGHDLLAGAQTGTGKTAAFGLPLLQHLGTSPQPVNGPRKPRALILTPTRELATQVHDSLRGYSKYLRIPSAVIYGGVGMGNQLDTLRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSGGPRQANAGPGAGRRDGGRGGQRPSGTR

SEQ ID NO: 79680 - DNA, 1944 bp, Xanthomonas oryzae pv. oryzae KACC10331
  CDS (1)..(1944): transl_table=11
atgttgaaccttatcgctcacgttgggtctcctggaaaccaaaacggcccacccgaacgggcaggccgctacattgcgttaaactggggcattgcgcgactgaatcaagtgtcagtcctaaagccgcgctgtccgccacaagagccgcagtttgcgacgctgtcggcatcgatgcaagccgcgcccgggctgccctgggcgcctcacgaagacggaataatgagcgacaaaccgctaaccgatgtgaccttttcctcgttcgacctgcatccggcgttggtcgccgggctggagagcgcagggtttacccgctgtaccccgatccaggcgctgaccttgccggtcgcgctgccgggcggcgatgtcgccggccaggcccagaccggcaccggcaagaccctggcgttcctggtggcggtgatgaaccgcctgctgaatcgcccggccctggccgaccgcaagcccgaagacccgcgcgcgctgattctggcgccgacccgcgaactggcgatccagatccacaaggacgcggtcaagttcggcgccgacctcggcctgcgctttgcgctggtctatggcggtgtggactacgacaagcagcgcgaactgctgcaacagggcgtggacgtgatcatcgccaccccgggccgcctgatcgactacgtcaagcagcacaaggtggtgtcgctgcacgcctgcgaaatctgcgtgctggacgaagccgaccgcatgttcgacctgggcttcatcaaggacattcgcttcctgctgcggcgcatgcccgagcgtggcacccggcagacgttgttgttctcggccacgctcagccaccgcgtgctggagctggcttacgagcacatgaacgagccggaaaagctcgtcgtcgagaccgagaccatcaccgccgcgcgggtgcgccagcgcatctatttcccgtccgacgatgagaagcagacgctactgttgggtttgttgtcgcgtagcgaaggcgcgcgcacgatggtcttcgtcaacaccaaggcattcgtcgagcgcgtggcgcgcaccctggagcggcatggctaccgcgtcggcgtgctgtcgggcgacgtgccgcagaagaagcgcgagtcgctgctcaaccgcttccagaagggccagctcgaaatcctggtggccacggacgtggccgcgcgcggtttgcacatcgacggcgtcaagtacgtctacaactacgatctgccgttcgacgccgaagactacgtgcaccgcatcggccgcaccgcgcgtctgggtgaggaaggcgatgcgatcagtttcgcctgcgagcgctacgcgatgagcctgccggacatcgaggcctacatcgagcagaagatcccggtcgagccggtgacctccgagctgctgacgccgttgccgcgtgcagcgcgcgtgccggtggagggcgaagaggccgatgacgaggcgggcgacagcgtcggcacgatcttccgcgaagcgcgtgaacagcgtgctgccgaagaacagcgtcgtggtggcggccgcagtggtcctggcggcgggtcgcgcagcggcagtggtggcggccgccgcgatggcgccagcgccggtgccgatggcaagccgcgtccgcgccgcaagccgcgggtggaaggcgaagcgcctgcggctgcggcgcagaccgaaaaaccggtggttgctgccgcagcggcgcaggcgccttccgttggcatggccgatgccgaacgcgcaccgcgcaagcgtcggcgtcgtcgcaacggtcgtccggtcgaaggtgccgagccggcagtggcatccaccccgattgccgcgcctgccgcaccgcgcaagcccacccaggtggttgccacgccggtgcgcgcggcaaacaagtcgtcgggcagcccgtcgctgctcggccggatcggccgccggctgcgttccctggtctcgggcaactga

SEQ ID NO: 79681 - protein, 647 aa, Xanthomonas oryzae pv. oryzae KACC10331
MLNLIAHVGSPGNQNGPPERAGRYIALNWGIARLNQVSVLKPRCPPQEPQFATLSASMQAAPGLPWAPHEDGIMSDKPLTDVTFSSFDLHPALVAGLESAGFTRCTPIQALTLPVALPGGDVAGQAQTGTGKTLAFLVAVMNRLLNRPALADRKPEDPRALILAPTRELAIQIHKDAVKFGADLGLRFALVYGGVDYDKQRELLQQGVDVIIATPGRLIDYVKQHKVVSLHACEICVLDEADRMFDLGFIKDIRFLLRRMPERGTRQTLLFSATLSHRVLELAYEHMNEPEKLVVETETITAARVRQRIYFPSDDEKQTLLLGLLSRSEGARTMVFVNTKAFVERVARTLERHGYRVGVLSGDVPQKKRESLLNRFQKGQLEILVATDVAARGLHIDGVKYVYNYDLPFDAEDYVHRIGRTARLGEEGDAISFACERYAMSLPDIEAYIEQKIPVEPVTSELLTPLPRAARVPVEGEEADDEAGDSVGTIFREAREQRAAEEQRRGGGRSGPGGGSRSGSGGGRRDGASAGADGKPRPRRKPRVEGEAPAAAAQTEKPVVAAAAAQAPSVGMADAERAPRKRRRRRNGRPVEGAEPAVASTPIAAPAAPRKPTQVVATPVRAANKSSGSPSLLGRIGRRLRSLVSGN

SEQ ID NO: 79682 - DNA, 1905 bp, Vibrio fischeri ES114
  CDS (1)..(1905): transl_table=11
atgtcagaatctattactgaatttcgccaactggctttagacgaatcaatcttatctgcacttgatgatatgggctttgtagctccaactcctattcaagcagcttcgattcctctacttctagaaggccgtgatgctcttggtaaagcgcaaacaggtactggtaaaacagctgcattctctttaccactattaaacaaaatcaatcttaagcaacataacccacaagcaattatcatggcaccaacgcgtgaacttgctattcaggttgctgctgaagttaaaaaccttggtcgtaacatcaagggtcttaaagttttagagatctacggtggtgcatctatcgttgatcaaatgcgtgctctaagccgcggtgctcatatcatcgttggtactccaggccgtgttaaagatttactaaaccgtgaccgtctaaacttaggcgaagttcatacgttcatcctagatgaagcagatgaaatgcttaaaatgggctttgttgatgatgtaacttggattcttgaaaaagcaccagatacagctcaacgtatccttttctctgcaactatgcctccaatggttaaaacaatcgttgatcgttacctacgtgagcctgctcgtgtagacgttgctggtactaaccacacggttgataaagtagagcaaaacttctgggttgttaaaggcgtagaaaaagacgaagcaatgtctcgtctacttgaaactgaagaaactgatgcgtcaatcgtattcgttcgtactcgtcaagatactgagcgtctagctgattggttatctgctcgtggctttaaagctgctgcactgcacggtgatatccctcagtctcaacgtgaacgtactgttgataacatcaaaaacggcgttatcgatatcctagttgctactgacgtagttgctcgtggtcttgatgttccacgtattactcacgtatttaactacgatatcccatttgatgttgaatcttacatccaccgtatcggtcgtacaggtcgtgctggacgtaaaggtaaagcgatccttctagttcgcacaaaccaaatgcgtatgcttcgtacaatcgagcgtgtaactaagtcaacaatggaagaaattcaacttccacatcgtgaccaagttgcagaatgtcgtttagctgctttagctgctgaacttcaagcggataaagaatttgttgctcttgatgcgtttactgatctaatcaataaacttcaagaaacactagaaatcgatgcaactacaattgctgcaatgctacttaagcgtcagcaaggcaagcgtcctttattctacaaaggtccagacccaatgatcgctgctatggaacgtgctaagaatcgtcgttctgatcgtggcgaacgtggtgagcgcggtggccgtggtgatcgtcctgagcgtggtgaacgtcgtcaatacaataacgatgacttcgatacataccaattagaagtaggtcgtgagcaaggcgttcaagttaaagacatcgtaggtgctctagctaacgaacttggtttcacaaaaggttctatcggtgcaattaaacttgctcctggccacacatacgtacaacttcctaagaaaatgtctgcagatgttgctggcaaacttaagaaactacgtattcgtcaaaacgaaacaaaagcggttgttgttgaaggtgttgacctaacaatcgaacgtcgtcctcgcactggtggtggtcgtgatgataaccgtggtggcaatggccgtggcggttaccgtggtaatcgtgaaaaccgtgaaggtggccgtggtggcgagcgtcgtttcgatcgcaacaaaggtggtgatcaccgtggtagtcaccgtggcgagcgtgcaccaggcggccgtggccgtggtcgcagcgagcgtagcgaaggttaa

SEQ ID NO: 79683 - protein, 634 aa, Vibrio fischeri ES114
MSESITEFRQLALDESILSALDDMGFVAPTPIQAASIPLLLEGRDALGKAQTGTGKTAAFSLPLLNKINLKQHNPQAIIMAPTRELAIQVAAEVKNLGRNIKGLKVLEIYGGASIVDQMRALSRGAHIIVGTPGRVKDLLNRDRLNLGEVHTFILDEADEMLKMGFVDDVTWILEKAPDTAQRILFSATMPPMVKTIVDRYLREPARVDVAGTNHTVDKVEQNFWVVKGVEKDEAMSRLLETEETDASIVFVRTRQDTERLADWLSARGFKAAALHGDIPQSQRERTVDNIKNGVIDILVATDVVARGLDVPRITHVFNYDIPFDVESYIHRIGRTGRAGRKGKAILLVRTNQMRMLRTIERVTKSTMEEIQLPHRDQVAECRLAALAAELQADKEFVALDAFTDLINKLQETLEIDATTIAAMLLKRQQGKRPLFYKGPDPMIAAMERAKNRRSDRGERGERGGRGDRPERGERRQYNNDDFDTYQLEVGREQGVQVKDIVGALANELGFTKGSIGAIKLAPGHTYVQLPKKMSADVAGKLKKLRIRQNETKAVVVEGVDLTIERRPRTGGGRDDNRGGNGRGGYRGNRENREGGRGGERRFDRNKGGDHRGSHRGERAPGGRGRGRSERSEG

SEQ ID NO: 79684 - DNA, 1383 bp, Vibrio fischeri ES114
  CDS (1)..(1383): transl_table=11
atgactggttatttatcaataatactcgaaattggagtgcagcttttgcaatttaaagatttaggtttagataatcgcctattaaaaaatctcgctcaccagaacattaaaacaccaactgaaattcaacgtaaagctgttcctgttgctattgcaggtaaagatgttcttgcgtcgtcaaaaacaggttcaggtaaaacactggcattcgttttaccaatgcttcacaaatcactgaaaacgaaatctttctcaaagaatgatcctcgagcagtgattcttgcgcctacacgtgaattagcaaaacaagtatacagtcatttacgtgcaatgcttggtggcttaacttatgacgcgacattgattacaggcggtgagaactttaatgaccaagtgaatgcattacgcaagcaccctaagttcattgttgccactccaggacgtttagctgaccaccttgagcatcaatctctgtaccttgatggtttagaaacactgatccttgatgaagctgaccgtatgttagatcttggttttgctgagcatttgcaaaagattcataaagcagcaagtcaccgtcgtcgtcaaacattaatgttctcagcaacgcttgatcacgatgcagtgaataagttcgcaggtaacatgctagataatccaaagcgtatctctgtaggtttatcgaatgatgagcacaaagacattacgcaacgtttctatctatgtgaccatttagatcacaaacaagcgatcttaaacaaaatcattgagactgaagattacttccaaatcatgattttcacagcaacacgctccgatactgatcgtttaactaaactattaaacgaagaaaacttaaaagctgtagcgctaagtggtgatatgaaccaaaccgctcgtaataacattatgagtcagtttgagcgtcgtgttcacaaaatcttagtaacaaccgatgttgcttctcgtggtttagacttaacaagtgtaacgcacgtaattaactttgatatgcctaagcatatggaagagtatgttcaccgtgttggtcgtacaggccgtgcaggtaagaaaggtactgcgatttctcttgttggtccaaaagactgggaaagctttaaacgtgtagaaaccttcttacaacaagatttgtctttctctgtatttgaagaattaaaaggcaaatttaaaggattgaaaccgaaacataagcgtacgtttgtgaaaaaaggtgatcctaagaaatttaaagcgaagggtaatcaaaacaaacctaaagcgcctaagaaacgtgataactcgttccatacaaatgtggcagttggcgatcaggtatttatgccaaagaaaaagcccaagcaaattgtggttgatgacgagtaa

SEQ ID NO: 79685 - protein, 460 aa, Vibrio fischeri ES114
MTGYLSIILEIGVQLLQFKDLGLDNRLLKNLAHQNIKTPTEIQRKAVPVAIAGKDVLASSKTGSGKTLAFVLPMLHKSLKTKSFSKNDPRAVILAPTRELAKQVYSHLRAMLGGLTYDATLITGGENFNDQVNALRKHPKFIVATPGRLADHLEHQSLYLDGLETLILDEADRMLDLGFAEHLQKIHKAASHRRRQTLMFSATLDHDAVNKFAGNMLDNPKRISVGLSNDEHKDITQRFYLCDHLDHKQAILNKIIETEDYFQIMIFTATRSDTDRLTKLLNEENLKAVALSGDMNQTARNNIMSQFERRVHKILVTTDVASRGLDLTSVTHVINFDMPKHMEEYVHRVGRTGRAGKKGTAISLVGPKDWESFKRVETFLQQDLSFSVFEELKGKFKGLKPKHKRTFVKKGDPKKFKAKGNQNKPKAPKKRDNSFHTNVAVGDQVFMPKKKPKQIVVDDE

SEQ ID NO: 79686 - DNA, 1389 bp, Neisseria gonorrhoeae FA 1090
  CDS (1)..(1389): transl_table=11
atgtctattaaatttgccgatttgaaccttgataaaaacattttgtccgccgtcagcagcgagggttacgaaagcccgacgccgattcaggcgcaagctattccgtttgctttggaaggctgcgacatcatggcttcggcgcaaaccggctccggaaaaaccgcagcctttctgttaccgactttgcagcgactgaccaaacgcagcgaaaaaccgggcaaaggcccgcgcgcgctggtgttggcaccgacccgcgaactggcggcgcaagtcgagaaaaacgcactggcgtatgccaaaaatatgcgctggttccgcaccgtcagcatcgtcggcggcacatcgttcggctaccaaacccgcgccctgagcaaaccggtcgatttgattgtcgccactccgggccgtctgacggacctgatgcaaagcggcaaagttgattttgaacgtttggaagtgctgattttggacgaagccgaccgtatgttggatatgggctttatcgacgacatcgaaaccatcgtggaagccaccccggccgaccgtcagactttattgttctccgccacttgggacggcgcagtcggcaaactggcgcgcaaactgaccaaagactctgaaattatcgaagtcgaacgcgtggacggccaaggcaaaatcgaagagcagttgttgtactgcgacgatatgcgccacaaaaaccgcctgctcgaccacatcctgcgcgatgccaacatcgaccaatgtgtgattttcacgtccaccaaagcgatgaccgaagtcatcgcggatgaattgtacgaaaaaggtttcgccgccaactgcctgcacggcgatatgccgcagggctggcgcaaccgcacgctgacggatttgcgtaaaggccgctgcaaaattttggttgccaccgacgttgccgcacgcggtattgacgtaccgaccattacccacgtcataaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgcaaactgcccgaactgaccatcgaaggcatggagccggcccgcaaacgcaaatccgcaggcggcaagccgaaaggcaaaggcggctggggcgataggaaatccggcggccggcgcggcgatcataaaccgggcaaagaaggcttcggcggcaaaacgcgcggcgaaggtttcaagaaagaaggctttaagaaagacagtttcaaaaaaaccggcgaaggcttcaaaggcaaacgcaaagccggcgactcttttgcaggcaaaagcgaacgccgttacaaagaccgctaa

SEQ ID NO: 79687 - protein, 462 aa, Neisseria gonorrhoeae FA 1090
MSIKFADLNLDKNILSAVSSEGYESPTPIQAQAIPFALEGCDIMASAQTGSGKTAAFLLPTLQRLTKRSEKPGKGPRALVLAPTRELAAQVEKNALAYAKNMRWFRTVSIVGGTSFGYQTRALSKPVDLIVATPGRLTDLMQSGKVDFERLEVLILDEADRMLDMGFIDDIETIVEATPADRQTLLFSATWDGAVGKLARKLTKDSEIIEVERVDGQGKIEEQLLYCDDMRHKNRLLDHILRDANIDQCVIFTSTKAMTEVIADELYEKGFAANCLHGDMPQGWRNRTLTDLRKGRCKILVATDVAARGIDVPTITHVINYDLPKQAEDYVHRIGRTGRAGRTGIAITFAEVNEYVKVHKIEKYINRKLPELTIEGMEPARKRKSAGGKPKGKGGWGDRKSGGRRGDHKPGKEGFGGKTRGEGFKKEGFKKDSFKKTGEGFKGKRKAGDSFAGKSERRYKDR

SEQ ID NO: 79688 - DNA, 1551 bp, Rhodobacter sphaeroides 2.4.1
  CDS (1)..(1551)
atgaccaagttctccgacctcgcgctggatccccgcgtgctgaaggccgtgcaggaagccggctacgaaacgcccaccccgatccaggcgcaggccatcccgcatgcgctggaaggcaaggatgtgctgggcatcgcccagaccggcaccggcaagaccgccagcttcacgctgcccatgatcaccatcctcggcaagggccgcgcgcgcgcccggatgccgcgcagcctcgtgctctgcccgacgcgcgagcttgcagcccaggtggccgagaatttcgacatctatgccaagcactccaagctctcgaaggcgctgctgatcggcggcgtctccttcaccgagcaggacaagctgatcgaccgcggcgtggacgtgctgatcgccaccccgggacgcctcctcgaccatttcgagcgcggcaagcttctgctcaccggcgtgcagatcatggtggtggacgaggccgaccggatgctcgacatgggcttcatcccggatatcgagcgcatcttctcgctgacgcccttcacgcgccagacgctgttctactcggccaccatggcgcccgagatcgagcggatcaccaacaccttcctcaccggcgcggtgaagatcgaggtggcgcggcaggccacgacctccgagacgatcgagcagaagctcatccaggtcacaccgacgcggaaggagcgtagcttcgccgacaagcgcgccgtcctgcgggcgctgatccgggccgaaggcgaggcctgcaccaacgcgatcatcttctgcaaccggaagatggacgtggacgtggtggccaagtcgctgaagcagcacggcttcaacgcgtcgcccatccatggcgatctcgaacagtcgcagcgcatgaagacgctcgacgggttccgcgacgggtcgttgcacctgctcgtagcctccgacgtggccgcgcgcgggctcgacattccggcggtgagccatgtgttcaacttcgacgtgccgacccaccccgaggattacgtccaccgcatcggccggaccggccgcgcgggccggaagggcaaggcctacacgatcgccgtgccgtcggacgagaagcatgtgaccgccatcgagagcctcgtgaaacaggcgatcccgcgcggcgagctgcccgagggcttcagcctcgaggatcgccccgaccggcccgagcgtgacaacgcacgcggcgagcggtccgaacgccctgcgcgcggccgtcgcggccgcgaccgcgaccggcgcgaggagccccgggtcgaggccgtggaagccccggccgcggccgttcccgaagtgcgggaagtgcgcgaggagcgcccgccccgccgcgaagagcggcgcgacgagcgccgcgagggcggcaacaaccggcgcgagcgtgaccgcgaccgccgcgaggaacgcgtggtgggcatgggcgaccatgtgccggacttcctgctccgcagcttccgcatcccgagcctgacggcctccgacgaagaggagcccgtccccgaggccgcggaagagatgctggcgggcgacggcgaggcctga

SEQ ID NO: 79689 - protein, 516 aa, Rhodobacter sphaeroides 2.4.1
MTKFSDLALDPRVLKAVQEAGYETPTPIQAQAIPHALEGKDVLGIAQTGTGKTASFTLPMITILGKGRARARMPRSLVLCPTRELAAQVAENFDIYAKHSKLSKALLIGGVSFTEQDKLIDRGVDVLIATPGRLLDHFERGKLLLTGVQIMVVDEADRMLDMGFIPDIERIFSLTPFTRQTLFYSATMAPEIERITNTFLTGAVKIEVARQATTSETIEQKLIQVTPTRKERSFADKRAVLRALIRAEGEACTNAIIFCNRKMDVDVVAKSLKQHGFNASPIHGDLEQSQRMKTLDGFRDGSLHLLVASDVAARGLDIPAVSHVFNFDVPTHPEDYVHRIGRTGRAGRKGKAYTIAVPSDEKHVTAIESLVKQAIPRGELPEGFSLEDRPDRPERDNARGERSERPARGRRGRDRDRREEPRVEAVEAPAAAVPEVREVREERPPRREERRDERREGGNNRRERDRDRREERVVGMGDHVPDFLLRSFRIPSLTASDEEEPVPEAAEEMLAGDGEA

SEQ ID NO: 79690 - DNA, 1830 bp, Xylella fastidiosa Ann-1
  CDS (1)..(1830)
atgtcaaatccatcttctacgccgctgctgtttgcagatctcggcctctccgatgctgtgatgcaagccgtcacaaaaatcggctacgaaactccgtcgcccatccaggcggcgaccatcccagccttgcttgctgggcgcgatgtgctgggccaagcccagaccggcactgggaagactgccgcattcgcgctaccgttgctcacacgcaccgttctgaaccaggtcaagccgcaagtgctcgtactggcacccacccgcgaactggctatccaagttgccgaagcattccagcgctacgctgcctcaatctctggcttccgtgtcctacccgtgtacggcggccaatcctatggccaacaactggccgcactgaaacgtggtgtccatgtgatcgtcggtaccccgggccgggtgattgatcacctagagcgcggcaccctggatctatcggaattaaaaacgctggtcctcgacgaagccgacgaaatgctgcgtatgggtttcattgaggacgttgaagaagtcctacggaagttgcccgcttcacgccaggtcgctctgttctcagcaaccatgccaccacagatccgccgtatcgcacaaacctatctacaagatccgattgaagtcaccatcgcaaccaaaaccacgaccgcggccaacatccgccaacgttactggtgggtcagcggcctccacaagcttgatgcactcacacgcattcttgaggtggaaaccttcgacgcaatgattatcttcgtgcgcaccaaagctgccaccgaagaattggccgagaaattgcaggcacgtggtctgaccgccgcagcgatcaatggcgatatgcaacaagcgcaacgcgaacgcaccattcaccaactcaaagatggcaagctggatatcctcgttgccaccgacgtcgccgcacgtggtttggacgtagaacgtatcagccacgtgctgaactacgacatcccttacgacgttgagagctacgtccaccgtatcggacgcactgggcgtgccggtcgcagcggcgaagcaatcctctttgtgactccgcgcgaaaaaggcatgctgcgccagattgaacgtgccactcaccaaccgatcgaagccatgcaactgcccagtgtggatgcagtcaacgacacgcgcgtgaccaaatttttcggacgcatcagcaatgctctggtggtcggcgctgaaatcgacttctaccgcaaactgctgcaacgtttcgagagcgagcacaatgtccctgccattgagatcgctgctgccctggcacgactccttcagggggatagccccttcctgctgagtgtcccgacgcgcccccaacgcgagcgcagcgagctggcatccgagcatcatgtcaaacgcccctcatccttcaagcagacagagcgtccaaacaacactgaacaccccaagcgcccccaacgcaacgcacctgcccgcaatgtcccagagttcggtatggagtcttaccgcatcgaagtcggccgcatgcacggtgtgaagccagccaatatcgtcggcgctatcgccaacgaagctggattagagagccgctacattggccggattgacatccgtgacgatcactcggttctggatctccccgcagaaatgccacacgagatcctgcaacacctaaaaaaggtctgggtatcaggacagcaactacaaatgcgtcggatcgacacaaccgaaacaaccgcacctgcacgggaatttaagtcaaaatcgggtggcgctggcaaattcccgccgaaaccccatcacaacaaatcaaccaaaccaaaaccaccatacagcggttga

SEQ ID NO: 79691 - protein, 609 aa, Xylella fastidiosa Ann-1
MSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMRRIDTTETTAPAREFKSKSGGAGKFPPKPHHNKSTKPKPPYSG

SEQ ID NO: 79692 - DNA, 1656 bp, Magnetospirillum magnetotacticum MS-1; identical to SEQ ID NO: 38867
  CDS (1)..(1656)

SEQ ID NO: 79693 - protein, 551 aa, Magnetospirillum magnetotacticum MS-1; identical to SEQ ID NO: 38868

SEQ ID NO: 79694 - DNA, 1209 bp, Magnetospirillum magnetotacticum MS-1
  CDS (1)..(1209)
atgaccgttctgttttccgaactcggcctggccgaacccctgttgaaggcgcttgaggccgaaggctacaccacgccgacccccattcaggaacaaagcattccccatctgctgcagggtagcgacgttctgggcctggcccagaccggcaccggcaagaccgccagcttcgccctgccgctgctccagcgcctggaccagttcaagaagcgcgccatgcccaagagctgccgcatcctggtgctcacccccacccgcgaactggcggtgcaggtgggtcagagcttcaagacctatggctgccattaccgtctgcgccacgctttggtgttcggcggcgtcggcatggtgccgcagatcaagaccatggcgggcggcgtcgatgtgctggtggccacgcccggccgactgctcgacctgatcgaccagggcgccatccgcctggattcggtcgaggcgctggtcctcgacgaggccgaccgcatgctcgacatgggcttcatccagcccatccgcaagatcgtcgccatggtgcccaagcagcgccagaccgttctgttctcggccaccatgcccgattccatcgtcggcctggccaattccgtgctgcacacgccggtgcgtgtcgaggtgaccccggtctcctccaccgtggacaagatcgaccagaaggttctgttcgtcgaccgcgagcataagcgcaccttgctgaccgatatcctgggcggtgccgatgtggtccgcgccctggtcttcacccgcaccaagcacggcgccaaccgcgtggtcgaactgctggagaaggccggtatcgatgccgacgccatccacggcaacaagagccagggcgcccgccagaaggctctgtccgacttccgcgacggcaagatcaaggcgctggtcgccaccgatatcgcggcgcgcggcatcgatgtggacggcatcactcacgtgatcaatttcgagctgcccaacgagccggaaagctatgtccaccgcatcggccgcaccgcgcgcgccggggcttcgggcatcgcgctgtctctgtgcgacggtgacgagtcgcttatctgcgcgacatcgaaaagacatccgtcagggatccccgggattacgagcagcctacatggcgccatatcgcaccggggccgccggggctcgcgcacaagcgcgagccctcggggcgggggcagacggcacccatggtag

SEQ ID NO: 79695 - protein, 402 aa, Magnetospirillum magnetotacticum MS-1
MTVLFSELGLAEPLLKALEAEGYTTPTPIQEQSIPHLLQGSDVLGLAQTGTGKTASFALPLLQRLDQFKKRAMPKSCRILVLTPTRELAVQVGQSFKTYGCHYRLRHALVFGGVGMVPQIKTMAGGVDVLVATPGRLLDLIDQGAIRLDSVEALVLDEADRMLDMGFIQPIRKIVAMVPKQRQTVLFSATMPDSIVGLANSVLHTPVRVEVTPVSSTVDKIDQKVLFVDREHKRTLLTDILGGADVVRALVFTRTKHGANRVVELLEKAGIDADAIHGNKSQGARQKALSDFRDGKIKALVATDIAARGIDVDGITHVINFELPNEPESYVHRIGRTARAGASGIALSLCDGDESLICATSKRHPSGIPGITSSLHGAISHRGRRGSRTSASPRGGGRRHPW

SEQ ID NO: 79696 - DNA, 1323 bp, Azotobacter vinelandii
  CDS (1)..(1320)
atgttttcccaattcgccctgcacgaacgcctgctcaaggcgctggccgaactgaatttcgtcgagcccacgccggtgcaggcggcagcgattccgccggctctggaggggcacgacctgcgggtgatcgcccggaccggcagcggcaagaccgcggccttcgtgttgccgctgctcaacggcctgatcggcgatgcccgaccgcgggtgagcatccgcgcgctgatcctgctgccgacccgcgagctggcgcagcagaccctcaaggaggtcgagcgcttctcgcagttcaccttcatcaagtccggactggtgaccggcggcgagaacttcaaggtgcaggcggcgctcctgcgcaaggtgccggacatcctgatcggtacgccgggccgcctgctcgaacacctgaacgccggccatcttgatctgcgggacgtggaggtgctggtgctcgacgaggccgaccgcatgctcgacatgggcttcgccgaagatgtgcagcgcttggtcgagtcttgtgccaaccgtcggcagaccctgctgttttccgccaccaccggcggttccgggctgcgcgagatggtcgccaaggtgctgcgcgagccgcggcacctgatgctcaacgcggtcggcgaactctccgagaccactcgccagcagatcgtcacggcggacgatccggcccacaaggagcgcctggtgcattggctgctggagaacgaaacctaccgcaaggcgatcgtcttcaccaacacccgcgcccaggcggaccggctctacgggcatctggtcgccgccggccacaaggccttcgtcctgcacggcgagaaggaccagaaagaccgcaaattggccatcgaacggctcaggcagggcggcgccagggtgctggtggccaccgatgtggcggcacgcgggttggacgtggacggcctggatctggtgatcaacttcgacatgccgcgctcgggcgacgagtacgtgcatcgcgtcggccgcaccggccgggccggcgccgagggactggcggtctcgctgatctgccacaacgactggaacctgatgtcgagcgtcgagcgttacctcaagcaacgcttcgagcggcgcgtcatcaaggggctcaagggcagctatcagggtccgaagagcctcaaggcttccggcaaggccgccggcaccaagaagaaaaagaccgacgacaggaaaggtggcaaaaagccggccgccaaggccgccccccggcgcaagccggcaggaccggcgctggtcagccaggatggcctggccccgctcaagcgtcgcacgccggcgccggaatgatag

SEQ ID NO: 79697 - protein, 439 aa, Azotobacter vinelandii
MFSQFALHERLLKALAELNFVEPTPVQAAAIPPALEGHDLRVIARTGSGKTAAFVLPLLNGLIGDARPRVSIRALILLPTRELAQQTLKEVERFSQFTFIKSGLVTGGENFKVQAALLRKVPDILIGTPGRLLEHLNAGHLDLRDVEVLVLDEADRMLDMGFAEDVQRLVESCANRRQTLLFSATTGGSGLREMVAKVLREPRHLMLNAVGELSETTRQQIVTADDPAHKERLVHWLLENETYRKAIVFTNTRAQADRLYGHLVAAGHKAFVLHGEKDQKDRKLAIERLRQGGARVLVATDVAARGLDVDGLDLVINFDMPRSGDEYVHRVGRTGRAGAEGLAVSLICHNDWNLMSSVERYLKQRFERRVIKGLKGSYQGPKSLKASGKAAGTKKKKTDDRKGGKKPAAKAAPRRKPAGPALVSQDGLAPLKRRTPAPE

SEQ ID NO: 79698 - DNA, 1890 bp, Pseudomonas syringae pv. syringae B728a
  CDS (1)..(1890)
atgtcctttgcttccctcggtctctccgaggctttagtccgcgccatcgaggcagccggctatacccagcctacccccgtgcaacagcgggccattcccgccgtgttgcaaggtcgcgacctgatggttgcggcacagaccggtactggtaaaaccggcggtttcgccctccctattctggagcggctgtttcccaatggtgttccggacaaatcccagcgtcacggcccgcgtcaaccgcgcgttctggtcctgaccccgacccgcgaactggccgcacaggtgcacgagagcttcaagctctatgcccgcgacctgaagttcgtcagcgcctgcatcttcggcggcgtcggcatgaacccgcaggttcaggccatgtcccgtggtgtggacgtcctggtggcctgccctggccgcctgctcgacctggccggtcaaggcagtgtcgacctctcccacgtcgaaatcctggtgctcgatgaagcagaccggatgctcgacatgggcttcgtgcatgacgtcaagaaggtcctcgcgcggctgccggccaagcgccagaacctgctgttctcggctaccttctccaatgacatcacgtcgttggccggcaagctgctgcacaacccagagcgcatcgaagtcacgccgccgaacaccacggtcgagcgcatcgagcaacgggttttccgcctggcagccaaccacaagcgttcgctgctggcgcacctgattaccgtcggcgcctgggaacaggtgctggtcttcacccgcaccaagcacggtgccaaccgtctggccgagtacctggacaagcacggccttgcggctgtcgcgatccacggcaacaagagccagaacgcccggaccaaggccctggccgacttcaaggcaggcgatgtacgcatcatggtcgcgaccgatatcgccgcacgcggcctggatatcgatcagttgccgcatgtcgtcaacttcgagctgcccaacgtcgacgaagactacgtgcaccgtatcggtcgtaccggccgtgccggtcgctctggtgaagccatttcgctggttgcgccggacgaagagaagctgctcaaaagcatcgagcgcatgaccaagcagaagatcgccgacggcgacctgatgggcttcgacatcactgcagtcgaggctgagaagcctgaagtgcgtgagcgtccggatgttcgcaactcgcgtggcgcacgtcctgcacgtggcgatggcgacaagaacaacggtggtcgtcgcgacaagggcaaggataaaggcaaggaaaaacctgctgctgcctccgccactggcgaacgccctgcaaggcagccacgcgaaaaaaaacctcgtgagggcacgcctcgcagcgaacagcgtgcatcgcaacccgccacaccgcgcccggcagccgatcgtgcccctgacgagttccgtgacgatgaagtagacaactttggcaaccgcgcggactacgtcagtccttatcagggcaaaggccagaaccgtggtcgtcgccctgctgccgcgcctggcgcagccgcaccggccgctggcggcgctgctcgcccggccaatccgggtcgccctgccggtggcgctcgcaacggctcgggcagtggcgcgccaaagcgcaacggctcgggttcatcggcaccacgctcgcgtgatggtcagccacgtggccgtcgtccggcacgtgaagaccagcccttgccacgtgaaggtcaggagccagccgcacgcgcaccacgcgacggccagcctcagccgaagatcgtgcacaaggaatccaagatcgaccgtttcccgtctgccgagcaactggaccagttgccaagccgcccacgcggtgaaaaaccggccctgctgacccgcaaccgcgacagctga

SEQ ID NO: 79699 - protein, 629 aa, Pseudomonas syringae pv. syringae B728a
MSFASLGLSEALVRAIEAAGYTQPTPVQQRAIPAVLQGRDLMVAAQTGTGKTGGFALPILERLFPNGVPDKSQRHGPRQPRVLVLTPTRELAAQVHESFKLYARDLKFVSACIFGGVGMNPQVQAMSRGVDVLVACPGRLLDLAGQGSVDLSHVEILVLDEADRMLDMGFVHDVKKVLARLPAKRQNLLFSATFSNDITSLAGKLLHNPERIEVTPPNTTVERIEQRVFRLAANHKRSLLAHLITVGAWEQVLVFTRTKHGANRLAEYLDKHGLAAVAIHGNKSQNARTKALADFKAGDVRIMVATDIAARGLDIDQLPHVVNFELPNVDEDYVHRIGRTGRAGRSGEAISLVAPDEEKLLKSIERMTKQKIADGDLMGFDITAVEAEKPEVRERPDVRNSRGARPARGDGDKNNGGRRDKGKDKGKEKPAAASATGERPARQPREKKPREGTPRSEQRASQPATPRPAADRAPDEFRDDEVDNFGNRADYVSPYQGKGQNRGRRPAAAPGAAAPAAGGAARPANPGRPAGGARNGSGSGAPKRNGSGSSAPRSRDGQPRGRRPAREDQPLPREGQEPAARAPRDGQPQPKIVHKESKIDRFPSAEQLDQLPSRPRGEKPALLTRNRDS

SEQ ID NO: 79700 - DNA, 1329 bp, Pseudomonas syringae pv. syringae B728a
  CDS (1)..(1329)
atgacattcgcctctctcggcctgatcgaacccttgctgcgcgccctcgaagcgctcggttaccagactccgacgcctgtacagacccaggcaattcctccggtactggcgggccgcgatctgatggcagctgcgcagaccggcaccggcaagaccgcaggttttgccttgccgctgctgcaacggctgaccatggaaggcccgaaagtcgcgcccaactcgattcgcgcgctggtactggcgccgacccgcgagctggccgatcaggttcacgaaagcattcgtcagtacgccgagcatctgccgctgaccacctacgcggcttacggcggcgtgagcatcaacccgcaaatgatgaagctgcgcaggggcgtcgacgtgctggtcgcgacccccggtcgcttgctcgatctgcatcgccagaacgcggtcaagttctcccagttgcagacgctgatcctcgatgaagctgatcgtatgctcgacctgggttttgccgaggaactgcgcggtatctacgcggtgttgcccaagcagcgccagaccctgctgttctccgcgacgttctctgacgagattcgtctgctggccgcgcagatgctcaatgacccgctgaccatcgaagtcagcccgcgcaacgtcgcggcgtcttcggtcaagcaatgggtcgtgaccgtcgacaagaaacgcaaggcggatctgttcatccatctgatgaagaagcatcgctggggtcaggtgctggtattcgccaagacccgggttggcgtcgatcaactggtggatcgcttgcaggcgctgggcatgaacgccgacggcattcatggcgacaaaccgcaggccactcgccagcgtgcgctggaccgcttcaagagcaacgaagtgaagattctggtcgccaccgacgtggcagcgcgcggtctggacattgatgacctgccgaccgtggtcaacctggacctgccgatcgtggccgaggattacatccaccgtattggccgcaccggccgtgcggggctgacgggggaggcaatttcgctggtgtgtgccgatgaggtcgagttgctgtcagccatcgaagtgctgacccgccagaccctggagcgcaaggaagagcaggacttcgagccggagcatcgcgtaccgagcacggatgccagcggccagatcctgaaaaagcccaagaaaccgaaaaaatccaaggtgtcgggcagcaagcgcaacctgggcaaatgggtcgacagcggcgactccgagcctgcgccggtggtcaaaccggtgcgtaaagtaccggtcttcaacaccgggccacgcaagaagaagccttga

SEQ ID NO: 79701 - protein, 442 aa, Pseudomonas syringae pv. syringae B728a
MTFASLGLIEPLLRALEALGYQTPTPVQTQAIPPVLAGRDLMAAAQTGTGKTAGFALPLLQRLTMEGPKVAPNSIRALVLAPTRELADQVHESIRQYAEHLPLTTYAAYGGVSINPQMMKLRRGVDVLVATPGRLLDLHRQNAVKFSQLQTLILDEADRMLDLGFAEELRGIYAVLPKQRQTLLFSATFSDEIRLLAAQMLNDPLTIEVSPRNVAASSVKQWVVTVDKKRKADLFIHLMKKHRWGQVLVFAKTRVGVDQLVDRLQALGMNADGIHGDKPQATRQRALDRFKSNEVKILVATDVAARGLDIDDLPTVVNLDLPIVAEDYIHRIGRTGRAGLTGEAISLVCADEVELLSAIEVLTRQTLERKEEQDFEPEHRVPSTDASGQILKKPKKPKKSKVSGSKRNLGKWVDSGDSEPAPVVKPVRKVPVFNTGPRKKKP

SEQ ID NO: 79702 - DNA, 1860 bp, Actinobacillus pleuropneumoniae serovar 1 str. 4074; identical to SEQ ID NO: 38883
  CDS (1)..(1860)

SEQ ID NO: 79703 - protein, 619 aa, Actinobacillus pleuropneumoniae serovar 1 str. 4074; identical to SEQ ID NO: 38884

SEQ ID NO: 79704 - DNA, 1338 bp, Actinobacillus pleuropneumoniae serovar 1 str. 4074
  CDS (1)..(1338)
atgaccactgaaaccccattaatgacctttgaggaattggatttagcccctcaactgttaaaagcactaaataaaaaaggctacaaacgcccgacttctgtacaagcggaaaccgttccgcacgcgcttgacggacgtgatttacttggctcggcaccaaccggcacaggtaaaaccgccgcatttttattgccggcgattcaacatttgttagattacccacgtcgtaaaccgggcgcaccacgcattttaattttaaccccaacccgtgaacttgcgatgcaagtggcggaagaagcgcaagcttttgccgaatttaccaaacttagtattgcaacgattaccggcggtgtagcgtatcaaaaccacggtgaagtgtttaacagcaaccaagatatcgtggtcgcgacaccgggacgtttaatgcaatatatcaaagaagaaaactttgactgccgtgcggtggagattttgatctttgatgaagcggatcgaatgctacaaatgggtttcggtcaagatgcggaaaaaattgcggcggaaacccgttggcgtaaacatacctggttattctcagcaacgctggaaggcgagttgttagtcgattttactgatcgcattttggataacccgttaaaaattgatgcggaaccaagtcgccgtgagcgtaaaaaaatccaacaatggtattatcatgcggacaatgtggaacacaaaaccaaattgcttgcccgtttaatttctacgatggaaatggaaaaagcgattgtgttcgttcgccgccgtgaagatgtacgcgagttaagtgatacgttacgtaaacgtggcttacgttcaacttatttagaaggcgatatggcgcaaactcagcgtaaccaagcgattgctcgtttaaaagacggcgtggtaaatgtgttggtggcgacggatgttgccgcacgtggtattgatattgatgatgttgattatgtgattaacttcgatttaccgtacagtgcggatacctatttgcaccgtatcggtcgtaccgcacgtgccggtaaaaaaggctcggcaatctcattggtggaagcacacgattacaaactcttaggtaaaatcaagcgttataccgaggagttattaaaaccgagagtgatcgaaggtttagaacctcgtaccaaagcgccgaaagacggtgagttgaacactacgaccaaaaaagaaaaagcacgcattaaaaaacgtaaagaagcgaaaaaagaagcggcaaaagccaaagtaaaagtgcgtcataaagacactaagaatgttggtaaacgtcgtaaaccggcttctgaagcagcaaagtctgcgtaa

SEQ ID NO: 79705 - protein, 445 aa, Actinobacillus pleuropneumoniae serovar 1 str. 4074
MTTETPLMTFEELDLAPQLLKALNKKGYKRPTSVQAETVPHALDGRDLLGSAPTGTGKTAAFLLPAIQHLLDYPRRKPGAPRILILTPTRELAMQVAEEAQAFAEFTKLSIATITGGVAYQNHGEVFNSNQDIVVATPGRLMQYIKEENFDCRAVEILIFDEADRMLQMGFGQDAEKIAAETRWRKHTWLFSATLEGELLVDFTDRILDNPLKIDAEPSRRERKKIQQWYYHADNVEHKTKLLARLISTMEMEKAIVFVRRREDVRELSDTLRKRGLRSTYLEGDMAQTQRNQAIARLKDGVVNVLVATDVAARGIDIDDVDYVINFDLPYSADTYLHRIGRTARAGKKGSAISLVEAHDYKLLGKIKRYTEELLKPRVIEGLEPRTKAPKDGELNTTTKKEKARIKKRKEAKKEAAKAKVKVRHKDTKNVGKRRKPASEAAKSA

SEQ ID NO: 79706 - DNA, 1704 bp, Psychrobacter sp. 273-4; identical to SEQ ID NO: 38891
  CDS (1)..(1704)

SEQ ID NO: 79707 - protein, 567 aa, Psychrobacter sp. 273-4; identical to SEQ ID NO: 38892

SEQ ID NO: 79708 - DNA, 1569 bp, Methanococcoides burtonii DSM 6242; identical to SEQ ID NO: 38893
  CDS (1)..(1569)

SEQ ID NO: 79709 - protein, 522 aa, Methanococcoides burtonii DSM 6242; identical to SEQ ID NO: 38894

SEQ ID NO: 79710 - DNA, 1524 bp, Dechloromonas aromatica RCB; identical to SEQ ID NO: 38897
  CDS (1)..(1524)

SEQ ID NO: 79711 - protein, 507 aa, Dechloromonas aromatica RCB; identical to SEQ ID NO: 38898

SEQ ID NO: 79712 - DNA, 1278 bp, Dechloromonas aromatica RCB
  CDS (1)..(1278)
atgcatttttccgatctcggcctgaaggccgaactcctgcgcgccgttgccgatcaaggctacgatacgccgacccccatccagcagcaggccattcctgccgtcatgaccggccgcgacctgatggccacggcccagaccggcaccggcaagacagccggcttcaccctgcccatcctgcaccgcctgtgcagcggcccgaacgaccgcctgacccgcgttgccaagacgccgcgcgtgctggtcctgacaccgacgcgtgaactggccatccaggtcgaggaaagcgtgcgcacttacggcaagcatctgccgatcacttcactggccgtctttggcggcgttggtatcaatccgcagatcgccaacctgcgccgtggggtcgatattctggtggcgacgccggggcgtttgctcgatcatgtccagcaacgcaccgttgatctgtccaagatcgagattttcgtcctcgatgaagccgaccgcatgctcgacatgggcttcatccgcgacatccgcaagatcatcgccctattgccgaaacagcgccagaacctgatgttctcggccaccttctcgccggatattcgcgaactggctgccggactgctgcacaatccggcctcggtcgatgttgcggcgcgcaataccgccgccgaaacggtcacccagcgcgtcatcgaaaccaatcgcgatcagaaaaaagagctgctctgtcaccttttcgaaacgcgcggctggcatcaggtgctggtttttgcccggaccaagcatggtgccgatgcgttgtccaagacgctggaaaaagccggtatcaagtcggctgccattcacggcgacaagtcgcagggcgcccggacccgtgccctgaccgaattcaaggaaggcaagctggttgctctggtggccactgacatcgcggcacgtggcatcgatattgacgcgctgccctatgtcatcaactacgaactgcccaatgttgccgaagactacgtgcaccgcatcggtcgtaccggccgggccgggatggaaggcgaggcaatttcgctggtctcccacgatgagcgcggtagcctgcgcgacatcgaaaggctgatcaagcgggatcttgagcgcgttgtcattccgggttttgagccatcggccattgcaccgccgaagccggttcagccgccgcgtggcgcgcgcaagccgcaaccaggtcggccatccgcgcagaaaacggcccaaaagccgggtggtccggcgcaacatcgcagcggcagccggcatcgctga

SEQ ID NO: 79713 - protein, 425 aa, Dechloromonas aromatica RCB
MHFSDLGLKAELLRAVADQGYDTPTPIQQQAIPAVMTGRDLMATAQTGTGKTAGFTLPILHRLCSGPNDRLTRVAKTPRVLVLTPTRELAIQVEESVRTYGKHLPITSLAVFGGVGINPQIANLRRGVDILVATPGRLLDHVQQRTVDLSKIEIFVLDEADRMLDMGFIRDIRKIIALLPKQRQNLMFSATFSPDIRELAAGLLHNPASVDVAARNTAAETVTQRVIETNRDQKKELLCHLFETRGWHQVLVFARTKHGADALSKTLEKAGIKSAAIHGDKSQGARTRALTEFKEGKLVALVATDIAARGIDIDALPYVINYELPNVAEDYVHRIGRTGRAGMEGEAISLVSHDERGSLRDIERLIKRDLERVVIPGFEPSAIAPPKPVQPPRGARKPQPGRPSAQKTAQKPGGPAQHRSGSRHR

SEQ ID NO: 79714 - DNA, 1344 bp, Dechloromonas aromatica RCB
  CDS (1)..(1344)
atgaccttctcttcgctcggcctcgccgccccactgctccaggccctcgaaacgctcggctacgaaacaccgacaccgatccaggcccaggccattcctgccgttctcgccgggcgcgacctgatggccgcggcgcagactggcactggcaagaccgccggcttcgcgctgcccattctgcagcgcctcagtgaaagcgaagacaaggtcgccagcaattcgatccgcgtgctggtcctggtaccgacccgcgaattggctgagcaagtccatgccagtttccgccagtacggcgaacatctggccgtcagcacctatgcggcctacggcggcgtcagcatcaacccgcagatgatgcgcctgcgccgtggtgtcgatgtgctggtcgccacgccaggcaggctgatcgatctgttcacccagaacgccatcaagttcaagcaggtacagacgctggtcctcgacgaggccgaccgcatgctcgaccttggcttcgcccatgaactcgacacgctgttcgccgccctgcccaggaagcgccagaccctgctcttctcggccactttctccgacgaaatccgcagcctggccaagggccgcctgcgcgaccccctgtccatcgaagtcgcgccgcgcaacagtaccgtcaaggcgatcaagcaatgggtcgtgcccgtcgacaagaaacgcaagaccgaactgttcctgttcatgcgcaaggaccgcaagtggggtcaggtgctggtcttcgtcaagacccggcgcggtgttgatgagctggtggccaccctgctcgccaagaagatcaaggccgatgccatccacggcgacaagccacaaccggcccgcctgcgcgcgctggaaagtttcaaggccggcgaagtgcagatcctggtcgccaccgacgtcgccgcccgcggcctggacatcgacgacttgccgcaggtggtcaattacgacctgcccatcgtcgccgaagactacattcaccgcatcggccgtaccggccgggccggcgccaccggccaggccatctcgctggtctgcgccgacgaagcccccctgctcgctgccatcgagacgctgatcaagcagaccttgagccgcgaggaagaacccggcttcgagccggatcatcgcgtgccactgacgggtgccagcgccatcgcggccaagaaaccgaaaaagcccaaggtcgccggcggccggggcggtaagggcgtcccgggcaactgggtcggcttcgatgaaggtggcggaaagcgcagtggcgctcgcagcaccggaggaccgcgatcagcggccaaaggcagcccgaaagcaggcaaggcacgcggccgctga

SEQ ID NO: 79715 - protein, 447 aa, Dechloromonas aromatica RCB
MTFSSLGLAAPLLQALETLGYETPTPIQAQAIPAVLAGRDLMAAAQTGTGKTAGFALPILQRLSESEDKVASNSIRVLVLVPTRELAEQVHASFRQYGEHLAVSTYAAYGGVSINPQMMRLRRGVDVLVATPGRLIDLFTQNAIKFKQVQTLVLDEADRMLDLGFAHELDTLFAALPRKRQTLLFSATFSDEIRSLAKGRLRDPLSIEVAPRNSTVKAIKQWVVPVDKKRKTELFLFMRKDRKWGQVLVFVKTRRGVDELVATLLAKKIKADAIHGDKPQPARLRALESFKAGEVQILVATDVAARGLDIDDLPQVVNYDLPIVAEDYIHRIGRTGRAGATGQAISLVCADEAPLLAAIETLIKQTLSREEEPGFEPDHRVPLTGASAIAAKKPKKPKVAGGRGGKGVPGNWVGFDEGGGKRSGARSTGGPRSAAKGSPKAGKARGR

SEQ ID NO: 79716 - DNA, 1281 bp, Anabaena variabilis ATCC 29413; identical to SEQ ID NO: 38909
  CDS (1)..(1281)

SEQ ID NO: 79717 - protein, 426 aa, Anabaena variabilis ATCC 29413; identical to SEQ ID NO: 38910

SEQ ID NO: 79718 - DNA, 1494 bp, Ralstonia eutropha JMP134
  CDS (1)..(1494)
atgacaactacgaccctacctgaccagaacgcagccgagcagacgttcgagagcttcggcctggacgcgcgcatcctgcgcgcgctgtccgaacaaggctacaccaagcccacgccgatccaggcgcaggccattccggtggtgctgctcggcaaggacgtgatgggcgcggcacagaccggcaccggcaagaccgccggtttcgcgctgccgatcatccagcgcctgttgccgatggcgagcgccagcgcctcgccggcgcgccacccggtgcgtgcgctgatgctcacgcctacgcgcgaactggccgaccaggtctatgacaacgtcgcccgctacgccaagcacactgacctgcgcagcacggtggtgttcggcggcgtggacatgaacccgcagaccgacgcgctgcgccgtggcgtggaaatccttgtggccacgccgggccgcctgctcgaccacgtgcagcagaagtcggtgaacctgtcgcaggtgcagatgctggtgctggacgaggccgaccgcatgctcgacatgggcttcctgccggacctgcagcgcatcatcaacctgctgccggcgcagcgccagacgctgctgttctcggccacgttctcgcccgagatcaagcgcctggccgccagctacctgaagcagccggtcacgatcgaagtggcgcgcagcaactccaccaacgaaaacgtgcgccagatggtgtaccaggtggaagacggccagaagcaggccgccgtggtgcacctgctgcgccagcgtgcggagcagggcctgtcgaaacagtgcatcgtgttcgtcaacagcaagattggctgctcgcgcctggcgcgtcacctggaacgcgaaggcatcaacgctgccgcgatccacggcgacaagacgcagaccgagcgcatgcagacgctcgaaggtttcaagaacggcaccatcgacgcactcgtggcgactgacgtggccgcacgcggcctcgacatcgccgacatgccgtgcgtgatcaacttcgacctgccgttcagcgccgaagactacgtgcaccgcatcggccgtaccggccgcgccggcgccagcggtgacgcgctgtcgatcttcgtgccgggcgacgaacgcctgctgaccgatatcgagaagctgatcaagcgaagcgtgccgcgcggtacgctcgaaggctttgacccgaccggcgaaaaggcccgccaggaagactctgatcgtcgccgtcagcgcaccgacgtgcgccgtgcgcgcggcaatggtgacggtgagggggaagaccgccgtcgccgccacgaccacggcggttcgcgctccgcgttccgcccgtcggacgacccattcttctcgcgtccgtacgagcccagcccgaacagcgcctcggccaagcccgccgacgaaatgattgccgcggccctgtcgcgtggccgccaggcgcccaagcggccggttgccgcattgctcggcggcgcgccgcgcaagtcctga

SEQ ID NO: 79719 - protein, 497 aa, Ralstonia eutropha JMP134
MTTTTLPDQNAAEQTFESFGLDARILRALSEQGYTKPTPIQAQAIPVVLLGKDVMGAAQTGTGKTAGFALPIIQRLLPMASASASPARHPVRALMLTPTRELADQVYDNVARYAKHTDLRSTVVFGGVDMNPQTDALRRGVEILVATPGRLLDHVQQKSVNLSQVQMLVLDEADRMLDMGFLPDLQRIINLLPAQRQTLLFSATFSPEIKRLAASYLKQPVTIEVARSNSTNENVRQMVYQVEDGQKQAAVVHLLRQRAEQGLSKQCIVFVNSKIGCSRLARHLEREGINAAAIHGDKTQTERMQTLEGFKNGTIDALVATDVAARGLDIADMPCVINFDLPFSAEDYVHRIGRTGRAGASGDALSIFVPGDERLLTDIEKLIKRSVPRGTLEGFDPTGEKARQEDSDRRRQRTDVRRARGNGDGEGEDRRRRHDHGGSRSAFRPSDDPFFSRPYEPSPNSASAKPADEMIAAALSRGRQAPKRPVAALLGGAPRKS

SEQ ID NO: 79720 - DNA, 1356 bp, Methylobacillus flagellatus KT; identical to SEQ ID NO: 38917
  CDS (1)..(1356)

SEQ ID NO: 79721 - protein, 451 aa, Methylobacillus flagellatus KT; identical to SEQ ID NO: 38918

SEQ ID NO: 79722 - DNA, 1383 bp, Methylobacillus flagellatus KT; identical to SEQ ID NO: 38919
  CDS (1)..(1383)

SEQ ID NO: 79723 - protein, 460 aa, Methylobacillus flagellatus KT; identical to SEQ ID NO: 38920

SEQ ID NO: 79724 - DNA, 1548 bp, Methylobacillus flagellatus KT; identical to SEQ ID NO: 38921
  CDS (1)..(1548)

SEQ ID NO: 79725 - protein, 515 aa, Methylobacillus flagellatus KT; identical to SEQ ID NO: 38922

SEQ ID NO: 79726 - DNA, 1335 bp, Mesorhizobium sp. BNC1
  CDS (1)..(1335)
ttgaccaaagacaacattctgccttccggcggcttcgccgatctgggcatcagcgaaacgcttctgaaggcagcagcggctgccggcatgaccgaaccgaagcccatccaaaaagaagccattccgcctttcctcgcgggcagcgatattctgggcgtcgctcagaccggttccggcaagaccgcggcattctccctgcccattctgtcgaagatcatcgggcttgggacgaagcggcgtccgcgcacggcgcgtgctctcatcctggtgccgacccgcgagctcgcggtgcagatcgagaaggtcgtgcgcgaacttgccaagggcgctcacgtctccaccgcgctggtgctcggcggcgtttcccgccattcacagataaagcggatggctcagggcgtggacgtgctgatcgccacgccgggccggctgacggatctcgtgcgcgatggggcagtcgtcctttcggagacgacctggctcgtgctcgacgaggcggaccgcatgctggacatggggttcatcaacgatgtccgtcgcatcgcaaaagcaacacatccggcacgccagaccgcactgttttccgcaaccatgccaagggaaatcgaagcgctggcctccagcctgctaaaggaacccgtgcgcattgaagtctctccccagggcaccacggcggcagagatcaggcaaagcgtcataatggcccgcaccaagcagaagcggaagcttctgtcggaaatgctggccgacgagaaaatggcccaagtcatcattttctctcgcaccaaacacggcgcggacagggtgacaaaggaccttcagcacgacggttttcaagcggcggtgattcacggaaacaagtctcagaacgcgaggcagcgcgcgctcaatgatttccgggagggcgcggtgcgcatcctggtggcgacggatatcgccgcccgcggcatcgacgttccgggtatcagtcacgtggtgaatttcgatctgccggacgaggcggagagctatgtgcaccgcatcggccgtaccggccgcaacggtgcggagggcgaggcaatcacgctctgcgatcccggcgaagtttccaagctgcgccaggtggaacgcgtgatacgcaaccgccttccaatcgctcgcgatatcaccggccagccggattctgcaccaaagccccgcgtcccttcggcaattcaaccgcttgccgagggcgtcgaggggaagccgcaaagaaatgccgcgcccaaacggtcgggcgccaagcctccgcgtcaccggcgcaaccgccgcggacagaaaggcggagcgcagcgccccacctcaaaggcggcctga

SEQ ID NO: 79727 - protein, 444 aa, Mesorhizobium sp. BNC1
MTKDNILPSGGFADLGISETLLKAAAAAGMTEPKPIQKEAIPPFLAGSDILGVAQTGSGKTAAFSLPILSKIIGLGTKRRPRTARALILVPTRELAVQIEKVVRELAKGAHVSTALVLGGVSRHSQIKRMAQGVDVLIATPGRLTDLVRDGAVVLSETTWLVLDEADRMLDMGFINDVRRIAKATHPARQTALFSATMPREIEALASSLLKEPVRIEVSPQGTTAAEIRQSVIMARTKQKRKLLSEMLADEKMAQVIIFSRTKHGADRVTKDLQHDGFQAAVIHGNKSQNARQRALNDFREGAVRILVATDIAARGIDVPGISHVVNFDLPDEAESYVHRIGRTGRNGAEGEAITLCDPGEVSKLRQVERVIRNRLPIARDITGQPDSAPKPRVPSAIQPLAEGVEGKPQRNAAPKRSGAKPPRHRRNRRGQKGGAQRPTSKAA

SEQ ID NO: 79728 - DNA, 1371 bp, Methanococcoides burtonii DSM 6242
  CDS (1)..(1371)
ttgattttcccgcttcagcgggcattaaccgaagaaggatatacatcacctactcccatacaagaactatccatcccccatctattggataatagggatatgatcggtatcgctcagacaggaactggcaagacggctgcattcatattgccaattcttcaaaatatgtctgcaattcacaaaaaggcaactccgaaaaaaccacgagtactcgtgcttgccccaacaagggaacttgcagcacagatcggggagagttttgccacttatggcaaatacacccgttacaaacatacagttgtattcggaggtgtcggacagacaccacaggtaagagctctctcaagaggtgtagattgccttgtagcaactccgggcagactgctggatctgatacagcaaggacacatcaagctttcaaatgtagaatattttgtcctcgatgaagcggacaggatgcttgacatgggtttcctcaacgacgtgaacaaaattgtcgatatgctgccaaaaaagcgtcagtcccttttcttttcagccaccatgtccccggagatatctacacttgccaggaagatgctcagcaatcctgcacaggttgaggttactccgcaggcaacaaccgttgagcgcatagagcagttcatctttttcgtggattcggataacaagaacgaattgcttttgcatttactaaggggcgaacatctggactgtgtcctcgtattcacacgtacaaagcaccgtgccaataaggtcactgagatgcttaacaagagcaatatcaatgcgggtgctatccatggaagcaagtcccagacccaccgtacaaaaacgcttcagaatttcaagtccggacaactgcgtgtactggtcgcaacagacatagctgcccgaggaattgatatcgaggacatatcccatgtaataaactatgacctgccgaatatccctgaaagctacgtgcaccgcataggacgtacagcaagagcaggagctgaaggaacagcatactcattctgtgcagcggatgaaagggatttccttcgtgatatcgaaaaactcaccgatatggagatcgaggtcgcagagcataattaccactccgaaaaagcgaagaatgccacaggtgacgcagcgaagccagctcccaagcaacagagaggacgaactggaagcaccggacctaaaagaggtagaggcaaaaaaggagaaggcaaaggcggtagaagtagtagtgctaataaggatagtaaaaataaagatggacgatccgagaacaccaatcgaggccaggctaaaagtacatccaagaagaactcaggtcgaaattctggtcgaggcgcaggtaagcccaaaagcagtcagtaa

SEQ ID NO: 79729 - protein, 456 aa, Methanococcoides burtonii DSM 6242
MIFPLQRALTEEGYTSPTPIQELSIPHLLDNRDMIGIAQTGTGKTAAFILPILQNMSAIHKKATPKKPRVLVLAPTRELAAQIGESFATYGKYTRYKHTVVFGGVGQTPQVRALSRGVDCLVATPGRLLDLIQQGHIKLSNVEYFVLDEADRMLDMGFLNDVNKIVDMLPKKRQSLFFSATMSPEISTLARKMLSNPAQVEVTPQATTVERIEQFIFFVDSDNKNELLLHLLRGEHLDCVLVFTRTKHRANKVTEMLNKSNINAGAIHGSKSQTHRTKTLQNFKSGQLRVLVATDIAARGIDIEDISHVINYDLPNIPESYVHRIGRTARAGAEGTAYSFCAADERDFLRDIEKLTDMEIEVAEHNYHSEKAKNATGDAAKPAPKQQRGRTGSTGPKRGRGKKGEGKGGRSSSANKDSKNKDGRSENTNRGQAKSTSKKNSGRNSGRGAGKPKSSQ

SEQ ID NO: 79730 - DNA, 1434 bp, Burkholderia cepacia R18194
  CDS (1)..(1434)
ttggccgaaccgctggtcaaggcggtcaacgagctcggctacacgtcgccgactccgatccagcagcaggcgatcccggccgtcctcggcggcggcgacctgctcgccggcgcgcagacgggcaccggcaagaccgccggcttcacgctgccgatcctgcaacgcctgcatacgttctacgcggacaatcgcggcgcgaagcgcgcggtgcgtgcgctgatcctcacgccgacgcgcgaactcgccgcccaggtcgaggaaagcgtccgtgcgtacagcaagtacctgaagctgcgctcgaccgtgatgttcggcggcgtcagcatcaatccgcagatcgatgcgctcaagcgcggcgtcgacatcgtcgtcgcgacgccgggccgcctgctcgatcacatgcagcagaagacgatcgacctgtcgaatctcgacatcctcgtgctcgacgaagccgaccggatgctcgacatgggcttcatccacgacatcaagcgcgtgctcgcgaagctgccgccgcagcgccagaacctgctgttctcggccaccttctccgacgagatcaaggcgctcgccgacagcctgctcgactcgcccgcgctgatcgaggtcgcacgccgcaacacgaccgccgaaagcgtcgcgcagaagattcacccggtcgaccgcgaccgcaagcgcgaactgctcacgcacctgatccgcgaacacaactggttccaggtgctcgtgttcacccgcacgaagcacggcgcgaaccggcttgccgagcagctgacgaaggacggcatcagcgcgatggcgatccacggcaacaagagccagtcggcccgtacgcgcgcgctggccgagttcaagaacagcacgctgcaggtgctcgtcgcaaccgatatcgccgcgcgcgggatcgacatcgaccagctgccgcacgtcgtcaacttcgacctgccgaacgtgccggaagactacgtgcaccggatcggccgcacgggccgcgcgggtgcgaccggcgaagccgtgtcgctcgtgtgcgtcgacgaaaagcagctgctgcgcgacatcgagcggctgatcaagcgcgagattccgcaggaagtgatcgcgggcttcgaacccgatccgcacgcgaagccggagccgatccagcagcgccgcgggcagcagcagccgcgcagcggtggcggtggcggcggcaatcgccagccgcgcgcaggcggctcaggccagccggccgcgaaacgcgacggcaatgcgcaaccgaaggcttcgccgcagaaggccgcgaagccgcgcgcgcaagggcaaggccaaggcggcgccggcggcagcggcgggcgtccggccggtggcggcaacagcgcccgcccggcgaacggcaatgccgcgcacccgaaccgcaaccgttcgtcgcgcagcggccagcgcggtcactga

SEQ ID NO: 79731 - protein, 477 aa, Burkholderia cepacia R18194
MAEPLVKAVNELGYTSPTPIQQQAIPAVLGGGDLLAGAQTGTGKTAGFTLPILQRLHTFYADNRGAKRAVRALILTPTRELAAQVEESVRAYSKYLKLRSTVMFGGVSINPQIDALKRGVDIVVATPGRLLDHMQQKTIDLSNLDILVLDEADRMLDMGFIHDIKRVLAKLPPQRQNLLFSATFSDEIKALADSLLDSPALIEVARRNTTAESVAQKIHPVDRDRKRELLTHLIREHNWFQVLVFTRTKHGANRLAEQLTKDGISAMAIHGNKSQSARTRALAEFKNSTLQVLVATDIAARGIDIDQLPHVVNFDLPNVPEDYVHRIGRTGRAGATGEAVSLVCVDEKQLLRDIERLIKREIPQEVIAGFEPDPHAKPEPIQQRRGQQQPRSGGGGGGNRQPRAGGSGQPAAKRDGNAQPKASPQKAAKPRAQGQGQGGAGGSGGRPAGGGNSARPANGNAAHPNRNRSSRSGQRGH

SEQ ID NO: 79732 - DNA, 1452 bp, Burkholderia cepacia R1808
  CDS (1)..(1452)
atgtccttcgcctcgcttggcctgatcgatcctctgctgcgcactctgcaggatctcaactaccagacaccgacgccggtgcaggccaacgcgattcctgcggtgctcggcggcaaggacgtgatggccgcggcacaaaccggcaccggaaaaactgccggctttgcgctgccgttgctgcagcggctggtgcagcatggcccggcggtgtcgagcaaccgcgcgcgcgtgctggtcctcgtgccgacgcgcgagctggccgagcaggtgctgcagagcttcgtcgaatacggcaagggcctggacctgcgctttctggccgcgtacggcggcgtcagcatcaacccgcagatgatgaagctgcgcaaaggcgtggacgtgctggtcgccacgccgggccgtctgctggacctgaaccgccagaacgcggtgcagttcgatcaggtggaaacgctggtgctcgacgaagccgaccgcatgctcgacctcggctttgcccgcgagctcaacgccgtgttcgccgcattgccggcccggcgtcagaccttgctgttctccgcgacgttcaccgacgacatccgcgcgatggcggcgaccattctgcgcaaccccgtcaacatcagcgtgagcccgccgaacacgacggccagccggatcaagcagtgggtggtgccggtggacaagcgcaacaagccggaactgttcatgcatctggtggcggagaacaagtgggagcacgcgctggtgttcgtcaagacgcgcgcgggcgtcgattacctggcggccatgctcgacgaggccggctatgcggtcgacaccattcacggcgacaagccgcagccggcgcgtctgcgcgcgctcgagcgcttcaaggcgcgcgacgtgcagatgctcgtcgccaccgatgtggcggcgcgcggcctcgacatcgacgatctgccgatggtgatcaacgtcgatctgccgatcgtcgcgcaggactatgtgcaccgcatcggccggactgggcgcgcgggcgcgagcggcgtcgcggtgtcgctcgtgtgcgcggacgaagcgccgcaattggctgcgatcgaggcgctgatcggcaagacgttgcgccgcgaggaagagcctggattcgaagccgagcatcgcgtgccggaaaccagcgcgacgggccagctcatcaagaaaccgaaaaagccgaagaagccgaaagtgttgcaggccgcgccggccgccaagccgatgccgggcaagcaggcgcggccgcggagtggggaagggagcggcaagccgggggcgaagcgcgcgggcggcgcgggtgcggcaagcgggaaaggcgcgaaaagcgtgatcagcggcagcccgttcagcgtgcagaagccgcgcggtaaatcgggcggcaagccgggcggtggttcggcctcggcgggcaaagcgacgggtgggcgcggcaaaggctga

SEQ ID NO: 79733 - protein, 483 aa, Burkholderia cepacia R1808
MSFASLGLIDPLLRTLQDLNYQTPTPVQANAIPAVLGGKDVMAAAQTGTGKTAGFALPLLQRLVQHGPAVSSNRARVLVLVPTRELAEQVLQSFVEYGKGLDLRFLAAYGGVSINPQMMKLRKGVDVLVATPGRLLDLNRQNAVQFDQVETLVLDEADRMLDLGFARELNAVFAALPARRQTLLFSATFTDDIRAMAATILRNPVNISVSPPNTTASRIKQWVVPVDKRNKPELFMHLVAENKWEHALVFVKTRAGVDYLAAMLDEAGYAVDTIHGDKPQPARLRALERFKARDVQMLVATDVAARGLDIDDLPMVINVDLPIVAQDYVHRIGRTGRAGASGVAVSLVCADEAPQLAAIEALIGKTLRREEEPGFEAEHRVPETSATGQLIKKPKKPKKPKVLQAAPAAKPMPGKQARPRSGEGSGKPGAKRAGGAGAASGKGAKSVISGSPFSVQKPRGKSGGKPGGGSASAGKATGGRGKG

SEQ ID NO: 79734 - DNA, 1569 bp, Listeria monocytogenes str. 1/2a F6854
  CDS (1)..(1569): transl_table=11
atgacattgacaaaattttcggagttcggactggacgaaaaaattgtaaaatcagtaaatcggatggggtttgaagaagcaacaccaatccaagaaaagacaattccactaggattagaaggtaaagacttaatcgggcaagcacaaacaggtactggtaaaacagccgcttttggtcttccaatgattcacaaaattgaccaaaagagtaacaacgtacaagctttaattattgctccaacacgtgaacttgcaatccaagtttcagaagagctttataaacttagctatgataaacatgtacgtgtgctagcggtttacggtggtagtgatatcagccgtcaaatccgttcacttaagaaaaacccacaaatcgtagttggtacgccaggacgtattttggatcatattaaccgtcgcacactgaaactagatcacgtggaaacacttgtactagatgaagcagacgaaatgctaaacatgggcttcattgatgatatcgaaactattctaaaagaagtaccagcagaacgtcaaactttactattttctgcaacaatgcccgatccaattcgccgtatcggtgaacgtttcatgcatagcccagaacttattcgtattaaagcaaaagaaatgactgcactattaatcgaacaattcttcgtaaaagtgcatgaaaaagaaaaatttgacgtattatctcgtttattagatgttcaagcaccagaattagcaattgtttttggtcgtacaaaacgtcgtgtagacgaactatctcgcgcgcttgatatgcgtggttacgtggctgaaggtatccacggtgacttaacgcaagcaaaacgtatgagcgtactacgcaaatttaaagaaggaaaaattgatgttctagttgcaacagacgtagcagcacgtggacttgatatttccggtgtaacacatgtatataactatgatattccacaagatccagaaagctatgttcaccgtattggtcgtactggtcgtgctggtaaagaaggtatggcgattacattcgtacaacctcgtgaaatgggttatttacgtattgtggaagaaactacgaaaaaacgtatgcaaccacttcaagctcctacatgggacgaagcatttgcaggccaattacgcgtagcaactgaaaaaattcaagaagcaattacagaagaaaacttagctgactacaaaacgtttgctaacgaacttcttgaaaaatacgatgcaactgacatcgcagcagcaatgcttaaaatgttagcgaaagaaccagataaaactcctgtccatattactgaagagcgtccattaccatcccgtggtggcggtggctacaaaggtaaaaatggtaaaggcggcaaaggtggcggctatcgcggcggaagcggcaaaggcggaagctaccgtgatcgtaacaacagcggtaaaggtcgtcgtagcggcggcggttccggtggtggaagcggctctggcggtggcggcaatcgtgatcgtcgtggcggcggagaacaacgcagcggcggcaacaaaggcaactactcacaaaaatctaaataa

SEQ ID NO: 79735 - protein, 522 aa, Listeria monocytogenes str. 1/2a F6854
MTLTKFSEFGLDEKIVKSVNRMGFEEATPIQEKTIPLGLEGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGGGSGSGGGGNRDRRGGGEQRSGGNKGNYSQKSK

SEQ ID NO: 79736 - DNA, 1356 bp, Bacillus cereus G9241
  CDS (1)..(1356): transl_table=11
gtgaaaaactttttagaattaggaattagtgaaacgtttaatcatacattacgtgaaaatggaattacagaagcaaccccaattcaagagcaggcaattcctgttatactgtcaggtaaagatattattgggcaggcgaaaacaggaacgggtaaaacgttagcatttgtgttaccaattttagaaaaaatcgatccagaatgtagcgatgttcaggctttaattgttgcaccaacaagggaactagcgctgcaaattacaactgaaattaaaaaaatgcttgttcaaagagaagatattaatgtattagcgatttatggtggacaagatgtagcacagcaattgagaaaattaaaaggaaatacacatatagttgttgcgacaccaggacgattattagatcatatacgacgtgaaacgattgatttaagtaatctttcaacgattgtactagatgaagcggatcaaatgctttatttcggtttcttatatgatattgaagatattttagatgagacacctggtagtaaacaaacaatgttattctcagcaacgatgccaaaagatattaaaaaattggcgaaacgttatatggatgagccgcaaatgattcaagtacaaagtgaagaagtaacggtaaatacaattgagcagcgtgtcattgagacgacagatcgtgcaaagccagacgcacttcgttttgttatggaccgtgatcagccatttttagcagttattttctgtcgtacaaaggttagagcaagtaagttgtatgataatttaaaaggactaggttataattgtgctgaacttcatggtgatatacctcaagcgaaacgtgaaagagttatgaagagtttccgcgaagcaaaaattcagtacttaatcgcaacggatgtagcagctcgtggacttgatgtagatggtgtaacgcacgtatttaactttgatatccctgaagatgtagaaagttatattcaccgcattggccgaacaggacgtgcaggtggatcaggtattgcaattacattcgttgcagcgaaagatgaaaaacatttagaagaaattgaaaaaacgcttggtgcaccaatacaaagagaaataatcgaacaaccgaagataaaacgtgtagatgaaaatggaaaaccggtaccaaagccggctccgaagaaatcaggcgagtatcgtcaaagagatagccgtgaaggttcaagaagtgattcaagacgtggttcgagaaatggctcaagaagtgattcaagaaatagttcaagaaatgaaaacaaccgatcatttaataagccaagtaataaaaaaggtagtacaaagcaaggtcagcaaagacgtggccgttaa

SEQ ID NO: 79737 - protein, 451 aa, Bacillus cereus G9241
MKNFLELGISETFNHTLRENGITEATPIQEQAIPVILSGKDIIGQAKTGTGKTLAFVLPILEKIDPECSDVQALIVAPTRELALQITTEIKKMLVQREDINVLAIYGGQDVAQQLRKLKGNTHIVVATPGRLLDHIRRETIDLSNLSTIVLDEADQMLYFGFLYDIEDILDETPGSKQTMLFSATMPKDIKKLAKRYMDEPQMIQVQSEEVTVNTIEQRVIETTDRAKPDALRFVMDRDQPFLAVIFCRTKVRASKLYDNLKGLGYNCAELHGDIPQAKRERVMKSFREAKIQYLIATDVAARGLDVDGVTHVFNFDIPEDVESYIHRIGRTGRAGGSGIAITFVAAKDEKHLEEIEKTLGAPIQREIIEQPKIKRVDENGKPVPKPAPKKSGEYRQRDSREGSRSDSRRGSRNGSRSDSRNSSRNENNRSFNKPSNKKGSTKQGQQRRGR

SEQ ID NO: 79738 - DNA, 1545 bp, Rubrivivax gelatinosus PM1
  CDS (1)..(1545)
atgtcattcaaagaactggggctcgccgagcccctgctgcaagccatcgtcgacgccggctacgagacgcccacgccgatccagaaacaggccattccggccgtcatgctgggcggcgacctgctcgccggcgcccagaccggcaccggcaagaccgccggcttcgtgctgccgatgctgcaccgcctgatggccaggccggccgtcaaggacgctcgcggcaagagcccggtgcgggcgctgatcctcacgccgacccgcgaactggcggcgcaggtggaggaaagcgtgcgcatctacggcaagcacgccaagctcagctcgatggtgatgttcggcggcgtcggcatgcagccgcagatcgaccgcctcaagcgcggcgtcgacatcctggtggccacgcccggccgcctgctcgaccaccaccagcagcgcacgctggacctgagccacgtcgagatcttcgtgctcgatgaagccgaccgcatgctcgacatgggcttcatccacgacatcaagaaggtgctggcgatcgtgccgaagcagaagcagagcctgctgttcagcgcgaccttcagcgacgagatcaaaaccctggccgaccgcctgctgaacagcccgcaggtgatcgaggtggcgcgccgcaacagcaccgtcgagaccatcgcgcagaagatccacccggtcgaccgcgacaagaagaaggaactgctggcccacctgatcaagagccaggattggcaccaggtgctggtgttctgccgcatgaagcacggcgccaaccgcctcaccgagtatctgaacgaccagcgcatcaccgcgatggcgatccacggcaacaagagccagaccgcgcgcaccaaggcgctggccgacttcaagagcggcgcgctccaggtgctggtggcgaccgacatcgccgcgcgcggcatcgacatcgaccagttgccgcacgtcgtcaatttcgagctgcccaacgtgtccgaggactacgtgcaccgtatcggccgcaccggccgcgccggtgccctgggcgaggccgtgtcgctggtctgtgtcgacgaggacggcttcctgcgcgatatcgagaagctgatcaagcgcagcatcccgcgcgaggtcgtgcccggcttcgagcccgatccgcgtgccgtggcgcagcccatccagatcggacggcagacgctcaacggcggcctgcgctctggtggcggcggccggggcggcgcgggtcgtccggcgggcggtgggcggtggcggccgtgggggcccccgcagtgccggcggcggcgcccgcagtggcggggccggtggccctcgcggcggtggcggccacggcgggggcggtggccgcagtcgctgatttgcgacagggcgccgaggcgtcaggcaacggaccgaagcatgtacttcggtcccggggcccgctggccgggagcttggggcactgcgaacggtgacctgcagccgcctcgtccatcgttcgcacacagcgattgcatttggacgcgcctcgtcacaccccgttttctcgcagggacctag

SEQ ID NO: 79739 - protein, 514 aa, Rubrivivax gelatinosus PM1
MSFKELGLAEPLLQAIVDAGYETPTPIQKQAIPAVMLGGDLLAGAQTGTGKTAGFVLPMLHRLMARPAVKDARGKSPVRALILTPTRELAAQVEESVRIYGKHAKLSSMVMFGGVGMQPQIDRLKRGVDILVATPGRLLDHHQQRTLDLSHVEIFVLDEADRMLDMGFIHDIKKVLAIVPKQKQSLLFSATFSDEIKTLADRLLNSPQVIEVARRNSTVETIAQKIHPVDRDKKKELLAHLIKSQDWHQVLVFCRMKHGANRLTEYLNDQRITAMAIHGNKSQTARTKALADFKSGALQVLVATDIAARGIDIDQLPHVVNFELPNVSEDYVHRIGRTGRAGALGEAVSLVCVDEDGFLRDIEKLIKRSIPREVVPGFEPDPRAVAQPIQIGRQTLNGGLRSGGGGRGGAGRPAGGGRWRPWGPPQCRRRRPQWRGRWPSRRWRPRRGRWPQSLICDRAPRRQATDRSMYFGPGARWPGAWGTANGDLQPPRPSFAHSDCIWTRLVTPRFLAGT

SEQ ID NO: 79740 - DNA, 1182 bp, Rhodospirillum rubrum; identical to SEQ ID NO: 38939
  CDS (1)..(1182)

SEQ ID NO: 79741 - protein, 393 aa, Rhodospirillum rubrum; identical to SEQ ID NO: 38940

SEQ ID NO: 79742 - DNA, 1905 bp, Ralstonia metallidurans CH34; identical to SEQ ID NO: 38943
  CDS (1)..(1905)

SEQ ID NO: 79743 - protein, 634 aa, Ralstonia metallidurans CH34; identical to SEQ ID NO: 38944

SEQ ID NO: 79744 - DNA, 1320 bp, Magnetococcus sp. MC-1
  CDS (1)..(1320)
atgtctgattttgcttcgttgaatcttgttaaacccctccttaatgccttaactcaagctggttacaccaccccaacccccattcaagcacaggctattccgcatctgttggcaggtcgggatctgctgggcattgcccagaccgggacaggtaaaaccgcagcttttgcactacccatactcaataagttgagccaaattaaaggtcgccccgcgcccaatgcgccccgcgccttgatccttaccccaacccgtgagctcgcttcacaaatcggcaacagcatcgccgtttatggtaagcatgtgccaaccacccacaccgttgtatttggtggcgtgggcaaacagccacagattcgcgccctctcccgtggcgttgatattttggtcgctacccctggccgcttactggatcttatgggggagcgccatgttcgcctggatcagattcaggtttttgtactggatgaggccgaccgcatgctggacatgggctttatccatgatatccgtcgcatcattaaggtgatcccagctaagcgccatacgctgctcttttctgccaccatgcccaaggatattgcagagctggcagagggcttattgaccaatcccgccaaggttgaggtcacgccagaatccacgacggttgagcgtattacgcaaaaggtgctgtttgtcgataaacagaacaagcgttctttgctcaaaaatgtgcttgagcatgagtctattgagcaggttttggtctttacccgcaccaagcatggggccaaccgggtggcggagtatcttgacaaacaccgcattgcctctgcggcgattcatggcaacaaatcccaaagcgcccgcgaaaaggcactggatggctttcgcaaaggcaagttaaaggttttggtagcgacagatattgcggcgcggggaattgatgtggcgggcattagccacgtgatcaattttgacctgcccaatgagtcggaaagctacgtgcaccgcataggccgcacagcgcgcgctgggcgggatggcaatgccatctctttttgcgatgctgaagagcgcggctatctgctggatattgaaaagaccatccgccagaccgtgccggttgatattgaccatgaattccattgcgaagtggttgccaacgcagccccaatcaaacccagccgcaaacgcagcagcggccatggtgccggtggtggcaatccccatggtgggggacatcgtcgcggcaaccccagtaccgccagcaaaccacgtcagcatagcggacgtcgcaccccatccagcaagggtcgtagcggtagcgtagcgtaa

SEQ ID NO: 79745 - protein, 439 aa, Magnetococcus sp. MC-1
MSDFASLNLVKPLLNALTQAGYTTPTPIQAQAIPHLLAGRDLLGIAQTGTGKTAAFALPILNKLSQIKGRPAPNAPRALILTPTRELASQIGNSIAVYGKHVPTTHTVVFGGVGKQPQIRALSRGVDILVATPGRLLDLMGERHVRLDQIQVFVLDEADRMLDMGFIHDIRRIIKVIPAKRHTLLFSATMPKDIAELAEGLLTNPAKVEVTPESTTVERITQKVLFVDKQNKRSLLKNVLEHESIEQVLVFTRTKHGANRVAEYLDKHRIASAAIHGNKSQSAREKALDGFRKGKLKVLVATDIAARGIDVAGISHVINFDLPNESESYVHRIGRTARAGRDGNAISFCDAEERGYLLDIEKTIRQTVPVDIDHEFHCEVVANAAPIKPSRKRSSGHGAGGGNPHGGGHRRGNPSTASKPRQHSGRRTPSSKGRSGSVA

SEQ ID NO: 79746 - DNA, 1512 bp, Thermobifida fusca; identical to SEQ ID NO: 38947
  CDS (1)..(1512)

SEQ ID NO: 79747 - protein, 503 aa, Thermobifida fusca; identical to SEQ ID NO: 38948

SEQ ID NO: 79748 - DNA, 1713 bp, Thermobifida fusca; identical to SEQ ID NO: 38949
  CDS (1)..(1713)

SEQ ID NO: 79749 - protein, 570 aa, Thermobifida fusca; identical to SEQ ID NO: 38950

SEQ ID NO: 79750 - DNA, 1356 bp, Geobacter metallireducens GS-15
  CDS (1)..(1356)
atggaattcaaggagttcaacctccacccccaggttatggccggtgtcacggcggcggggtacacgacccctacgccgatccaggcccaggcgataccgactgtcatggaggggcgcgacgtcatggggctcgcccagaccggcacgggcaagaccgcagcctttgcgctgccgatcctgcatcggctcgcccagggagagcgggggcgcgtccgggccctggtcattgcccccacccgggagctggccgagcagatcaatgacagcttcgtcaccctggggcgccagacccggctgcggagtgtcaccgtctacggcggcgttaacgtcaacccccagattcagaagctcaaggcgggcgcggagatcgtcgtggcttgcccggggcggctcctggaccacatggcccaggggaccatcgacctctcgcacctggaggtgctcgtcctggacgaggcggaccagatgttcgacatgggctttctccctgaccttcgccggatcctgaagcagcttccccccaagcgccagaccctcctcttctcggccaccatgcccatcgacatcagggtcttggcccaggagatcctgcgggacccggtcacggtgcaggtggggaccgtggccccggcggtcaccgtcacccatgccctctacccggtggagcagcacctgaagacgccgctcctgctggagctgttgcgtcacaccgacaccgagtcggtcctcatcttcacccgcaccaagcaccgggccaagcggctgggtgagcaaatggagaaggccggctacaaggccgcgtccctccaggggaacctctcccagaaccggcgccaggcggcactggacgggttccgggacggcaccttccaaatcctcgtggccaccgatatcgccgcccgggggattgatgtctcccaggtgtcccacgtcatcaactacgacatccccgacaccgccgaggcgtacatccaccgcataggccgcacgggccgggccgcccgcagcggcgacgccttcaccatggtgacgagcgaagatacggccatggtccgcactatcgagcgtaagctcaacacctccctagagcgccgcaccatggccggcttcgactacagcgtgccggcaccgaaaaaggacaccgagttcgctcgtcccccccggcagcccatgccgtcccgccgtcccacggaggcgaagaaggggggagcccgtcaaggtgcatcccatcagccgggaagcgccaaacccgccgaggggaggcgttcccagccccaagctgcgaaggcaaatccagcccgcaccgccggaaccggtggccagcgcaccggccagcagcgccgtcagccccgctga

SEQ ID NO: 79751 - protein, 451 aa, Geobacter metallireducens GS-15
MEFKEFNLHPQVMAGVTAAGYTTPTPIQAQAIPTVMEGRDVMGLAQTGTGKTAAFALPILHRLAQGERGRVRALVIAPTRELAEQINDSFVTLGRQTRLRSVTVYGGVNVNPQIQKLKAGAEIVVACPGRLLDHMAQGTIDLSHLEVLVLDEADQMFDMGFLPDLRRILKQLPPKRQTLLFSATMPIDIRVLAQEILRDPVTVQVGTVAPAVTVTHALYPVEQHLKTPLLLELLRHTDTESVLIFTRTKHRAKRLGEQMEKAGYKAASLQGNLSQNRRQAALDGFRDGTFQILVATDIAARGIDVSQVSHVINYDIPDTAEAYIHRIGRTGRAARSGDAFTMVTSEDTAMVRTIERKLNTSLERRTMAGFDYSVPAPKKDTEFARPPRQPMPSRRPTEAKKGGARQGASHQPGSAKPAEGRRSQPQAAKANPARTAGTGGQRTGQQRRQPR

SEQ ID NO: 79752 - DNA, 1317 bp, Geobacter metallireducens GS-15
  CDS (1)..(1317)
atgaaattcaccgacttaaacctccccgaactggtgcaacggggtatcgccgacaccggcttcaccgactgcaccccgatccaggaaaagacccttcccctggccctttccggtaaggatgtggccggccaggcccagaccggcaccggcaagactgcagcctttctcatcagcctcttcacccggctcctgaagaaccccacggagggagaaacccgcaatccgcgcgccctgatcctggctcccacccgggagctcgtcgtccagatcgagaaggacgcccaggccctcggggcccactgcggcttcgtgatccaggccatctacggcggcgtcgactacatgaagcagcggagcgccctcaaggaaggggccgacgtggtggtcggcaccccggggcgcctcatcgactacctgaagcagaaggtctactccctcaaggagatcgaggtgctggtcatcgacgaggcggaccggatgttcgatatggggttcatcgccgacctccgcttcatcctccggcggctcccccccttcgacaaacgccagaacctcatgttctccgccaccctcaaccagcgggtgatggaactggcctacgagttcatgaacgtccccgaaaaggtggcggtcacccccgagcagatgaccgccgagcgggtggagcaggtcctctaccacgtggggcgcaaggagaaattcccgctcctcctgggcctcctgcgcaagaaggggatggagcggaccatgatcttcgtcaacaccaagcgggaggcggagttcctggacgagcggcttaatgccaacgacttcccctgtcgggtcatctccggcgacgtggagcagcgcaagcggatgaggattctggaggacttcaagaacggcaagctcccgatcatgatcgccaccgacgtcgcctcccgcggcctccacatcgacggggtctcccacgtcatcaactacgaccttccccaggacgccgaggactacgtccaccgcatcggccgcaccgcccgggccggcgccgagggaaaggcgatctccatggccgatgaggacggcgccttccacctggaggcgatccacgagtacatcaaggacaaaatcccggttgaatgggccgaggacgacctcttcgtccacgacttcaagcgggtgaaaccgaagcccaaggggcacgagacccgagccaaggggccgacccgccacggccggaagcacccggaaggggagaagaaagagggagaaggggaggcgaagaagcgccgccgcgggccccggaagaaaccggcgggggagaagccgaagccggaatag

SEQ ID NO: 79753 - protein, 438 aa, Geobacter metallireducens GS-15
MKFTDLNLPELVQRGIADTGFTDCTPIQEKTLPLALSGKDVAGQAQTGTGKTAAFLISLFTRLLKNPTEGETRNPRALILAPTRELVVQIEKDAQALGAHCGFVIQAIYGGVDYMKQRSALKEGADVVVGTPGRLIDYLKQKVYSLKEIEVLVIDEADRMFDMGFIADLRFILRRLPPFDKRQNLMFSATLNQRVMELAYEFMNVPEKVAVTPEQMTAERVEQVLYHVGRKEKFPLLLGLLRKKGMERTMIFVNTKREAEFLDERLNANDFPCRVISGDVEQRKRMRILEDFKNGKLPIMIATDVASRGLHIDGVSHVINYDLPQDAEDYVHRIGRTARAGAEGKAISMADEDGAFHLEAIHEYIKDKIPVEWAEDDLFVHDFKRVKPKPKGHETRAKGPTRHGRKHPEGEKKEGEGEAKKRRRGPRKKPAGEKPKPE

SEQ ID NO: 79754 - DNA, 1359 bp, Geobacter metallireducens GS-15; identical to SEQ ID NO: 38953
  CDS (1)..(1359)

SEQ ID NO: 79755 - protein, 452 aa, Geobacter metallireducens GS-15; identical to SEQ ID NO: 38954

SEQ ID NO: 79756 - DNA, 1395 bp, Novosphingobium aromaticivorans DSM 12444; identical to SEQ ID NO: 38955
  CDS (1)..(1395)

SEQ ID NO: 79757 - protein, 464 aa, Novosphingobium aromaticivorans DSM 12444; identical to SEQ ID NO: 38956

SEQ ID NO: 79758 - DNA, 1497 bp, Novosphingobium aromaticivorans DSM 12444; identical to SEQ ID NO: 38957
  CDS (1)..(1497)

SEQ ID NO: 79759 - protein, 498 aa, Novosphingobium aromaticivorans DSM 12444; identical to SEQ ID NO: 38958

SEQ ID NO: 79760 - DNA, 1392 bp, Cytophaga hutchinsonii
  CDS (1)..(1392)
ttgacacaccccttgaatttcgaagaacttaaattaaacagacaacttctcaatgctattgaagaagctggttatactgaacctactgaaattcagtctaaagcaataccgcagattctggcgggccacgacatcatcggtgtggcacaaaccggtaccggtaaaacggctgcctatgccctgcccattctgatgaaaatcaaatatgcacagggacataatccaagagcggtaattttcggaccaacccgcgagctggtgatgcagattgaaattgccatgaaacagctggcaaaatatacagacttacgcattgttgcactctatggcggcataggtcctaaacttcaaaaagaacacttacaaaaaggcgttgatattattgttgctaccccaggccgttttctggatctgtatctggaagaagaaattgtgttgaaggaagtaaaaacaatggtgctggatgaagccgataaaatgatggacatgggatttatgccgcagctgcgcaagatgctcgaagttattccgcggaaaagacagaacctgcttttctcggcaaccatgtctgagcgtgtggaacgtttaaccgaagagtttctggaatatccaatgaagatcgaggttacaccgcaggcgacaccagctacactcatcagtcagaagttgtacaaagtacccaactttaaaactaaaattcatttattagaatatttaattcgaaaagatgaatccgtaacccgtgccattatttttgtacgaacgaaaaaatcagcagacgatatatataaattcattatccgtaaaacaaccaatacctgccgcatcattcatgcaaacaaagatcagaacagccgcatcaatgcaatggatgattttaaagacggcaccatcaaaatactcgttgctaccgatgtggcagccagaggtattgatgtgcatgaagtaagccatgtgatcaattttgatgtaccgatcatttacgacgattacatacaccgcatcgggcgtacaggcagagctaatcatacaggcgttgcgatcacatttgctacggaagcagaaatgtatcacattgaaaagatcgaaaagattatccgtatgcagattccggtagaagagctacctgccgcggtagaaattacggaaacaggtttcgaggaaagccaggagttcgcacgtgagttggacttttataagaaaaaagaggatcccacatacaaaggtgcgttccatgaaaagaaacgtgatttgaaaggcgatgcgaaacaaactgcctacaagccgggtaaatcagttaaagccaagccttccaaagaaatacgtttaggaaaaaataaaccaaaggctaaaccaagcaaaccgattgctcctaaaaaaccaaaaaaataa

SEQ ID NO: 79761 - protein, 463 aa, Cytophaga hutchinsonii
MTHPLNFEELKLNRQLLNAIEEAGYTEPTEIQSKAIPQILAGHDIIGVAQTGTGKTAAYALPILMKIKYAQGHNPRAVIFGPTRELVMQIEIAMKQLAKYTDLRIVALYGGIGPKLQKEHLQKGVDIIVATPGRFLDLYLEEEIVLKEVKTMVLDEADKMMDMGFMPQLRKMLEVIPRKRQNLLFSATMSERVERLTEEFLEYPMKIEVTPQATPATLISQKLYKVPNFKTKIHLLEYLIRKDESVTRAIIFVRTKKSADDIYKFIIRKTTNTCRIIHANKDQNSRINAMDDFKDGTIKILVATDVAARGIDVHEVSHVINFDVPIIYDDYIHRIGRTGRANHTGVAITFATEAEMYHIEKIEKIIRMQIPVEELPAAVEITETGFEESQEFARELDFYKKKEDPTYKGAFHEKKRDLKGDAKQTAYKPGKSVKAKPSKEIRLGKNKPKAKPSKPIAPKKPKK

SEQ ID NO: 79762 - DNA, 1179 bp, Microbulbifer degradans 2-40; identical to SEQ ID NO: 38965
  CDS (1)..(1179)

SEQ ID NO: 79763 - protein, 392 aa, Microbulbifer degradans 2-40; identical to SEQ ID NO: 38966

SEQ ID NO: 79764 - DNA, 1311 bp, Microbulbifer degradans 2-40; identical to SEQ ID NO: 38969
  CDS (1)..(1311)

SEQ ID NO: 79765 - protein, 436 aa, Microbulbifer degradans 2-40; identical to SEQ ID NO: 38970

SEQ ID NO: 79766 - DNA, 1560 bp, Microbulbifer degradans 2-40
  CDS (1)..(1560)
ttggccattgtggctgcaatcctgtatcctgcgcgccctttagttgatgcagaccccaatatgaaatttgccgaacttggcctttgtcccgccattcagaaagccgtactcgaacaaggctacgaaacccctaccccaattcaagcgcaagccattccccctgtattagaagggcgcgatgtgatggccgctgcgcaaaccggtacgggtaagacggcggggtttacattgcccattttagaaatactggcagaaggcatagaaaacggccgtaaagtaaagccgaatcaggcacgtgcgttagtacttactcctacgcgagagcttgcagcacaggtaggtgaaaacgttgccctatacggcaagtacttgcctattaaatctaccatcgtatttggcggcgtgaaaattaacccgcaaatgatgaaattgcgcggcggtgtcgacattttagtggccacgccaggccgtttgatggacctatacaatcagcgtgcagtgaagtttgatcagctagaaatgctggtgttggacgaagccgatcgcatgctcgatatgggctttattcacgatattcgcaaaattatggctattttaccgaagaaacgtcaaaacctgatgttttcggcgacgttctcgcaagatattcgcgaattagctaaaagtattgtgaataacccagtagaaattactgtgaacccgcccaacagcaccgcaacccgcgtaaaacagtggatttgccccgttgataaaaaagaaaagcccgctttgcttacccatttgattaaaaccaataagtggcagcaagtgttggtgttctctcgcaccaagcatggcgcaaataaattagttaaacaattggaaggcagtggcctgcgagcagcggcgattcacggcaacaaaagccaaggcgcacgcactaaagcgttagccgagtttaaaaatggcacggtaaaaattcttgtagccaccgatattgccgctcgcggtttggatattgatcaactaccgcaagtggtgaacttcgacttacctcaggttgctgaagattacgtgcatcgaattggccgcacaggccgtgctggcgcagagggcaatgccgtttcgctagtgagtgccgacgaatttcaaatgttaaaagagattgagcgtttaactaaaacgttgctcactcgcgaagttattcaaggctttgagccagaccacaatttacctgagtctcgattagatacccgccccattcgccccaataagccgaaacggcccaagccagcaggtggtgcttcgaaccgcagtggcggtggtaacagtggcggtggcaataatcgcgctaagccgcgtggcgatgacagcaaagcggccaatgccgataccccgtgggcaggcaaagcaaagccgcgcaagcctcgccctgcaggtgctaaacccgctacacaaggtaagcctgccggcgcgcgcaatggcaatacaggcccaaaaggtaagggtgggccagccggtgggggtgccagacgaccaactaataagcctagcggtgcacaaggggctgctagaagttag

SEQ ID NO: 79767 - protein, 519 aa, Microbulbifer degradans 2-40
MAIVAAILYPARPLVDADPNMKFAELGLCPAIQKAVLEQGYETPTPIQAQAIPPVLEGRDVMAAAQTGTGKTAGFTLPILEILAEGIENGRKVKPNQARALVLTPTRELAAQVGENVALYGKYLPIKSTIVFGGVKINPQMMKLRGGVDILVATPGRLMDLYNQRAVKFDQLEMLVLDEADRMLDMGFIHDIRKIMAILPKKRQNLMFSATFSQDIRELAKSIVNNPVEITVNPPNSTATRVKQWICPVDKKEKPALLTHLIKTNKWQQVLVFSRTKHGANKLVKQLEGSGLRAAAIHGNKSQGARTKALAEFKNGTVKILVATDIAARGLDIDQLPQVVNFDLPQVAEDYVHRIGRTGRAGAEGNAVSLVSADEFQMLKEIERLTKTLLTREVIQGFEPDHNLPESRLDTRPIRPNKPKRPKPAGGASNRSGGGNSGGGNNRAKPRGDDSKAANADTPWAGKAKPRKPRPAGAKPATQGKPAGARNGNTGPKGKGGPAGGGARRPTNKPSGAQGAARS

SEQ ID NO: 79768 - DNA, 1581 bp, Pediococcus pentosaceus ATCC 25745; identical to SEQ ID NO: 38977
  CDS (1)..(1581)

SEQ ID NO: 79769 - protein, 526 aa, Pediococcus pentosaceus ATCC 25745; identical to SEQ ID NO: 38978

SEQ ID NO: 79770 - DNA, 1365 bp, Trichodesmium erythraeum IMS101; identical to SEQ ID NO: 38981
  CDS (1)..(1365)

SEQ ID NO: 79771 - protein, 454 aa, Trichodesmium erythraeum IMS101; identical to SEQ ID NO: 38982

SEQ ID NO: 79772 - DNA, 1602 bp, Thiobacillus denitrificans ATCC 25259; identical to SEQ ID NO: 38985
  CDS (1)..(1602)

SEQ ID NO: 79773 - protein, 533 aa, Thiobacillus denitrificans ATCC 25259; identical to SEQ ID NO: 38986

SEQ ID NO: 79774 - DNA, 1434 bp, Thiobacillus denitrificans ATCC 25259; identical to SEQ ID NO: 38987
  CDS (1)..(1434)

SEQ ID NO: 79775 - protein, 477 aa, Thiobacillus denitrificans ATCC 25259; identical to SEQ ID NO: 38988

SEQ ID NO: 79776 - DNA, 1383 bp, Thiobacillus denitrificans ATCC 25259; identical to SEQ ID NO: 38989
  CDS (1)..(1383)

SEQ ID NO: 79777 - protein, 460 aa, Thiobacillus denitrificans ATCC 25259; identical to SEQ ID NO: 38990

SEQ ID NO: 79778 - DNA, 1482 bp, Silicibacter sp. TM1040
  CDS (1)..(1482)
atgacaaaattcaccgatctgaacctcaatccgaaggtcctcaaagccatcgaggaagccggatacgaaagccccaccccgattcaggcaggcgcaattcccgccgcattggaagggcgcgatgtcctcggaatcgctcagaccggcaccggcaaaaccgcctctttcaccctgccgatgatcacccgccttgcgcgtggccgcgcccgggcgcgcatgccgcgctcgctggtgctctgcccgacgcgcgaactcgctgcgcaggtggctgaaaacttcgacacctacgccaaacacgtcaagctcaccaaagccctcctgatcggcggcgtttccttcaaggaacaggacgccgcaatcgaccgtggtgtagacgtgctgatcgccacaccgggccgtctgctcgatcatttcgagcgcggcaagctcctgctgaccgggatcgagatcatggtggtcgatgaggctgaccggatgctggacatgggcttcatccccgacatcgagcgcatcttctcgctgacccccttcacccgtcagacgctgtttttctccgccaccatggcgccggaaatcgagcggatcaccaatacgtttctctccggccccgagcgggtcgagatcgcccgtcaggccaccacctccgagaatatcgaacaggccgtggtgatgttcaaagcctcccgcaaggatcgcgaaggcagcgaaaaacgccgggttctgcgcgagctgatcaaccaggaaggtgaggccgtgcagaacgccatcatcttctgcaaccgcaagaccgatgtggacatcgtcgccaagtccttgaaaaaatacggctatgacgccgcgccgatccacggcgacctggatcagagccagcgcaccaagaccctcgacgggttccgcgacggcacactcaagatccttgtggcctccgatgtggccgcccgcggtctggacgttccctccgtgagccatgtgttcaactttgatgtgccgggtcatgccgaggactacgtccaccggatcggccgcaccggccgcgcaggtcgcgatggcaaggccatcaccctgtgcagcccgcgtgacgaaaaggcgctcgatgctgtcgaaggtctggttcaaaaagaaatcactcgccttgaaaacccggtaaagccgacgccgcgcaaaactgcgaccaaggacgaggatgcaggcgacaagcccaaacccgcccgtcgcagccgcagcaaagccgcctccgccaagaccgacgcgacaccaacgcccgaggcggcaaatgacgcagccccgcaggtcgaagcccctcagcagcagccccaagagcccaaggagacccgggccgagcaaccgtctgctggcgccaaatcgggcaagtcccgtggtcgtggacgccgcgatgatcgtcgcgacgacaaagtagtgggcatgggcgaccatatgccaagcttcatcgcgctgagctttgacgagcgccgcgccagctga

SEQ ID NO: 79779 - protein, 493 aa, Silicibacter sp. TM1040
MTKFTDLNLNPKVLKAIEEAGYESPTPIQAGAIPAALEGRDVLGIAQTGTGKTASFTLPMITRLARGRARARMPRSLVLCPTRELAAQVAENFDTYAKHVKLTKALLIGGVSFKEQDAAIDRGVDVLIATPGRLLDHFERGKLLLTGIEIMVVDEADRMLDMGFIPDIERIFSLTPFTRQTLFFSATMAPEIERITNTFLSGPERVEIARQATTSENIEQAVVMFKASRKDREGSEKRRVLRELINQEGEAVQNAIIFCNRKTDVDIVAKSLKKYGYDAAPIHGDLDQSQRTKTLDGFRDGTLKILVASDVAARGLDVPSVSHVFNFDVPGHAEDYVHRIGRTGRAGRDGKAITLCSPRDEKALDAVEGLVQKEITRLENPVKPTPRKTATKDEDAGDKPKPARRSRSKAASAKTDATPTPEAANDAAPQVEAPQQQPQEPKETRAEQPSAGAKSGKSRGRGRRDDRRDDKVVGMGDHMPSFIALSFDERRAS

SEQ ID NO: 79780 - DNA, 1338 bp, Silicibacter sp. TM1040; identical to SEQ ID NO: 38991
  CDS (1)..(1338)

SEQ ID NO: 79781 - protein, 445 aa, Silicibacter sp. TM1040; identical to SEQ ID NO: 38992

SEQ ID NO: 79782 - DNA, 1641 bp, Azotobacter vinelandii
  CDS (1)..(1641)
ttggtccgcgccgtcgaggccgccggctatgcccagcccactcccgtgcaacagcgggccatccccgccgtgttgcaaggccgcgacctgatggtcgccgcccagaccggcaccggcaagaccggcggcttcgcgctccccgtactcgaacgactgttccccggcggccacccggacaaggaacaccgccatggtccgcgccaggcccgcgtgctggtgctgaccccgacccgcgagctggcggcccaggtgcacgacagcttcaagctctacgcccgcgacctgaaactggtcagcgcctgcatcttcggcggggtcggcatgaatccgcaggtccaggccctgtcccgcggcgtcgacgtgctggtggcctgtcccggacgcctgctcgacctggtcggccagggcagcgtcgacctctcccacgtggagatcctggtgctcgacgaagccgaccgcatgctcgacatgggcttcatccacgacgtcaagaaggttctcgccaagcttccgcccaaacgccagaacctgctgttctcggcgaccttctcggcggacatcgtcaacctcaccaacaagctgctgcacgaccccgaacgcatcgaggtgaccccgccgaacaccacggtggaacgcatcgagcagcgcgtcttccgcctgccggccggccacaagcgcgccctgctcgcccacctggtcacccagggcgcctgggagcaggtgctggtgttcacccgtaccaagcacggtgccaaccgccttgccgaatacctcgacaagcacggcctgccggccgcggcgatccacggcaacaagagccagaacgcccgcaccaaggccctggccgacttcaagagcggcaccatccgcatcctggtcgccaccgacatcgccgcccgcggcctggacatcgaccagttgccccatgtggtcaacttcgaactgcccaacgtcgaggaggactacgtccaccgcatcggccgcaccggccgcgccggccgcagcggcgaggcgatctcgctggtcgccccggacgaggagaagctgctcaagtccatcgagcgcatgactcgccagagcattccggaaggcgactgggcgggcttcgacataggcgccgtcgaggcggagaaacccgaggtccgcgaagcgcacccgccgcgcaacgccagtgccggacgcaaggacaagggcaaggacaagggccaggagaaatcccgggaaaaaaccaggagaaggcccgcggcaaggaacgcgacccgcaggccaagggcgccggtcagccgggccgcccgcagccgaaggccaaggcgcaacccgccagccagccgacgatccccatgctgccgccgaatcgcgatcccgaggaattcctcgacgacgatatcgacaacttcggcaaccgcgccgactacgtcagcccctaccagaacaagtcgcagcgcggccgccgtccgggcacgaacggccaggcggccggccgtggtcagagccaggggcaagggcaggggcaaggccaaggtcagggccagcgcggcccgaagcgccagggccagcaggcacgccgcgcaccggtaccggcctaccgcagcgaagcgccccgcgaggaagcgccgcgcaagcctgaacggcaaccgctga

SEQ ID NO: 79783 - protein, 546 aa, Azotobacter vinelandii
MVRAVEAAGYAQPTPVQQRAIPAVLQGRDLMVAAQTGTGKTGGFALPVLERLFPGGHPDKEHRHGPRQARVLVLTPTRELAAQVHDSFKLYARDLKLVSACIFGGVGMNPQVQALSRGVDVLVACPGRLLDLVGQGSVDLSHVEILVLDEADRMLDMGFIHDVKKVLAKLPPKRQNLLFSATFSADIVNLTNKLLHDPERIEVTPPNTTVERIEQRVFRLPAGHKRALLAHLVTQGAWEQVLVFTRTKHGANRLAEYLDKHGLPAAAIHGNKSQNARTKALADFKSGTIRILVATDIAARGLDIDQLPHVVNFELPNVEEDYVHRIGRTGRAGRSGEAISLVAPDEEKLLKSIERMTRQSIPEGDWAGFDIGAVEAEKPEVREAHPPRNASAGRKDKGKDKGQEKSREKTRRRPAARNATRRPRAPVSRAARSRRPRRNPPASRRSPCCRRIAIPRNSSTTISTTSATAPTTSAPTRTSRSAAAVRARTARRPAVVRARGKGRGKAKVRASAARSARASRHAAHRYRPTAAKRPARKRRASLNGNR

SEQ ID NO: 79784 - DNA, 1695 bp, Polaromonas sp. JS666
  CDS (1)..(1695)
atgcttgagcagggttacgacacccccacgcctatccaggcccaggcgattcccgccgtgctggccggcagcgacctgctcggcggcgcccagacgggcaccggcaagaccgccgcgttcaccctgcccatgctgcagcgcctgtctaccgaaccccggctgaccaaccgacgcggcgtcaacgccgtgcgcgccctcatcatgacgccgacccgcgagctggccgcgcaggttgaagaaagcgtacgcacctacggcaaatacctggatctcacctccatggtgatgttcggcggtgtcggcatgggggcgcaaatcgacaagctgcgccgcggcgtggacatcctggtggccacccccggccgcctgctcgaccatgcaggccagggcacgctggacctgagccaggtacagatcctggtgctcgacgaagccgaccgcatgctcgacatgggcttcatccacgacatcaagaaggtgctggcgctggtgcccaagcacaagcagtcgctgctgttcagcgccaccttcagcgacgagatccgcgaactggccaatggcctgctgcgtgaccccctgcacattcaggtgacgccgcgcaacaccaccgtgcagcgcatcacgcagacgatccatccggtgggccgcagcaaaaagaaggcgctgctgacccacatcatcaacgagcacaactggagccaggtgctggtgttcacgcgcaccaagtttggcgccaacaacgtggccgagcacctgaccaaaaacggcattgaagccatggccctgcacggcaacaagagccagaccgcccgcacccaggcgctgcagggcttcaaggacggcacgattcgcgcactggtcgccacggacatcgcagcccgcggcattgacatcgacgaattgccgcacgtggtgaactacgagattcccaacgtcagtgaagactatgtgcaccgcatcggccgcaccggccgcgccggcaacagcggcgaggcggtgagcctggtgtgtctggatgaagaaggctttatgcaggacatcgagcgcttcaccaagcagaacattgaaaaagtgctggtgcccggctttgaagccgagcccggcgaaagagccgagccgctggccatgggccgccagaccatctggggcggcctcggtaaacccccaagccgtgacgtgatgcaggccgccgcgaaagcagcgcgcagcgaaatgatgcagcgtatccgtgacaccaaaggcgcccagcctgcgcgcggcgcgagtggcggcggtaatggtggcaatggcggcaacggaggcggccgcggacgcggccccgccggtggcggcaatggcagtggtaatggcagtggacgcggcccgcgcacccccaatccgggtcagccgcgccagaattccggctattcgcaaggcggccagcctgcccagccgagacatgctcaggcgcggcaacgcgacgagcaaccccgtgcgccaaggaatgactcacgcagcgagcctcgcaatgacttcgacaaccagcagcccgccagccacgcctcgtccggattcccgtcttccggccaacccactggcaaccgcaacaacttccggggcaaccgctccggcggtggcggcggctcgggtggcgctggtggccggggcaacgggcctcgtcggccaggcggtcctggctcgtttactggccgataa

SEQ ID NO: 79785 - protein, 564 aa, Polaromonas sp. JS666
MLEQGYDTPTPIQAQAIPAVLAGSDLLGGAQTGTGKTAAFTLPMLQRLSTEPRLTNRRGVNAVRALIMTPTRELAAQVEESVRTYGKYLDLTSMVMFGGVGMGAQIDKLRRGVDILVATPGRLLDHAGQGTLDLSQVQILVLDEADRMLDMGFIHDIKKVLALVPKHKQSLLFSATFSDEIRELANGLLRDPLHIQVTPRNTTVQRITQTIHPVGRSKKKALLTHIINEHNWSQVLVFTRTKFGANNVAEHLTKNGIEAMALHGNKSQTARTQALQGFKDGTIRALVATDIAARGIDIDELPHVVNYEIPNVSEDYVHRIGRTGRAGNSGEAVSLVCLDEEGFMQDIERFTKQNIEKVLVPGFEAEPGERAEPLAMGRQTIWGGLGKPPSRDVMQAAAKAARSEMMQRIRDTKGAQPARGASGGGNGGNGGNGGGRGRGPAGGGNGSGNGSGRGPRTPNPGQPRQNSGYSQGGQPAQPRHAQARQRDEQPRAPRNDSRSEPRNDFDNQQPASHASSGFPSSGQPTGNRNNFRGNRSGGGGGSGGAGGRGNGPRRPGGPGSFTGR

SEQ ID NO: 79786 - DNA, 1479 bp, Polaromonas sp. JS666
  CDS (1)..(1479)
atgacatcatctttttccaatctttcgctggcagaaccgctggcccgcgccgtagccgaaatgggctacgaaaccatgacacccattcaggaacaggccattccggtcgtcctgcagggcaaagacgtgatgggcgccgcgcagaccggtaccggtaaaaccgctgctttttcgctgccgctgctgcagcgcatgctcaagcacgagaacgcctcgacctcgccggcgcggcaccccgtgcgtgcgctggtgctgctgcctacccgcgagctggccgtccaggtggccgaacaggtcaagctctacgccaagcacaccaacctgcgcagtgccgtggtgtttggcggcatggacatgaagccgcaaacgctggagctcaaacaaggcgttgaagtgctggtggccacgccgggccgcctgctcgaccacatcgaagccaaaaataccgtgctcaaccaggttgaatatgtggtgctcgacgaagccgaccgcatgctcgacatcggcttcctgccggatctgcagcgcattctgagctacctgcccaagcagcgcatcacgctgctgttttcggcgaccttctcgcctgaaatcaagcgcctggcctcaagctacctgcaggatccggtgacgattgaggtggcgcgttccaacgccaccgcctcgacagtcgagcagcatttctacagcgtgggcgctgacgacaagcgccgcgccctgcaccagatcctcaaagagcgcggcatgaagcaggcctttgtgttcgtcaacagcaaactcggctgtgcacgcctggcccgctcactggaacgcgaaggcctgaaaaccaccgcgctgcacggcgacaagagccaggacgaacgcttgaaggcgctggatgccttcaaaaaaggcgaggtagacctgctggtgtgtaccgacgtcgcagcgcgcggcctggacatcaaggatgtgccggcggtgttcaacttcgacgtgcccttcaatgccgaagactatgtgcaccggattggccgcaccggccgtgccggggcttcaggcctggccgtgagttttgtcgccagcagcgaccagcgcctggtggcagatattgaaaagctgatcaagaccaagatcgagctggagccgatcgagtttgacgaggaccgcccgcgcatcagcgagcagggccgcatcaacgacggccgccgcatgtaccgtcagggcaacgaaggcgaggagggcgcggggcgtgaagcgtttgtttcgcgggaaccgcgcgaccgggaacgcagggagcgtcgcgagtacacgccgcatcgccagccggcggcgccgcgtgatccgttttttgaccagccctacgaggcaacaaccgttatagcggacgcgcaaccgtcctgggaagccgccgccaaggccggccctgcgcgcagcagcgtctcggccaacatcaagccgaagaaaaaagtcgctgcactgttcaagaccagcgactga

SEQ ID NO: 79787 - protein, 492 aa, Polaromonas sp. JS666
MTSSFSNLSLAEPLARAVAEMGYETMTPIQEQAIPVVLQGKDVMGAAQTGTGKTAAFSLPLLQRMLKHENASTSPARHPVRALVLLPTRELAVQVAEQVKLYAKHTNLRSAVVFGGMDMKPQTLELKQGVEVLVATPGRLLDHIEAKNTVLNQVEYVVLDEADRMLDIGFLPDLQRILSYLPKQRITLLFSATFSPEIKRLASSYLQDPVTIEVARSNATASTVEQHFYSVGADDKRRALHQILKERGMKQAFVFVNSKLGCARLARSLEREGLKTTALHGDKSQDERLKALDAFKKGEVDLLVCTDVAARGLDIKDVPAVFNFDVPFNAEDYVHRIGRTGRAGASGLAVSFVASSDQRLVADIEKLIKTKIELEPIEFDEDRPRISEQGRINDGRRMYRQGNEGEEGAGREAFVSREPRDRERRERREYTPHRQPAAPRDPFFDQPYEATTVIADAQPSWEAAAKAGPARSSVSANIKPKKKVAALFKTSD

SEQ ID NO: 79788 - DNA, 2199 bp, Corynebacterium glutamicum; identical to SEQ ID NO: 39005
  CDS (1)..(2199): transl_table=11

SEQ ID NO: 79789 - protein, 732 aa, Corynebacterium glutamicum; identical to SEQ ID NO: 39006

SEQ ID NO: 79790 - DNA, 1341 bp, uncultured bacterium 581
  CDS (1)..(1341): transl_table=11
atgagtttttctaccctaggtttatctgaatcactacttaaggctgttgccgacgaaggctacaccacgccgtctcccatacaggcgcaggctatccctgcggtgctggagggccgtgacgtcatggccgcagcccaaaccggtaccggcaaaaccgcgggtttcaccctaccgttgctacacggactatcaaagggacagtccgcaaaagcaaaccaagtgcgagcacttgttttaacgccaacgcgagagttggcggctcaagtcgcggaaagtgtcgacatctacggaaaatacttgaatcttcgttctgcggtggtttttggcggcgttaaaatcaacccacaaatgatgcggctacgtaagggcgtcgatatattaattgctacgccgggacgtttattagacctgtatcagcaaaatgccatgtcttttcagaagcttgaagttctcattttggatgaagcagaccgcatgctcgacatgggttttatccacgatattcgaagaataatgaaagccttaccgaacaaacgacaaaacctgatgttttctgcgactttttctgaagacattcgcgatcttgccaaaaccattgtaaacaacccggtagaaatttctgtaacaccaagaaatagcacggcagtaagcgtgacccagtggatacacccggttgataaaaatcaaaaacggcatttgttggttgagctgattaaccagcacaattgggaacaggtacttgttttcagccgaacaaaacgcggggcgaaccgcctagccgaatttcttgaaaagaaagatattcaagccgcagcaattcatggcaataaaagccaaggtgcacgcaccagagcgcttagcgaattcaagtcagggaaattacgcgtcttagtcgccaccgacatcgcagcccggggccttgatatcgaacagctgccccaagtagtaaatctcgacttacccgaggtcgcgcaagattatgttcatcgcataggccggacggggcgtgcaggagccacggggcaagcgatatcactcgtgagtgctgatgaagcccaactgctacaagacattgagcgattgattcaaacgctacttcctcgaaagctcgtcgcgggctacgaaccggaaagcccgctacctgaactcgctctacgtccccctgccaaacccaaaaagcccaaaaagcccaaagaatctacccccccccgaacagcaagcgaaaaaagtccaactgcgactgataaaaagcgtcatccaaacgacgcccattcaccaaaacgccgccgaagcaatcataggagcagcccaaaaagtgctcgtcctaccggcaatcaatag

SEQ ID NO: 79791 - protein, 446 aa, uncultured bacterium 581
MSFSTLGLSESLLKAVADEGYTTPSPIQAQAIPAVLEGRDVMAAAQTGTGKTAGFTLPLLHGLSKGQSAKANQVRALVLTPTRELAAQVAESVDIYGKYLNLRSAVVFGGVKINPQMMRLRKGVDILIATPGRLLDLYQQNAMSFQKLEVLILDEADRMLDMGFIHDIRRIMKALPNKRQNLMFSATFSEDIRDLAKTIVNNPVEISVTPRNSTAVSVTQWIHPVDKNQKRHLLVELINQHNWEQVLVFSRTKRGANRLAEFLEKKDIQAAAIHGNKSQGARTRALSEFKSGKLRVLVATDIAARGLDIEQLPQVVNLDLPEVAQDYVHRIGRTGRAGATGQAISLVSADEAQLLQDIERLIQTLLPRKLVAGYEPESPLPELALRPPAKPKKPKKPKESTPPRTASEKSPTATDKKRHPNDAHSPKRRRSNHRSSPKSARPTGNQ

SEQ ID NO: 79792 - DNA, 1908 bp, uncultured marine proteobacterium ANT8C10; identical to SEQ ID NO: 39007
  CDS (1)..(1908): transl_table=11

SEQ ID NO: 79793 - protein, 635 aa, uncultured marine proteobacterium ANT8C10; identical to SEQ ID NO: 39008

SEQ ID NO: 79794 - DNA, 1974 bp, Yersinia enterocolitica; identical to SEQ ID NO: 39009
  CDS (1)..(1974): transl_table=11

SEQ ID NO: 79795 - protein, 657 aa, Yersinia enterocolitica; identical to SEQ ID NO: 39010

SEQ ID NO: 79796 - DNA, 1266 bp, Yersinia pestis
  CDS (1)..(1266): transl_table=11
atgtcatttgattctctcggcctaaacgccgacatcctgcgtgctgttgaagagcagggctaccttgtgccgacgccaattcaacgtcaggcaatccctgtagtactggaaggccgcgatttgatggccagtgcgcaaacgggtacgggtaaaaccgctggtttcaccttgccgctattgcaactgcttagccaagatcaacaacccattaagggccgccgtccggtacgagcattgattttgacgccaacccgtgagctggccgcgcagattgacgaaaacgtacagagttatagcaaatacctgaaacttcgctcactggtggtatttggtggcgttagcattaatccgcagatgatgaaattgcgtggtggcgtcgatattttagtcgcgacacctggccgtttactggatctggaacatcaaaacgcggttgatttgtccaaaattgaaattttagtattggacgaagctgaccgtatgctggatatgggctttattcacgatatccgccgtgtattagccaaattaccggctaaacgtcagaatttgctgttctctgccaccttctctgatgagattaaagggctggccagcaaattgttgcacaacccagcctctgttgaagtggctcgccgtaatacggcgtcagagcagatcgcccaaagcgttcactttgtcgataaaaaccgtaagcgtgagctgttgtctcagatgattggcgaaggtaactggcagcaagtgctggtgtttaaccgcactaagcacggcgcgaaccatttagctgaacagttaaataaagacggcattactgcggcggcaatccacggtaataaaagtcagggcgcacgtactcgtgcactggccgattttaaagacggtaaaatccgtgtgttggtcgcgacggatatcgctgcccgtggtctggatatcgaccagttacctcacgtggttaactatgaattgccaaacgttccggaagattacgttcaccgaattggccgtactggccgcgcggaacggaccggggaagcgatttcactggtttgtgtcgatgaacataaactgctgcgtgatattgaacgtttattaaaacgtgaaattccacgtatcgcacttgatggctatgagccggatccaagcattaaagctgatccaattcaaaatggccgtcagggccgtggtgcacaacgtccaggaatgggccgtggcagcagcgcgggtcgtccgcagaatgggggcggtgcatcaggtgcgcggggatag

SEQ ID NO: 79797 - protein, 421 aa, Yersinia pestis
MSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGASGARG

SEQ ID NO: 79798 - DNA, 1464 bp, Synechococcus sp; identical to SEQ ID NO: 39019
  CDS (1)..(1464): transl_table=11

SEQ ID NO: 79799 - protein, 487 aa, Synechococcus sp; identical to SEQ ID NO: 39020

SEQ ID NO: 79800 - DNA, 1890 bp, Escherichia coli
  CDS (1)..(1890)
atggctgaattcgaaaccacttttgcagatctgggcctgaaggctcctatccttgaagcccttaacgatctgggttacgaaaaaccatctccaattcaggcagagtgtattccacatctgctgaatggccgcgacgttctgggtatggcccagacggggagcggaaaaactgcagcattctctttacctctgttgcagaatcttgatcctgagctgaaagcaccacagattctggtgctggcaccgacccgcgaactggcggtacaggttgctgaagcaatgacggatttctctaaacacatgcgcggcgtaaatgtggttgctctgtacggcggccagcgttatgacgtgcaattacgcgccctgcgtcaggggccgcagatcgttgtcggtactccgggccgtctgctggaccacctgaaacgtggcactctggacctctctaaactgagcggtctggttctggatgaagctgacgaaatgctgcgcatgggcttcatcgaagacgttgaaaccattatggcgcagatcccggaaggtcatcagaccgctctgttctctgcaaccatgccggaagcgattcgtcgcattacccgccgctttatgaaagagccgcaggaagtgcgcattcagtccagcgtgactacccgtcctgacatcagccagagctactggactgtctggggtatgcgcaaaaacgaagcactggtacgtttcctggaagcggaagattttgatgcggcgattatcttcgttcgtaccaaaaacgcgactctggaagtggctgaagctcttgagcgtaacggctacaacagcgccgcgctgaacggtgacatgaaccaggcgctgcgtgaacagacactggaacgcctgaaagatggtcgtctggacatcctgattgcgaccgacgttgcagcccgtggcctggacgttgagcgtatcagcctggtagttaactacgatatcccgatggattctgagtcttacgttcaccgtatcggtcgtaccggtcgtgcgggtcgtgctggccgcgcgctgctgttcgttgagaaccgcgagcgtcgtctgctgcgcaacattgaacgtactatgaagctgactattccggaagtagaactgccgaacgcagaactgctaggcaaacgccgtctggaaaaattcgccgctaaagtacagcagcagctggaaagcagcgatctggatcaataccgcgcactgctgagcaaaattcagccgactgctgaaggtgaagagctggatctcgaaactctggctgcggcactgctgaaaatggcacagggtgaacgtactctgatcgtaccgccagatgcgccgatgcgtccgaaacgtgaattccgtgaccgtgatgaccgtggtccgcgcgatcgtaacgaccgtggcccgcgtggtgaccgtgaagatcgtccgcgtcgtgaacgtcgtgatgttggcgatatgcagctgtaccgcattgaagtgggccgcgatgatggtgttgaagttcgtcatatcgttggtgcgattgctaacgaaggcgacatcagcagccgttacattggtaacatcaagctgtttgcttctcactccaccatcgaactgccgaaaggtatgccgggtgaagtgctgcaacactttacgcgcactcgcattctcaacaagccgatgaacatgcagttactgggcgatgcacagccgcatactggcggtgagcgtcgtggcggtggtcgtggtttcggtggcgaacgtcgtgaaggcggtcgtaacttcagcggtgaacgccgtgaaggtggccgtggtgatggtcgtcgttttagcggcgaacgtcgtgaaggccgcgctccgcgtcgtgatgattctaccggtcgtcgtcgtttcggtggtgatgcgtaa

SEQ ID NO: 79801 - protein, 629 aa, Escherichia coli
MAEFETTFADLGLKAPILEALNDLGYEKPSPIQAECIPHLLNGRDVLGMAQTGSGKTAAFSLPLLQNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLSKIQPTAEGEELDLETLAAALLKMAQGERTLIVPPDAPMRPKREFRDRDDRGPRDRNDRGPRGDREDRPRRERRDVGDMQLYRIEVGRDDGVEVRHIVGAIANEGDISSRYIGNIKLFASHSTIELPKGMPGEVLQHFTRTRILNKPMNMQLLGDAQPHTGGERRGGGRGFGGERREGGRNFSGERREGGRGDGRRFSGERREGRAPRRDDSTGRRRFGGDA

SEQ ID NO: 79802 - DNA, 1692 bp, Mycobacterium tuberculosis
  CDS (1)..(1692): transl_table=11
atggccttcccggaatattcgcctgcggcgtccgctgcgacgtttgctgacctgcagattcatccccgcgtcttgcgggcgatcggcgacgtcggttacgagtcaccgacggctatccaggcggctacgatcccggcgttgatggcaggctccgacgtggtggggctggcgcagaccggcaccggcaagacggcggcatttgcgattccgatgctgtccaagatcgacatcaccagcaaggtgccccaggcgctggtgctggtgcccacccgggagctggctctgcaggtggccgaggcgttcggccgctacggtgcctatctgtcgcaactcaacgtgctgccgatctacggcggatcgtcgtatgccgtgcaactggccggattgagacgcggcgcgcaggtggtggttggcacccccggtcgtatgatagaccatctcgaacgggcgaccttggacctgtcgcgggtggactttctagtgctcgatgaggccgatgagatgctgaccatgggtttcgccgacgacgttgagcgcattctgtccgagacccccgaatacaagcaggtcgccctgttttccgcgaccatgccgccggcgatccgcaaactcagcgccaagtatctgcacgatccgttcgaagtcacttgtaaggcgaaaaccgctgtggccgagaatatttcgcagagctacattcaggtagcacggaagatggacgcgctcaccagagtgctcgaagtcgagccgttcgaggcgatgatcgtctttgtccgcaccaagcaggcgaccgaggagattgccgaaaagctgcgtgcccgagggttttccgcggctgccatcagcggtgacgtcccgcaggcgcagcgggagcggaccatcacggcgctgcgggacggcgacatcgatatcctggtcgccaccgatgtggcggcgcgcggactcgacgtggagcggatatcacacgtgcttaactacgacatcccgcacgacaccgagtcctacgtacaccggatcgggcgcaccggcagggccgggcgttcgggagccgcgctgatattcgtctcgccacgggagcttcacctgctcaaggcgatcgaaaaggctacgcggcaaacgcttaccgaggcgcaattgcccaccgtcgaggatgtcaacacccagcgggtggccaagttcgccgattccatcaccaatgcgctgggcggtccgggaatcgagctgttccgccgactggtcgaggagtatgaacgcgagcatgatgtcccgatggctgacatcgccgcggcactggccgtgcagtgccgcggcggtgaggcattcctgatggcacccgacccgccgctttcgcggcgcaaccgcgaccagcgtcgggaccgtccgcaaaggcccaagcgtagaccggacttgaccacctaccgcgtcgccgtcggcaagcggcacaagatcggtccaggcgccatcgtcggcgccatcgccaatgagggtgggctgcaccgcagcgacttcggtcagatccgtatcgggccagacttctcgctagtagaattgccggcgaagctgccccgcgcgacgctcaaaaagcttgcacagacccgtatctcgggtgtgctgatcgaccttcggccataccggccgcccgacgcggcgcgccggcataatggcggcaaaccacggcggaaacacgtcggatga

SEQ ID NO: 79803 - protein, 563 aa, Mycobacterium tuberculosis
MAFPEYSPAASAATFADLQIHPRVLRAIGDVGYESPTAIQAATIPALMAGSDVVGLAQTGTGKTAAFAIPMLSKIDITSKVPQALVLVPTRELALQVAEAFGRYGAYLSQLNVLPIYGGSSYAVQLAGLRRGAQVVVGTPGRMIDHLERATLDLSRVDFLVLDEADEMLTMGFADDVERILSETPEYKQVALFSATMPPAIRKLSAKYLHDPFEVTCKAKTAVAENISQSYIQVARKMDALTRVLEVEPFEAMIVFVRTKQATEEIAEKLRARGFSAAAISGDVPQAQRERTITALRDGDIDILVATDVAARGLDVERISHVLNYDIPHDTESYVHRIGRTGRAGRSGAALIFVSPRELHLLKAIEKATRQTLTEAQLPTVEDVNTQRVAKFADSITNALGGPGIELFRRLVEEYEREHDVPMADIAAALAVQCRGGEAFLMAPDPPLSRRNRDQRRDRPQRPKRRPDLTTYRVAVGKRHKIGPGAIVGAIANEGGLHRSDFGQIRIGPDFSLVELPAKLPRATLKKLAQTRISGVLIDLRPYRPPDAARRHNGGKPRRKHVG

SEQ ID NO: 79804 - DNA, 1254 bp, Mannheimia succiniciproducens; identical to SEQ ID NO: 38811
  CDS (1)..(1254): transl_table=11

SEQ ID NO: 79805 - protein, 417 aa, Mannheimia succiniciproducens; identical to SEQ ID NO: 38812

SEQ ID NO: 79806 - DNA, 1632 bp, Xylella fastidiosa; identical to SEQ ID NO: 39049
  CDS (1)..(1632): transl_table=11

SEQ ID NO: 79807 - protein, 543 aa, Xylella fastidiosa; identical to SEQ ID NO: 39050

SEQ ID NO: 79808 - DNA, 1365 bp, Escherichia coli; identical to SEQ ID NO: 39051
  CDS (1)..(1365): transl_table=11

SEQ ID NO: 79809 - protein, 454 aa, Escherichia coli; identical to SEQ ID NO: 39052

SEQ ID NO: 79810 - DNA, 1320 bp, Haemophilus influenzae
  CDS (1)..(1320): transl_table=11
atgaatttatcccaatttgaacaattcgatctttctcctgagcttttaaaggcacttgagaaaaaaggttattcccgcccaacagctattcaaatggaagccattcctgccgcaatggaagagagtgatgtattaggctcggcaccaacgggaacagggaaaactgctgcttttttattacctgcgctacaacatttattggattatccacgccgtaaaccaggcccaccacgtattttggtattaacaccaacccgtgaactggcaatgcaagtggctgaacaagcggaagaattagcgcagttcacccatttaaatattgcgacaattacaggtggcgtggcgtatcaaaatcacggtgatgtattcaataccaatcaagatttggtggtggctacgccaggccgtttgttgcaatacattaaggaagaaaattttgattgccgttccgttgaaatgctgatttttgatgaagccgatagaatgttgcaaatgggatttgggcaagatgcggaaaaaattgcagctgaaacccgttggcgaaaacaaactttgttgttttctgcaaccttagaaggagagttattggtcgatttcgcggagcgtttattgaatgatcctgtgaaagtagatgcggaaccaagtcgccgtgaaagaaaaaaaatcaatcaatggtattatcacgcagacagcaatgaacacaaaatcaaattgctcgcgcgttttattgaaactgaagaagtaacccgtggaattgtgtttattcgtcgtcgtgaagatgcacgtgaactttccgaaacattgcgtaaacgaggcattcgttccgcatatttagaaggcgaaatggcacaaactcaacgtaacaatgccattgataaattgaaatcaggtattgtgacggtattggttgcaacagatgtggctgcacgtggtattgatattgacgatgtaagccacgtgatgaattttgatttgccctatagtgcggatacttatttgcatcgaattggacgtaccgcgcgagctggcaaaaaaggcacggcagtctcttttgtcgaagcgcatgattacaagttgctaggtaaaatcaaacgttatactgaggaaattttaaaggcacgcattttagcaggtttagaacctcgcactaagccaccaaaagatggcgaagtgaaatctgtcagcaaaaaacaaaaggcacgcattaaagaaaaacgtgaagaaaagaaaaaaacagaggcaaagaaaaaagtaaaattgcgtcataaggatacgaaaaatatcggcaaacgacgcaagccaagtaacagtaatgtttag

SEQ ID NO: 79811 - protein, 439 aa, Haemophilus influenzae
MNLSQFEQFDLSPELLKALEKKGYSRPTAIQMEAIPAAMEESDVLGSAPTGTGKTAAFLLPALQHLLDYPRRKPGPPRILVLTPTRELAMQVAEQAEELAQFTHLNIATITGGVAYQNHGDVFNTNQDLVVATPGRLLQYIKEENFDCRSVEMLIFDEADRMLQMGFGQDAEKIAAETRWRKQTLLFSATLEGELLVDFAERLLNDPVKVDAEPSRRERKKINQWYYHADSNEHKIKLLARFIETEEVTRGIVFIRRREDARELSETLRKRGIRSAYLEGEMAQTQRNNAIDKLKSGIVTVLVATDVAARGIDIDDVSHVMNFDLPYSADTYLHRIGRTARAGKKGTAVSFVEAHDYKLLGKIKRYTEEILKARILAGLEPRTKPPKDGEVKSVSKKQKARIKEKREEKKKTEAKKKVKLRHKDTKNIGKRRKPSNSNV

SEQ ID NO: 79812 - DNA, 23 bp, Primer
atgactgtaacgactttttccga

SEQ ID NO: 79813 - DNA, 23 bp, Primer
ttactcttctgtcgtttgcggtg

SEQ ID NO: 79814 - protein, 402 aa, consensus
  MISC_FEATURE (1)..(402): consensus for the disclosure of xaa see table XV
FXXXXLXXXXXXXXXXXGXXXPXPIQXXXIPXXLXGXDXXXXAQTGTGKTAXFXLPXXXXXXXXXXXXXXXXXXXXXXXXXXXXXXXXXXXXXXXXLXLXPTRELAXQXXXXXXXXXXXXXXXXXXXXXXGGXXXXXQXXXLXXXXXXXXXXTPGRLXDXXXXXXXXXXXXXXXXVLDEADXMLXMGFXXDXXXXXXXXPXXXXXQXXXFSATXXXXXXXXXXXXXXXXPXXXXXXXXXXXXXXXXXXXQXXXXXXXXXXXXXXXXKXXXLXXXXXXXXXXXXXXXXFXXTKXXXXXXXXXLXXXXXXGXXXXXXXGXXXQXXRXXXXXXXXXGXXXXLVATDXAARGXDXXXXXXVXNXXXPXXXXXYXHRIGRTGRAGXXGXAXXXXXXXXXXXXXXXIE

SEQ ID NO: 79815 - protein, 61 aa, consensus
  MISC_FEATURE (1)..(61): consensus for the disclosure of xaa see table XV
XXXXXXXXXXXXXXXXXXXXXXXXXQXXXXPXXXXXXDXXXXXXTGXGKTXXXXXXXXXXX

SEQ ID NO: 79816 - protein, 113 aa, consensus
  MISC_FEATURE (1)..(113): consensus for the disclosure of xaa see table XV
PTRELXXQXXXXXXXXXXXXXXXXXXXXXXGGXXXXXXXXXXXXXXXXXXXXXXGRXXXXXXXXXXXXXXXXXXXXXDEXDXXXXXGFXXXXXXXXXXXXXXXXXXXXXXXAT

SEQ ID NO: 79817 - protein, 96 aa, consensus
  MISC_FEATURE (1)..(96): consensus for the disclosure of xaa see table XV
FXXXXXXXXXXXXXXXXXXXXXXXXXXXXXXXXQXXRXXXXXXXKXXXXXXXXXXDXAXRGXXXXXXXXVXNXXXPXXXXXYXHRXGRXXRXXXXG

SEQ ID NO: 79818 - DNA, 681 bp, Escherichia coli K12; identical to SEQ ID NO: 30948
  CDS (1)..(681)

SEQ ID NO: 79819 - protein, 226 aa, Escherichia coli K12; identical to SEQ ID NO: 30949

SEQ ID NO: 79820 - DNA, 738 bp, Pseudomonas sp; identical to SEQ ID NO: 30950
  CDS (1)..(738)

SEQ ID NO: 79821 - protein, 245 aa, Pseudomonas sp; identical to SEQ ID NO: 30951

SEQ ID NO: 79822 - DNA, 678 bp, Salmonella enterica subsp. enterica serovar Typhi; identical to SEQ ID NO: 30952
  CDS (1)..(678)

SEQ ID NO: 79823 - protein, 225 aa, Salmonella enterica subsp. enterica serovar Typhi; identical to SEQ ID NO: 30953

SEQ ID NO: 79824 - DNA, 675 bp, Sinorhizobium meliloti; identical to SEQ ID NO: 30954
  CDS (1)..(675)

SEQ ID NO: 79825 - protein, 224 aa, Sinorhizobium meliloti; identical to SEQ ID NO: 30955

SEQ ID NO: 79826 - DNA, 923 bp, Pseudomonas pseudoalcaligenes; identical to SEQ ID NO: 30956
  CDS (95)..(832)

SEQ ID NO: 79827 - protein, 245 aa, Pseudomonas pseudoalcaligenes; identical to SEQ ID NO: 30957

SEQ ID NO: 79828 - DNA, 681 bp, Bacillus licheniformis DSM 13; identical to SEQ ID NO: 30958
  CDS (1)..(681)

SEQ ID NO: 79829 - protein, 226 aa, Bacillus licheniformis DSM 13; identical to SEQ ID NO: 30959

SEQ ID NO: 79830 - DNA, 654 bp, Photobacterium profundum; identical to SEQ ID NO: 30960
  CDS (1)..(654)

SEQ ID NO: 79831 - protein, 217 aa, Photobacterium profundum; identical to SEQ ID NO: 30961

SEQ ID NO: 79832 - DNA, 732 bp, Rhodopseudomonas palustris; identical to SEQ ID NO: 30962
  CDS (1)..(732)

SEQ ID NO: 79833 - protein, 243 aa, Rhodopseudomonas palustris; identical to SEQ ID NO: 30963

SEQ ID NO: 79834 - DNA, 711 bp, Rhodopseudomonas palustris; identical to SEQ ID NO: 30964
  CDS (1)..(711)

SEQ ID NO: 79835 - protein, 236 aa, Rhodopseudomonas palustris; identical to SEQ ID NO: 30965

SEQ ID NO: 79836 - DNA, 666 bp, Rhodopseudomonas palustris; identical to SEQ ID NO: 30966
  CDS (1)..(666)

SEQ ID NO: 79837 - protein, 221 aa, Rhodopseudomonas palustris; identical to SEQ ID NO: 30967

SEQ ID NO: 79838 - DNA, 738 bp, Rhizobium sp; identical to SEQ ID NO: 30968
  CDS (1)..(738)

SEQ ID NO: 79839 - protein, 245 aa, Rhizobium sp; identical to SEQ ID NO: 30969

SEQ ID NO: 79840 - DNA, 720 bp, Rhizobium sp; identical to SEQ ID NO: 30970
  CDS (1)..(720)

SEQ ID NO: 79841 - protein, 239 aa, Rhizobium sp; identical to SEQ ID NO: 30971

SEQ ID NO: 79842 - DNA, 675 bp, Chromobacterium violaceum; identical to SEQ ID NO: 30972
  CDS (1)..(675)

SEQ ID NO: 79843 - protein, 224 aa, Chromobacterium violaceum; identical to SEQ ID NO: 30973

SEQ ID NO: 79844 - DNA, 663 bp, Bordetella parapertussis; identical to SEQ ID NO: 30974
  CDS (1)..(663)

SEQ ID NO: 79845 - protein, 220 aa, Bordetella parapertussis; identical to SEQ ID NO: 30975

SEQ ID NO: 79846 - DNA, 711 bp, Bordetella parapertussis; identical to SEQ ID NO: 30976
  CDS (1)..(711)

SEQ ID NO: 79847 - protein, 236 aa, Bordetella parapertussis; identical to SEQ ID NO: 30977

SEQ ID NO: 79848 - DNA, 741 bp, Bordetella parapertussis; identical to SEQ ID NO: 30978
  CDS (1)..(741)

SEQ ID NO: 79849 - protein, 246 aa, Bordetella parapertussis; identical to SEQ ID NO: 30979

SEQ ID NO: 79850 - DNA, 657 bp, Bordetella bronchiseptica; identical to SEQ ID NO: 30980
  CDS (1)..(657)

SEQ ID NO: 79851 - protein, 218 aa, Bordetella bronchiseptica; identical to SEQ ID NO: 30981

SEQ ID NO: 79852 - DNA, 945 bp, Wautersia oxalatica; identical to SEQ ID NO: 30982
  CDS (1)..(945)

SEQ ID NO: 79853 - protein, 314 aa, Wautersia oxalatica; identical to SEQ ID NO: 30983

SEQ ID NO: 79854 - DNA, 699 bp, Ralstonia sp; identical to SEQ ID NO: 30984
  CDS (1)..(699)

SEQ ID NO: 79855 - protein, 232 aa, Ralstonia sp; identical to SEQ ID NO: 30985

SEQ ID NO: 79856 - DNA, 675 bp, Vibrio parahaemolyticus; identical to SEQ ID NO: 30986
  CDS (1)..(675)

SEQ ID NO: 79857 - protein, 224 aa, Vibrio parahaemolyticus; identical to SEQ ID NO: 30987

SEQ ID NO: 79858 - DNA, 669 bp, Vibrio parahaemolyticus; identical to SEQ ID NO: 30988
  CDS (1)..(669)

SEQ ID NO: 79859 - protein, 222 aa, Vibrio parahaemolyticus; identical to SEQ ID NO: 30989

SEQ ID NO: 79860 - DNA, 729 bp, Pseudomonas syringae; identical to SEQ ID NO: 30990
  CDS (31)..(729)

SEQ ID NO: 79861 - protein, 232 aa, Pseudomonas syringae; identical to SEQ ID NO: 30991

SEQ ID NO: 79862 - DNA, 696 bp, Pseudomonas putida; identical to SEQ ID NO: 30992
  CDS (1)..(696)

SEQ ID NO: 79863 - protein, 231 aa, Pseudomonas putida; identical to SEQ ID NO: 30993

SEQ ID NO: 79864 - DNA, 717 bp, Pseudomonas putida; identical to SEQ ID NO: 30994
  CDS (1)..(717)

SEQ ID NO: 79865 - protein, 238 aa, Pseudomonas putida; identical to SEQ ID NO: 30995

SEQ ID NO: 79866 - DNA, 774 bp, Bradyrhizobium japonicum; identical to SEQ ID NO: 30996
  CDS (1)..(774)

SEQ ID NO: 79867 - protein, 257 aa, Bradyrhizobium japonicum; identical to SEQ ID NO: 30997

SEQ ID NO: 79868 - DNA, 693 bp, Bradyrhizobium japonicum; identical to SEQ ID NO: 30998
  CDS (1)..(693)

SEQ ID NO: 79869 - protein, 230 aa, Bradyrhizobium japonicum; identical to SEQ ID NO: 30999

SEQ ID NO: 79870 - DNA, 924 bp, Bradyrhizobium japonicum; identical to SEQ ID NO: 31000
  CDS (1)..(924)

SEQ ID NO: 79871 - protein, 307 aa, Bradyrhizobium japonicum; identical to SEQ ID NO: 31001

SEQ ID NO: 79872 - DNA, 720 bp, Bradyrhizobium japonicum; identical to SEQ ID NO: 31002
  CDS (1)..(720)

SEQ ID NO: 79873 - protein, 239 aa, Bradyrhizobium japonicum; identical to SEQ ID NO: 31003

SEQ ID NO: 79874 - DNA, 627 bp, Vibrio vulnificus; identical to SEQ ID NO: 31004
  CDS (1)..(627)

SEQ ID NO: 79875 - protein, 208 aa, Vibrio vulnificus; identical to SEQ ID NO: 31005

SEQ ID NO: 79876 - DNA, 672 bp, Shewanella oneidensis; identical to SEQ ID NO: 31006
  CDS (1)..(672)

SEQ ID NO: 79877 - protein, 223 aa, Shewanella oneidensis; identical to SEQ ID NO: 31007

SEQ ID NO: 79878 - DNA, 675 bp, Xanthomonas campestris; identical to SEQ ID NO: 31008
  CDS (1)..(675)

SEQ ID NO: 79879 - protein, 224 aa, Xanthomonas campestris; identical to SEQ ID NO: 31009

SEQ ID NO: 79880 - DNA, 675 bp, Xanthomonas axonopodis; identical to SEQ ID NO: 31010
  CDS (1)..(675)

SEQ ID NO: 79881 - protein, 224 aa, Xanthomonas axonopodis; identical to SEQ ID NO: 31011

SEQ ID NO: 79882 - DNA, 765 bp, Pseudomonas sp; identical to SEQ ID NO: 31012
  CDS (1)..(765)

SEQ ID NO: 79883 - protein, 254 aa, Pseudomonas sp; identical to SEQ ID NO: 31013

SEQ ID NO: 79884 - DNA, 762 bp, Rhizobium loti; identical to SEQ ID NO: 31014
  CDS (1)..(762)

SEQ ID NO: 79885 - protein, 253 aa, Rhizobium loti; identical to SEQ ID NO: 31015

SEQ ID NO: 79886 - DNA, 663 bp, Rhizobium loti; identical to SEQ ID NO: 31016
  CDS (1)..(663)

SEQ ID NO: 79887 - protein, 220 aa, Rhizobium loti; identical to SEQ ID NO: 31017

SEQ ID NO: 79888 - DNA, 744 bp, Rhizobium loti; identical to SEQ ID NO: 31018
  CDS (1)..(744)

SEQ ID NO: 79889 - protein, 247 aa, Rhizobium loti; identical to SEQ ID NO: 31019

SEQ ID NO: 79890 - DNA, 780 bp, Rhizobium loti; identical to SEQ ID NO: 31020
  CDS (1)..(780)

SEQ ID NO: 79891 - protein, 259 aa, Rhizobium loti; identical to SEQ ID NO: 31021

SEQ ID NO: 79892 - DNA, 693 bp, Streptomyces coelicolor; identical to SEQ ID NO: 31022
  CDS (1)..(693)

SEQ ID NO: 79893 - protein, 230 aa, Streptomyces coelicolor; identical to SEQ ID NO: 31023

SEQ ID NO: 79894 - DNA, 732 bp, Alcaligenes eutrophus; identical to SEQ ID NO: 31024
  CDS (1)..(732)

SEQ ID NO: 79895 - protein, 243 aa, Alcaligenes eutrophus; identical to SEQ ID NO: 31025

SEQ ID NO: 79896 - DNA, 741 bp, Rhodococcus sp; identical to SEQ ID NO: 31026
  CDS (1)..(741)

SEQ ID NO: 79897 - protein, 246 aa, Rhodococcus sp; identical to SEQ ID NO: 31027

SEQ ID NO: 79898 - DNA, 780 bp, Comamonas testosteroni; identical to SEQ ID NO: 31028
  CDS (25)..(744)

SEQ ID NO: 79899 - protein, 239 aa, Comamonas testosteroni; identical to SEQ ID NO: 31029

SEQ ID NO: 79900 - DNA, 666 bp, Photobacterium leiognathi; identical to SEQ ID NO: 31030
  CDS (1)..(666)

SEQ ID NO: 79901 - protein, 221 aa, Photobacterium leiognathi; identical to SEQ ID NO: 31031

SEQ ID NO: 79902 - DNA, 22 bp, Primer
atgatcaggagtcacaccatga

SEQ ID NO: 79903 - DNA, 21 bp, Primer
ttaattgccagccatcgcctg

SEQ ID NO: 79904 - protein, 178 aa, consensus; identical to SEQ ID NO: 31034
  MISC_FEATURE (1)..(178): consensus for the disclosure of xaa see table XV

SEQ ID NO: 79905 - protein, 81 aa, consensus; identical to SEQ ID NO: 31035
  MISC_FEATURE (1)..(81): consensus for the disclosure of xaa see table XV

SEQ ID NO: 79906 - protein, 12 aa, consensus
  MISC_FEATURE (1)..(12): consensus for the disclosure of xaa see table XV
XXXXXXXXXXXX

SEQ ID NO: 79907 - DNA, 1038 bp, Escherichia coli
  CDS (1)..(1038)
atgttttccgcattgcgccaccgtaccgctgccctggcgctcggcgtatgctttattctccccgtacacgcctcgtcacctaaacctggcgattttgctaatactcaggcacgacatattgctactttctttccgggacgcatgaccggaactcctgcagaaatgttatctgccgattatattcgccaacagtttcagcaaatgggttatcgcagtgatattcggacatttaatagtcggtatatttataccgcccgcgataatcgtaagagctggcataacgtgacgggaagtacggtgattgccgctcatgaaggcaaagcgccgcagcagatcatcattatggcgcatctggatacttacgccccgctgagcgatgctgacgccgatgccaatctcggcgggctgacgttacaaggaatggatgataacgccgcaggtttaggtgtcatgctggaattggcagaacgcctgaaaaatacgcctaccgagtatggtattcgatttgtggcgaccagcggcgaagaggaagggaaattaggcgctgagaatttactcaagcggatgagtgacaccgaaaagaaaaatacgctgctggtgattaatctcgataacttaattgttggcgataaattgtatttcaacagcggtgtaaaaacccctgaggcagtaaggaaattaacgcgcgacagggcgctggcaattgcgcgcagtcacggaatagccgcaacgaccaatccgggtttgaataaaaattatccgaaaggcactgggtgttgtaatgacgcagaaatattcgacaaagcgggcattgctgtactttcggtggaagcgactaactggaatcttgggaataaggatggttatcagcaacgcgcaaaaacacctgccttcccggcgggaaatagctggcatgacgtaagactggataatcaccaacatattgataaggctcttcctggaagaatagaacgtcgctgccgtgacgttatgcggataatgctacctctggtgaaggagttggcgaaggcgtcttga

SEQ ID NO: 79908 - protein, 345 aa, Escherichia coli
MFSALRHRTAALALGVCFILPVHASSPKPGDFANTQARHIATFFPGRMTGTPAEMLSADYIRQQFQQMGYRSDIRTFNSRYIYTARDNRKSWHNVTGSTVIAAHEGKAPQQIIIMAHLDTYAPLSDADADANLGGLTLQGMDDNAAGLGVMLELAERLKNTPTEYGIRFVATSGEEEGKLGAENLLKRMSDTEKKNTLLVINLDNLIVGDKLYFNSGVKTPEAVRKLTRDRALAIARSHGIAATTNPGLNKNYPKGTGCCNDAEIFDKAGIAVLSVEATNWNLGNKDGYQQRAKTPAFPAGNSWHDVRLDNHQHIDKALPGRIERRCRDVMRIMLPLVKELAKAS

SEQ ID NO: 79909 - DNA, 1944 bp, Pseudomonas aeruginosa PAO1
  CDS (1)..(1944): transl_table=11
gtgttcaaaccattagctgtcgctgtaggcctgggatgtgctgcgctgtcgttgggtgccaacgcctatcaatacggggaatacgccggggagaccctggagcgcctgatcaccgactacccgggccgctatcgcggcaccgccagcttcgccggcgccagcaaactgatgcagtcgcgcctgggcttcggctaccagaccagtcgccaggacttcacctgggccggcaaccgcagttcgcagaacgtcatcgcctcggcgcccggcagcagcgggaagttcctggtactcggcgcgcactacgacacctactacggtcgcccgaccctgcagggcctggacgataacgcctcgggcgcggcggtgctcaccgagatcgcccgcaacctcggcggcatcgccctggagaacggcctcgaggtggtcggtttcggcgccgaggaggaaggcctgcgcggttcgcgtgcctacgtcgagtccctcgacgccagccagcgcgccaacctgctgggaatgatcaacctcgacagcctggtcaccggcgacaagatgtacgcccatgccggctccaacagcgtgtccaacccggccctcggcgcctaccgcgaacagatcctgcgcatcgcccgcgagctggacatcccgttgttcaccaaccccggcctgaacgccgaatacccggcgggtaccggctgctgcagcgacggcgaaagcttcaacgggatggacatcccggtgttgttcatcgaggcgaccaactgggaactgggcgacctggacggctacgagcagaccgacaacccggcgattcccggcggctcaacctggcacgacccggccgaggacaacaaggaagtactgaccaacgccctcggccaggagcgcatcgagcaacgcatgcgcgacttttcccgcctgctgacgcgcctggtgctggagcagaccaacgccgacctgctggcctccaccgcctccggcggcgccctggcgcggcagatggaagaccagttgcagcgccagcatcaggcactgacccgcctgcacgaccgccgctggctgaccctgctcggcagcaaccggccggtaggcagcttcgacggcgaggtgggcgcggagggcgaggtctcgccggacagcggtttcgacatgcctggcaatccggagtccaggcgcgccggcgtgcatctgctcggcgactaccgctacagcgaggccctgactctcggcggcagcctggccttccagcgcagccgcgacaagctggaccatggtgggcgcatcgagggcgacacctggcagctcggcctgttcggcctgtacaacgacggcggtccggaatggctggccggcgagctgaacctcgggcatacccgctacgacagcaagcgttcggtctacctccaggccgccggcgggccggtgctgctcgaccagcgtctgtcgggcgacacctcggcctggtcctggggcgcccggctggaaggcggctatgacttcagcttcggcgaactgcggagcgggccgctggccggcctcgactacatgcactaccgcatcgacgacttccgcgaggacgaggccctgcgtaccgcactcggctacgagaagcaggactacgactcgctggaggcgagtctcggctggcgcctgcgcggcgagctggcgctgggcgcgagaatgcgcctgcaaccctacgccagcctgcgctgggtccgcgagctggcggacggacgcctggacgacatggacctgaccagccgcggcgacgggcgtgtccgggtcgccgacatgggcggcgtggacaaggatttcggccgcgcccagcttggcgcgcaactggcgatcaccgagcagctcggggtcttcgccgaagccaacagccgcttcgcccacagcgaaggcaaccaagcgggctattcgctcggggtgaactggcagttctga

SEQ ID NO: 79910 - protein, 647 aa, Pseudomonas aeruginosa PAO1
MFKPLAVAVGLGCAALSLGANAYQYGEYAGETLERLITDYPGRYRGTASFAGASKLMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRANLLGMINLDSLVTGDKMYAHAGSNSVSNPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLEQTNADLLASTASGGALARQMEDQLQRQHQALTRLHDRRWLTLLGSNRPVGSFDGEVGAEGEVSPDSGFDMPGNPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMHYRIDDFREDEALRTALGYEKQDYDSLEASLGWRLRGELALGARMRLQPYASLRWVRELADGRLDDMDLTSRGDGRVRVADMGGVDKDFGRAQLGAQLAITEQLGVFAEANSRFAHSEGNQAGYSLGVNWQF

SEQ ID NO: 79911 - DNA, 1038 bp, Methanothermobacter thermautotrophicus str. Delta H
  CDS (1)..(1038): transl_table=11
atgaagttaaaggccctgatcattatcattctgattttttcgatccagccggttcaccccgtggatatggtgggggaagtgaagcacctttcagaggatgtgggtccaagacccgccggttcagccagtgaaaggatggccgccgagtacattgcctcacggttccaggccatggggataaagacggagctggaggaattcaggtactactcattaacctctccgggggtgaggaggtcatgcaatgttatagccaccattgagggtgattcagagcgtgaaatcataatctgcgccgatctggacactcctgtggatcccgtgagcgggaactactcatccggggccaacgatgatgcaaccggacttgcactgctccttgaaattgcagagaggtaccatgaccggaggccaccatacacaatcaaactcatcgccttcggtgccggggaggatggcttcaccttccccctggtaaccccgaaaaggacgtccctctcccctgacgcataccaccagatagtctatctgccctacctggtaggtgcaaggcaccacgtccttaacaggcaggaggaggtgaacagaaccattgcggttatcagcctggaggccatgggcatggggagcccctgcattgtgaggagggactactacgctgacagcagcccagcccttgtcggcctaattgccctcaacgcccgccttcacggtatcagggccgatgtggttgatttcatggcggcctcaacaccggcgggcgagcaggccataagccacgtttacctcccattctcagttgcaggtgtcccctcaaccttcctggtctccatgagggacccctccagtgggggtgtccacagcaccatcaccgagataccgggatacctctcagaccgtgacaccttcagcaacctcattgaggagtcaggtggaagggaagcccttgaagggcacatggatgccatggctgacatggtcgagtacagtattgaagccattttccttgtcagagggatgtgggacctcctccagtga

SEQ ID NO: 79912 - protein, 345 aa, Methanothermobacter thermautotrophicus str. Delta H
MKLKALIIIILIFSIQPVHPVDMVGEVKHLSEDVGPRPAGSASERMAAEYIASRFQAMGIKTELEEFRYYSLTSPGVRRSCNVIATIEGDSEREIIICADLDTPVDPVSGNYSSGANDDATGLALLLEIAERYHDRRPPYTIKLIAFGAGEDGFTFPLVTPKRTSLSPDAYHQIVYLPYLVGARHHVLNRQEEVNRTIAVISLEAMGMGSPCIVRRDYYADSSPALVGLIALNARLHGIRADVVDFMAASTPAGEQAISHVYLPFSVAGVPSTFLVSMRDPSSGGVHSTITEIPGYLSDRDTFSNLIEESGGREALEGHMDAMADMVEYSIEAIFLVRGMWDLLQ

SEQ ID NO: 79913 - DNA, 930 bp, Caulobacter crescentus CB15
  CDS (1)..(930): transl_table=11
atgatcgcttctcgccgttccttgagtctgttcgccgctgtcttcctggcgctcgcgtccccggcctttgcgggccctggcgacagggcgctcgacgatgtccggatcctctcggccgacgacatgcaggggcggggcgtggccacgcccggctcggaaaagtcacgcgcctacattctctcgcggttcgccgagattgggctggcgccggtcggcgaccggtttgagcatggcttcagcttcaccaagcgagacggctcgaccgtgcagggcgtgaatctgatcgcccggatcaaggggagcaagcctggcaaggtcatggtggtcaccgcccactacgaccatctgggcgtccgcaacggcgagatctacaacggcgccgacgacaatgcgtccggcgttgcgggtttgctggcggtggccgaggccttcaaggccaagcgccccaagcacgatgtcctcttcgcggtggtcgacgccgaggagagcggactgcgcggcgcgcgggccttcatggccgcgccgccggttccccgggagtcgatcgcgctgaacatcaatttcgacatgctcagcaagaacacgaagaacgaactcttcgtcgccggcgcgtcgccgttcccggtcctgcgtccgatcctagagcgcgtcgccgcgaccgcgccggtagcgctgaaattgggtcatgacaccgacgccgacggaccccagaacaactggaccacgcagtcagaccactacgccttcggcgagaagggcgtgccgtgggtctatttcggggtcgaggatcaccccgagtaccaccgcccgagcgatgacttcgcgacgatcccgcaggacttcttcaagcgttcggtgaccacggtggtgcaggccagccgggcgctggacgcctcgctggacgatgtcgccaagagcactggccgctga

SEQ ID NO: 79914 - protein, 309 aa, Caulobacter crescentus CB15
MIASRRSLSLFAAVFLALASPAFAGPGDRALDDVRILSADDMQGRGVATPGSEKSRAYILSRFAEIGLAPVGDRFEHGFSFTKRDGSTVQGVNLIARIKGSKPGKVMVVTAHYDHLGVRNGEIYNGADDNASGVAGLLAVAEAFKAKRPKHDVLFAVVDAEESGLRGARAFMAAPPVPRESIALNINFDMLSKNTKNELFVAGASPFPVLRPILERVAATAPVALKLGHDTDADGPQNNWTTQSDHYAFGEKGVPWVYFGVEDHPEYHRPSDDFATIPQDFFKRSVTTVVQASRALDASLDDVAKSTGR

SEQ ID NO: 79915 - DNA, 1047 bp, Salmonella typhimurium LT2
  CDS (1)..(1047): transl_table=11
atgttttccgcaacgcgccgctttgccgtcattctggcgctcggcgtaggctttatccttcctgcacaagcagcatcaccagggcctggtgaaatagcgaatactcaggcacgacatatcgccaccttttttcccgggagaatgacgggctcccccgccgagatgttgtctgccgattatttacgccaacaatttacccagatgggataccaaagcgatattcgaacgtttaatagccgatttatttataccacgaaggataatcgcaaaaactggcataacgtgacgggcagtacggtcatcgccgcccatgaagggcgcgtgccgcaacagatcatcattatggcgcatctggatacgtacgctccgcagagcgacgctgatgtcgatgccaatctgggcggtttaacgttacagggaatggatgataatgccgcgggattaggcgttatgctggaactggcggcgcgtctgaaagatataccgacccattacgggattcgttttatcgccaccagcggggaagaagagggaaagctaggcgcggaaaatttactcaaacgaatgagtgacgctgagaagaaaaatacgctgctggtcattaatctcgataacctgattgttggcgacaagctctattttaatagcgggaaaaatacgccggaagcggtgcgtacactgacccgcgatcgggcattagcgattgcgcgccgttatggcatcgccgccaacaccaatccgggacgcaatccatcctaccccaaaggaacgggttgctgtaatgatgcggaggttttcgataaagcgggaatatctgtgctttctgttgaggcgacgaactggaatctgggtaaaaaagacggataccagcaacgcgtgaaaaatgcctccttcccgaacggtaatagctggcacgacgtacggcttgataatcaacagcatattgacaaggcgctgccagggcggattgagcgccgtagccgcgatgtagtgcggataatgctgccgttggtaaaagagctggcgaaggcggaaaaaacgtcctga

SEQ ID NO: 79916 - protein, 348 aa, Salmonella typhimurium LT2
MFSATRRFAVILALGVGFILPAQAASPGPGEIANTQARHIATFFPGRMTGSPAEMLSADYLRQQFTQMGYQSDIRTFNSRFIYTTKDNRKNWHNVTGSTVIAAHEGRVPQQIIIMAHLDTYAPQSDADVDANLGGLTLQGMDDNAAGLGVMLELAARLKDIPTHYGIRFIATSGEEEGKLGAENLLKRMSDAEKKNTLLVINLDNLIVGDKLYFNSGKNTPEAVRTLTRDRALAIARRYGIAANTNPGRNPSYPKGTGCCNDAEVFDKAGISVLSVEATNWNLGKKDGYQQRVKNASFPNGNSWHDVRLDNQQHIDKALPGRIERRSRDVVRIMLPLVKELAKAEKTS

SEQ ID NO: 79917 - DNA, 963 bp, Methanosarcina acetivorans C2A
  CDS (1)..(963): transl_table=11
ttgctccccgaggaagtaagccgtttcactgaaggcgagggggactggtggacgatacgtccgctggcaatggacagcgtggttatggatataatcaaacctgaagcccgggaagccgttccaaggatgcaggcaaacattgaagctgtgtcacaatccacatacaattattatctgagttcgctggtgaatttcctgactcgtcattccttaagctctcaatttaccagcgcagcaacctgggcgacagatcagttgcaaaactttggttaccaggtggaattgattccaataaatgttggaagtggcgaaagctataatgtcattgcggatcgttcgggcaatgaaagtggagcccgtaaactgatacttgttactgctcacctggactcggtaaacctcaccgggggaagggaggcacccgccccgggtgcggatgacaatgcaagcggtgctgcaggggttctggagatcgcacgcgtgcttgctgaacatcctgcaaaacaagacctgcgtctcattctttttggcggggaggaacagggccttcacgggagcaaacaatatgtcagcggattggcgaccagtgaacgcgcccgtatcagtgcagttatcaacatggacatggttgcgaccttaaataccgcatcgccaactgtcttgctcgaaggagctccagtttcaaggactataatgggagaacttgccgaagcagcttcgacatacacatcactggctgtccagacatcagagaacccctttgcaagtgatcacgtacctttcatcgatgagcttatccctgcagttctcacgattgaaggaactgatagttcaaataccaacgtacataccgctaatgatacgcttgatcacatcaactgcggtcttgcactggacattgtccggatgaatttagctgttactttcaggctgcttggtgttgacgagtcgcagacaccctaa

SEQ ID NO: 79918 - protein, 320 aa, Methanosarcina acetivorans C2A
MLPEEVSRFTEGEGDWWTIRPLAMDSVVMDIIKPEAREAVPRMQANIEAVSQSTYNYYLSSLVNFLTRHSLSSQFTSAATWATDQLQNFGYQVELIPINVGSGESYNVIADRSGNESGARKLILVTAHLDSVNLTGGREAPAPGADDNASGAAGVLEIARVLAEHPAKQDLRLILFGGEEQGLHGSKQYVSGLATSERARISAVINMDMVATLNTASPTVLLEGAPVSRTIMGELAEAASTYTSLAVQTSENPFASDHVPFIDELIPAVLTIEGTDSSNTNVHTANDTLDHINCGLALDIVRMNLAVTFRLLGVDESQTP

SEQ ID NO: 79919 - DNA, 1353 bp, Clostridium tetani
  CDS (1)..(1353): transl_table=11
atgaaaaaaattataagtttaattatgtgtttaactataagtgtagtatttatttcttgctcaaaggacactacacccaatgaagatagtaataataaaaatacatcaattgaaagtaaatataaaaagcatattgaaatatccatagatgaaaatttaatactagaaaatttaaaaaagctttgtgaaaatgtaagaaactatggatctgttggtgaaaaagtttctgctgattacctaaaaggtaagctagaggaatatggttatatagtagaatttcaagagtttccggtatataaacaaacaattgattctacaatggctgtgaaaaataataaagattactttaaactaaatccctataattcagaaaaaaagggtacaggcaaaaatgtaattggaaaaagggataatcatagtaatgagaaaaaaacaatatatttaacagcacattatgacactacagactttactaaaggagttatagataatggtacaggcactgctgttatacttgaggtagcaagacaactaagaaactaccatagcccatttaacattgaaatagtattttttagtggagaagagtattgcagaagtggatctagatattttgtttccaaattaacagaggaagaaaagaaaaataccttgggttgcattaatgttgacatggttggagaaaagggtgcaggggacatagtaatgggacttgttaatcaggagaataatgtaatgactgtaatgttaaatgaaggtttagaaaataaattgaaaatttcccgtggtggctccagtgatgatctttcattttaccatggagaaataccagctataactttattaaataaaaaacctaattttaaaatagataaaaaagaagatcaatttccatatgtagacttacaacaattaaaaaatacagcttatttaatatcaaattttttaactaattttaatatggatacttataataaaatagtaaataaagataaaacttattctagcaataaaaaagtagataaactaggagaagttaatggatttaaattaaataaaataagtgcttatccaataaaaaatggctatgatagtataacagaatatgagtatattaataaaaatggtaaaaggtatatttttacagagcaaattaaaacatttattaatttagatgattatggtgagtttaaatcactagataaagataataattggctttattctataagtaaagattcaaaatataacactaaagttttttattgttttggaatacattttggagaaataaaaagtgatatttccatggatgaagcaatgaagatattaaagatttattctgagaaatag

SEQ ID NO: 79920 - protein, 450 aa, Clostridium tetani
MKKIISLIMCLTISVVFISCSKDTTPNEDSNNKNTSIESKYKKHIEISIDENLILENLKKLCENVRNYGSVGEKVSADYLKGKLEEYGYIVEFQEFPVYKQTIDSTMAVKNNKDYFKLNPYNSEKKGTGKNVIGKRDNHSNEKKTIYLTAHYDTTDFTKGVIDNGTGTAVILEVARQLRNYHSPFNIEIVFFSGEEYCRSGSRYFVSKLTEEEKKNTLGCINVDMVGEKGAGDIVMGLVNQENNVMTVMLNEGLENKLKISRGGSSDDLSFYHGEIPAITLLNKKPNFKIDKKEDQFPYVDLQQLKNTAYLISNFLTNFNMDTYNKIVNKDKTYSSNKKVDKLGEVNGFKLNKISAYPIKNGYDSITEYEYINKNGKRYIFTEQIKTFINLDDYGEFKSLDKDNNWLYSISKDSKYNTKVFYCFGIHFGEIKSDISMDEAMKILKIYSEK

SEQ ID NO: 79921 - DNA, 1962 bp, Erwinia carotovora subsp. atroseptica SCRI1043
  CDS (1)..(1962)
atggggtgtatgttgaagcaagtagctgttgcggtagggatggcgtgtttatgtgtaccggcctgggcttatgattatggtgactatgcgcgagagaccgtggatacgctcattaatgattatccggggcgctatcgcgatacggcaaattttgttggtgcggcggactggatgacgcagcgtatggcacccggctatagcacagtcaggcaggatttttcctggacggcaggtggcacgacacgttcgtcacagaacgtgctggcctctaatgtcgggttgagcagcgaatacatcattaccggggcgcactttgataccttcttcgggcggccaacgctacaagggctggatgacaacgcatcgggtgccgccattctgacggaagtggcgcgtaattttagcggtatccagacggaaaaaacgctggtctttgctgccttcggtgcagaagaagaggggctacgcggttcgcgtgcgatggttaacgatctgattgcgcaaggaaacgcgggcgatcttaaggccatgattaacatggatagcatgatcaccggtgacaaactctacgctcacgccggcgataacagcgtggctaaccctgctctggcaagcctgcgtgaacagacgctgcgtattgcgaatgaattgggcatcgatctgttcactaatccggggttgaatgcgagttatcccgctggaaccggctgttgcagcgacggcgatagcttcaatgcggcgtttgatattcccgtgctctatatggaggccaccaactgggatattggcgatcaagatggctatgagcaaaccacaaaccccgcggtgccgggtggcgcgacatggcatgatcccaccgttgataacgaagcctttctgaccagcgtgttcgggcaggagcgtatcgaccagcacctgcgtgacgtttcacgtctggtgacgcgactgttgctggaaatctccaataccgatttactgcattcggcatattccgccgccgcgatgcagcaggcgatggaagagagtctgaagcgtcagcgtcagtcattgagtgatttgcataaccagcgctggctgctgttgcaaaataccactcggagcgtgggcacgctggatacggcgatcggggttgagggcgatgttattccgtcaaatggctttgaccgcgcaccgcagcagcgctctcggcaggcgatggcttatgcactggtggattatcaattaagtgacattgtcacgattggcggaagcctgagtctgctgcgtagtaaggataagctggagcgcaatggacacattgaaagcgatacctggcaagcgggtgtctatggtttgctgaatcagggcggacccgcctggctgggcagcgaagtgacggcaggtcgcgcagcgattgaatcacgccgctcggtttatctgcaatctgcaggcggtccggttttgttggacaacgcgctggatggtaacaccgaagcgcagtttatcggtgcccgcgttagcggcggttatgacttcccaataagcggcctgcgcactggcccggttgttggtctggattacgcgcgttatcgcatcaatgcgtttgatgacaagggcaatttgcggactggcgtgcggtatgaaaagcaggatgtcgattcgctggaggccagtctgggctggcgagtgcgtggcaaggtggaattcagcaatacgatgtcgctacaaccttacgcaacagtggcgtgggtgcgtgaactggccgatgggctcgattccagctttactgtgaaagatcatgtcgatggtgcaaaccgccgcgttgcggtgggagagcaggataagaatttcggcaaggcgacggtcggtgtgcagtggcttgcggcagagaatctgaatctatattccgaaatcggcagtcgttttggtcatcaggatggcgatcaaacgcgctacagcgtgggcgtacagtggcaattctga

SEQ ID NO: 79922 - protein, 653 aa, Erwinia carotovora subsp. atroseptica SCRI1043
MGCMLKQVAVAVGMACLCVPAWAYDYGDYARETVDTLINDYPGRYRDTANFVGAADWMTQRMAPGYSTVRQDFSWTAGGTTRSSQNVLASNVGLSSEYIITGAHFDTFFGRPTLQGLDDNASGAAILTEVARNFSGIQTEKTLVFAAFGAEEEGLRGSRAMVNDLIAQGNAGDLKAMINMDSMITGDKLYAHAGDNSVANPALASLREQTLRIANELGIDLFTNPGLNASYPAGTGCCSDGDSFNAAFDIPVLYMEATNWDIGDQDGYEQTTNPAVPGGATWHDPTVDNEAFLTSVFGQERIDQHLRDVSRLVTRLLLEISNTDLLHSAYSAAAMQQAMEESLKRQRQSLSDLHNQRWLLLQNTTRSVGTLDTAIGVEGDVIPSNGFDRAPQQRSRQAMAYALVDYQLSDIVTIGGSLSLLRSKDKLERNGHIESDTWQAGVYGLLNQGGPAWLGSEVTAGRAAIESRRSVYLQSAGGPVLLDNALDGNTEAQFIGARVSGGYDFPISGLRTGPVVGLDYARYRINAFDDKGNLRTGVRYEKQDVDSLEASLGWRVRGKVEFSNTMSLQPYATVAWVRELADGLDSSFTVKDHVDGANRRVAVGEQDKNFGKATVGVQWLAAENLNLYSEIGSRFGHQDGDQTRYSVGVQWQF

SEQ ID NO: 79923 - DNA, 1350 bp, Bacillus licheniformis ATCC 14580
  CDS (1)..(1350): transl_table=11
atgaagagaaaaatgatgatgttcggattggcgctatcgatcattgcaggcggcgtggtcgccgatggaacggggaatgcagctcaagcggcccctcaggaaacagccatcgcaaaagatatcgaaaaattcagcaaaaaattcaacgagaaccgcgcctatcaaacgatttaccatttaagcgaaacgatcgggccgcgtgtgacaggcacggcagaagaaaaaaagagcgccgcttttatcgcctcacagatgaaaaagtcaaatctgaaagtaagcacacaaaagttcagcatacctgaccggctggaaggaacgcttaccgttcagggaaataacgtgcctgcgcggcctgccgccggttccgccccgactgcagcagaaggcttggccgctcctctctatgatgccggcctcggcttgcccggcgacttcacagaagaagcgaaaggaaaaatcgccgtcattttgagaggagagctgacattctatgaaaaggccaaaaacgctgctgacgcaggcgcaagcggagttatcatttataataacgtcgacagcctcgtccctctgactccgaatctaagcggtaataaagtcgatattccagttgtcggcgtcaaaaaggaagacggggaaaagctgctttctgaacaagaagcgatcctgaagctgaaagctcataaaaatcaaacctcgcaaaacgtaatcggcgtccgcaaagcaaaaggtgtcaaaaatcctgacatcgtttatgtgacttcgcattatgacagcgttccatatgcaccgggagccaatgacaatgcctccggcacttcagtcgtccttgaactggcccgaattttgaagacagtgccagccgacaaagaaattcgctttattacattcggagccgaagaaatcggactcctcggttcgcgccattatgtcagcacattgtcaaatcaggaagtcaaacggagcgttgccaactttaacttagatatggtggcgacaagctgggagaatgcttcacagctgtacatcaatacgcccgacggttcggcaaacctcgtctggcagctaagtaaagccgcttctttaagccttggaaaagacgtattatttttacatcaaggcggatcatccgaccatgtcccattccatgaagccggcatcgactcggccaactttatttggagagagccgggaacaggcgctttggagccttggtaccacaccccttacgacacgattgaacatatcagcaaagacaggctgaaaacagccggtcaaatcgcgggaacagctgtgtataacttcaccaagaaggaaaacagaaaaccgtcttacagctcagttgcccagtaa

SEQ ID NO: 79924 - protein, 449 aa, Bacillus licheniformis ATCC 14580
MKRKMMMFGLALSIIAGGVVADGTGNAAQAAPQETAIAKDIEKFSKKFNENRAYQTIYHLSETIGPRVTGTAEEKKSAAFIASQMKKSNLKVSTQKFSIPDRLEGTLTVQGNNVPARPAAGSAPTAAEGLAAPLYDAGLGLPGDFTEEAKGKIAVILRGELTFYEKAKNAADAGASGVIIYNNVDSLVPLTPNLSGNKVDIPVVGVKKEDGEKLLSEQEAILKLKAHKNQTSQNVIGVRKAKGVKNPDIVYVTSHYDSVPYAPGANDNASGTSVVLELARILKTVPADKEIRFITFGAEEIGLLGSRHYVSTLSNQEVKRSVANFNLDMVATSWENASQLYINTPDGSANLVWQLSKAASLSLGKDVLFLHQGGSSDHVPFHEAGIDSANFIWREPGTGALEPWYHTPYDTIEHISKDRLKTAGQIAGTAVYNFTKKENRKPSYSSVAQ

SEQ ID NO: 79925 - DNA, 2241 bp, Desulfitobacterium hafniense DCB-2
  CDS (1)..(2241)
atggcttacaatagcgccccagcctcggggaaggtgtccaaagacttctcggcagataaagcctatgaacatattctgcatttatcggaaaagatcggtccccggccggccggaagtcctaatgaaaccaaagcggctcaatatctgtactatatgctggaacaatatggatggaaggtgcgggagcagcccttcagcaagattgtgggcaatgccaatcctcttaaacccgagcataaaattcaagtgatcaacagtcagaacattatcgctgaattaccaggggcctcaccggaaaccattcttctgggggctcattatgacagcgccgatgtttcaactcccggagctattgataacgcttccggggtgggcgtgctgttggaaatagcccgtatcttaggtcaggaaaagcatcagaagagctaccaaatcgtattttttggagcagaagaaaatggtttggtaggttcacagtatttcactgctcaaagcgatttatcggcgatccagtggatgttgaatttggacatggtgggcactccactggagattgatatcgccggcaagacatcagcacccccggaattggtagataaggttgtaacgctcgcccgtcaggaacaaattcctttccatatcagccgggattttgcagtgatgaccagagaaggttcacagggaggggccagcgatttcagccctttcctggatcaaagcatacctgctcttggtctgggcattgccggccgcgcggaggggtactatcatcggcctgaggatcggattgagcgggtcactttacaaagcctggatactgtgggcaagttcattcctaagcttatcgagtctgtggaagtgacgggtagcggtcagaaaacctgggattcctattatttgccgttccagctgggatccttcgtcgtgatcataccgactttagggctgaggatactttttatcctcactatcttctttacagtattctctgtttcccggagtttccgtgaccaggaaccctttattcaaggcaatctcaaggagtatgtgctgatcggcgtaggtattcccggtgctgcttttctagcgagtttcttaagtggcgccggcgaagcgttatggcaattactcaaaggcagagtctatttatggcaggcctatcccggagtattcttaacgctgagggttattctggtgttatgcgcactgctgatctttttgaaacttttaagaagcttaccccagcccaaaggaggcaaactttattggctgattggcgtcttgaccttaaccctgctcaccattattttagggctttatcgaattgatttagccttcccctttcttttctggctgctttgttttaatctatttctttattatccaagcatcatcttattgtttatagggccttattttatctataagacccattgggagctcttaaattctcaacaatggcccagtttttatgaaaccattcatctctacccagtattatttatcgtcctctatggactactctttatcccagttcttttaggggccttatatatcttagaaaaaggaaaaagaccttgggagcaaatgctcaagcggctgcttattcccgctctgttggtaggtgttggctgtgttctcggaacgggcttgattccaaattatagtagagccaaccctcagccgatcactgttcaaaaagtctggacggaatcggaaagggttatactcagagtatccagtaccgacaccctccccaagagtctccttaaagagcttgattcccaggagaccaagattggggaagacaaaaaagtgcttgagttgccgataccctctgaaaaagcccccttgcaggccaatgtctccgtcaccgacaccggcgagcgtctcctcaacttcaaaatggctatgaaatatgggcgggatccctacttagtaagaataaaactggaaagtaaaaagccttttaaaatccaggagatggttgacttcgttcccattgccaagttgcccaaaaagattgctttggaaggtaaggagcgcgatggcagctacgctctgcttctggagcgtacaccgcctcatcaagggacaatacagtggaaaattgctgccgaaggtatcgtgaaatgcagtatagaagtggtgtttgccgatcaaaccccacggtacagcatcaatttgcctcatatctctcctgactataaagaagtctatcaagatgtttttgaattctaa

SEQ ID NO: 79926 - protein, 746 aa, Desulfitobacterium hafniense DCB-2
MAYNSAPASGKVSKDFSADKAYEHILHLSEKIGPRPAGSPNETKAAQYLYYMLEQYGWKVREQPFSKIVGNANPLKPEHKIQVINSQNIIAELPGASPETILLGAHYDSADVSTPGAIDNASGVGVLLEIARILGQEKHQKSYQIVFFGAEENGLVGSQYFTAQSDLSAIQWMLNLDMVGTPLEIDIAGKTSAPPELVDKVVTLARQEQIPFHISRDFAVMTREGSQGGASDFSPFLDQSIPALGLGIAGRAEGYYHRPEDRIERVTLQSLDTVGKFIPKLIESVEVTGSGQKTWDSYYLPFQLGSFVVIIPTLGLRILFILTIFFTVFSVSRSFRDQEPFIQGNLKEYVLIGVGIPGAAFLASFLSGAGEALWQLLKGRVYLWQAYPGVFLTLRVILVLCALLIFLKLLRSLPQPKGGKLYWLIGVLTLTLLTIILGLYRIDLAFPFLFWLLCFNLFLYYPSIILLFIGPYFIYKTHWELLNSQQWPSFYETIHLYPVLFIVLYGLLFIPVLLGALYILEKGKRPWEQMLKRLLIPALLVGVGCVLGTGLIPNYSRANPQPITVQKVWTESERVILRVSSTDTLPKSLLKELDSQETKIGEDKKVLELPIPSEKAPLQANVSVTDTGERLLNFKMAMKYGRDPYLVRIKLESKKPFKIQEMVDFVPIAKLPKKIALEGKERDGSYALLLERTPPHQGTIQWKIAAEGIVKCSIEVVFADQTPRYSINLPHISPDYKEVYQDVFEF

SEQ ID NO: 79927 - DNA, 849 bp, Anabaena variabilis ATCC 29413
  CDS (1)..(849)
ttgaatttaaaagccagattacacaatcatttaatacaggtagcacgagaacgtgatccttatctagcaacggcgggacatttctttgtccaagaatacattcgccaagaatttgcccagtggggaagtgtggaaatccacacctttcaagtaggaaataaatcctttaacaatctcatactcaatttgccgtcccaatctatagggaaaaaacaggagctaccacctattttaattggcgcacactatgatggtgtacctggaacgtcaggggctgatgataatgctacaggtgtagtagttttattagaattggcgagaaagtttgcggctgcaccagctaaatatcctctgcggttggtggcatttgatatggaagaatatggcttgttgggtagtactgattatgcaggcttattacgtcaacaacagcagccgttacgcttgatgatgtctttagaaatgctgggatatcgggactgtacacccggttcgcagagatatcctgcaccattagaaaaattttaccccaatacaggtgattttattgctttaattggtaatttacgcactatccccgacttaatcggcatgagtcgccatatccgcaaagctggtatatccagccagtggctaccagtaccaaatcgaggcttgattgttccccaaaccagattaagcgatcatgcaccattttgggatgcgggttacccagcaattatggtgacagatacagcctttttgcggaatcctcattatcataagcccagtgatgcgatcgccactctcgatttagattttctcacaggcgtgtgcgaaggcttagaaatcagtatccggcggctgtga

SEQ ID NO: 79928 - protein, 282 aa, Anabaena variabilis ATCC 29413
MNLKARLHNHLIQVARERDPYLATAGHFFVQEYIRQEFAQWGSVEIHTFQVGNKSFNNLILNLPSQSIGKKQELPPILIGAHYDGVPGTSGADDNATGVVVLLELARKFAAAPAKYPLRLVAFDMEEYGLLGSTDYAGLLRQQQQPLRLMMSLEMLGYRDCTPGSQRYPAPLEKFYPNTGDFIALIGNLRTIPDLIGMSRHIRKAGISSQWLPVPNRGLIVPQTRLSDHAPFWDAGYPAIMVTDTAFLRNPHYHKPSDAIATLDLDFLTGVCEGLEISIRRL

SEQ ID NO: 79929 - DNA, 1707 bp, Methanosarcina barkeri str. fusaro
  CDS (1)..(1707)
atgattgatattaaaaatattacacattacatattttcacatacatatcttataatttttttaatattattagtaccttcctcaacagctattgcactctctaataacatatcttccgatttcaatattcattataataacacgtcagttacgcttgatgtttcagagacagggcttgaaaactcaacccgaacaatatcttcctttggggaaagaaaaataggaagtcagaacgctgcagaagcctctctatttataaaagaggagatggaaaaggcaggcctgcaggtttctctggacaatttttccgcgcgggtacgtacacgggacttcaattactggaatgtaagcggcacaaacgtagtggggattaaagagggaaacgaccttaaagacgagataattcttgtaaccgctcattatgattcaagaataattgtacgtccagaatcaggtttacgagatatttttgattctgagataagaaagccctatctctggccagtctggtccgatacttacgtttgcgaatcggccaacggaaccggagcggatgacaatgccggaggggtggcttgtatgcttgaacttgcaagggtcttgcagaatgagtcttttgacaggacaatatatttcattgctttttccggagaagaatacaatcttcttggcagccaggcctgggttgaagcccattctgagttggaaaatgatattgttgcagttattaatgtggattctataggaaacgagcctctctacatagaatatcttccccagaatgcctggcttaaatccgttcttgaaaacgagacaagagacctagggatcgaaattcaatgtgaaattccggattattcaagctttattcatcctttaatcggaggagatcatgaaatattctgggaaagtgatatccctgcagttgcaatttgccatcacaacgatagaaacttccacaagttaagtgatacaattgacaatgttgatttttcggttgtcaggaatgcaagtgttctgactgccaaaagtctcatctatctggctagtcctgacgaaaatcagggtccttttgtcaatatttccaattcacacgtttctggagactctcttaaacttatctataaagtatctgacccagaggctactattaatatcttttttgacaatcagaacctgggaaatctccaatcaggcaggaatttttcacttccggaaggagaacatactatcaaagtttttgcaaccgactgttatggaaacagaggctctgatagtataaatattgtaaatgagaaaaaccaaaatagaagttttgagcctccaagtcaggataaaaaatactgcggtaattatataattgggtacccaaaaaattttgtggactcaaatagaactctttatttttatctggataattttgggcctctgtatccagggaatcttttgattcttactccaggaagtcataacctaaaaatatggtcagaaaatgaaaacggaactgtgtttatggagaatgaaatttctgattttagaaaatactctatggaaatgattgagataaataatccgattgctgatcgtaaaaatcctcttcttttcctttcatgtttatttgcaattttggctattgttgcgttttatgggaagcggataaaaagaaaattattgaatctaaaaggttctaaagataaatataaataa

SEQ ID NO: 79930 - protein, 568 aa, Methanosarcina barkeri str. fusaro
MIDIKNITHYIFSHTYLIIFLILLVPSSTAIALSNNISSDFNIHYNNTSVTLDVSETGLENSTRTISSFGERKIGSQNAAEASLFIKEEMEKAGLQVSLDNFSARVRTRDFNYWNVSGTNVVGIKEGNDLKDEIILVTAHYDSRIIVRPESGLRDIFDSEIRKPYLWPVWSDTYVCESANGTGADDNAGGVACMLELARVLQNESFDRTIYFIAFSGEEYNLLGSQAWVEAHSELENDIVAVINVDSIGNEPLYIEYLPQNAWLKSVLENETRDLGIEIQCEIPDYSSFIHPLIGGDHEIFWESDIPAVAICHHNDRNFHKLSDTIDNVDFSVVRNASVLTAKSLIYLASPDENQGPFVNISNSHVSGDSLKLIYKVSDPEATINIFFDNQNLGNLQSGRNFSLPEGEHTIKVFATDCYGNRGSDSINIVNEKNQNRSFEPPSQDKKYCGNYIIGYPKNFVDSNRTLYFYLDNFGPLYPGNLLILTPGSHNLKIWSENENGTVFMENEISDFRKYSMEMIEINNPIADRKNPLLFLSCLFAILAIVAFYGKRIKRKLLNLKGSKDKYK

SEQ ID NO: 79931 - DNA, 1386 bp, Streptomyces fradiae
  CDS (1)..(1386): transl_table=11
atgaagcactccgcgtcccgcatatccgcgtcccgctccccgagacgcaccgcagcagcccccgccgccgcggccgtcctcgccctcgccgggctggtcgccaccgccgctcccgccgcgagcgccgcaccctccgcggcccccgccacccgcaccgcggccaccaccaccgccaacgccgccgcggcaccggacatcccgctggccaacgtcaaggcgcacctcacgcagttccagtcgatcgcctcggccaacggcggcaaccgcgcccacggccgccccggctacaaggcgtccgtcgactacgtgcgggcgaagctggacgccgccgggttcaccacgagcctccagcagttcacgtccaacggcgccaccggctacaacctgatcgccgactggccgggcggcgacccgaaccaggtcgtcatggcgggcgcccacctggactccgtctcctccggcgccggcatcaacgacaacggctccggttccgccgccgtcctggagaccgcgctggccgtgtcccgcgccggctaccagccggccaagcacctgcggttcgcctggtggggcgccgaggagctgggcctggtcggctcgaagcactacgtggcgaacctgccgagcaccaaacgctccaagatcagcggctatctgaacttcgacatgatcggctcgcccaacgcgggctacttcgtctacgacgacgacccggtcatcgagaagaccttcaaggactacttcgccggcctcggcgtccccaccgagatcgagaccgagggcgacggccgctccgaccacgcgcccttcaagaacgccggcgtccccgtcggcggcctcttcaccggcgcgagccgcaccaagaccagcgcccaggcgcagaagtggggcggaacggccgggcagtccttcgaccgctgctaccactcgtcgtgcgacaacacgtcgaacatcaacgacacggcgctggaccgcaacagcgacgccgccgcgcacgccgtgtggacgctgtcggccggcacgtccgagccgccggccggggacacctaccagaacacgaccgacgtgccgatcccggacggcggcgccgccgtcacctcgtccgtcaccgtcacgggccgcaccggcaacgcgccctccgccctgaaggtcggcgtggacatcgtccacacctggcgcggcgacctggtcgtcgacctcgtggccccggacggcaccgcgtaccgcctgaagaacgccagcggcggcgactccgccgacaacgtccgggagacgtacaccgtcgacgcgtcgtccgagaccgccaacggcacctggtcgctgcgggtccaggacacggcccgctacgacaccggctacatcaacggcttctcgctgaccttctga

SEQ ID NO: 79932 - protein, 461 aa, Streptomyces fradiae
MKHSASRISASRSPRRTAAAPAAAAVLALAGLVATAAPAASAAPSAAPATRTAATTTANAAAAPDIPLANVKAHLTQFQSIASANGGNRAHGRPGYKASVDYVRAKLDAAGFTTSLQQFTSNGATGYNLIADWPGGDPNQVVMAGAHLDSVSSGAGINDNGSGSAAVLETALAVSRAGYQPAKHLRFAWWGAEELGLVGSKHYVANLPSTKRSKISGYLNFDMIGSPNAGYFVYDDDPVIEKTFKDYFAGLGVPTEIETEGDGRSDHAPFKNAGVPVGGLFTGASRTKTSAQAQKWGGTAGQSFDRCYHSSCDNTSNINDTALDRNSDAAAHAVWTLSAGTSEPPAGDTYQNTTDVPIPDGGAAVTSSVTVTGRTGNAPSALKVGVDIVHTWRGDLVVDLVAPDGTAYRLKNASGGDSADNVRETYTVDASSETANGTWSLRVQDTARYDTGYINGFSLTF

SEQ ID NO: 79933 - DNA, 22 bp, Primer
atgttttccgcattgcgccacc

SEQ ID NO: 79934 - DNA, 24 bp, Primer
ttaagacgccttcgccaactcctt

SEQ ID NO: 79935 - protein, 126 aa, consensus
  MISC_FEATURE (1)..(126): consensus for the disclosure of xaa see table XV
AXXDXXXXXXXXXXXXXXXXXXXXXXXXXXXXXXXXXXXXXXXXXXXXXXXXXXXXXXXXXXXXXXXXXXXXXXXXXXXXXXGXXDNAXGXXXXLEXAXXXXXXXXXXXXXXXXXXXXXEEXGXXG

SEQ ID NO: 79936 - protein, 45 aa, consensus
  MISC_FEATURE (1)..(45): consensus for the disclosure of xaa see table XV
GXXDXXXGXXXXXEXAXXXXXXXXXXXXXXXXXXXXXEEXXXXGX

SEQ ID NO: 79937 - DNA, 1290 bp, Escherichia coli
  CDS (1)..(1290)
atggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgccggtgttggcggtatgatcccgctgatcatcatggctatccttgcgttcccgatgacgttttttgctcaccgcggcctgactcgcttcgtactgtctggtaaaaacccgggcgaagacattaccgaggttgtagaagaacactttggtattggcgcaggtaaactgattaccctgctctacttcttcgctatctacccgatcctgctggtttatagcgtggcaatcaccaatacagttgaaagcttcatgtctcaccagctgggtatgacaccaccgccgcgtgcgattctgtcgctgatcctgatcgtgggtatgatgaccatcgttcgctttggtgaacagatgatcgttaaagcgatgagtattctggtattcccgtttgttggcgtactgatgctgctggctctgtacctgatcccgcagtggaacggcgcagcactggaaacgctgtctctggacactgcatctgcaaccggaaacggtctgtggatgaccctgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgcgtactgagcctgactccggcagacctggctgcggctaaagagcagaacatctcgattctgtcttacctggctaaccactttaacgcaccggttatcgcgtggatggctccgattatcgcgattatcgctatcaccaaatccttcctcggccactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggcccaatcatcgcgatgatcctgttcctgatgccgatgtacgcaattcagaaagtaccggcaatgcgtaagtacagcggtcacatcagcaacgtattcgttgtcgtgatgggtctgattgcaatctccgcaatcttctactctctgttcagctaa

SEQ ID NO: 79938 - protein, 429 aa, Escherichia coli; identical to SEQ ID NO: 63800

SEQ ID NO: 79939 - DNA, 1242 bp, Helicobacter pylori 26695; identical to SEQ ID NO: 63715
  CDS (1)..(1242): transl_table=11

SEQ ID NO: 79940 - protein, 413 aa, Helicobacter pylori 26695; identical to SEQ ID NO: 63716

SEQ ID NO: 79941 - DNA, 1194 bp, Chlamydia trachomatis D/UW-3/CX
  CDS (1)..(1194): transl_table=11
atgtgtatgcggaataagtgtgtaggaggaattttaattgttgcggggactgtaataggtgctggtgtgttagccgttcctattttgacagctgtagaagggtttttccctgccgtggtgctatatgtgctcgcttggttggtttcgttagcctcaggttatggctatctggaggtattaacctggtgtaagggaaatagacaggctaacttatgctctatggctgaagaaactctagggagagtaggacgtatagtgttatgtttagtctacctgtttctattttactctttacttgtagcttatttttgtgatggaggaaatattctttctcgagtgatcggagagagctttttctcctatccttggatgcgacatgtcatgccccttttatttttctccctttttgcacctttgctgatggcaaacacttctgttattgattattgcaatcgggggtttgtttttggccttatctttgtttttgggcttctctgcgtattgggtgtgccgcgtatacagggagaactgctattgcgagcttcctggttttcctctcttaatagcttgcctattttcttcttagcatttggatttcagaatgtggtgccctctttgtatcactacttggatgggaatattcgtgaggttaaacgtgctattctaatagggagtttgattcctttaattctctatattgcttgggaagctttggttttagggacggttcccttagtcgacttgctaaaagctaaggatttagggtggactgctgcaggagctcttcaaggatctttaaagaattctgctttttatattgccggggaattatttggattttttgctttggttacttcttttatagggactgcgttagcattaaaggacttttatatagatatttttaaatgggatgctcgtaagaaacgggtatctttgttctttttagttcaggtatttcctttagtgtgggctattttttatcccgagattgttttgtcttgtttacgctatgctggggggatagggggagcttgcattatcgtgttattcccagtagccatgttatggaatggacgctatgggaaacggcgttgctttggtaaaaggatattgccaggaggaaagaccgttctattaattctaacaggatatactgtgttaaatcttgcaaccctgtattatacgttttag

SEQ ID NO: 79942 - protein, 397 aa, Chlamydia trachomatis D/UW-3/CX
MCMRNKCVGGILIVAGTVIGAGVLAVPILTAVEGFFPAVVLYVLAWLVSLASGYGYLEVLTWCKGNRQANLCSMAEETLGRVGRIVLCLVYLFLFYSLLVAYFCDGGNILSRVIGESFFSYPWMRHVMPLLFFSLFAPLLMANTSVIDYCNRGFVFGLIFVFGLLCVLGVPRIQGELLLRASWFSSLNSLPIFFLAFGFQNVVPSLYHYLDGNIREVKRAILIGSLIPLILYIAWEALVLGTVPLVDLLKAKDLGWTAAGALQGSLKNSAFYIAGELFGFFALVTSFIGTALALKDFYIDIFKWDARKKRVSLFFLVQVFPLVWAIFYPEIVLSCLRYAGGIGGACIIVLFPVAMLWNGRYGKRRCFGKRILPGGKTVLLILTGYTVLNLATLYYTF

SEQ ID NO: 79943 - DNA, 1254 bp, Vibrio cholerae O1 biovar eltor str. N16961
  CDS (1)..(1254): transl_table=11
atgaatactacaacagcggctacttctacagcacgttctgctagcaagtggacctacaaagatttcacctgggctctgtcccttttcggtacagcggttggtgcaggtgtcctgttcctacctattaaagcgggtgcgggtggcttctggccattagttcttctcgcactgattgccgccccaatgacttggtttgcacacaagtctctcgctcgtttcgtattatctgcaaaaaatcctgatgcagacatcactgacacggttgaagaacattttggtaaagctggcgctaacctcattacttttgcttactttttcgccatctatcctatcgttctgatctacggtgtgggcatcactaacacggtggattctttcctcgttaaccaaatcggcatggaatcgattcctcgctggttactatctggtgcactgatcacggcgatgactgctggtgtggtatttggtaaggagctgatgctgaaagccacttctgccatggtttacccactggtattcattctgctggctctctctttctatctgatccctgattggaacacttccatgatggaagtcgcacctgactggtcagcaatgcctgctatcgtatggcttgcgatcccaatcatcgtgttctctttcaaccacagcccaatcatttctcagttctctaaagagcaacgccaacagtttggtgataaagccgtacaaaaaacggacatgattactggcggtgcagcgatgatgctgatgggcttcgtgatgttcttcgtattctcggtagttctatcactgtctcctgcagagctggcgatggcaaaagagcaaaacatctctgttctgtcttacctagctaatgaacacgcttcaccgatcatctcttacttaggtccaatcgtggcatttgcagcgatcacctcaagctacttcggtcacttcttaggtgctcatgaaggtctagtcggtctggtgaaatcacgcagcaacatgcaagtcagcaagattgagaaaatctctctgggcttcatcgtcatcaccacttggattgtagcaattgtgaacccaagcatcctaggtatgattgaaaccatgggcgcaccaatgattgctgctatcttgttcctgctgcctgtatttgcaatgcacaaagtgcctgcaatggctaagttcaagacttcagcacctgtacagatttttacagttatttgtggcttggctgcgattagttctgtaatctacggcgctctttaa

SEQ ID NO: 79944 - protein, 417 aa, Vibrio cholerae O1 biovar eltor str. N16961
MNTTTAATSTARSASKWTYKDFTWALSLFGTAVGAGVLFLPIKAGAGGFWPLVLLALIAAPMTWFAHKSLARFVLSAKNPDADITDTVEEHFGKAGANLITFAYFFAIYPIVLIYGVGITNTVDSFLVNQIGMESIPRWLLSGALITAMTAGVVFGKELMLKATSAMVYPLVFILLALSFYLIPDWNTSMMEVAPDWSAMPAIVWLAIPIIVFSFNHSPIISQFSKEQRQQFGDKAVQKTDMITGGAAMMLMGFVMFFVFSVVLSLSPAELAMAKEQNISVLSYLANEHASPIISYLGPIVAFAAITSSYFGHFLGAHEGLVGLVKSRSNMQVSKIEKISLGFIVITTWIVAIVNPSILGMIETMGAPMIAAILFLLPVFAMHKVPAMAKFKTSAPVQIFTVICGLAAISSVIYGAL

SEQ ID NO: 79945 - DNA, 1254 bp, Vibrio cholerae O1 biovar eltor str. N16961; identical to SEQ ID NO: 63717
  CDS (1)..(1254): transl_table=11

SEQ ID NO: 79946 - protein, 417 aa, Vibrio cholerae O1 biovar eltor str. N16961; identical to SEQ ID NO: 63718

SEQ ID NO: 79947 - DNA, 1242 bp, Pasteurella multocida subsp. multocida str. Pm70; identical to SEQ ID NO: 63719
  CDS (1)..(1242): transl_table=11

SEQ ID NO: 79948 - protein, 413 aa, Pasteurella multocida subsp. multocida str. Pm70; identical to SEQ ID NO: 63720

SEQ ID NO: 79949 - DNA, 1188 bp, Chlamydia muridarum Nigg
  CDS (1)..(1188): transl_table=11
atgcggaataaatgtataggaggggttttaattgttgctggaaccgtgatcggagccggagtattagctgtgcctgttttaacagctttggatgggtttttgcctgctgccttactgtatatgcttgcttggttagtgtcattggcctctggttatggttatttggaggttttgacctggtgcaaagggaataagcaagcgaatttgtgctccatggcagaagaaactttggggaaagtaggacgcatagttttgtgtttagtctacttgtttttattttattccttacttgttgcctacttttgcgatggggggaatattctttctcgtatgcttggagatggggttcttgaaaatccatgggctcggcatgttatgcctatcttatttttctgcatttttgctcctttacttatggcaaaaacctcgatcatcgattactgcaaccgagtatttgttttcggtcttatcctggttttcggtcttttctgtatcttgggagctccgcgtgtgcaaggggatcttttattaagagcatcatggttttcttccctaaatagtttgcctatttttttcttggcttttggttttcaaaatgtcgtgccttcattgtaccattacttagatggggatgttcgagaagttaaacgggcaatttttataggaagcctgattcctttagttttgtatgtaatttgggaagcattggttcttggtacagttccattagtttatttgctgaaagctaaggaactaggatggactgctgcaggtgctcttcaaggagctttaaaaaattctgcttttcatatcgctggagaattattcggattctttgcgctagtcacctcttttatagggactgcattggccttgaaagatttttatatagatatttttaaatgggatgctcgtaagcagcgattgaatttatttttattagttttggtgttcccattggtatgggcggtttcttatcccgagattgttttgtcttgtttgcgttatgctgggggaatagggggagcttgtattatcgtattgttcccggtagcgatgctatggaatggccggtatggaaaacggcattgttctggcaaacaaatattgccaggaggaaagaccgtcctattgattttattaggatatactgtgctaaatctcgcacccctgtattatacgttttag

SEQ ID NO: 79950 - protein, 395 aa, Chlamydia muridarum Nigg
MRNKCIGGVLIVAGTVIGAGVLAVPVLTALDGFLPAALLYMLAWLVSLASGYGYLEVLTWCKGNKQANLCSMAEETLGKVGRIVLCLVYLFLFYSLLVAYFCDGGNILSRMLGDGVLENPWARHVMPILFFCIFAPLLMAKTSIIDYCNRVFVFGLILVFGLFCILGAPRVQGDLLLRASWFSSLNSLPIFFLAFGFQNVVPSLYHYLDGDVREVKRAIFIGSLIPLVLYVIWEALVLGTVPLVYLLKAKELGWTAAGALQGALKNSAFHIAGELFGFFALVTSFIGTALALKDFYIDIFKWDARKQRLNLFLLVLVFPLVWAVSYPEIVLSCLRYAGGIGGACIIVLFPVAMLWNGRYGKRHCSGKQILPGGKTVLLILLGYTVLNLAPLYYTF

SEQ ID NO: 79951 - DNA, 1671 bp, Mycobacterium tuberculosis CDC1551; identical to SEQ ID NO: 9201
  CDS (1)..(1671): transl_table=11

SEQ ID NO: 79952 - protein, 556 aa, Mycobacterium tuberculosis CDC1551; identical to SEQ ID NO: 9202

SEQ ID NO: 79953 - DNA, 1191 bp, Chlamydophila pneumoniae AR39
  CDS (1)..(1191): transl_table=11
atgtcaaataaagttctaggtgggtccttgcttattgcaggttctgccatcggtgctggtgttttagcagttcctgtattgaccgcaaaaggcggttttttccctgcaacttttctctatattgtctcctggcttttttctatggcctcaggcctttgccttcttgaagtcatgacttggatgaaagaatcaaagaacccagtgaacatgctttctatggcggaatctattttaggtcatgtaggcaagatttctatatgccttgtctacttgtttctcttttactccctactgattgcctatttctgcgaagggggaaacatcttatgccgcgtgtttaattgtcaaaatttaggaatctcgtggattcgtcaccttggccctctaggttttgctatattgatggggcctatcattatggcgggaacaaaagtgattgattactgtaatcgtttctttatgttcggcttaactgtagcttttggaattttctgtgcccttggatttttaaaaatccaacctagctttctggtgcgttcctcatggttaactacaataaacgcatttcctgtgtttttccttgcttttggattccaaagtatcattcctacgttgtactactacatggacaaaaaagttggagatgttaaaaaggcaattctcataggaacgttgattcctcttgttctctatgtcttatgggaagttgtggttttaggtgctgtctctcttccgattctttcccaggctaagataggtggatatactgctgtagaagctctcaagcaggcccatcgttcttgggcattttatattgctggagaactttttggcttctttgctttggtctcctcttttgtaggagttgctctcggtgttatggacttcctggcagacggtttaaaatggaataaaaaatcacatccattttcaattttctttttaacatttattattccccttgcttgggctgtttgttatcctgaaattgttttgacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaa

SEQ ID NO: 79954 - protein, 396 aa, Chlamydophila pneumoniae AR39
MSNKVLGGSLLIAGSAIGAGVLAVPVLTAKGGFFPATFLYIVSWLFSMASGLCLLEVMTWMKESKNPVNMLSMAESILGHVGKISICLVYLFLFYSLLIAYFCEGGNILCRVFNCQNLGISWIRHLGPLGFAILMGPIIMAGTKVIDYCNRFFMFGLTVAFGIFCALGFLKIQPSFLVRSSWLTTINAFPVFFLAFGFQSIIPTLYYYMDKKVGDVKKAILIGTLIPLVLYVLWEVVVLGAVSLPILSQAKIGGYTAVEALKQAHRSWAFYIAGELFGFFALVSSFVGVALGVMDFLADGLKWNKKSHPFSIFFLTFIIPLAWAVCYPEIVLTCLKYAGGFGAAVIIGVFPTLIVWKGRYGKQHHREKQLVPGGKFALFLMFLLIVINVVSIYHEL

SEQ ID NO: 79955 - DNA, 1290 bp, Salmonella typhimurium LT2
  CDS (1)..(1290): transl_table=11
atggaaaccactcagaccagcactattgcttcgattgactctcgaagcgcatggcgcaaaacggataccatgtggatgctgggcctttacggcacggctatcggcgcgggcgttctgttcctgccgatcaacgcaggcgtcggcggcatgattccgctcatcatcatggcgattctcgctttcccgatgacctttttcgcacaccgtggtttaacccgcttcgtgctgtccggtaaaaatccgggtgaagacatcactgaagtcgttgaggaacacttcggtatcggcgcaggtaaactgattaccctgctttacttcttcgcgatttaccccatcctgctggtttacagcgtggcgattactaataccgtggaaagcttcctgacccaccagttagcgattaatccgccgccgcgggcgattctttccctgatcctgattgttggcatgatgaccatcgtgcgcttcggcgagcaaatgatcgttaaggcgatgagtatcctggtattcccgttcgtcgctgcgctgatgctgctggccttgtacctgatcccgcagtggaacggcgcggcgctggaaactctgtcctttgattccgccgcgtctaccggtaacggtctgtggatgacgctgtggctggcgattccggtgatggttttctctttcaaccactccccgatcatctcctccttcgcggttgcgaagcgtgaagagtacggtgaaggcgctgagaagaaatgttctaaaattctggccttcgcccacatcatgatggtgctgaccgtgatgttcttcgtcttcagctgcgtgctgagcctgacgccggcagatctggcagcggcaaaagagcagaacatctctattctgtcttacctggcgaaccattttaacgcgccgatcatcgcctggatggcgccgatcattgcgatgattgctatcaccaaatccttcctcggccactaccttggcgcgcgtgaaggctttaacgggatggtgattaaatcgctgcgtggtaaaggtaaatccatcgaaatcaacaaactgaataaaattaccgcgctgttcatgctggtcaccacctggattgtggcgacgctgaaccccagcatcctgggcatgattgaaaccctgggcggcccgatcatcgcgatgattctgttcctgatgccgatgtatgccatccagaaagtaccggcaatgcgtaagtacagcggtcatatcagcaacgtattcgttgtgattatgggcctgattgccatctccgctattttctactcactgttcagctaa

SEQ ID NO: 79956 - protein, 429 aa, Salmonella typhimurium LT2
METTQTSTIASIDSRSAWRKTDTMWMLGLYGTAIGAGVLFLPINAGVGGMIPLIIMAILAFPMTFFAHRGLTRFVLSGKNPGEDITEVVEEHFGIGAGKLITLLYFFAIYPILLVYSVAITNTVESFLTHQLAINPPPRAILSLILIVGMMTIVRFGEQMIVKAMSILVFPFVAALMLLALYLIPQWNGAALETLSFDSAASTGNGLWMTLWLAIPVMVFSFNHSPIISSFAVAKREEYGEGAEKKCSKILAFAHIMMVLTVMFFVFSCVLSLTPADLAAAKEQNISILSYLANHFNAPIIAWMAPIIAMIAITKSFLGHYLGAREGFNGMVIKSLRGKGKSIEINKLNKITALFMLVTTWIVATLNPSILGMIETLGGPIIAMILFLMPMYAIQKVPAMRKYSGHISNVFVVIMGLIAISAIFYSLFS

SEQ ID NO: 79957 - DNA, 1332 bp, Salmonella typhimurium LT2; identical to SEQ ID NO: 63725
  CDS (1)..(1332): transl_table=11

SEQ ID NO: 79958 - protein, 443 aa, Salmonella typhimurium LT2; identical to SEQ ID NO: 63726

SEQ ID NO: 79959 - DNA, 1299 bp, Salmonella typhimurium LT2
  CDS (1)..(1299): transl_table=11
atgcaggacgacacattaccattaaataacagtaacgctacgaccacaccgctttcaacgagattaccgtttacaaaatatgattttggctgggtgctcttgtgtatcggaatggcgatcggcgccggtaccgtcttaatgccagtgcaaatcggtctcaaggggatctgggtatttattaccgcttttatcatcgcctatcccgctacctatattgtgcaggatatttatctaaaaacgttatctgaaagcgaaacctgtgacgattatacggatattatcagtcactatcttggcaaaaactggggcatttttctcggtgtaatctattttcttatgattatccacggggtgtttatttattccctgtcggtggtgtttgatagcgcctcctatatcaaaaccttcggccttactgaggccgatctttcgcagtctattatctataaagtcgcgattttcgccgtgctggtggcgattgcctccggcggggaaaagttattatttaaaatttccggcccgatggtggtggtaaaagtcgggatcattctgatattcggtttcgcgatgatcccacactggaatcttgataatatttccgcctttcccgccgcatcggttttctttcgcgacgtactgctcactatcccattttgcttcttttctgcggtcttcattcaggtgctaaacccaatgaacatcgcctatcgtaagcgcgaacctgaccgtgtgctggccacccggatggcgattcgcacgcatcgcattagctatattacgctgattgccattattctctttttctcgttctcgtttaccttttcgattagtcatgaagaggcggtatcagcattcgagcagaatatttccgcccttgcgctggcagctcaggtaatccctggccatatcatccacattacctctaccatcctcaatatttttgccgtacttaccgcgttctttggtatttatttaggttttcacgaagcgcttaaaggtattgtactgaatgtattgagtcgtattatggatgtcaaaaacgtcaacccactgttactgacatctggaatctgtgtctttatcgtggttactctggttatttgggtttcgtttcgcgtctcagtattggtctttttccagttaggcagtccgctttatggcattgtcgcgtgtattattccctttttcctgatttataaagtagcgcaactggaaaaattacgcggcctgaaaacctggcttattctgttatatggaatattgttgtgcctgtcgccgttattaaaattgattgaataa

SEQ ID NO: 79960 - protein, 432 aa, Salmonella typhimurium LT2
MQDDTLPLNNSNATTTPLSTRLPFTKYDFGWVLLCIGMAIGAGTVLMPVQIGLKGIWVFITAFIIAYPATYIVQDIYLKTLSESETCDDYTDIISHYLGKNWGIFLGVIYFLMIIHGVFIYSLSVVFDSASYIKTFGLTEADLSQSIIYKVAIFAVLVAIASGGEKLLFKISGPMVVVKVGIILIFGFAMIPHWNLDNISAFPAASVFFRDVLLTIPFCFFSAVFIQVLNPMNIAYRKREPDRVLATRMAIRTHRISYITLIAIILFFSFSFTFSISHEEAVSAFEQNISALALAAQVIPGHIIHITSTILNIFAVLTAFFGIYLGFHEALKGIVLNVLSRIMDVKNVNPLLLTSGICVFIVVTLVIWVSFRVSVLVFFQLGSPLYGIVACIIPFFLIYKVAQLEKLRGLKTWLILLYGILLCLSPLLKLIE

SEQ ID NO: 79961 - DNA, 1287 bp, Yersinia pestis KIM; identical to SEQ ID NO: 63727
  CDS (1)..(1287): transl_table=11

SEQ ID NO: 79962 - protein, 428 aa, Yersinia pestis KIM; identical to SEQ ID NO: 63728

SEQ ID NO: 79963 - DNA, 1119 bp, Shigella flexneri 2a str. 301; identical to SEQ ID NO: 63729
  CDS (1)..(1119): transl_table=11

SEQ ID NO: 79964 - protein, 372 aa, Shigella flexneri 2a str. 301; identical to SEQ ID NO: 63730

SEQ ID NO: 79965 - DNA, 1332 bp, Shigella flexneri 2a str. 301; identical to SEQ ID NO: 63733
  CDS (1)..(1332): transl_table=11

SEQ ID NO: 79966 - protein, 443 aa, Shigella flexneri 2a str. 301; identical to SEQ ID NO: 63734

SEQ ID NO: 79967 - DNA, 1248 bp, Shigella flexneri 2a str. 301
  CDS (1)..(1248): transl_table=11
atgactgatcaagctgaaaaaaagaactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcctgtcggctccagttttaacaccatcaccaaagatttaataggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcacagccattttcgttgccagcgtattgtggataagttcgttagccgccagtcgcattacctcattgttcctcgggctgaagattatctcctttgtgatcgtgtttggttctttcttcttccaggtcgattactccatcctgcgcgatgccaccagcaccactgcgggaacgtcttacttcccgtatatctttatggctttgccggtgtgtctggcgtcatttggtttccacggcaatattcccagcctgattatttgctatggcaaacgcaaagataagttaatcaaaagcgtggtatttggttcgctgctggcgctggtgatttatctcttctggctctattgcacgatggggaatattccgcgcgaaagctttaaggcgataatctcctcaggcggcaacattgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaa

SEQ ID NO: 79968 - protein, 415 aa, Shigella flexneri 2a str. 301
MTDQAEKKNSAFWGVMVIAGTVIGGGMFALPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWISSLAASRITSLFLGLKIISFVIVFGSFFFQVDYSILRDATSTTAGTSYFPYIFMALPVCLASFGFHGNIPSLIICYGKRKDKLIKSVVFGSLLALVIYLFWLYCTMGNIPRESFKAIISSGGNIDSLVKSFLGTKQHGIIEFCLLVFSNLAVASSFFGVTLGLFDYLADLFKIDNSHGGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 79969 - DNA, 1320 bp, Shewanella oneidensis MR-1
  CDS (1)..(1320): transl_table=11
atgagtaaatcagaaaataaaattggcgttgtccaattaacgattatcaccatagtgaatatgatgggctctgggattatcatgctgcccacccaattagcacaagtcggtactatctctgtgctttcttggcttgttaccgctgcaggctcaaccgcgctggcctttgcatttgcaaaatgcggtatgttcagcaaaaaatccggtgggatgggcggttatgccgaatatgcctttggccgcagcggtaactttatggcgaactacacctatgcggtttcgctacttatcgccaacgtcgccatcgccatctccgctgtaggttacgcagccgtattactcgaagttaacttaagccctatggccatctgtcttgccactattggcgtcctttggttagccacagtcgcaaactttggcggtgctcgcattactggccgcgtgagtagcgtgaccgtgtgggggattattctgccagtgattggcgtgtcattgatcggttggttctggtttgatattgacctctataaaggtgcttggaacccacatgatatgcctttcttcaaagccttaggtggttcaatcgcgatgaccttatgggcatttcttggcttagaatctgcctgcgccaactcagaggctgttgataatccagagaaaaatgttcctatcgccgtaatgggcggaaccttaggtgcagcacttatctatattgtttccactaacgtgattgccggtattgtacccaacgctgaacttgccagctcaaatgctccttttggtttagctttcgcgcaaatgtttaacccagttgtgggtaaaatcgtgatggcctgcgccattatctcctgtactggttcgctgctcggttggcagtttactattgcgcaagtgtttaaagcctctgccgatgaaggtttcttccctaaagtgttcgctaaagtcagcaaagccgatgcaccaatttgggggatgaccattattgtttcgattcaaaccctgctgtctttgatgactatcagcccatcactgagcaaacagtttgaagcgctcgttaaccttgcggtggtaactaacattgtgccttatatcctgtcgatggcagccctaggcgtaatgcaaaaacaactgaaagtgcccgcaaacaaagcccgtgtcgccaacgtgattgcggttatcggtgccctttatagcttctacgccctctatagttctggtgaaacagctgtgatgttaggcgctatcgcgaccttcttcggctggactatctacggggtgatctcaaataaaaccccaagcgtcgagattaaagcggcgtga

SEQ ID NO: 79970 - protein, 439 aa, Shewanella oneidensis MR-1
MSKSENKIGVVQLTIITIVNMMGSGIIMLPTQLAQVGTISVLSWLVTAAGSTALAFAFAKCGMFSKKSGGMGGYAEYAFGRSGNFMANYTYAVSLLIANVAIAISAVGYAAVLLEVNLSPMAICLATIGVLWLATVANFGGARITGRVSSVTVWGIILPVIGVSLIGWFWFDIDLYKGAWNPHDMPFFKALGGSIAMTLWAFLGLESACANSEAVDNPEKNVPIAVMGGTLGAALIYIVSTNVIAGIVPNAELASSNAPFGLAFAQMFNPVVGKIVMACAIISCTGSLLGWQFTIAQVFKASADEGFFPKVFAKVSKADAPIWGMTIIVSIQTLLSLMTISPSLSKQFEALVNLAVVTNIVPYILSMAALGVMQKQLKVPANKARVANVIAVIGALYSFYALYSSGETAVMLGAIATFFGWTIYGVISNKTPSVEIKAA

SEQ ID NO: 79971 - DNA, 1293 bp, Shewanella oneidensis MR-1; identical to SEQ ID NO: 63737
  CDS (1)..(1293): transl_table=11

SEQ ID NO: 79972 - protein, 430 aa, Shewanella oneidensis MR-1; identical to SEQ ID NO: 63738

SEQ ID NO: 79973 - DNA, 1188 bp, Shewanella oneidensis MR-1
  CDS (1)..(1188): transl_table=11
gtgaattcaaaaatgttaggctcgatagccattgttgcaggcaccgctattggcgcgggaatgttagctttaccgctcgctacagcggccttaggtatggtacctgctattttgttgatggtagtgatttgggggctatcagcttatacctcattgttaatgcttgagattaaccttcgctctggcgtgggtgataatgtccatgcgattacaggcaaattactcggcaagaaaggccagatagtgcagggggcatcatttttgagtctgctggttgctttaacggctgcttatctaacggggggctcgtccctgttggtgcttaaagcccaaaatatgtttgacatagtgttagataaccaactggcggtggtgttatttaccattgtgctcggcggttttgcagcgttaggggtggcttgggttgataaagtctcacgctttttattttcgttgatgattttattgctaattgtcgtggtgctgtttctattacctgaagtcagtatttccaccatagcaactagtgcagtggcgcaatccttgaccagcagttggatggcggctatccccgtggtatttacttcctttggttttcacgtctgtatcgcgaccttagtacgttatttagatggcgataccgtgtctctgcgcaaggtgctattgattggttcaaccattccgctagcctgttatatcttctggttattggtgaccttaggtacggtaggcggcaacgaaattaatggctttaatggttctttacctgcgcttatcagtgcgttacaagagattgcccacacgcctttgatcagcaaatgtatttctctgtttgctgatttagccttaatcacttccttccttggcgttaccttaagcctatacgattttgtggctgagttaacccgtgccaagaagaccttcgtcgggcgggcgcaaacctggttattaacctttgtgccaccgctgttatgcgcactttatgtgccagaaggcttcgttgccgtattaggttttgccgctgtgccgttggtggtgatgattatcttcttgccaattgcgatggccctgcgtcagcgtcaaatacagcctcaaggatatcaggttgtaggcggcacatttgcgctcggtcttgccgggatcttgggggccattattattggtgctcagttatttgtcgcactctaa

SEQ ID NO: 79974 - protein, 395 aa, Shewanella oneidensis MR-1
MNSKMLGSIAIVAGTAIGAGMLALPLATAALGMVPAILLMVVIWGLSAYTSLLMLEINLRSGVGDNVHAITGKLLGKKGQIVQGASFLSLLVALTAAYLTGGSSLLVLKAQNMFDIVLDNQLAVVLFTIVLGGFAALGVAWVDKVSRFLFSLMILLLIVVVLFLLPEVSISTIATSAVAQSLTSSWMAAIPVVFTSFGFHVCIATLVRYLDGDTVSLRKVLLIGSTIPLACYIFWLLVTLGTVGGNEINGFNGSLPALISALQEIAHTPLISKCISLFADLALITSFLGVTLSLYDFVAELTRAKKTFVGRAQTWLLTFVPPLLCALYVPEGFVAVLGFAAVPLVVMIIFLPIAMALRQRQIQPQGYQVVGGTFALGLAGILGAIIIGAQLFVAL

SEQ ID NO: 79975 - DNA, 1188 bp, Shewanella oneidensis MR-1
  CDS (1)..(1188): transl_table=11
atgacacaaaataaatttttcggcagtttactgctgattgcaggcaccaccattggcgcgggcatgctcgcactccccatcgcatcggccggccttggctttggcatgtcgagcatgattatgctgatcttctgggcattaatggcctacactgccctactcatggtcgaaatccaccaatttgccccgagtgatgccagcctcaaccaattagcccgtcatctattgggcacaaaaggccaagtggttgcctgtatcgcgttaatgtttttactctatgccctgtgcgccgcctacatcgctggcggtggtgagcaagtgcatcaaaaactcacctcttggttagggctagcactgccgccacaggcgggcgccatcttatttaccctcttgattggtacgattgtgggtttaggtacgcactgtgtcgatttgattaatcgcgtactctttagtttaaaaatcattgcgttaatcctaatgctggccttattactgccacaggtggaaggcacgcatttactcgaactgccgctagagcaagggcttattgtgtcggccatcccagtgatttttacctcgtttggttttcatggttcgattccgtccgtggtgcgctacttaggcatcgaagtgaaagcgctgcgcaaaattatgctgctcggctcagcgttacccctgctgatttacctgctgtggcaactgggtagccaaggcgtactaagccaaagccaattgatgaccaatcaaagtctttctggctttattagtcaattagcgagtgtacttcacagccaatacttaagctcagcgattagtgtgtttgccgatctcgcccttgcgacctcctttttaggcgtgagcctaggtctatttgactttatagccgccaacttaaggcaagaggataatgcgacgggtcgcagtgtcaccgcggcgatcacttttgtgccgccattaggctttgcccttttctacccacagggatttattaccgctctaggctacgcggcaatcgctttagtgatcctcgcgatttttttaccggtttctatggtatgggtacaaagaaaacaacgggataaagccaagcttccccaaggctaccgcgtcgcagggggaacattaggcttagtgctcgcactactatgtggccttgcggtgattagtgcgcagcttttaggctag

SEQ ID NO: 79976 - protein, 395 aa, Shewanella oneidensis MR-1
MTQNKFFGSLLLIAGTTIGAGMLALPIASAGLGFGMSSMIMLIFWALMAYTALLMVEIHQFAPSDASLNQLARHLLGTKGQVVACIALMFLLYALCAAYIAGGGEQVHQKLTSWLGLALPPQAGAILFTLLIGTIVGLGTHCVDLINRVLFSLKIIALILMLALLLPQVEGTHLLELPLEQGLIVSAIPVIFTSFGFHGSIPSVVRYLGIEVKALRKIMLLGSALPLLIYLLWQLGSQGVLSQSQLMTNQSLSGFISQLASVLHSQYLSSAISVFADLALATSFLGVSLGLFDFIAANLRQEDNATGRSVTAAITFVPPLGFALFYPQGFITALGYAAIALVILAIFLPVSMVWVQRKQRDKAKLPQGYRVAGGTLGLVLALLCGLAVISAQLLG

SEQ ID NO: 79977 - DNA, 1281 bp, Pseudomonas putida KT2440
  CDS (1)..(1281): transl_table=11
atgaatgagcaggccccaagcgttgaacaacgctttgcagaatcgacccccgccgccctcggcacctgggcgcgtcacgacaccacctggatgctgggcctgttcggcacagccatcggcgccgggacactgttcctgccgatcaacgccggccttggcggcttctggccgctgctgatcctggccgtgctggcctttccgatgacctatttcgcccatcgcgggctgacccgtttcgtcctttccgggcgcgatggcagcgacatcaccgaagtggtcaaggagcatttcggcatcaccgccggtgcctcgatcaccgtgctgtacttcttcgccatcttcccgatcctgcttatctacagcgtggcgctgaccaacaccgtgtccagcttcatggagcaccagctgcacatgcagccgccgccacgggcaatcctgtcattcgtgctgatcctcggtctgctggccatcgtgcgctgcggggagcaggccacggtcaaggtcatgagcctgctggtctacccgttcatcgtcgctctggcgttgctgggcctgtacctggtgccgcactggaccggtggcattctcgacagcgccacagaggtgccgccggcctcggccttcctgcacaccctgtggctggccattccggtgatggtgttctcgttcaaccattcgccgatcatctcggcctttgccgtcgaccagaagcgccgttacggcgcgcacgccgacgagcgcagcggccagatcctgcgtcgtgcccacctgttgatggtggtgatggtgctgttcttcgtgttcagctgcgtgctcaccctgagcagcgcccagctggccgaagccaaggcgcagaacctgtcgatcctgtcgtacctggccaaccacttcagcaacccgaccatcgcgttcgctgcgccgttgatcgccttcgtggccatcgccaagtcgttcctcggccactacatcggcgccagcgaaggcctgaagggcatcatcgccaagaccggtgcgcgcccaggcgccaaggccctggaccgcgtggttgccgcactgatgctggtggtgtgctggatcgtcgccacgctcaacccgagcattctcggcatgatcgagtcgctcggcggcccgattctcgcggtgctgttgttcctgatgccgatgtacgccattcgccgtgtgccatcgatgcgcaagtacagcggtgcggcctccaacgtgttcgtcgttgtggtcggcctggttgcgctgacttccgtggtgtacggccttgtaagctga

SEQ ID NO: 79978 - protein, 426 aa, Pseudomonas putida KT2440
MNEQAPSVEQRFAESTPAALGTWARHDTTWMLGLFGTAIGAGTLFLPINAGLGGFWPLLILAVLAFPMTYFAHRGLTRFVLSGRDGSDITEVVKEHFGITAGASITVLYFFAIFPILLIYSVALTNTVSSFMEHQLHMQPPPRAILSFVLILGLLAIVRCGEQATVKVMSLLVYPFIVALALLGLYLVPHWTGGILDSATEVPPASAFLHTLWLAIPVMVFSFNHSPIISAFAVDQKRRYGAHADERSGQILRRAHLLMVVMVLFFVFSCVLTLSSAQLAEAKAQNLSILSYLANHFSNPTIAFAAPLIAFVAIAKSFLGHYIGASEGLKGIIAKTGARPGAKALDRVVAALMLVVCWIVATLNPSILGMIESLGGPILAVLLFLMPMYAIRRVPSMRKYSGAASNVFVVVVGLVALTSVVYGLVS

SEQ ID NO: 79979 - DNA, 1281 bp, Lactobacillus plantarum WCFS1; identical to SEQ ID NO: 63739
  CDS (1)..(1281): transl_table=11

SEQ ID NO: 79980 - protein, 426 aa, Lactobacillus plantarum WCFS1; identical to SEQ ID NO: 63740

SEQ ID NO: 79981 - DNA, 1278 bp, Pseudomonas syringae pv. tomato str. DC3000
  CDS (1)..(1278): transl_table=11
atgaatgatcaggctaacggcgtcgtagaacgcctggatgtagctcccgagagcatcgcctcttggaaccgtaatgacaccacctggatgctcggattgttcggtaccgccattggcgcaggtacgctgttcttgcccatcaacgcaggcatcggcggtttctggccactgctggctctcgcgctgctggcattcccgatgacgttttatgcacaccgtggcctgacccgcttcgtactgtccgggcgtgagggtgccgacatcacggaagtggtcgaacagcatttcggcaaaagcgccggggcaatgatcaccttgctgtacttcttcgcgatcttcccgatcctgttgatttacagcgtggccctcaccaataccgtgggcagctttcttgaacaccaattgcacatagcgccgccgccgcgtgccgtgctggcgttcttgctgatcatgggcctgctggcgctggttcgctgtggcgagcggttcatcgtcaaggccatgagcgtgatggtttatccgtttatcgtcgcgctgctgtttctggccatgtttctgattccacactggaccggcggtatcttgagcaccgcaaccaccttgcctgagccctcggcgtttttgtcgaccctttggctggcgattccggtgatggtgttttctttcaaccatgcgccgatcatctcggcttttgcggtcgatcagaaacgccagtacggcgagaatgccgaggtgcgcagttcgcagattctggcacgcgcccacgttttgatggtggtgatggtgctgttcttcgtgttcagctgcgtgctgaccctttcgcccgctgaactggctgaagccaaggcgcagaacatctcgatcctgtcttacctggccaaccacttcaacaacccgaccattgcattcgtcgcgccgctgattgcgtttgtggcgatttccaaatcgtttctcggccactacatcggcgccagcgagggcttgaaagggctggttctgaaatcgggacgtcgtccggcgcccaaggtactggaccgtatgaccgccgcgttcatgctggtggtgtgctggatagtggcaacgctcgacccaagtattctggggatgatcgagaacctgggcgggccagtgatttcggtgttgctgtttctgatgccgatgtatgcgatctacaaggtgccttccatgcgcaaatatgcaggtgcatggtccaactactttgtcattgccgcaggtctggtggctatttcggcgctgatcttctcgctgacgcgctga

SEQ ID NO: 79982 - protein, 425 aa, Pseudomonas syringae pv. tomato str. DC3000
MNDQANGVVERLDVAPESIASWNRNDTTWMLGLFGTAIGAGTLFLPINAGIGGFWPLLALALLAFPMTFYAHRGLTRFVLSGREGADITEVVEQHFGKSAGAMITLLYFFAIFPILLIYSVALTNTVGSFLEHQLHIAPPPRAVLAFLLIMGLLALVRCGERFIVKAMSVMVYPFIVALLFLAMFLIPHWTGGILSTATTLPEPSAFLSTLWLAIPVMVFSFNHAPIISAFAVDQKRQYGENAEVRSSQILARAHVLMVVMVLFFVFSCVLTLSPAELAEAKAQNISILSYLANHFNNPTIAFVAPLIAFVAISKSFLGHYIGASEGLKGLVLKSGRRPAPKVLDRMTAAFMLVVCWIVATLDPSILGMIENLGGPVISVLLFLMPMYAIYKVPSMRKYAGAWSNYFVIAAGLVAISALIFSLTR

SEQ ID NO: 79983 - DNA, 1230 bp, Salmonella enterica subsp. enterica serovar Typhi Ty2; identical to SEQ ID NO: 63745
  CDS (1)..(1230): transl_table=11

SEQ ID NO: 79984 - protein, 409 aa, Salmonella enterica subsp. enterica serovar Typhi Ty2; identical to SEQ ID NO: 63746

SEQ ID NO: 79985 - DNA, 1299 bp, Salmonella enterica subsp. enterica serovar Typhi Ty2
  CDS (1)..(1299): transl_table=11
atgcaggacgacacattaccattaaataacagtaacgctacgaccacaccgctttcaacgagattaccgtttacaaaatatgattttggctgggtgctcttgtgtatcggtatggcaatcggcgccggtaccgtcttaatgccagtgcaaatcggtctcaaggggatctgggtatttattaccgcttttatcatcgcctatcccgctacctatattgtgcaggatatttatctaaaaacgttatctgaaagcgaaacctgtgacgattatacggatattatcagtcactatcttggcaaaaactggggcgtttttctcggtgtaatctattttcttatgattatccacggggtgtttatttactccctgtcggtggtgtttgatagcgcctcctatatcaaaaccttcggccttactgaggccgatctttcgcagtctattatctataaagtcgcgattttcgccgtgctggtggcgattgcctccggcggggaaaagctattatttaaaatttccggcccgatggtagtggtaaaagtcgggatcattctgatattcggtttggcgatgatcccacactggaatcttgataatatttccgcctttcccgccgcatcggttttctttcgcgacgtactgctcactatcccattttgcttcttttctgcggtcttcattcaggtgctaaacccaatgaacatcgcctatcgtaagcgcgaacctgaccgtgtgctggccacccggatggcgattcgcacgcatcgcattagctatattacgctgattgccattattctctttttctcgttttcgtttaccttttcgattagtcatgaagaggcggtatcagcgttcgagcagaatatttccgctcttgcgctggcagctcaggtaatccctggccagatcatccacattacctctaccatcctcaatatttttgccgtacttaccgcgttctttggtatttatttaggttttcacgaagcgcttaaaggtattgtactgaatgtgttgagtcgcattatggatgtcaaaaacatcaacccactgttactgacatctggaatctgtgtctttatcgtggttactctggttatttgggtttcgtttcgcgtctcagtattggtctttttccagttaggcagtccgctttatggcattgtcgcgtgtattattccctttttcctgatttataaagtagcgcaactggaaaaattacgcggcctgaaaacctggcttattctgttatatggaatattgttgtgcctgtcgccgttattaaaattgattgaataa

SEQ ID NO: 79986 - protein, 432 aa, Salmonella enterica subsp. enterica serovar Typhi Ty2
MQDDTLPLNNSNATTTPLSTRLPFTKYDFGWVLLCIGMAIGAGTVLMPVQIGLKGIWVFITAFIIAYPATYIVQDIYLKTLSESETCDDYTDIISHYLGKNWGVFLGVIYFLMIIHGVFIYSLSVVFDSASYIKTFGLTEADLSQSIIYKVAIFAVLVAIASGGEKLLFKISGPMVVVKVGIILIFGLAMIPHWNLDNISAFPAASVFFRDVLLTIPFCFFSAVFIQVLNPMNIAYRKREPDRVLATRMAIRTHRISYITLIAIILFFSFSFTFSISHEEAVSAFEQNISALALAAQVIPGQIIHITSTILNIFAVLTAFFGIYLGFHEALKGIVLNVLSRIMDVKNINPLLLTSGICVFIVVTLVIWVSFRVSVLVFFQLGSPLYGIVACIIPFFLIYKVAQLEKLRGLKTWLILLYGILLCLSPLLKLIE

SEQ ID NO: 79987 - DNA, 1281 bp, Coxiella burnetii RSA 493
  CDS (1)..(1281): transl_table=11
gtgattatggaacccccaaatatcctcttcgatgaatctcaagacgtcacattcgtcaatgagattgaatccccaaaagctgaaacgactcgcggaaaagtttttggcgctattttattaattattggcacatcggtcggcggaggcatgttggctttgcccatggcaatcgctgccggtggctattatcactccattttcttattttttggcgcttggctaatcacggtgttggccgctttttacattttagaagctaatttatggctgccggaaaatacgaatctcatttcaatggcgcgaataacgctgggcaaagcgggtcagttaatcacctggattagctatttattgttgttatatacgctattagctgcctacatgtctggcgggaccgatttaattcacaatttactgtcattaattaatatccccacgccgacgtggctggattcgattttattcgttgtgattttaggtgcagttttgttttatggggtgcgcgccgtggattgggtcaaccgcggtttgatgtcaacgaaattagcggtttattttttactggtcttatttatttcgccgcacatcgatgtgggcaaactttctggcggtcgtttagcacttttatccggggcggtcatggtgattatcacttctttcggttatgccactattgtgcctactttgcgaagttatttgaaaagccaagtcaatgccttgcgattaacgatcgccatcggaagcctaatgccgttaattttatatttattatggactttcgttgtcaacggaacgctgggaagccatggagctaatggtttaattcacatggccgcttccaccgacgccgtgagcgaattaagtaatactttatctgctcacgtaaatggcgaacttgtgaaaggattaatccacttttttacttctatttgtatcgcgacttcttttctcggggtctcgttgtgcttatcagattttatggcggatggtttaaaaattaaaaaagaaaaaaacggccgctggttattggttgcattaacccttgcgccgccgcttttagtcattctgttttatccaggcgctttcattgcaagtttaaattacgccggcgttttatgcgtcattttacttatcttcttgcccgcattaatggtctggagcggccgttatgttaaaaagatcgctatcggttacgaagtcatcggcggaaaaacatttattatccttgaaatcctcgtcgcccttgcgttgctgatttttgcgttaatgcatttagggtga

SEQ ID NO: 79988 - protein, 426 aa, Coxiella burnetii RSA 493
MIMEPPNILFDESQDVTFVNEIESPKAETTRGKVFGAILLIIGTSVGGGMLALPMAIAAGGYYHSIFLFFGAWLITVLAAFYILEANLWLPENTNLISMARITLGKAGQLITWISYLLLLYTLLAAYMSGGTDLIHNLLSLINIPTPTWLDSILFVVILGAVLFYGVRAVDWVNRGLMSTKLAVYFLLVLFISPHIDVGKLSGGRLALLSGAVMVIITSFGYATIVPTLRSYLKSQVNALRLTIAIGSLMPLILYLLWTFVVNGTLGSHGANGLIHMAASTDAVSELSNTLSAHVNGELVKGLIHFFTSICIATSFLGVSLCLSDFMADGLKIKKEKNGRWLLVALTLAPPLLVILFYPGAFIASLNYAGVLCVILLIFLPALMVWSGRYVKKIAIGYEVIGGKTFIILEILVALALLIFALMHLG

SEQ ID NO: 79989 - DNA, 1188 bp, Chlamydophila caviae GPIC
  CDS (1)..(1188): transl_table=11
atgtctaacaaggttttaggaggttcccttattgttacagggaccgccataggagctggtgtgttagcagttcctgtaataacagcgtatgcaggttttctccccacgactcttctttatgtgctatcttggcttttctctgtggcatccggactttgttacctcgaaattatgacttggtttaaggaaaagcaacaagttaacttgttgtcgatggcgcaatataccttaggggatattggtaagatcttcatgtggctcctttacctgttcctattttactctttgcttattgcttacttttgtgagggagggaatatcctatttcgtatttttggttgtcagggattagacattccttggatacgtcacatggcccctttggcatttgcagttttgatttgccctgcattgatgatgggagcaaaagttgtagattactgtaatcgcttttttgttttaggattagctattgctttcgcggtattttgtatcttaggagttttttctttacaaccccagctacttttacgtgcttcgtgggcgcgctctacagaaggtttatctgttctgtttctctcctttggtttccacaatgtagtgccctcactgtattactacatggataagaacgttaaagatgttaaaaaagctatctttattggtagtttgattcctttgattttatacgtgatttgggaggctcttgttttgggagttgttcctttagactttcttatgaaagctaaggaacatggctatacagcagtagaggctatgaaaacttcattgcagtgttcaatgttttatcttgctggggagttttttggtttctttgctttagtttcttcatttttaggcgtggctctgggggttatggacttcctcgcggatgctcttcaatggaataaaaagaaacgtagtttttctattttctttttaactgttattatccctttagcttggtcaatgtgctatcccgagatcgtgcttaaatgtctcagttatgctggaggtttcggcgctgctttaattatcggagtttgcccagtgttaatgatctggaaagggcgttatgggaaaaaacattatcaagcaaaacatttagtcccaggtggaaaaattgtcttggtattaatgcttgtagtaatagtaattaatttagctagcttttattacaaattttaa

SEQ ID NO: 79990 - protein, 395 aa, Chlamydophila caviae GPIC
MSNKVLGGSLIVTGTAIGAGVLAVPVITAYAGFLPTTLLYVLSWLFSVASGLCYLEIMTWFKEKQQVNLLSMAQYTLGDIGKIFMWLLYLFLFYSLLIAYFCEGGNILFRIFGCQGLDIPWIRHMAPLAFAVLICPALMMGAKVVDYCNRFFVLGLAIAFAVFCILGVFSLQPQLLLRASWARSTEGLSVLFLSFGFHNVVPSLYYYMDKNVKDVKKAIFIGSLIPLILYVIWEALVLGVVPLDFLMKAKEHGYTAVEAMKTSLQCSMFYLAGEFFGFFALVSSFLGVALGVMDFLADALQWNKKKRSFSIFFLTVIIPLAWSMCYPEIVLKCLSYAGGFGAALIIGVCPVLMIWKGRYGKKHYQAKHLVPGGKIVLVLMLVVIVINLASFYYKF

SEQ ID NO: 79991 - DNA, 1320 bp, Bacillus cereus ATCC 14579
  CDS (1)..(1320): transl_table=11
atgaacgggaatactgcaaagaaaatagaagttcaagctgaaaataccgcactaaaaaatgagcaatatgcagatccgaaaaagtggcataagcaggatactacatgggcactcagtctatttggaactgcaattggagcaggggtgctctttttaccgattaatgcaggttcaggtggtttattatctttactactaattacattgcttgcatatccagttatgtactactcacatagggcacttgctaaaatgatatacgcttctaattctgctgatgaggggatcacaggtacaattagagagtatttcggaaataaagcgagtatcatttttaacatcgtatatttcggttcaatttatacaatcgtactaatgtattcggttgcgcttacaaacactgcaagtagttttatcgtgcatcaattgcacatgccagaacctccaagagctattttatcacttgtattagttcttggtcttatcgctatactgaattttggtcaagatattactgtaaaggtaatgagtatgttagtgtatcctttcatagtttctctactgtttatcgcaatatctttaattccacagtggaatacgtcaatgcttagtttttcagctgtttcaactgcttcaacaggaacaggctattttgggacgatattgatgattctaccaatcatcgtattctcatttaatcattcacctatgatttcatcatttgttgtgaaacagagagctacgtatggaatcgaagccactgatgctaaatgtgcgcaaatacaaaaggtttgttatatcatgacattcgctgttgttatgttcttcgtttggagtagcgcattgagcttgactccagatgatataaaaatggcaaaagaacaaaacttatcaattctttcatatcttgctaatgagcttaattcgcctgtaatcactattgcagctccaattattgcttttgtggctattacaaagtctttccttggccattatataggagcatttgaagtaatgcgtgacatgattattaagtttggtaaatcacgtggaaaagatattgaagaaaaaacaattaagacaataattcttacttttgttgtattatcatgctggtttgttgcttatacaaatccaagtattcttggacttattgattctctaagcggtcctttagttgctgctatcttatgtctattaccgatgtatgcgattcaaaaagtgccagtactagctaaatacaaagggaaaatgagcaacgtatttgttattattgtaggtgtacttactgtcttagcaagtattaagtcattattctaa

SEQ ID NO: 79992 - protein, 439 aa, Bacillus cereus ATCC 14579
MNGNTAKKIEVQAENTALKNEQYADPKKWHKQDTTWALSLFGTAIGAGVLFLPINAGSGGLLSLLLITLLAYPVMYYSHRALAKMIYASNSADEGITGTIREYFGNKASIIFNIVYFGSIYTIVLMYSVALTNTASSFIVHQLHMPEPPRAILSLVLVLGLIAILNFGQDITVKVMSMLVYPFIVSLLFIAISLIPQWNTSMLSFSAVSTASTGTGYFGTILMILPIIVFSFNHSPMISSFVVKQRATYGIEATDAKCAQIQKVCYIMTFAVVMFFVWSSALSLTPDDIKMAKEQNLSILSYLANELNSPVITIAAPIIAFVAITKSFLGHYIGAFEVMRDMIIKFGKSRGKDIEEKTIKTIILTFVVLSCWFVAYTNPSILGLIDSLSGPLVAAILCLLPMYAIQKVPVLAKYKGKMSNVFVIIVGVLTVLASIKSLF

SEQ ID NO: 79993 - DNA, 1380 bp, Helicobacter hepaticus ATCC 51449; identical to SEQ ID NO: 63749
  CDS (1)..(1380): transl_table=11

SEQ ID NO: 79994 - protein, 459 aa, Helicobacter hepaticus ATCC 51449; identical to SEQ ID NO: 63750

SEQ ID NO: 79995 - DNA, 1290 bp, Wigglesworthia glossinidia endosymbiont of Glossina brevipalpis; identical to SEQ ID NO: 63751
  CDS (1)..(1290): transl_table=11

SEQ ID NO: 79996 - protein, 429 aa, Wigglesworthia glossinidia endosymbiont of Glossina brevipalpis; identical to SEQ ID NO: 63752

SEQ ID NO: 79997 - DNA, 1227 bp, Haemophilus ducreyi 35000HP
  CDS (1)..(1227): transl_table=11
gtgattatgaataaaactttaggcagtacattattggtttcagggacgatgattggtggcggtatgttggctatgccattgacgtcagcaggtattggtttttgtttaactttagtattattggtcgtgctgtggatattgcttacttatagtgccttattatttgtggaagtatatcaaactgcagaacatgatgttggtattggcacattagcggcgcgatattttggtaaaacaggacgagtcattgctacgttagtattaatggtctttttgtatgcgttgttatccgcttatgttacgggcggtggtaatattttagcgtcaatgtttccagctgcgcctgatcatttaatgacagagaaagagaaaattgcgatagtcatgtttacgataatttttggtgcttttattgtttttggcactagaagtgttgatggtattaaccgttttctgttttttattatgttagccggtttagcgttggtactgtttgctttaatgccttttattcagatagataatttactcgcaatgcctgtggataacttattattagtttctgctagcccgatctttttcaccgcttttggatttcatggctctattccaagtttaaataattatttaaatggtaatgtgaaagcattacgttttgctattatagttggttcattgattaccttaatggtttatattttatggcaaatggcgacccacggtttattaagtcaaaccgcatttcttgatatcttacagaaagatccaaccttgaatggtttagtcgtggcaacggcgcaaacaactggcagtaatattattggttatatagtgaagtttttctcggcatttgctttaatcacttcttttttgggggttgcgcttggcttatttgaatgtattaacgatttattaaagcaatcgtttaattttgcatcaaatcgtttaaatgttggcttactgactttctcgccaccattattatttgcattgttttatcctgaaggctttgtgttagctttacgttatgctgggcaaatgtttgcgttttatgctgtagtgttgccggtgttattagtttggaaagttcgtcaactacaccctaatttgccttatcgagtatggggcggcaatgtattactctggttagtggctttacttggtattgtcatcacgtgcattccttttatggtaaaaacaggttgtttacctacagtggtagggtag

SEQ ID NO: 79998 - protein, 408 aa, Haemophilus ducreyi 35000HP
MIMNKTLGSTLLVSGTMIGGGMLAMPLTSAGIGFCLTLVLLVVLWILLTYSALLFVEVYQTAEHDVGIGTLAARYFGKTGRVIATLVLMVFLYALLSAYVTGGGNILASMFPAAPDHLMTEKEKIAIVMFTIIFGAFIVFGTRSVDGINRFLFFIMLAGLALVLFALMPFIQIDNLLAMPVDNLLLVSASPIFFTAFGFHGSIPSLNNYLNGNVKALRFAIIVGSLITLMVYILWQMATHGLLSQTAFLDILQKDPTLNGLVVATAQTTGSNIIGYIVKFFSAFALITSFLGVALGLFECINDLLKQSFNFASNRLNVGLLTFSPPLLFALFYPEGFVLALRYAGQMFAFYAVVLPVLLVWKVRQLHPNLPYRVWGGNVLLWLVALLGIVITCIPFMVKTGCLPTVVG

SEQ ID NO: 79999 - DNA, 1299 bp, Chromobacterium violaceum ATCC 12472; identical to SEQ ID NO: 63753
  CDS (1)..(1299): transl_table=11

SEQ ID NO: 80000 - protein, 432 aa, Chromobacterium violaceum ATCC 12472; identical to SEQ ID NO: 63754

SEQ ID NO: 80001 - DNA, 1299 bp, Photorhabdus luminescens subsp. laumondii TTO1; identical to SEQ ID NO: 63755
  CDS (1)..(1299): transl_table=11

SEQ ID NO: 80002 - protein, 432 aa, Photorhabdus luminescens subsp. laumondii TTO1; identical to SEQ ID NO: 63756

SEQ ID NO: 80003 - DNA, 1254 bp, Vibrio vulnificus YJ016
  CDS (1)..(1254): transl_table=11
gtgaaagaatctcgagaaacgttaaattttagtgacacgctgcccactaaaacttggacaaaacacgacactcattgggtattgagtttattcggcaccgccgtgggggctggcattctctttctgcctatcaacctaggaatcggcggcttttggcctttggtactgttagcgcttttggcgtttcccatgacattttggggccatcgtgcacttgcgcggtttgtgctctcgtcaaaacaagccgatgcagactttaccgatgttgtcgaggaacactttggagcgaaagcaggtcgtctgatttccttgctctatttcttgtcgatattccctattctgctcatttatggtgtgggcatcaccaacacggttgacagctttatggtcaatcaagcgggaatggaatcattacctcgagtgctgctgtctggtgtattggttttcagcctgatcgccatcatgctcggcggtgaaaagctgatgctgcgtgcgtttgcagccatggtttacccactcgccaccatactggcgttcttgtcgctttatctcatcccaagttggcaactgccttctttggctctgccttctgccggcgattttctacaaacggtctggttagccgtgcctgtggtgatcttctcatttagccatgccgctgccatttccagcttcgttggcgtgcaaaaacgccattacggtgagcaggcaaatggtaaatcagaacagattcttcagcgtaccagcatcatgttgattgcttttgtgctgctgtttgttttctcctgcgtactctctttaagcccagagcaattggcacaagcaaaagcgcaaaatgtgtcggtactttcttatttagccaacgcaacggagaacccatttattgcgacttttggtcctctggttgcctttatcgccattacgtcgtcattccttggccattttttaggtgcacgagaaagccttaacggattgctaaccaagcacacatcaatgcctattcaacgcgccgataaaatgaccatcgtcagcttgtttatctcaatttggattgcggcggtgatcaacccgagcattctcggcatgatggaaaccttatctggcccagtcatcgctatgatcctgtttataatgccggtttacgccatttaccgagttgattcattaaaaatctatcgtggtaaagccacgactgtgtttgttttgctgacagggctactggccgtttctgcgttgctgttcgcgattgtctaa

SEQ ID NO: 80004 - protein, 417 aa, Vibrio vulnificus YJ016
MKESRETLNFSDTLPTKTWTKHDTHWVLSLFGTAVGAGILFLPINLGIGGFWPLVLLALLAFPMTFWGHRALARFVLSSKQADADFTDVVEEHFGAKAGRLISLLYFLSIFPILLIYGVGITNTVDSFMVNQAGMESLPRVLLSGVLVFSLIAIMLGGEKLMLRAFAAMVYPLATILAFLSLYLIPSWQLPSLALPSAGDFLQTVWLAVPVVIFSFSHAAAISSFVGVQKRHYGEQANGKSEQILQRTSIMLIAFVLLFVFSCVLSLSPEQLAQAKAQNVSVLSYLANATENPFIATFGPLVAFIAITSSFLGHFLGARESLNGLLTKHTSMPIQRADKMTIVSLFISIWIAAVINPSILGMMETLSGPVIAMILFIMPVYAIYRVDSLKIYRGKATTVFVLLTGLLAVSALLFAIV

SEQ ID NO: 80005 - DNA, 1344 bp, Corynebacterium diphtheriae NCTC 13129; identical to SEQ ID NO: 63759
  CDS (1)..(1344): transl_table=11

SEQ ID NO: 80006 - protein, 447 aa, Corynebacterium diphtheriae NCTC 13129; identical to SEQ ID NO: 63760

SEQ ID NO: 80007 - DNA, 1200 bp, Parachlamydia sp. UWE25
  CDS (1)..(1200): transl_table=11
atgaccaatgataaatatcgtttattaggcggtattctccttgttgctggaacgacaataggagcagggatgctcgctcttccaattgtaacaggatttgcagggtttattccttcgattgttctgtttgtgatttattgggtttttatgactttcacagcccttttgatgttagaggttaacttatggatgggagagcatactaatctgattacgatggctaaaaaaacgcttggaagaggtggacaagcgattagttggatgatttacctcttccttttatatacattgacaactgcgtatgtagcggggggaggtcatatcattgttgattttgcaaggcaagttactgaatggaatctgccaagctggatagggcctcttcctttgttgggaatttttggtttttttgtttataaaggagctcgttcagtagattatgttaatcgaattttgatgggcggattagttttgacttatgtttgcatggtcttctttttatcatctcatatacaaccgattcttttaaaacatcaaaggtgggatgcgctttggattgcagtccctattgtgtcaacctcatttggttttcatattattattcctaccctgactgactatttgaaacgagatgtcaagcaaattagaaatgtcattttaatcggcggtgcaatcccgcttttgatttacgttagctgggaattgctaacacttggaattattccattgcagggagaaaatgggttgttaatgggatatgaaaaaggtttagatggggccactttaatgagtcaattacttgaacactctgaactttctcttttagcaaggttgttttccctttttgccattctaacttcatttttaggggtctcattgagtttgcgagattttttatctgacggattgaaaattcaaaaatcaaataaaggaagatttgttctttatttactgacatttattcctcctcttcttctaactttaacagatccacgggcgtttttaaatgccttagaatacgctggggcatttggagttgttaccttacttggcttgattcctattttaatggtttggcgtggacgttatcatttaaaattgccttcaacttttaaagctcctggaggcaaaatagctttaatcttagcattacttgtgtcattaggcgtgattggaatggaaatttttaataaagtgtag

SEQ ID NO: 80008 - protein, 399 aa, Parachlamydia sp. UWE25
MTNDKYRLLGGILLVAGTTIGAGMLALPIVTGFAGFIPSIVLFVIYWVFMTFTALLMLEVNLWMGEHTNLITMAKKTLGRGGQAISWMIYLFLLYTLTTAYVAGGGHIIVDFARQVTEWNLPSWIGPLPLLGIFGFFVYKGARSVDYVNRILMGGLVLTYVCMVFFLSSHIQPILLKHQRWDALWIAVPIVSTSFGFHIIIPTLTDYLKRDVKQIRNVILIGGAIPLLIYVSWELLTLGIIPLQGENGLLMGYEKGLDGATLMSQLLEHSELSLLARLFSLFAILTSFLGVSLSLRDFLSDGLKIQKSNKGRFVLYLLTFIPPLLLTLTDPRAFLNALEYAGAFGVVTLLGLIPILMVWRGRYHLKLPSTFKAPGGKIALILALLVSLGVIGMEIFNKV

SEQ ID NO: 80009 - DNA, 1284 bp, Parachlamydia sp. UWE25
  CDS (1)..(1284): transl_table=11
gtggaagacaaggaaacgaatcctgaaaaaggaagtttaatttctgcaatattcttagtagcaggaacatgcattggtggaggaatgttagcacttcctgtatcaacaggaataagcggatttattccttcaacaatcgtaatgggatgctgttggattgcgatgactttgtcagcattattgttattagaagtgaatttatggatgaaggaaggcgcgcatgtgattactatgtcttccaccattttaggtccggtaggccgtgtgattagttggattctctttttatttatctcttatgcttctattgtggcttatacatctgctggaggatcgttggttagagatgtagccccttctttattgggaatgtctatttcgaaagaatggggatgcttaatttttatcgtttgctttggaggaattatttactttggaagtcgtattgtgggaaaagtaaatgcgattttttttgttgcgatgattgtggcttatttagctttaatcagtactggattgtctgaagtgaaattagaaatgcttggacatcgtcgttggtcaacatcatttttagcgattcctattttattaacgacatttagttttcaaacaatgttacctagtttgactccttatctaaaaaggaatgcgatagcattacgttgggctattattggaggaacaactttaactttttttgtttatttgatttggcagtttttagttcttggagtcattcctctttttggaccaaatagccttttaaaagctttagaagtaggtgaacctgtaactcaattcgttcgacaacatgtgcaaagctcttgggtttctagtttggccgaatattttggattttttgctcttgttacttcttttttaggaatagctttaggtttgttcgattttttgtctgatggtttaaaaataaaaaagcaaggggtaggaaagattgttttaggtttattgatcgtaattcccacatttattttttctgcttattttgaacgaattttcttgcttgctttagatacttctggagggtttggtgattctattttaaatggaattatgcctgtattaatggtttggattggccgctattatcttcattttcccaatgaaaatcgcgttcctggtggaaaaccgttacttttatttgtcttcgctttctttttgacttcactgattattgaaattttaattcatacaggatttatttgttccatttttgaagcttgtcaaatcatgttaaatcaacaacaatacggtattagcttttaa

SEQ ID NO: 80010 - protein, 427 aa, Parachlamydia sp. UWE25
MEDKETNPEKGSLISAIFLVAGTCIGGGMLALPVSTGISGFIPSTIVMGCCWIAMTLSALLLLEVNLWMKEGAHVITMSSTILGPVGRVISWILFLFISYASIVAYTSAGGSLVRDVAPSLLGMSISKEWGCLIFIVCFGGIIYFGSRIVGKVNAIFFVAMIVAYLALISTGLSEVKLEMLGHRRWSTSFLAIPILLTTFSFQTMLPSLTPYLKRNAIALRWAIIGGTTLTFFVYLIWQFLVLGVIPLFGPNSLLKALEVGEPVTQFVRQHVQSSWVSSLAEYFGFFALVTSFLGIALGLFDFLSDGLKIKKQGVGKIVLGLLIVIPTFIFSAYFERIFLLALDTSGGFGDSILNGIMPVLMVWIGRYYLHFPNENRVPGGKPLLLFVFAFFLTSLIIEILIHTGFICSIFEACQIMLNQQQYGISF

SEQ ID NO: 80011 - DNA, 1290 bp, Erwinia carotovora subsp. atroseptica SCRI1043; identical to SEQ ID NO: 63763
  CDS (1)..(1290)

SEQ ID NO: 80012 - protein, 429 aa, Erwinia carotovora subsp. atroseptica SCRI1043; identical to SEQ ID NO: 63764

SEQ ID NO: 80013 - DNA, 1416 bp, Propionibacterium acnes KPA171202; identical to SEQ ID NO: 63765
  CDS (1)..(1416): transl_table=11

SEQ ID NO: 80014 - protein, 471 aa, Propionibacterium acnes KPA171202; identical to SEQ ID NO: 63766

SEQ ID NO: 80015 - DNA, 1197 bp, Desulfotalea psychrophila LSv54
  CDS (1)..(1197): transl_table=11
atgaagaattcaaaagtactgggcagtaccctgattattgcaggaacaagtatcggtgcggggatgttagcacttcccctggcttcggcagggcttggttgttttacctcttttattatcttattggttatgtggctgcttatgtcatatacggcattattgatgttagaggtgcatcagcatgccgctaaggacgcaactcttcacactcttgccagtcaatttttgggcaggcggggagatatggtggcaactgtttccatgctttttttgttttatgccctctgtgcagcctatattgccggcggtggggcacagtttaacgtaaaattaactgattggtttcatttggctgtgccacaggaagtgggaactattctctttactgtcattgttgcaactgttgttaccttcggtaccggttctgttgatatggttaaccgcctactcttttcggcaaagattgtggtgttggcgattatgcttttctttcttacccccagtataaatcctgctaatctggtgaccatgccaattcatcagggacttattctctcggcattgcctgttatatttacctcctttggttttcatggcagtattcctgccgttgttcgttatcttgatttggatatgaaggcactgcgcagagtacttattatcggttcagcacttcctttgctgatctatattctctggcttttgacaacccttggtgtcttgagccagggagtacttttgcaaaatcaaaacctggccgcctttgttaagaccctttcgggttcaatagagagtagccagattggccgggctgtttccatttttgctgatcttgccctggtaacatcttttcttggcgtaagcctaggtctctttgaatttctgggtgatagcctgggtaaggggaggggaggtctgtttattgctttgattacctttttgccacctctgggttttgctcttttttatccacagggatttattacagccctgggttatgctgctatcgcccttgctgttcttgctgttttacttccagttgctatggtaaaggtggcacgtaagagatacactggatcgggcttttatcgcgcacccggtggtggtggcgctttggtgctgactggtctactgggccttgttattattgtctctcaagtattaattagttttggcatagttcccgctattggttaa

SEQ ID NO: 80016 - protein, 398 aa, Desulfotalea psychrophila LSv54
MKNSKVLGSTLIIAGTSIGAGMLALPLASAGLGCFTSFIILLVMWLLMSYTALLMLEVHQHAAKDATLHTLASQFLGRRGDMVATVSMLFLFYALCAAYIAGGGAQFNVKLTDWFHLAVPQEVGTILFTVIVATVVTFGTGSVDMVNRLLFSAKIVVLAIMLFFLTPSINPANLVTMPIHQGLILSALPVIFTSFGFHGSIPAVVRYLDLDMKALRRVLIIGSALPLLIYILWLLTTLGVLSQGVLLQNQNLAAFVKTLSGSIESSQIGRAVSIFADLALVTSFLGVSLGLFEFLGDSLGKGRGGLFIALITFLPPLGFALFYPQGFITALGYAAIALAVLAVLLPVAMVKVARKRYTGSGFYRAPGGGGALVLTGLLGLVIIVSQVLISFGIVPAIG

SEQ ID NO: 80017 - DNA, 1302 bp, Yersinia pseudotuberculosis IP 32953; identical to SEQ ID NO: 63767
  CDS (1)..(1302): transl_table=11

SEQ ID NO: 80018 - protein, 433 aa, Yersinia pseudotuberculosis IP 32953; identical to SEQ ID NO: 63768

SEQ ID NO: 80019 - DNA, 1362 bp, Legionella pneumophila subsp. pneumophila str. Philadelphia 1
  CDS (1)..(1362): transl_table=11
gtgttaatattgatcaacctgcgaggcgctattttattagttagtattaaaacgaggatgtttttcatgtcatcaaatgaatctgcagctatagtatctccgatagtcaaccaaaaactatcacaatggaaaaaacaagatacgatttggatgttaagcctctatggcacagcaattggtgccggaactcttttccttcctatagatgctggtcttaatggcattttgcctttaatcattatgacaattctggccttccccatgacttattattctcatagggctttatgtcgttttgtcctttcaggctcgtcctcacacaatgacatcaccgatgttgtagaagaacactttggctcatttgcgggtaagatgctaactatcctgtacttttttgcgatttatccaattttgcttatgtacagtgtcgcaataactaataccacggaaagtttcctgattaatcaaatgggaattacccctccgccacgggctcttttagcaatcatattaattcttgggttaatgggtatcgtgcgtttaggacaagaaattattgtcaaatcgatgtcggtattggtatatccttttgccactattctatttctgctttcgctttatttaattccaaattggaataacgctatttttatccaaagcaattccttacatgccaatggagggcatggactattaatgactttatggttaattattccagtgatggtgttctcctttaaccattctcctatcatttcatcttttgctgtgaatcaaaagcagcaatatggtagccaagctgacgagaaaagctcattaattatgaaatacagtcacttgatgatggttttctctgtgatgttttttgtatttagctgtgtgttgagcctgtcacctcaagatcttttgcaagcaaagcaacaaaatatttccattttgtcttatctggcgaatcattttaatacccctattatggcctatattgcaccggttattgcattcatagccatttcaaaatcttttctgggacattatttaggtgccaaggaaggtttaagtggaattattgttaaatcattaaaatcaacaacaggcaaaacaattaataagaattccctgcacagaatcattgaaatctttatgattctgacttgttgggttgttgctacaattaatcctaatattttaaaaatgattgaaacattaggaggtcccatcatagctgtcttattatttatcatgccaatgtatgccattgctaaagtgccagccatgaaaaaatacaacaatcaaatcagtaacgtatttgttaccgtcatgggcattatttctatctcagccatcatttatggcttaatttaa

SEQ ID NO: 80020 - protein, 453 aa, Legionella pneumophila subsp. pneumophila str. Philadelphia 1
MLILINLRGAILLVSIKTRMFFMSSNESAAIVSPIVNQKLSQWKKQDTIWMLSLYGTAIGAGTLFLPIDAGLNGILPLIIMTILAFPMTYYSHRALCRFVLSGSSSHNDITDVVEEHFGSFAGKMLTILYFFAIYPILLMYSVAITNTTESFLINQMGITPPPRALLAIILILGLMGIVRLGQEIIVKSMSVLVYPFATILFLLSLYLIPNWNNAIFIQSNSLHANGGHGLLMTLWLIIPVMVFSFNHSPIISSFAVNQKQQYGSQADEKSSLIMKYSHLMMVFSVMFFVFSCVLSLSPQDLLQAKQQNISILSYLANHFNTPIMAYIAPVIAFIAISKSFLGHYLGAKEGLSGIIVKSLKSTTGKTINKNSLHRIIEIFMILTCWVVATINPNILKMIETLGGPIIAVLLFIMPMYAIAKVPAMKKYNNQISNVFVTVMGIISISAIIYGLI

SEQ ID NO: 80021 - DNA, 1254 bp, Photobacterium profundum SS9; identical to SEQ ID NO: 63771
  CDS (1)..(1254): transl_table=11

SEQ ID NO: 80022 - protein, 417 aa, Photobacterium profundum SS9; identical to SEQ ID NO: 63772

SEQ ID NO: 80023 - DNA, 1332 bp, Photobacterium profundum SS9; identical to SEQ ID NO: 63775
  CDS (1)..(1332): transl_table=11

SEQ ID NO: 80024 - protein, 443 aa, Photobacterium profundum SS9; identical to SEQ ID NO: 63776

SEQ ID NO: 80025 - DNA, 1395 bp, Photobacterium profundum SS9; identical to SEQ ID NO: 63777
  CDS (1)..(1395): transl_table=11

SEQ ID NO: 80026 - protein, 464 aa, Photobacterium profundum SS9; identical to SEQ ID NO: 63778

SEQ ID NO: 80027 - DNA, 1329 bp, Zymomonas mobilis subsp. mobilis ZM4; identical to SEQ ID NO: 63779
  CDS (1)..(1329): transl_table=11

SEQ ID NO: 80028 - protein, 442 aa, Zymomonas mobilis subsp. mobilis ZM4; identical to SEQ ID NO: 63780

SEQ ID NO: 80029 - DNA, 1263 bp, Francisella tularensis subsp. tularensis Schu 4; identical to SEQ ID NO: 63781
  CDS (1)..(1263): transl_table=11

SEQ ID NO: 80030 - protein, 420 aa, Francisella tularensis subsp. tularensis Schu 4; identical to SEQ ID NO: 63782

SEQ ID NO: 80031 - DNA, 1218 bp, Francisella tularensis subsp. tularensis Schu 4
  CDS (1)..(1218): transl_table=11
atgaatagtaatagtaatagtaaaataaaaattttaggatctataatgattattgtcggtaccatgattggcggcggcatattagctttaccaataattactgctaaacttggctttgttataggctccattctcatattcgtagtttggagtataatgacttacactgctgtggttatatcagatatctcttgctcgatgccttatggtagtagtttcaaaactatagcagaaaagtatcttggtaagtcaggtggagttgttgcaagtattgcttttttgatattaatgtatttcataagtactgcatatatctctgcagctgcatcttcattatcgacaacattcccaagtcttgatgaaaaactatcatctttaatttttgtgattatctttggtagcatcgtagtcttagggactagatttgtagattacgctaatagattttttataatacttaagatcttagtgttagtaattttatgtgtggtttttaacagatatattgatattccaaatctttttgtagcacctgttgaccttggaatatcactagtaatagctatacctgtttttacaacatcttttacctcgcatattattgtaccagctttatctgactatcttggtaaaaattctaaagatatgaagcgtattgttataataggcagtattattccattaatactatatttagtatgggtcgtaactatactaggtgtactaccactacatggtccagtaagctttatggattcaatttttaatcatatccctgtagataaggctaatataggcgatatcctaaaaacgctaggtactaaagtaagaactccaacaacagatgctatattacatatttttacttatgtggcgattatgacatcattcttaagcgtgaacttatcgctatttcattttaatttagacacatataaattatacaaaactaaaaaagttataggttactcaatagcagcagtactaacctttgctatacctctaataataaaccaaatggatccagatatttttatttacgcaatgacttgtgttggtttatcaatcgccattttattgattattatgccggcgcttatggcatttaagataaataaccttggtgaaaatttcaattataagatatccacgtataaaagtttatggctaatttcactagtttctggtgtaatagttatattatgtgttgttgcttaa

SEQ ID NO: 80032 - protein, 405 aa, Francisella tularensis subsp. tularensis Schu 4
MNSNSNSKIKILGSIMIIVGTMIGGGILALPIITAKLGFVIGSILIFVVWSIMTYTAVVISDISCSMPYGSSFKTIAEKYLGKSGGVVASIAFLILMYFISTAYISAAASSLSTTFPSLDEKLSSLIFVIIFGSIVVLGTRFVDYANRFFIILKILVLVILCVVFNRYIDIPNLFVAPVDLGISLVIAIPVFTTSFTSHIIVPALSDYLGKNSKDMKRIVIIGSIIPLILYLVWVVTILGVLPLHGPVSFMDSIFNHIPVDKANIGDILKTLGTKVRTPTTDAILHIFTYVAIMTSFLSVNLSLFHFNLDTYKLYKTKKVIGYSIAAVLTFAIPLIINQMDPDIFIYAMTCVGLSIAILLIIMPALMAFKINNLGENFNYKISTYKSLWLISLVSGVIVILCVVA

SEQ ID NO: 80033 - DNA, 1224 bp, Francisella tularensis subsp. tularensis Schu 4; identical to SEQ ID NO: 63783
  CDS (1)..(1224): transl_table=11

SEQ ID NO: 80034 - protein, 407 aa, Francisella tularensis subsp. tularensis Schu 4; identical to SEQ ID NO: 63784

SEQ ID NO: 80035 - DNA, 1206 bp, Francisella tularensis subsp. tularensis Schu 4
  CDS (1)..(1206): transl_table=11
atgattttatcaagaaaatttggcgcagcgatgattatatctggcacttgcattggtgctggaatgttggcaatccctgcaacagtagctagttgcggctttttgattggctcaatactgattgtttgtatttgggcattaatgactttcacagctttagttttagcagaagttaatctaaaaatggatgatggcgctaattttgttgagatgacaagtcaaactcttggtcctattggggttggtattgtttggatttgctatgtgctactactttattcacttgtggctgcttatactgtcggcggtggctcactcatctcaacaactcttagtaaccttgggattactttatcagaaaaaaccacggggattatttttatccttatccttggagtttttatatatatcagtactagaattgttgatcatatcaataaaattatgttttctggtaaacttttagcgtttttattactaattgctgtacttgtacctcatatttctctagatcatctaagctataaaattaaaaatccaaattttatttgggcagcgtttccaatactactaacttcctttggatttcatcatattattcctacgcttagaacctatgtaggatcaaataaaagatctttacgccaagcaattataataggtagctccataccattaatagtgtatttattatggatctttgcaacgcttggttcattgccagttgctacaccaacaggcatactaggtaagaattctggtgaaataacctctgtgataatcaatcactttagtactagttctagctatatttcaacaatatcttttttatttggtttttttgctttagcaacttcttttctaggagtagctctcggactatttgattttaatcgtagcacttatagaatttcagaaaatatacataaacataaaataattgcttttataataactttcttgccagcatacatttatgctatcgcttatcctgatggatttaaaacagctttaggctatgccagcatattcattgctatacttcaggttgcgctaccagttatgatgctatgggttattaactaccgtaagcaaaaagccttagttagcacttctactatagcaatatttataatatttattgcaattttaattattattttgcaaattatgagctcttttgatttattaccaactctaaattaa

SEQ ID NO: 80036 - protein, 401 aa, Francisella tularensis subsp. tularensis Schu 4
MILSRKFGAAMIISGTCIGAGMLAIPATVASCGFLIGSILIVCIWALMTFTALVLAEVNLKMDDGANFVEMTSQTLGPIGVGIVWICYVLLLYSLVAAYTVGGGSLISTTLSNLGITLSEKTTGIIFILILGVFIYISTRIVDHINKIMFSGKLLAFLLLIAVLVPHISLDHLSYKIKNPNFIWAAFPILLTSFGFHHIIPTLRTYVGSNKRSLRQAIIIGSSIPLIVYLLWIFATLGSLPVATPTGILGKNSGEITSVIINHFSTSSSYISTISFLFGFFALATSFLGVALGLFDFNRSTYRISENIHKHKIIAFIITFLPAYIYAIAYPDGFKTALGYASIFIAILQVALPVMMLWVINYRKQKALVSTSTIAIFIIFIAILIIILQIMSSFDLLPTLN

SEQ ID NO: 80037 - DNA, 1251 bp, Campylobacter jejuni RM1221; identical to SEQ ID NO: 63785
  CDS (1)..(1251): transl_table=11

SEQ ID NO: 80038 - protein, 416 aa, Campylobacter jejuni RM1221; identical to SEQ ID NO: 63786

SEQ ID NO: 80039 - DNA, 1305 bp, Vibrio fischeri ES114; identical to SEQ ID NO: 63711
  CDS (1)..(1305): transl_table=11

SEQ ID NO: 80040 - protein, 434 aa, Vibrio fischeri ES114; identical to SEQ ID NO: 63712

SEQ ID NO: 80041 - DNA, 1167 bp, Vibrio fischeri ES114
  CDS (1)..(1167): transl_table=11
atgaattttaaattatttggtagtgcgttaattttatctggtacagcattaggcgcagggatgctggctatccctatggtattggcacagtttggattgttttatagcactctactaatgttgattatctgtgcaggaacaacatacgcagctttgctattaacagaagcatgttcaaaaacagaattagcatttgggattaatactgtagcaaataagaccattggtaaaggtggtcaacttgttactaatgctctgttctatcttttattattttgcatgttaattgcttatattttaggggcagcagatttaattaaacgtatattttctatgatgaatgtagaaatgagcattgaatttgctcaggttgcattcaccttgtttgcgagtgcttttgttgtttgtggaacacaaattattgataagctaaatcgactgttgtttttctttatgatttccatgttggtgttgactttaatcattctaattccaggtatgacagtggaaaatctatcgcaagtaacaaaccatgataaaggtatgctatttgataccagcacgattttgtttactagctttgcctctatgccagtaattccttcgttagttgcttataataaggaagcgacaaaacaacaattgcgaaatatggttattctaggatcgatcattccattgatctgttatttagtatggctatatgcggttgttggtaacttaacagcaaatgaaattacgcatttttctaatatctctgatttgattcaaacattcagtgcgaagaatgaatatattgaaattattctgtcgattttcacatcattagcattattgacttctttccttggtgtggcgatggctttatataatcaaaataaagatatgatttcacataataagattgtgacatatgtgtgcacgtttattttgcctttattaggtgctggtttagcggctgatcaattcttatctgtacttggttatgctggtgttatcttggttttcttagctatttttattccattagcaatggttgtaacgttaagaaaaaaagagacagaggaagtgcatcaaaaccttcatatttatacagctgaaggtggtaaattagctcttggtttaactcttttatttggtttattgctattaattagccaaatttaa

SEQ ID NO: 80042 - protein, 388 aa, Vibrio fischeri ES114
MNFKLFGSALILSGTALGAGMLAIPMVLAQFGLFYSTLLMLIICAGTTYAALLLTEACSKTELAFGINTVANKTIGKGGQLVTNALFYLLLFCMLIAYILGAADLIKRIFSMMNVEMSIEFAQVAFTLFASAFVVCGTQIIDKLNRLLFFFMISMLVLTLIILIPGMTVENLSQVTNHDKGMLFDTSTILFTSFASMPVIPSLVAYNKEATKQQLRNMVILGSIIPLICYLVWLYAVVGNLTANEITHFSNISDLIQTFSAKNEYIEIILSIFTSLALLTSFLGVAMALYNQNKDMISHNKIVTYVCTFILPLLGAGLAADQFLSVLGYAGVILVFLAIFIPLAMVVTLRKKETEEVHQNLHIYTAEGGKLALGLTLLFGLLLLISQI

SEQ ID NO: 80043 - DNA, 1260 bp, Vibrio fischeri ES114; identical to SEQ ID NO: 63713
  CDS (1)..(1260): transl_table=11

SEQ ID NO: 80044 - protein, 419 aa, Vibrio fischeri ES114; identical to SEQ ID NO: 63714

SEQ ID NO: 80045 - DNA, 1167 bp, Desulfovibrio desulfuricans G20
  CDS (1)..(1167)
atgttggattccagacattccggcgcggcctgtattgtggcgggcaccgccataggggcgggcatgctggggctgcccatggttatcggtcccatgggctttctgccgggaacattgcttatggccgtggtatgggccatggcgcttttttccgcgctgcttctgcttgaagtgaatctgaaaataggcgccggaaaaaatttcaataatatggcccgcgaagtgctgggccgcggcgggcagatagtggccacgggcagcatggcttttttgctgtatgcgctgctggtagcctatctgaccggtgtgggcggtcttgtggcacgtaccggcggcgcgctgggcatggccgtcactccgcaggccggcagtctgctttttgcagtggccggcggtgtggtggtgcttatcggcacggcgcttgtggtcagagtcaataaagcgcttttctacggtatgcttgtggccatggttgtggcttttgccagccttgtgccgggggtggatgtggcgaacctgaccacggcggccccccgcgaaaagctggtactggcctgcctgcccgtgctgtttacgtctttcgggtttcatacgggcataccgagcatcgtccgttttttgcgcagcgatgcccgcagcctgcgaagagtcattctggtgggtacggcgttgcccgtcatttgttactttctgtggcttatggtgtcgctgggaggtatgcccgctgcggacatcagccgtatgggcggtaatgtggacacgcttgtttccgcccttgccggcagttcggcatggctcggatcggtactgtccgcttttgccgctctggcgctgatcacatcgtttctcggggtggcactggcactgtttgaccttctggccgaaacattccggcttagcgattctgtgctgcaccggacggttacggctgtgctggtgtttgccccgccggtgactgccgcgctattgtcgccgggcagattcattcaggcactggcccatgcgggcgccgcgttgaccatccttgcggtgtttctgccctgtgccatggcatggaagctgcggcgcgacaatgtgcaggcgtcctatcaggtggcgggcggtaccgccgcgcttgtggtgacctctgctttcggtttgctggtggtttcggcaagctatctgtaa

SEQ ID NO: 80046 - protein, 388 aa, Desulfovibrio desulfuricans G20
MLDSRHSGAACIVAGTAIGAGMLGLPMVIGPMGFLPGTLLMAVVWAMALFSALLLLEVNLKIGAGKNFNNMAREVLGRGGQIVATGSMAFLLYALLVAYLTGVGGLVARTGGALGMAVTPQAGSLLFAVAGGVVVLIGTALVVRVNKALFYGMLVAMVVAFASLVPGVDVANLTTAAPREKLVLACLPVLFTSFGFHTGIPSIVRFLRSDARSLRRVILVGTALPVICYFLWLMVSLGGMPAADISRMGGNVDTLVSALAGSSAWLGSVLSAFAALALITSFLGVALALFDLLAETFRLSDSVLHRTVTAVLVFAPPVTAALLSPGRFIQALAHAGAALTILAVFLPCAMAWKLRRDNVQASYQVAGGTAALVVTSAFGLLVVSASYL

SEQ ID NO: 80047 - DNA, 1218 bp, Haemophilus somnus 2336
  CDS (1)..(1218)
atgaaaaataaaattctcggcagtgcattaatgatcgccggcacaactataggtgcgggcatgttggctatgccattgacctcagccggcatggggttttccatgacgttagtgctacttgcaggattatggttattattgacctataccggcttgttgtttatggaagtttatcaaactgcaaaagaaaaagatgtaggcgttgcaactcttgcagaacagtatttcggtttaaccggacgttttttggcgactattagcttgctcgttctactctatgccttacttgccgcttatattaccggtggcggctctcttttatcaggccttttaacgggtattggtgatgaaaaacaaacttctcaaatctcaatattactctttaccctaattttaggtgcatttgttgtgattggtattaaaggggttgacggcttaacccgactcttgtttatcggaaaaatcattggctttattgcggtcttattaatgatgttaccaaaggcaaaattagaaaacctaggggcaattcctttagataatctattggttatttctgcaattccaattttctttacctcttttggcttccacgtcattatggggagtatcaatagctaccttgatgcagatattcgtaaaatccgtttagccattattattggaacgttaattccattatttgcctatttattatggcaattcgcaacacatggcgtattaagccaaactcaatttgttagcctattaaaacaagatccgaccctaaatggattagtaaaagcgactagtcaaattactggaagtagcctattaggtgaggtagttcgcctattctcatctcttgcattaattacttctttcttaggcgttgcaatgggaatttttgaaggagttggtgatctattaaaacgtattaatctgccgacaaatcgcccgatactggcacttttaacttttattccgccactagcctttgctctattctatccaaacggttttatcaccgcactaggttatgccggcattttatttgccttctatgggctacttcttcctgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataa

SEQ ID NO: 80048 - protein, 405 aa, Haemophilus somnus 2336
MKNKILGSALMIAGTTIGAGMLAMPLTSAGMGFSMTLVLLAGLWLLLTYTGLLFMEVYQTAKEKDVGVATLAEQYFGLTGRFLATISLLVLLYALLAAYITGGGSLLSGLLTGIGDEKQTSQISILLFTLILGAFVVIGIKGVDGLTRLLFIGKIIGFIAVLLMMLPKAKLENLGAIPLDNLLVISAIPIFFTSFGFHVIMGSINSYLDADIRKIRLAIIIGTLIPLFAYLLWQFATHGVLSQTQFVSLLKQDPTLNGLVKATSQITGSSLLGEVVRLFSSLALITSFLGVAMGIFEGVGDLLKRINLPTNRPILALLTFIPPLAFALFYPNGFITALGYAGILFAFYGLLLPVALAWKARQLHPNLPYRVAGGNLALVIAFIMGIVIIVIPFLMQEGILPTVAG

SEQ ID NO: 80049 - DNA, 1230 bp, Actinobacillus pleuropneumoniae serovar 1 str. 4074; identical to SEQ ID NO: 63789
  CDS (1)..(1230)

SEQ ID NO: 80050 - protein, 409 aa, Actinobacillus pleuropneumoniae serovar 1 str. 4074; identical to SEQ ID NO: 63790

SEQ ID NO: 80051 - DNA, 1218 bp, Actinobacillus pleuropneumoniae serovar 1 str. 4074
  CDS (1)..(1218)
atgaaaaataaaattttaggtagtgcgttaatgattgccggcactacgattggtgcggggatgttagcgatgccgctgacttctgcgggaatgggatttggagcgacggttgttttactggtttgtttatgggcgttattggcttataccggtttattgtttatggaagtgtatcaaactgctcccaagcaagacgtcggcgtagcgagtcttgcagagcaatatttcggcataaccggacgagtattggcaaccgcaagtttattgattttgctttatgctttattagccgcctatattaccggcggcggctcgttgctttcgggattactacctgaaatcggtgatgcgcataccacgactcaagtagggattttactctttaccgtattactcggttcgtttgtcgtgattgggattaaaggcgttgatggtttaactcgtttattatttattgggaaaatcgttgcgtttgtctttgtattactaatgatgttaccaaaagcaaaattggaaaatttaaccgccgtaccgttagataatctgtttgttgtttcagccgtgccgattttctttacttcgttcggcttccacgtgattatggcgagtatcaatacctatttagatgcggatattcgtaaaattcgtattgcgatttatatcggtaccgcgattccgttggtggcgtatttattgtggcaacttgcaacccacggcgttttaacgcaagcggaatttgtggagattttaaaacaggatccgaccttaaacggtttggttaaagcaaccagtcaaattaccggcagcacgattttaggcgaaatggtacgtttattctcggcacttgcattgattacctcattcttaggtgtggcaatgggtatcttcgagtgtgtcggcgatttattaaaacgtgtgaatttaccggcaaatcgtttatggctgaccctagcgacctttattccgccagtattgtttgcattattctatccgaacggatttattgcggcgttaggttatgcgggtttattatttgcattctacggcatgttattgccaatcggtttggcgtggaaagcgcgccagcaacatcctaatttggcgtatcgcgtgattggcggcaaagctgcgctgatagtcgcattaattgccggcattattattatgattattccgttccttattcagctggggtacttgccgcaagttgcaggttaa

SEQ ID NO: 80052 - protein, 405 aa, Actinobacillus pleuropneumoniae serovar 1 str. 4074
MKNKILGSALMIAGTTIGAGMLAMPLTSAGMGFGATVVLLVCLWALLAYTGLLFMEVYQTAPKQDVGVASLAEQYFGITGRVLATASLLILLYALLAAYITGGGSLLSGLLPEIGDAHTTTQVGILLFTVLLGSFVVIGIKGVDGLTRLLFIGKIVAFVFVLLMMLPKAKLENLTAVPLDNLFVVSAVPIFFTSFGFHVIMASINTYLDADIRKIRIAIYIGTAIPLVAYLLWQLATHGVLTQAEFVEILKQDPTLNGLVKATSQITGSTILGEMVRLFSALALITSFLGVAMGIFECVGDLLKRVNLPANRLWLTLATFIPPVLFALFYPNGFIAALGYAGLLFAFYGMLLPIGLAWKARQQHPNLAYRVIGGKAALIVALIAGIIIMIIPFLIQLGYLPQVAG

SEQ ID NO: 80053 - DNA, 1215 bp, Actinobacillus pleuropneumoniae serovar 1 str. 4074
  CDS (1)..(1215)
atgcaaaataaaacttttggcagcacattgattgtggcggggacgacaatcggtgcgggaatgctggcgatgcctctcacttctgcgggaatcggtttcggctggacggtggcattactcatcgcactttggttattattgtcatttggtgcgttattattcgtagaactttatcaaaatgccgaaagtgatgcgggtatcggtactttagccgaaaaatattatggcaacttcggacgaatcgtttctaccgcagtgttagtgattttcctgtatgccattctttccgcttatgtgtccggaggaagctcgttattggcaggcatcatgccgacgatcggcgatagcgaaaccaccaaaagaattgcaggtgtgatttttacccttgtgttcggtacttttgttgttatcgggacaaccagtgtggatgtagtaaatcgtattcttttcttaacgaaaatcggtgcgtttttcttagtcttggcattattattaccgaatatttccgtggataatttacttgaaatgccgattgataatgcgctattgatttccgctacaccggttttctttacagcattcggcttccatggttcaattccgagcttaaataaatatttagacggtaatgtcaaagcgttacgtatttcgattttagtcggtacggcgattccgttagtcgcttatgtattatggcagcttgcaacacacggtttattgaatcaaaccgaatttttacaattgattgagaaagatccgacattaaacggtttagcggaagcgattcagcaaatgacaggcagttcgttaattggcggtacggttaaattattctcggcattggcgttgatcacctcatttttaggggttgcattgggtttatttgagtgtttagaggatctatttaagcgagtacatattaacgcgcctcgaatttcactcggtcttttaacctttattccgccgatgttatttgcctttttctatcctgaaggttttattgctgcattaggttatgcagggcaaatgtttgctttctatgcgctagttttaccgattgcgatggtttggaagttccgtaaacaatatccggaggctaaatacaaagtattcggcggaaatattgcattgttagttgcattattattagcaatatttattattaacgttccatttattattgaagcgggttatttaccgaaagtagtgggataa

SEQ ID NO: 80054 - protein, 404 aa, Actinobacillus pleuropneumoniae serovar 1 str. 4074
MQNKTFGSTLIVAGTTIGAGMLAMPLTSAGIGFGWTVALLIALWLLLSFGALLFVELYQNAESDAGIGTLAEKYYGNFGRIVSTAVLVIFLYAILSAYVSGGSSLLAGIMPTIGDSETTKRIAGVIFTLVFGTFVVIGTTSVDVVNRILFLTKIGAFFLVLALLLPNISVDNLLEMPIDNALLISATPVFFTAFGFHGSIPSLNKYLDGNVKALRISILVGTAIPLVAYVLWQLATHGLLNQTEFLQLIEKDPTLNGLAEAIQQMTGSSLIGGTVKLFSALALITSFLGVALGLFECLEDLFKRVHINAPRISLGLLTFIPPMLFAFFYPEGFIAALGYAGQMFAFYALVLPIAMVWKFRKQYPEAKYKVFGGNIALLVALLLAIFIINVPFIIEAGYLPKVVG

SEQ ID NO: 80055 - DNA, 1239 bp, Haemophilus influenzae R2846
  CDS (1)..(1239)
atgaaaccaacagaaaaactcaaatggaacaaatttgatgcaacatggatgttaaaccttttcggtacggcggttggcgcgggcgtattgttcttgccgattaacgcagggatgggtggattttggccgttagttttaatggcaattatcgtcgggccaatgacttattttgctcaccgtggcttagcctactttgtactttcatcaaaaaatcctggcagcgatattactgaagtagtggaagaacactttggtaaaacagcgggtaaacttattaccttactttattttttcgcgattttccctattctgttgatttacggtaacggtattactaacaccgtagattcttttattgtaaatcaacttggtatggcatcaccaaatcgagtcattctctcttttgtattaattgcggtattgatttccgtgatgttatttaatgaaaaagtgatgttaaaaatcacagaatggcttgtttatccgttagtcttaattttatttgttctttctatttacttaattcctgaatggaatagtgccgtattatatgaacttccaacagcaggcggtttcttaacaactttatggctaaccattcccgtattagtattttcatttaaccattcaccagcaatttcatctttcacttgctcacaattccgtgaatacaaaacgtttgagggtgcagaacgccatatcagccatacagaaaaaggcgcctcaacgattttgttattctttgtaatgttcttcgtatttagctgtgtactaacattaacacctgaagaattagtggcagcaaaagaacagaatattagtatcttgtctttcttagcgaataaatttgataatccatatatctcttattttggcccgcttgttgcattcttagcgattactagttcattcttcggtcactatatgggggcgcgtgaaggcttagaaggtttatatttaaaaatgaaaggtgaagcagtaaatcgtaaaaaactcaattatgcgaccgcacttttcttcttattaacgttatggggcgttgcgattattaatccaagtatcttaggcttaatcgaatctcttggcggtccaatcattgcgatgattttgtttatcatgccaatgtacgcgattcgaaaaatcccagcaatgaaacgctacagcggacatttcagtaatgtatttgtaacaattatggggctgattgctatttctgcagttgtttatggattattataa

SEQ ID NO: 80056 - protein, 412 aa, Haemophilus influenzae R2846
MKPTEKLKWNKFDATWMLNLFGTAVGAGVLFLPINAGMGGFWPLVLMAIIVGPMTYFAHRGLAYFVLSSKNPGSDITEVVEEHFGKTAGKLITLLYFFAIFPILLIYGNGITNTVDSFIVNQLGMASPNRVILSFVLIAVLISVMLFNEKVMLKITEWLVYPLVLILFVLSIYLIPEWNSAVLYELPTAGGFLTTLWLTIPVLVFSFNHSPAISSFTCSQFREYKTFEGAERHISHTEKGASTILLFFVMFFVFSCVLTLTPEELVAAKEQNISILSFLANKFDNPYISYFGPLVAFLAITSSFFGHYMGAREGLEGLYLKMKGEAVNRKKLNYATALFFLLTLWGVAIINPSILGLIESLGGPIIAMILFIMPMYAIRKIPAMKRYSGHFSNVFVTIMGLIAISAVVYGLL

SEQ ID NO: 80057 - DNA, 1320 bp, Bacillus cereus G9241
  CDS (1)..(1320): transl_table=11
atggatgggaatactgcgaaaaacatagaatttcaagctgataacactgcagtaaaaaatgagaaatatctagaccctaaaaagtggcataaacaggatactacctgggcattgagcctttttggaacagcaattggagcaggagtactctttttacctattaatgcaggttcaggtggtttattatcattgctgttaattaccatacttgcatatcctgttatgtattattcacatagggcgcttgctaaaatgatttacgcttcgaattctgccgatgaggggattacaggtacaataagagaatatttcggaaataaagcaagtatcatttttaacattgtatatttcgtctccatttatacgatcgtgctgatgtactcggtcgcacttacaaatactgcaagtagttttattgtacaccaattgcacatgccggagcctccaagggctattttatcacttgtattagtactcggtcttatcactatactaaattttggtcaggatattactgtaaagataatgagcgtgctagtatatcctttcattgcttctctactttttattgcaatatctttaattccacaatggaatacttcaatgctaagtttttcaagtgtttctactgcttcaactggaacaggttatttcggaacgatttggatgatactaccaatcatagtgttctcgtttaatcattctcctatgatttcgtcattcgttatgaaacagagagctacgtatggaatagacgctaccgatgccaagtgtgcccaaatacaaaaagtttgttatatcatgacattcgctgttgttatgttctttgtttggagcagtactttaagtttgactccagatgatcttaaggtggcaaaagaacagaacttgtcaatcctatcatatcttgctaatgaacttaattcgccagtaatcacgattgcagctcctatcattgcgtttgtggctattacaaagtctttccttggccattatataggagcgtatgaggtaatgcgtgacatgattatcaagtccagtaaaaaacatgggaaagatataggagaaaaaacagttaagacaatgattcttacttttgttgtattaacatgctggtatgttgcttatacaaatccaagtattcttggaatcattgatgcccttagcggtcctttagtcgctgctatcttatgtctattaccgatgtatgcgattcgtaaagtaccagtactagcaaaatacagagggaaaatgagtaatgtatttgtaattgttatagggatacttactgttctagcgagtattaagtcattattctaa

SEQ ID NO: 80058 - protein, 439 aa, Bacillus cereus G9241
MDGNTAKNIEFQADNTAVKNEKYLDPKKWHKQDTTWALSLFGTAIGAGVLFLPINAGSGGLLSLLLITILAYPVMYYSHRALAKMIYASNSADEGITGTIREYFGNKASIIFNIVYFVSIYTIVLMYSVALTNTASSFIVHQLHMPEPPRAILSLVLVLGLITILNFGQDITVKIMSVLVYPFIASLLFIAISLIPQWNTSMLSFSSVSTASTGTGYFGTIWMILPIIVFSFNHSPMISSFVMKQRATYGIDATDAKCAQIQKVCYIMTFAVVMFFVWSSTLSLTPDDLKVAKEQNLSILSYLANELNSPVITIAAPIIAFVAITKSFLGHYIGAYEVMRDMIIKSSKKHGKDIGEKTVKTMILTFVVLTCWYVAYTNPSILGIIDALSGPLVAAILCLLPMYAIRKVPVLAKYRGKMSNVFVIVIGILTVLASIKSLF

SEQ ID NO: 80059 - DNA, 1302 bp, Pseudomonas fluorescens PfO-1
  CDS (1)..(1302)
atgaccgatgtacgcacacctgctgccgaaaatcccgctgtagaccgcacacgcaataacgaaaccgcccacaagggctggagcaagttcgacaccacctggatgctcggcctgtatggcaccgccattggcgccggcaccctgttcctgccgatcaacgccggtgtcggcggcttctggccgttgctgatcctggcgttgctggctttcccgatgaccttcttcgcgcaccgtggcctcacccgcttcgtgctctcgggccgctccggtgacatcaccgaagtggtggaggaacacttcggcatcggcgccggcaaactgattacgctgctgtatttcttcgcaatcttcccgatcctgctggtgtacagcgtggcgctgaccaacactctcggcagcttcctcgaacaccagttgcacatcgccccgccaccgcgcgcggtgctgtcgctggcgctgatcctcggtctgatggccatcgtccgttgcggtcagaacgtgatcgtcaaagccatgagtgtgctggtgtatccgttcgtcgccgcgttgctgttgctcggcatcagcctgattccgaactggaacggcgcattcttcgccagcgctcaagaaccgatggaaatgtcggtgttcctcaagaccctgtggctggcgatcccggtgatggtgttctcgttcaaccattcacccatcatctctgcgttcgccgtcgagcagaaacagcgctacggcgagcaggccgaacgcaagagcagcggcatcctcgccatggcccacggcatgatggtcgtcacggtgatgttcttctgcttcagctgcgtgctggcgctgtcgccgacggatctggcagcggccaaggcgcagaacatctcgatcctgtcgtatctggccaaccacttccagaccccggtcatcgcttacgccgcgccattgattgcgctggtggcgatcaccaaatccttcctcggccactacatcggcgccagcgaaggcttccagggcatgatcgtcaaaagcctgcgcagccgtggccgggtgatgtcggcgagctggctgaaccgtgcgaccgcgctgttcatgatcctcagctgctgggccgtggcgaccttcaacccgagcatcctcggcatgatcgaaaccctcggcgggccggtgattgcctgcctgctgttcctgatgccgatgtacgcgatccgccgcgtgccagccttgcgccagtattcgggccaggtgtcgaacgtgttcgtggtgctgatcggcctgattgcactgtcagcgatcatctactcggttctgccctga

SEQ ID NO: 80060 - protein, 433 aa, Pseudomonas fluorescens PfO-1
MTDVRTPAAENPAVDRTRNNETAHKGWSKFDTTWMLGLYGTAIGAGTLFLPINAGVGGFWPLLILALLAFPMTFFAHRGLTRFVLSGRSGDITEVVEEHFGIGAGKLITLLYFFAIFPILLVYSVALTNTLGSFLEHQLHIAPPPRAVLSLALILGLMAIVRCGQNVIVKAMSVLVYPFVAALLLLGISLIPNWNGAFFASAQEPMEMSVFLKTLWLAIPVMVFSFNHSPIISAFAVEQKQRYGEQAERKSSGILAMAHGMMVVTVMFFCFSCVLALSPTDLAAAKAQNISILSYLANHFQTPVIAYAAPLIALVAITKSFLGHYIGASEGFQGMIVKSLRSRGRVMSASWLNRATALFMILSCWAVATFNPSILGMIETLGGPVIACLLFLMPMYAIRRVPALRQYSGQVSNVFVVLIGLIALSAIIYSVLP

SEQ ID NO: 80061 - DNA, 1281 bp, Pseudomonas fluorescens PfO-1; identical to SEQ ID NO: 63791
  CDS (1)..(1281)

SEQ ID NO: 80062 - protein, 426 aa, Pseudomonas fluorescens PfO-1; identical to SEQ ID NO: 63792

SEQ ID NO: 80063 - DNA, 1323 bp, Campylobacter coli RM2228
  CDS (1)..(1323): transl_table=11
atgaatactcctaagtggactcgttatgacacgagatgggttttatctctttttggaaccgctgtgggtgcggggattttatttttacctattaaggcgggtgttggtggtttttggccagttgttgtgatgactttgattatttttccaatggtgtatttaagccatagagccttaagtcgttttgtatgtcaagcaaatggtaatgataaagacattacccatgcggctgaagagtattttggtagaaaagtaagtatttttatttctgtgctttatttctttgcaatttttccaatttgtttagcgtattgtgtgggtataaccaatacttttgaaagttttatctaccatcaatttttaccccttttaaattcagagggtgtatttgcagatattattcgtgccatgtatgaggtaagcacagatgataaagaaaaagttgtagcgagtttatttcctttttatcgtttgcttttagcttttattttggtaagtatttttatgcttattatgctttttagcgaagagttaatcactaaagtatgtgaatggcttgtgtatcctttatgtgctattttatttttattttctttatatcttatcccacaatggtcatttgaaagttttagtgctattcctggaacaaaagaatttattactatagtatggctaactttaccggttttagtgttttcatttaatcactcaccagcaatttcaactttttctctaagcgtaaaaagagaatatcctgaaaattcagtacaaaaagcaaatcaaattttgtttagaacctctgtcatgttgcttgcttttgttatgttttttgtggtatcttgcgtgctttctttaactccagctgaacttgctgaagcaagagcacaaaacataccggtgctttcttattttgctaataagcttgataatccatttatttcttatggtggtccattaatcgcatttttggcaatttctagttcattctttggacattattttggcgctagagaaggtgcttatggtatagttagaaaatgctgcaaattagcaggtaatgaaaatcctgatttgaaaaaaatcgcagtttattctactttagtaatgtatattgttatgttaattactgcttatatcaatcctagtattttaggttttattgaaagtttgggcggtccaattatcgcagcaatcttatttttaatgccaattattgcaatttatacggtttcaaaaatgaaaaaattccaaaataaagctttagatgcttttgtttttattacaggtgttttaacaatcatcactgtaatttatactttttaa

SEQ ID NO: 80064 - protein, 440 aa, Campylobacter coli RM2228
MNTPKWTRYDTRWVLSLFGTAVGAGILFLPIKAGVGGFWPVVVMTLIIFPMVYLSHRALSRFVCQANGNDKDITHAAEEYFGRKVSIFISVLYFFAIFPICLAYCVGITNTFESFIYHQFLPLLNSEGVFADIIRAMYEVSTDDKEKVVASLFPFYRLLLAFILVSIFMLIMLFSEELITKVCEWLVYPLCAILFLFSLYLIPQWSFESFSAIPGTKEFITIVWLTLPVLVFSFNHSPAISTFSLSVKREYPENSVQKANQILFRTSVMLLAFVMFFVVSCVLSLTPAELAEARAQNIPVLSYFANKLDNPFISYGGPLIAFLAISSSFFGHYFGAREGAYGIVRKCCKLAGNENPDLKKIAVYSTLVMYIVMLITAYINPSILGFIESLGGPIIAAILFLMPIIAIYTVSKMKKFQNKALDAFVFITGVLTIITVIYTF

SEQ ID NO: 80065 - DNA, 1284 bp, Campylobacter lari RM2100; identical to SEQ ID NO: 63793
  CDS (1)..(1284): transl_table=11

SEQ ID NO: 80066 - protein, 427 aa, Campylobacter lari RM2100; identical to SEQ ID NO: 63794

SEQ ID NO: 80067 - DNA, 1311 bp, Campylobacter upsaliensis RM3195
  CDS (1)..(1311): transl_table=11
atgaaatcatataaatttgacacgaggtggatgctttctctttttggcacggctgtgggagctgggattttatatttacccattaaggctgggacgggaggcgttttacccgtcatagcaatgtgttttatcattttccctatggtgtatcttagccatagagccttgagtcgttttgtttctcaggcaaatggagcagataaggacatcacgcacgctgcggaggagtattttggtagaaaaacggctttatttatttcggtgctttattttttcgcgatttttcctatatgccttgcgtattgtgtggggattagtaatacctttgaaagctttatttatcatcaatttatgcctttaacaagtgaaaatgtagccgaatttatccaaagcatttatagcgtaagcacaagtgaaaatggcaaaattatagccaaccttaccccattttatagaactttgctagtgtttattttggtaagttcgtttatgctagtaatgcttctaagcgaagagcttatcacaaaaatttgcgaatggcttgtgtatcctttatgcttgattttatttttattttcactctatcttattcctcactggaatttagaaagctttacgcaaatccctcattttaaagaatttatcaccatagtttggcttaccttacctgttttagttttttccttcaatcactccccagccatttcaacctttactctaagcgtgaaaaggcactataaagagcataaaagtatagaaaaaactaatcaaattctttttaaaacctccattatgctacttatttttgtgatgttttttgttttttcttgcgtattttctttaaatggcgaggaatttagcgatgctagagcgcaaaatatccccgtgctttcgtattttgctaataagcttgataatcctatcatcgcttatggtggtcctttggtggcgtttttagcgattacaagttcattttttgggcattattttggtgcgagagaaggtgcttatggcatagtgcgtaagtgctgcaaaatgacaggaattttaaatcctaatcaaaagctcatcaagctcatttgcggaagcgtgatgtatatcattatgctacttgtgggtttttataatcctagcgttttagattttatagaaaagcttggcggtcctattatagcggcgattttatttttaatgcctatgattgcgatttatagcatttcaaaacttaagaaatttcaaaataagcctttagatttgtttgtctttgcgacaggcttactaaccatcatcacggtaatttacagcttttaa

SEQ ID NO: 80068 - protein, 436 aa, Campylobacter upsaliensis RM3195
MKSYKFDTRWMLSLFGTAVGAGILYLPIKAGTGGVLPVIAMCFIIFPMVYLSHRALSRFVSQANGADKDITHAAEEYFGRKTALFISVLYFFAIFPICLAYCVGISNTFESFIYHQFMPLTSENVAEFIQSIYSVSTSENGKIIANLTPFYRTLLVFILVSSFMLVMLLSEELITKICEWLVYPLCLILFLFSLYLIPHWNLESFTQIPHFKEFITIVWLTLPVLVFSFNHSPAISTFTLSVKRHYKEHKSIEKTNQILFKTSIMLLIFVMFFVFSCVFSLNGEEFSDARAQNIPVLSYFANKLDNPIIAYGGPLVAFLAITSSFFGHYFGAREGAYGIVRKCCKMTGILNPNQKLIKLICGSVMYIIMLLVGFYNPSVLDFIEKLGGPIIAAILFLMPMIAIYSISKLKKFQNKPLDLFVFATGLLTIITVIYSF

SEQ ID NO: 80069 - DNA, 1296 bp, Aeromonas salmonicida; identical to SEQ ID NO: 63795
  CDS (1)..(1296): transl_table=11

SEQ ID NO: 80070 - protein, 431 aa, Aeromonas salmonicida; identical to SEQ ID NO: 63796

SEQ ID NO: 80071 - DNA, 1248 bp, Escherichia coli
  CDS (1)..(1248): transl_table=11
atgactgatcaagctgaaaaaaagcactctgcattttggggtgttatggttatagcaggtacagtaattggtggaggtatgttttctttacctgttgatcttgccggtgcctggtttttctggggtgcctttatccttatcattgcctggttttcaatgcttcattccgggttattgttattagaagcaaatttaaattatcctgtcggctccagttttaacaccatcaccaaagatttaataggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcacagccattttcgttgccagcgtattgtggataagttcgttagccgccagtcgcattacctcattgttcctcgggctgaagattatctcctttgtgatcgtgtttggttctttcttcttccaggtcgattactccatcctgcgcgatgccaccagcaccactgcgggaacgtcttacttcccgtatatctttatggctttgccggtgtgtctggcgtcatttggtttccacggcaatattcccagcctgattatttgctatggcaaacgcaaagataagttaatcaaaagcgtggtatttggttcgctgctggcgctggtgatttatctcttctggctctattgcacgatggggaatattccgcgcgaaagctttaaggcgataatctcctcaggcggcaacattgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaa

SEQ ID NO: 80072 - protein, 415 aa, Escherichia coli
MTDQAEKKHSAFWGVMVIAGTVIGGGMFSLPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWISSLAASRITSLFLGLKIISFVIVFGSFFFQVDYSILRDATSTTAGTSYFPYIFMALPVCLASFGFHGNIPSLIICYGKRKDKLIKSVVFGSLLALVIYLFWLYCTMGNIPRESFKAIISSGGNIDSLVKSFLGTKQHGIIEFCLLVFSNLAVASSFFGVTLGLFDYLADLFKIDNSHGGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 80073 - DNA, 1248 bp, Escherichia coli
  CDS (1)..(1248): transl_table=11
atgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcctgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcacagccattttcgttgccagcgtattgtggataagttcgttagccgccagtcgcattacctcattgttcctcgggctgaagattatctcctttgtgatcgtgtttggttctttcttcttccaggtcgattactccatcctgcgcgatgccaccagcaccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcacgatggggaatattccgcgcgaaagctttaaggcgataatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaa

SEQ ID NO: 80074 - protein, 415 aa, Escherichia coli
MTDQAEKKHSAFWGVMVIAGTVIGGGMFALPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWISSLAASRITSLFLGLKIISFVIVFGSFFFQVDYSILRDATSTTAGTSYFPYIFMALPVCLASFGFHGNIPSLIICYGKRKDKLIKSVVFGSLLALVIYLFWLYCTMGNIPRESFKAIISSGGNVDSLVKSFLGTKQHGIIEFCLLVFSNLAVASSFFGVTLGLFDYLADLFKIDNSHGGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 80075 - DNA, 1299 bp, Citrobacter freundii; identical to SEQ ID NO: 63797
  CDS (1)..(1299): transl_table=11

SEQ ID NO: 80076 - protein, 432 aa, Citrobacter freundii; identical to SEQ ID NO: 63798

SEQ ID NO: 80077 - DNA, 1332 bp, Escherichia coli
  CDS (1)..(1332): transl_table=11
atgagtacttcagatagcattgtatccagccagacaaaacaatcgtcctggcgtaaatcagataccacatggacgttaggcttgtttggtacggcaatcggcgccggggtgctgttcttccctatccgcgcaggttttggcggactgatcccgattcttctgatgttggtattggcataccccatcgcgttttattgccaccgggcgctggcgcgtctgtgtctttctggctctaacccttccggcaacattacggaaacggtggaagagcattttggtaaaactggcggcgtggttatcacgttcctgtacttcttcgcgatttgcccactgctgtggatttatggcgttactattaccaatacctttatgacgttctgggaaaaccagctcggctttgcaccgctgaatcgcggctttgtggcgctgttcctgttgctgctgatggctttcgtcatctggtttggtaaggatctgatggttaaagtgatgagctacctggtatggccgtttatcgccagcctggtgctgatttctttgtcgctgatcccttactggaactctgcagttatcgaccaggttgacctcggttcgctgtcgttaaccggtcatgacggtatcctgatcactgtctggctggggatttccatcatggttttctcctttaacttctcgccaatcgtctcttccttcgtggtttctaagcgtgaagagtatgagaaagacttcggtcgcgacttcaccgaacgtaaatgttcccaaatcatttctcgtgccagcatgctgatggttgcagtggtgatgttctttgcctttagctgcctgtttactctgtctccggccaacatggcggaagccaaagcgcagaatattccagtgctttcttatctggctaaccactttgcgtccatgaccggtaccaaaacaacgttcgcgattacactggaatatgcggcttccatcatcgcactcgtggctatcttcaaatctttcttcggtcactatctgggaacgctggaaggtctgaatggcctggtcctgaagtttggttataaaggcgacaaaactaaagtgtcgctgggtaaactgaacactatcagcatgatcttcatcatgggctccacctgggttgttgcctacgccaacccgaacatccttgacctgattgaagccatgggcgcaccgattatcgcatccctgctgtgcctgttgccgatgtatgccatccgtaaagcgccgtctctggcgaaataccgtggtcgtctggataacgtgtttgttaccgtgattggtctgctgaccatcctgaacatcgtatacaaactgttttaa

SEQ ID NO: 80078 - protein, 443 aa, Escherichia coli; identical to SEQ ID NO: 63710

SEQ ID NO: 80079 - DNA, 1332 bp, Escherichia coli; identical to SEQ ID NO: 63805
  CDS (1)..(1332)

SEQ ID NO: 80080 - protein, 443 aa, Escherichia coli; identical to SEQ ID NO: 63806

SEQ ID NO: 80081 - DNA, 1272 bp, Escherichia coli; identical to SEQ ID NO: 63807
  CDS (1)..(1272): transl_table=11

SEQ ID NO: 80082 - protein, 423 aa, Escherichia coli; identical to SEQ ID NO: 63808

SEQ ID NO: 80083 - DNA, 23 bp, Primer
atggaaacgactcaaaccagcac

SEQ ID NO: 80084 - DNA, 25 bp, Primer
ttagctgaacagagagtagaagatt

SEQ ID NO: 80085 - protein, 423 aa, consensus
  MISC_FEATURE (1)..(423): consensus for the disclosure of xaa see table XV
GTXXGAGXXXXPXXXXXXGXXXXXXXXXXXXXXXXXXXXXXXXXXXXXXXXXXXXXXXXXXXXXXGXXXXXXXXXXYXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXSFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXSFXGXXXGXXXXXXXXXXXXXXXXXXXXXXXXXXXXXXXXXXXXXXXXXXXXXXXXXXXXXXXXXXXXXXXXXXXXXXP

SEQ ID NO: 80086 - protein, 23 aa, consensus
  MISC_FEATURE (1)..(23): consensus for the disclosure of xaa see table XV
XXXXGXXXGXGXXXXPXXXXXXG

SEQ ID NO: 80087 - protein, 15 aa, consensus
  MISC_FEATURE (1)..(15): consensus for the disclosure of xaa see table XV
XXXXXXXXXXXXXXX

SEQ ID NO: 80088 - DNA, 1014 bp, Escherichia coli; identical to SEQ ID NO: 45566
  CDS (1)..(1014)

SEQ ID NO: 80089 - protein, 337 aa, Escherichia coli; identical to SEQ ID NO: 45567

SEQ ID NO: 80090 - DNA, 978 bp, Thermococcus kodakaraensis; identical to SEQ ID NO: 45568
  CDS (1)..(978)

SEQ ID NO: 80091 - protein, 325 aa, Thermococcus kodakaraensis; identical to SEQ ID NO: 45569

SEQ ID NO: 80092 - DNA, 1026 bp, Staphylococcus aureus subsp. aureus COL; identical to SEQ ID NO: 45570
  CDS (1)..(1026)

SEQ ID NO: 80093 - protein, 341 aa, Staphylococcus aureus subsp. aureus COL; identical to SEQ ID NO: 45571

SEQ ID NO: 80094 - DNA, 1167 bp, Gluconobacter oxydans 621H; identical to SEQ ID NO: 45572
  CDS (1)..(1167)

SEQ ID NO: 80095 - protein, 388 aa, Gluconobacter oxydans 621H; identical to SEQ ID NO: 45573

SEQ ID NO: 80096 - DNA, 1215 bp, Danio rerio; identical to SEQ ID NO: 45574
  CDS (1)..(1215)

SEQ ID NO: 80097 - protein, 404 aa, Danio rerio; identical to SEQ ID NO: 45575

SEQ ID NO: 80098 - DNA, 1161 bp, Saccharomyces cerevisiae; identical to SEQ ID NO: 45576
  CDS (1)..(1161)

SEQ ID NO: 80099 - protein, 386 aa, Saccharomyces cerevisiae; identical to SEQ ID NO: 45577

SEQ ID NO: 80100 - DNA, 972 bp, Archaeoglobus fulgidus DSM 4304; identical to SEQ ID NO: 45578
  CDS (1)..(972): transl_table=11

SEQ ID NO: 80101 - protein, 323 aa, Archaeoglobus fulgidus DSM 4304; identical to SEQ ID NO: 45579

SEQ ID NO: 80102 - DNA, 963 bp, Ureaplasma parvum serovar 3 str. ATCC 700970; identical to SEQ ID NO: 45580
  CDS (1)..(963): transl_table=4

SEQ ID NO: 80103 - protein, 320 aa, Ureaplasma parvum serovar 3 str. ATCC 700970; identical to SEQ ID NO: 45581

SEQ ID NO: 80104 - DNA, 1245 bp, Mus musculus; identical to SEQ ID NO: 45582
  CDS (1)..(1245)

SEQ ID NO: 80105 - protein, 414 aa, Mus musculus; identical to SEQ ID NO: 45583

SEQ ID NO: 80106 - DNA, 1089 bp, Mesorhizobium loti MAFF303099; identical to SEQ ID NO: 45584
  CDS (1)..(1089): transl_table=11

SEQ ID NO: 80107 - protein, 362 aa, Mesorhizobium loti MAFF303099; identical to SEQ ID NO: 45585

SEQ ID NO: 80108 - DNA, 1584 bp, Thermoplasma volcanium GSS1; identical to SEQ ID NO: 45586
  CDS (1)..(1584): transl_table=11

SEQ ID NO: 80109 - protein, 527 aa, Thermoplasma volcanium GSS1; identical to SEQ ID NO: 45587

SEQ ID NO: 80110 - DNA, 1050 bp, Aeropyrum pernix K1; identical to SEQ ID NO: 45588
  CDS (1)..(1050): transl_table=11

SEQ ID NO: 80111 - protein, 349 aa, Aeropyrum pernix K1; identical to SEQ ID NO: 45589

SEQ ID NO: 80112 - DNA, 1062 bp, Arabidopsis thaliana; identical to SEQ ID NO: 45590
  CDS (1)..(1062)

SEQ ID NO: 80113 - protein, 353 aa, Arabidopsis thaliana; identical to SEQ ID NO: 45591

SEQ ID NO: 80114 - DNA, 984 bp, Thermotoga maritima MSB8; identical to SEQ ID NO: 45592
  CDS (1)..(984): transl_table=11

SEQ ID NO: 80115 - protein, 327 aa, Thermotoga maritima MSB8; identical to SEQ ID NO: 45593

SEQ ID NO: 80116 - DNA, 1032 bp, Bacillus halodurans C-125; identical to SEQ ID NO: 45594
  CDS (1)..(1032): transl_table=11

SEQ ID NO: 80117 - protein, 343 aa, Bacillus halodurans C-125; identical to SEQ ID NO: 45595

SEQ ID NO: 80118 - DNA, 1032 bp, Pasteurella multocida subsp. multocida str. Pm70; identical to SEQ ID NO: 45596
  CDS (1)..(1032): transl_table=11

SEQ ID NO: 80119 - protein, 343 aa, Pasteurella multocida subsp. multocida str. Pm70; identical to SEQ ID NO: 45597

SEQ ID NO: 80120 - DNA, 1452 bp, Halobacterium salinarum NRC-1; identical to SEQ ID NO: 45598
  CDS (1)..(1452): transl_table=11

SEQ ID NO: 80121 - protein, 483 aa, Halobacterium salinarum NRC-1; identical to SEQ ID NO: 45599

SEQ ID NO: 80122 - DNA, 1008 bp, Campylobacter jejuni subsp. jejuni NCTC 11168; identical to SEQ ID NO: 45600
  CDS (1)..(1008): transl_table=11

SEQ ID NO: 80123 - protein, 335 aa, Campylobacter jejuni subsp. jejuni NCTC 11168; identical to SEQ ID NO: 45601

SEQ ID NO: 80124 - DNA, 1065 bp, Neisseria meningitidis Z2491; identical to SEQ ID NO: 45602
  CDS (1)..(1065): transl_table=11

SEQ ID NO: 80125 - protein, 354 aa, Neisseria meningitidis Z2491; identical to SEQ ID NO: 45603

SEQ ID NO: 80126 - DNA, 1038 bp, Deinococcus radiodurans R1; identical to SEQ ID NO: 45604
  CDS (1)..(1038): transl_table=11

SEQ ID NO: 80127 - protein, 345 aa, Deinococcus radiodurans R1; identical to SEQ ID NO: 45605

SEQ ID NO: 80128 - DNA, 1047 bp, Xylella fastidiosa 9a5c; identical to SEQ ID NO: 45606
  CDS (1)..(1047): transl_table=11

SEQ ID NO: 80129 - protein, 348 aa, Xylella fastidiosa 9a5c; identical to SEQ ID NO: 45607

SEQ ID NO: 80130 - DNA, 1023 bp, Clostridium acetobutylicum ATCC 824; identical to SEQ ID NO: 45608
  CDS (1)..(1023): transl_table=11

SEQ ID NO: 80131 - protein, 340 aa, Clostridium acetobutylicum ATCC 824; identical to SEQ ID NO: 45609

SEQ ID NO: 80132 - DNA, 1101 bp, Agrobacterium tumefaciens str. C58; identical to SEQ ID NO: 45610
  CDS (1)..(1101): transl_table=11

SEQ ID NO: 80133 - protein, 366 aa, Agrobacterium tumefaciens str. C58; identical to SEQ ID NO: 45611

SEQ ID NO: 80134 - DNA, 1011 bp, Streptococcus pneumoniae R6; identical to SEQ ID NO: 45612
  CDS (1)..(1011): transl_table=11

SEQ ID NO: 80135 - protein, 336 aa, Streptococcus pneumoniae R6; identical to SEQ ID NO: 45613

SEQ ID NO: 80136 - DNA, 1011 bp, Sulfolobus tokodaii str. 7; identical to SEQ ID NO: 45614
  CDS (1)..(1011): transl_table=11

SEQ ID NO: 80137 - protein, 336 aa, Sulfolobus tokodaii str. 7; identical to SEQ ID NO: 45615

SEQ ID NO: 80138 - DNA, 1083 bp, Sinorhizobium meliloti 1021; identical to SEQ ID NO: 45616
  CDS (1)..(1083): transl_table=11

SEQ ID NO: 80139 - protein, 360 aa, Sinorhizobium meliloti 1021; identical to SEQ ID NO: 45617

SEQ ID NO: 80140 - DNA, 1590 bp, Thermoplasma acidophilum DSM 1728; identical to SEQ ID NO: 45618
  CDS (1)..(1590): transl_table=11

SEQ ID NO: 80141 - protein, 529 aa, Thermoplasma acidophilum DSM 1728; identical to SEQ ID NO: 45619

SEQ ID NO: 80142 - DNA, 1014 bp, Yersinia pestis CO92; identical to SEQ ID NO: 45620
  CDS (1)..(1014)

SEQ ID NO: 80143 - protein, 337 aa, Yersinia pestis CO92; identical to SEQ ID NO: 45621

SEQ ID NO: 80144 - DNA, 1104 bp, Caulobacter crescentus CB15; identical to SEQ ID NO: 45622
  CDS (1)..(1104): transl_table=11

SEQ ID NO: 80145 - protein, 367 aa, Caulobacter crescentus CB15; identical to SEQ ID NO: 45623

SEQ ID NO: 80146 - DNA, 1035 bp, Chlamydophila pneumoniae AR39; identical to SEQ ID NO: 45624
  CDS (1)..(1035): transl_table=11

SEQ ID NO: 80147 - protein, 344 aa, Chlamydophila pneumoniae AR39; identical to SEQ ID NO: 45625

SEQ ID NO: 80148 - DNA, 1035 bp, Listeria innocua Clip11262; identical to SEQ ID NO: 45626
  CDS (1)..(1035): transl_table=11

SEQ ID NO: 80149 - protein, 344 aa, Listeria innocua Clip11262; identical to SEQ ID NO: 45627

SEQ ID NO: 80150 - DNA, 1041 bp, Nostoc sp. PCC 7120; identical to SEQ ID NO: 45628
  CDS (1)..(1041): transl_table=11

SEQ ID NO: 80151 - protein, 346 aa, Nostoc sp. PCC 7120; identical to SEQ ID NO: 45629

SEQ ID NO: 80152 - DNA, 1176 bp, Caenorhabditis elegans; identical to SEQ ID NO: 45630
  CDS (1)..(1176)

SEQ ID NO: 80153 - protein, 391 aa, Caenorhabditis elegans; identical to SEQ ID NO: 45631

SEQ ID NO: 80154 - DNA, 1266 bp, Caenorhabditis elegans; identical to SEQ ID NO: 45632
  CDS (1)..(1266)

SEQ ID NO: 80155 - protein, 421 aa, Caenorhabditis elegans; identical to SEQ ID NO: 45633

SEQ ID NO: 80156 - DNA, 1032 bp, Pyrobaculum aerophilum str. IM2; identical to SEQ ID NO: 45634
  CDS (1)..(1032): transl_table=11

SEQ ID NO: 80157 - protein, 343 aa, Pyrobaculum aerophilum str. IM2; identical to SEQ ID NO: 45635

SEQ ID NO: 80158 - DNA, 1020 bp, Clostridium perfringens str. 13; identical to SEQ ID NO: 45636
  CDS (1)..(1020): transl_table=11

SEQ ID NO: 80159 - protein, 339 aa, Clostridium perfringens str. 13; identical to SEQ ID NO: 45637

SEQ ID NO: 80160 - DNA, 1443 bp, Arabidopsis thaliana; identical to SEQ ID NO: 45638
  CDS (1)..(1443)

SEQ ID NO: 80161 - protein, 480 aa, Arabidopsis thaliana; identical to SEQ ID NO: 45639

SEQ ID NO: 80162 - DNA, 975 bp, Pyrococcus furiosus DSM 3638; identical to SEQ ID NO: 45640
  CDS (1)..(975): transl_table=11

SEQ ID NO: 80163 - protein, 324 aa, Pyrococcus furiosus DSM 3638; identical to SEQ ID NO: 45641

SEQ ID NO: 80164 - DNA, 1239 bp, Schizosaccharomyces pombe; identical to SEQ ID NO: 45642
  CDS (1)..(1239)

SEQ ID NO: 80165 - protein, 412 aa, Schizosaccharomyces pombe; identical to SEQ ID NO: 45643

SEQ ID NO: 80166 - DNA, 1041 bp, Schizosaccharomyces pombe; identical to SEQ ID NO: 45644
  CDS (1)..(1041)

SEQ ID NO: 80167 - protein, 346 aa, Schizosaccharomyces pombe; identical to SEQ ID NO: 45645

SEQ ID NO: 80168 - DNA, 996 bp, Encephalitozoon cuniculi; identical to SEQ ID NO: 45646
  CDS (1)..(996)

SEQ ID NO: 80169 - protein, 331 aa, Encephalitozoon cuniculi; identical to SEQ ID NO: 45647

SEQ ID NO: 80170 - DNA, 1035 bp, Corynebacterium glutamicum ATCC 13032; identical to SEQ ID NO: 45648
  CDS (1)..(1035): transl_table=11

SEQ ID NO: 80171 - protein, 344 aa, Corynebacterium glutamicum ATCC 13032; identical to SEQ ID NO: 45649

SEQ ID NO: 80172 - DNA, 1026 bp, Fusobacterium nucleatum subsp. nucleatum ATCC 25586; identical to SEQ ID NO: 45650
  CDS (1)..(1026): transl_table=11

SEQ ID NO: 80173 - protein, 341 aa, Fusobacterium nucleatum subsp. nucleatum ATCC 25586; identical to SEQ ID NO: 45651

SEQ ID NO: 80174 - DNA, 1230 bp, Drosophila melanogaster; identical to SEQ ID NO: 45652
  CDS (1)..(1230)

SEQ ID NO: 80175 - protein, 409 aa, Drosophila melanogaster; identical to SEQ ID NO: 45653

SEQ ID NO: 80176 - DNA, 1041 bp, Methanopyrus kandleri AV19; identical to SEQ ID NO: 45654
  CDS (1)..(1041): transl_table=11

SEQ ID NO: 80177 - protein, 346 aa, Methanopyrus kandleri AV19; identical to SEQ ID NO: 45655

SEQ ID NO: 80178 - DNA, 1644 bp, Methanosarcina acetivorans C2A; identical to SEQ ID NO: 45656
  CDS (1)..(1644): transl_table=11

SEQ ID NO: 80179 - protein, 547 aa, Methanosarcina acetivorans C2A; identical to SEQ ID NO: 45657

SEQ ID NO: 80180 - DNA, 1689 bp, Methanosarcina mazei Go1; identical to SEQ ID NO: 45658
  CDS (1)..(1689): transl_table=11

SEQ ID NO: 80181 - protein, 562 aa, Methanosarcina mazei Go1; identical to SEQ ID NO: 45659

SEQ ID NO: 80182 - DNA, 1065 bp, Xanthomonas campestris pv. campestris str. ATCC 33913; identical to SEQ ID NO: 45660
  CDS (1)..(1065): transl_table=11

SEQ ID NO: 80183 - protein, 354 aa, Xanthomonas campestris pv. campestris str. ATCC 33913; identical to SEQ ID NO: 45661

SEQ ID NO: 80184 - DNA, 1059 bp, Xanthomonas axonopodis pv. citri str. 306; identical to SEQ ID NO: 45662
  CDS (1)..(1059): transl_table=11

SEQ ID NO: 80185 - protein, 352 aa, Xanthomonas axonopodis pv. citri str. 306; identical to SEQ ID NO: 45663

SEQ ID NO: 80186 - DNA, 1044 bp, Drosophila melanogaster; identical to SEQ ID NO: 45664
  CDS (1)..(1044)

SEQ ID NO: 80187 - protein, 347 aa, Drosophila melanogaster; identical to SEQ ID NO: 45665

SEQ ID NO: 80188 - DNA, 1062 bp, Chlorobium tepidum TLS; identical to SEQ ID NO: 45666
  CDS (1)..(1062): transl_table=11

SEQ ID NO: 80189 - protein, 353 aa, Chlorobium tepidum TLS; identical to SEQ ID NO: 45667

SEQ ID NO: 80190 - DNA, 1062 bp, Thermosynechococcus elongatus BP-1; identical to SEQ ID NO: 45668
  CDS (1)..(1062): transl_table=11

SEQ ID NO: 80191 - protein, 353 aa, Thermosynechococcus elongatus BP-1; identical to SEQ ID NO: 45669

SEQ ID NO: 80192 - DNA, 1026 bp, Oceanobacillus iheyensis HTE831; identical to SEQ ID NO: 45670
  CDS (1)..(1026): transl_table=11

SEQ ID NO: 80193 - protein, 341 aa, Oceanobacillus iheyensis HTE831; identical to SEQ ID NO: 45671

SEQ ID NO: 80194 - DNA, 1080 bp, Brucella suis 1330; identical to SEQ ID NO: 45672
  CDS (1)..(1080): transl_table=11

SEQ ID NO: 80195 - protein, 359 aa, Brucella suis 1330; identical to SEQ ID NO: 45673

SEQ ID NO: 80196 - DNA, 1017 bp, Leptospira interrogans serovar Lai str. 56601; identical to SEQ ID NO: 45674
  CDS (1)..(1017): transl_table=11

SEQ ID NO: 80197 - protein, 338 aa, Leptospira interrogans serovar Lai str. 56601; identical to SEQ ID NO: 45675

SEQ ID NO: 80198 - DNA, 1017 bp, Shewanella oneidensis MR-1; identical to SEQ ID NO: 45676
  CDS (1)..(1017): transl_table=11

SEQ ID NO: 80199 - protein, 338 aa, Shewanella oneidensis MR-1; identical to SEQ ID NO: 45677

SEQ ID NO: 80200 - DNA, 1011 bp, Streptococcus mutans UA159; identical to SEQ ID NO: 45678
  CDS (1)..(1011): transl_table=11

SEQ ID NO: 80201 - protein, 336 aa, Streptococcus mutans UA159; identical to SEQ ID NO: 45679

SEQ ID NO: 80202 - DNA, 1035 bp, Corynebacterium efficiens YS-314; identical to SEQ ID NO: 45680
  CDS (1)..(1035): transl_table=11

SEQ ID NO: 80203 - protein, 344 aa, Corynebacterium efficiens YS-314; identical to SEQ ID NO: 45681

SEQ ID NO: 80204 - DNA, 1026 bp, Pseudomonas putida KT2440; identical to SEQ ID NO: 45682
  CDS (1)..(1026): transl_table=11

SEQ ID NO: 80205 - protein, 341 aa, Pseudomonas putida KT2440; identical to SEQ ID NO: 45683

SEQ ID NO: 80206 - DNA, 1023 bp, Staphylococcus epidermidis ATCC 12228; identical to SEQ ID NO: 45684
  CDS (1)..(1023): transl_table=11

SEQ ID NO: 80207 - protein, 340 aa, Staphylococcus epidermidis ATCC 12228; identical to SEQ ID NO: 45685

SEQ ID NO: 80208 - DNA, 1074 bp, Bradyrhizobium japonicum USDA 110; identical to SEQ ID NO: 45686
  CDS (1)..(1074)

SEQ ID NO: 80209 - protein, 357 aa, Bradyrhizobium japonicum USDA 110; identical to SEQ ID NO: 45687

SEQ ID NO: 80210 - DNA, 1023 bp, Clostridium tetani E88; identical to SEQ ID NO: 45688
  CDS (1)..(1023): transl_table=11

SEQ ID NO: 80211 - protein, 340 aa, Clostridium tetani E88; identical to SEQ ID NO: 45689

SEQ ID NO: 80212 - DNA, 1047 bp, Lactobacillus plantarum WCFS1; identical to SEQ ID NO: 45690
  CDS (1)..(1047): transl_table=11

SEQ ID NO: 80213 - protein, 348 aa, Lactobacillus plantarum WCFS1; identical to SEQ ID NO: 45691

SEQ ID NO: 80214 - DNA, 1206 bp, Tropheryma whipplei str. Twist; identical to SEQ ID NO: 45692
  CDS (1)..(1206): transl_table=11

SEQ ID NO: 80215 - protein, 401 aa, Tropheryma whipplei str. Twist; identical to SEQ ID NO: 45693

SEQ ID NO: 80216 - DNA, 1020 bp, Bacteroides thetaiotaomicron VPI-5482; identical to SEQ ID NO: 45694
  CDS (1)..(1020): transl_table=11

SEQ ID NO: 80217 - protein, 339 aa, Bacteroides thetaiotaomicron VPI-5482; identical to SEQ ID NO: 45695

SEQ ID NO: 80218 - DNA, 1047 bp, Enterococcus faecalis V583; identical to SEQ ID NO: 45696
  CDS (1)..(1047): transl_table=11

SEQ ID NO: 80219 - protein, 348 aa, Enterococcus faecalis V583; identical to SEQ ID NO: 45697

SEQ ID NO: 80220 - DNA, 1020 bp, Coxiella burnetii RSA 493; identical to SEQ ID NO: 45698
  CDS (1)..(1020): transl_table=11

SEQ ID NO: 80221 - protein, 339 aa, Coxiella burnetii RSA 493; identical to SEQ ID NO: 45699

SEQ ID NO: 80222 - DNA, 1125 bp, Streptomyces avermitilis MA-4680; identical to SEQ ID NO: 45700
  CDS (1)..(1125)

SEQ ID NO: 80223 - protein, 374 aa, Streptomyces avermitilis MA-4680; identical to SEQ ID NO: 45701

SEQ ID NO: 80224 - DNA, 1035 bp, Chlamydophila caviae GPIC; identical to SEQ ID NO: 45702
  CDS (1)..(1035): transl_table=11

SEQ ID NO: 80225 - protein, 344 aa, Chlamydophila caviae GPIC; identical to SEQ ID NO: 45703

SEQ ID NO: 80226 - DNA, 1014 bp, Nitrosomonas europaea ATCC 19718; identical to SEQ ID NO: 45704
  CDS (1)..(1014): transl_table=11

SEQ ID NO: 80227 - protein, 337 aa, Nitrosomonas europaea ATCC 19718; identical to SEQ ID NO: 45705

SEQ ID NO: 80228 - DNA, 1077 bp, Helicobacter hepaticus ATCC 51449; identical to SEQ ID NO: 45706
  CDS (1)..(1077): transl_table=11

SEQ ID NO: 80229 - protein, 358 aa, Helicobacter hepaticus ATCC 51449; identical to SEQ ID NO: 45707

SEQ ID NO: 80230 - DNA, 1077 bp, Rhodopirellula baltica SH 1; identical to SEQ ID NO: 45708
  CDS (1)..(1077): transl_table=11

SEQ ID NO: 80231 - protein, 358 aa, Rhodopirellula baltica SH 1; identical to SEQ ID NO: 45709

SEQ ID NO: 80232 - DNA, 1023 bp, Wigglesworthia glossinidia endosymbiont of Glossina brevipalpis; identical to SEQ ID NO: 45710
  CDS (1)..(1023): transl_table=11

SEQ ID NO: 80233 - protein, 340 aa, Wigglesworthia glossinidia endosymbiont of Glossina brevipalpis; identical to SEQ ID NO: 45711

SEQ ID NO: 80234 - DNA, 1047 bp, Haemophilus ducreyi 35000HP; identical to SEQ ID NO: 45712
  CDS (1)..(1047): transl_table=11

SEQ ID NO: 80235 - protein, 348 aa, Haemophilus ducreyi 35000HP; identical to SEQ ID NO: 45713

SEQ ID NO: 80236 - DNA, 1062 bp, Candidatus Blochmannia floridanus; identical to SEQ ID NO: 45714
  CDS (1)..(1062): transl_table=11

SEQ ID NO: 80237 - protein, 353 aa, Candidatus Blochmannia floridanus; identical to SEQ ID NO: 45715

SEQ ID NO: 80238 - DNA, 1041 bp, Bordetella pertussis Tohama I; identical to SEQ ID NO: 45716
  CDS (1)..(1041): transl_table=11

SEQ ID NO: 80239 - protein, 346 aa, Bordetella pertussis Tohama I; identical to SEQ ID NO: 45717

SEQ ID NO: 80240 - DNA, 1041 bp, Bordetella parapertussis 12822; identical to SEQ ID NO: 45718
  CDS (1)..(1041): transl_table=11

SEQ ID NO: 80241 - protein, 346 aa, Bordetella parapertussis 12822; identical to SEQ ID NO: 45719

SEQ ID NO: 80242 - DNA, 1071 bp, Prochlorococcus marinus subsp. pastoris str. CCMP1986; identical to SEQ ID NO: 45720
  CDS (1)..(1071): transl_table=11

SEQ ID NO: 80243 - protein, 356 aa, Prochlorococcus marinus subsp. pastoris str. CCMP1986; identical to SEQ ID NO: 45721

SEQ ID NO: 80244 - DNA, 1071 bp, Prochlorococcus marinus str. MIT 9313; identical to SEQ ID NO: 45722
  CDS (1)..(1071): transl_table=11

SEQ ID NO: 80245 - protein, 356 aa, Prochlorococcus marinus str. MIT 9313; identical to SEQ ID NO: 45723

SEQ ID NO: 80246 - DNA, 1065 bp, Synechococcus sp. WH 8102; identical to SEQ ID NO: 45724
  CDS (1)..(1065): transl_table=11

SEQ ID NO: 80247 - protein, 354 aa, Synechococcus sp. WH 8102; identical to SEQ ID NO: 45725

SEQ ID NO: 80248 - DNA, 1026 bp, Chromobacterium violaceum ATCC 12472; identical to SEQ ID NO: 45726
  CDS (1)..(1026): transl_table=11

SEQ ID NO: 80249 - protein, 341 aa, Chromobacterium violaceum ATCC 12472; identical to SEQ ID NO: 45727

SEQ ID NO: 80250 - DNA, 1026 bp, Porphyromonas gingivalis W83; identical to SEQ ID NO: 45728
  CDS (1)..(1026): transl_table=11

SEQ ID NO: 80251 - protein, 341 aa, Porphyromonas gingivalis W83; identical to SEQ ID NO: 45729

SEQ ID NO: 80252 - DNA, 996 bp, Wolinella succinogenes DSM 1740; identical to SEQ ID NO: 45730
  CDS (1)..(996): transl_table=11

SEQ ID NO: 80253 - protein, 331 aa, Wolinella succinogenes DSM 1740; identical to SEQ ID NO: 45731

SEQ ID NO: 80254 - DNA, 1029 bp, Gloeobacter violaceus PCC 7421; identical to SEQ ID NO: 45732
  CDS (1)..(1029): transl_table=11

SEQ ID NO: 80255 - protein, 342 aa, Gloeobacter violaceus PCC 7421; identical to SEQ ID NO: 45733

SEQ ID NO: 80256 - DNA, 1014 bp, Photorhabdus luminescens subsp. laumondii TTO1; identical to SEQ ID NO: 45734
  CDS (1)..(1014): transl_table=11

SEQ ID NO: 80257 - protein, 337 aa, Photorhabdus luminescens subsp. laumondii TTO1; identical to SEQ ID NO: 45735

SEQ ID NO: 80258 - DNA, 1020 bp, Vibrio vulnificus YJ016; identical to SEQ ID NO: 45736
  CDS (1)..(1020): transl_table=11

SEQ ID NO: 80259 - protein, 339 aa, Vibrio vulnificus YJ016; identical to SEQ ID NO: 45737

SEQ ID NO: 80260 - DNA, 1053 bp, Corynebacterium diphtheriae NCTC 13129; identical to SEQ ID NO: 45738
  CDS (1)..(1053): transl_table=11

SEQ ID NO: 80261 - protein, 350 aa, Corynebacterium diphtheriae NCTC 13129; identical to SEQ ID NO: 45739

SEQ ID NO: 80262 - DNA, 1170 bp, Rhodopseudomonas palustris CGA009; identical to SEQ ID NO: 45740
  CDS (1)..(1170): transl_table=11

SEQ ID NO: 80263 - protein, 389 aa, Rhodopseudomonas palustris CGA009; identical to SEQ ID NO: 45741

SEQ ID NO: 80264 - DNA, 1026 bp, Mycobacterium avium subsp. paratuberculosis str. k10; identical to SEQ ID NO: 45742
  CDS (1)..(1026): transl_table=11

SEQ ID NO: 80265 - protein, 341 aa, Mycobacterium avium subsp. paratuberculosis str. k10; identical to SEQ ID NO: 45743

SEQ ID NO: 80266 - DNA, 945 bp, Nanoarchaeum equitans Kin4-M; identical to SEQ ID NO: 45744
  CDS (1)..(945): transl_table=11

SEQ ID NO: 80267 - protein, 314 aa, Nanoarchaeum equitans Kin4-M; identical to SEQ ID NO: 45745

SEQ ID NO: 80268 - DNA, 1008 bp, Wolbachia endosymbiont of Drosophila melanogaster; identical to SEQ ID NO: 45746
  CDS (1)..(1008): transl_table=11

SEQ ID NO: 80269 - protein, 335 aa, Wolbachia endosymbiont of Drosophila melanogaster; identical to SEQ ID NO: 45747

SEQ ID NO: 80270 - DNA, 1038 bp, Bdellovibrio bacteriovorus HD100; identical to SEQ ID NO: 45748
  CDS (1)..(1038): transl_table=11

SEQ ID NO: 80271 - protein, 345 aa, Bdellovibrio bacteriovorus HD100; identical to SEQ ID NO: 45749

SEQ ID NO: 80272 - DNA, 1017 bp, Treponema denticola ATCC 35405; identical to SEQ ID NO: 45750
  CDS (1)..(1017): transl_table=11

SEQ ID NO: 80273 - protein, 338 aa, Treponema denticola ATCC 35405; identical to SEQ ID NO: 45751

SEQ ID NO: 80274 - DNA, 960 bp, Mycoplasma mycoides subsp. mycoides SC str. PG1; identical to SEQ ID NO: 45752
  CDS (1)..(960): transl_table=4

SEQ ID NO: 80275 - protein, 319 aa, Mycoplasma mycoides subsp. mycoides SC str. PG1; identical to SEQ ID NO: 45753

SEQ ID NO: 80276 - DNA, 1017 bp, Bacillus cereus ATCC 10987; identical to SEQ ID NO: 45754
  CDS (1)..(1017): transl_table=11

SEQ ID NO: 80277 - protein, 338 aa, Bacillus cereus ATCC 10987; identical to SEQ ID NO: 45755

SEQ ID NO: 80278 - DNA, 1158 bp, Eremothecium gossypii; identical to SEQ ID NO: 45756
  CDS (1)..(1158)

SEQ ID NO: 80279 - protein, 385 aa, Eremothecium gossypii; identical to SEQ ID NO: 45757

SEQ ID NO: 80280 - DNA, 1155 bp, Eremothecium gossypii; identical to SEQ ID NO: 45758
  CDS (1)..(1155)

SEQ ID NO: 80281 - protein, 384 aa, Eremothecium gossypii; identical to SEQ ID NO: 45759

SEQ ID NO: 80282 - DNA, 1647 bp, Methanococcus maripaludis S2; identical to SEQ ID NO: 45760
  CDS (1)..(1647): transl_table=11

SEQ ID NO: 80283 - protein, 548 aa, Methanococcus maripaludis S2; identical to SEQ ID NO: 45761

SEQ ID NO: 80284 - DNA, 1053 bp, Anopheles gambiae str. PEST; identical to SEQ ID NO: 45762
  CDS (1)..(1053)

SEQ ID NO: 80285 - protein, 350 aa, Anopheles gambiae str. PEST; identical to SEQ ID NO: 45763

SEQ ID NO: 80286 - DNA, 1209 bp, Anopheles gambiae str. PEST; identical to SEQ ID NO: 45764
  CDS (1)..(1209)

SEQ ID NO: 80287 - protein, 402 aa, Anopheles gambiae str. PEST; identical to SEQ ID NO: 45765

SEQ ID NO: 80288 - DNA, 1065 bp, Neurospora crassa; identical to SEQ ID NO: 45766
  CDS (1)..(1065)

SEQ ID NO: 80289 - protein, 354 aa, Neurospora crassa; identical to SEQ ID NO: 45767

SEQ ID NO: 80290 - DNA, 1065 bp, Magnaporthe grisea 70-15; identical to SEQ ID NO: 45768
  CDS (1)..(1065)

SEQ ID NO: 80291 - protein, 354 aa, Magnaporthe grisea 70-15; identical to SEQ ID NO: 45769

SEQ ID NO: 80292 - DNA, 1092 bp, Gibberella zeae PH-1; identical to SEQ ID NO: 45770
  CDS (1)..(1092)

SEQ ID NO: 80293 - protein, 363 aa, Gibberella zeae PH-1; identical to SEQ ID NO: 45771

SEQ ID NO: 80294 - DNA, 1008 bp, Apis mellifera; identical to SEQ ID NO: 45772
  CDS (1)..(1008)

SEQ ID NO: 80295 - protein, 335 aa, Apis mellifera; identical to SEQ ID NO: 45773

SEQ ID NO: 80296 - DNA, 1149 bp, Apis mellifera; identical to SEQ ID NO: 45774
  CDS (1)..(1149)

SEQ ID NO: 80297 - protein, 382 aa, Apis mellifera; identical to SEQ ID NO: 45775

SEQ ID NO: 80298 - DNA, 1245 bp, Ustilago maydis 521; identical to SEQ ID NO: 45776
  CDS (1)..(1245)

SEQ ID NO: 80299 - protein, 414 aa, Ustilago maydis 521; identical to SEQ ID NO: 45777

SEQ ID NO: 80300 - DNA, 1092 bp, Aspergillus nidulans FGSC A4; identical to SEQ ID NO: 45778
  CDS (1)..(1092)

SEQ ID NO: 80301 - protein, 363 aa, Aspergillus nidulans FGSC A4; identical to SEQ ID NO: 45779

SEQ ID NO: 80302 - DNA, 1494 bp, Aspergillus nidulans FGSC A4; identical to SEQ ID NO: 45780
  CDS (1)..(1494)

SEQ ID NO: 80303 - protein, 497 aa, Aspergillus nidulans FGSC A4; identical to SEQ ID NO: 45781

SEQ ID NO: 80304 - DNA, 1122 bp, Candida glabrata CBS138; identical to SEQ ID NO: 45782
  CDS (1)..(1122)

SEQ ID NO: 80305 - protein, 373 aa, Candida glabrata CBS138; identical to SEQ ID NO: 45783

SEQ ID NO: 80306 - DNA, 1188 bp, Candida glabrata CBS138; identical to SEQ ID NO: 45784
  CDS (1)..(1188)

SEQ ID NO: 80307 - protein, 395 aa, Candida glabrata CBS138; identical to SEQ ID NO: 45785

SEQ ID NO: 80308 - DNA, 1173 bp, Kluyveromyces lactis NRRL Y-1140; identical to SEQ ID NO: 45786
  CDS (1)..(1173)

SEQ ID NO: 80309 - protein, 390 aa, Kluyveromyces lactis NRRL Y-1140; identical to SEQ ID NO: 45787

SEQ ID NO: 80310 - DNA, 1158 bp, Kluyveromyces lactis NRRL Y-1140; identical to SEQ ID NO: 45788
  CDS (1)..(1158)

SEQ ID NO: 80311 - protein, 385 aa, Kluyveromyces lactis NRRL Y-1140; identical to SEQ ID NO: 45789

SEQ ID NO: 80312 - DNA, 1122 bp, Debaryomyces hansenii CBS767; identical to SEQ ID NO: 45790
  CDS (1)..(1122)

SEQ ID NO: 80313 - protein, 373 aa, Debaryomyces hansenii CBS767; identical to SEQ ID NO: 45791

SEQ ID NO: 80314 - DNA, 1329 bp, Debaryomyces hansenii CBS767; identical to SEQ ID NO: 45792
  CDS (1)..(1329)

SEQ ID NO: 80315 - protein, 442 aa, Debaryomyces hansenii CBS767; identical to SEQ ID NO: 45793

SEQ ID NO: 80316 - DNA, 1071 bp, Yarrowia lipolytica CLIB99; identical to SEQ ID NO: 45794
  CDS (1)..(1071)

SEQ ID NO: 80317 - protein, 356 aa, Yarrowia lipolytica CLIB99; identical to SEQ ID NO: 45795

SEQ ID NO: 80318 - DNA, 1131 bp, Yarrowia lipolytica CLIB99; identical to SEQ ID NO: 45796
  CDS (1)..(1131)

SEQ ID NO: 80319 - protein, 376 aa, Yarrowia lipolytica CLIB99; identical to SEQ ID NO: 45797

SEQ ID NO: 80320 - DNA, 1737 bp, Pan troglodytes; identical to SEQ ID NO: 45798
  CDS (1)..(1737)

SEQ ID NO: 80321 - protein, 578 aa, Pan troglodytes; identical to SEQ ID NO: 45799

SEQ ID NO: 80322 - DNA, 972 bp, Thermus thermophilus HB27; identical to SEQ ID NO: 45800
  CDS (1)..(972): transl_table=11

SEQ ID NO: 80323 - protein, 323 aa, Thermus thermophilus HB27; identical to SEQ ID NO: 45801

SEQ ID NO: 80324 - DNA, 1032 bp, Parachlamydia sp. UWE25; identical to SEQ ID NO: 45802
  CDS (1)..(1032): transl_table=11

SEQ ID NO: 80325 - protein, 343 aa, Parachlamydia sp. UWE25; identical to SEQ ID NO: 45803

SEQ ID NO: 80326 - DNA, 1086 bp, Desulfovibrio vulgaris subsp. vulgaris str. Hildenborough; identical to SEQ ID NO: 45804
  CDS (1)..(1086): transl_table=11

SEQ ID NO: 80327 - protein, 361 aa, Desulfovibrio vulgaris subsp. vulgaris str. Hildenborough; identical to SEQ ID NO: 45805

SEQ ID NO: 80328 - DNA, 1023 bp, Listeria monocytogenes str. 4b F2365; identical to SEQ ID NO: 45806
  CDS (1)..(1023): transl_table=11

SEQ ID NO: 80329 - protein, 340 aa, Listeria monocytogenes str. 4b F2365; identical to SEQ ID NO: 45807

SEQ ID NO: 80330 - DNA, 918 bp, Mycoplasma mobile 163K; identical to SEQ ID NO: 45808
  CDS (1)..(918): transl_table=4

SEQ ID NO: 80331 - protein, 305 aa, Mycoplasma mobile 163K; identical to SEQ ID NO: 45809

SEQ ID NO: 80332 - DNA, 1590 bp, Picrophilus torridus DSM 9790; identical to SEQ ID NO: 45810
  CDS (1)..(1590): transl_table=11

SEQ ID NO: 80333 - protein, 529 aa, Picrophilus torridus DSM 9790; identical to SEQ ID NO: 45811

SEQ ID NO: 80334 - DNA, 1095 bp, Bartonella quintana str. Toulouse; identical to SEQ ID NO: 45812
  CDS (1)..(1095): transl_table=11

SEQ ID NO: 80335 - protein, 364 aa, Bartonella quintana str. Toulouse; identical to SEQ ID NO: 45813

SEQ ID NO: 80336 - DNA, 1095 bp, Bartonella henselae str. Houston-1; identical to SEQ ID NO: 45814
  CDS (1)..(1095): transl_table=11

SEQ ID NO: 80337 - protein, 364 aa, Bartonella henselae str. Houston-1; identical to SEQ ID NO: 45815

SEQ ID NO: 80338 - DNA, 1023 bp, Acinetobacter sp. ADP1; identical to SEQ ID NO: 45816
  CDS (1)..(1023): transl_table=11

SEQ ID NO: 80339 - protein, 340 aa, Acinetobacter sp. ADP1; identical to SEQ ID NO: 45817

SEQ ID NO: 80340 - DNA, 1014 bp, Erwinia carotovora subsp. atroseptica SCRI1043; identical to SEQ ID NO: 45818
  CDS (1)..(1014)

SEQ ID NO: 80341 - protein, 337 aa, Erwinia carotovora subsp. atroseptica SCRI1043; identical to SEQ ID NO: 45819

SEQ ID NO: 80342 - DNA, 954 bp, Mesoplasma florum L1; identical to SEQ ID NO: 45820
  CDS (1)..(954): transl_table=4

SEQ ID NO: 80343 - protein, 317 aa, Mesoplasma florum L1; identical to SEQ ID NO: 45821

SEQ ID NO: 80344 - DNA, 1044 bp, Propionibacterium acnes KPA171202; identical to SEQ ID NO: 45822
  CDS (1)..(1044): transl_table=11

SEQ ID NO: 80345 - protein, 347 aa, Propionibacterium acnes KPA171202; identical to SEQ ID NO: 45823

SEQ ID NO: 80346 - DNA, 1083 bp, Leifsonia xyli subsp. xyli str. CTCB07; identical to SEQ ID NO: 45824
  CDS (1)..(1083): transl_table=11

SEQ ID NO: 80347 - protein, 360 aa, Leifsonia xyli subsp. xyli str. CTCB07; identical to SEQ ID NO: 45825

SEQ ID NO: 80348 - DNA, 1035 bp, Desulfotalea psychrophila LSv54; identical to SEQ ID NO: 45826
  CDS (1)..(1035): transl_table=11

SEQ ID NO: 80349 - protein, 344 aa, Desulfotalea psychrophila LSv54; identical to SEQ ID NO: 45827

SEQ ID NO: 80350 - DNA, 1017 bp, Borrelia garinii PBi; identical to SEQ ID NO: 45828
  CDS (1)..(1017): transl_table=11

SEQ ID NO: 80351 - protein, 338 aa, Borrelia garinii PBi; identical to SEQ ID NO: 45829

SEQ ID NO: 80352 - DNA, 963 bp, Symbiobacterium thermophilum IAM 14863; identical to SEQ ID NO: 45830
  CDS (1)..(963): transl_table=11

SEQ ID NO: 80353 - protein, 320 aa, Symbiobacterium thermophilum IAM 14863; identical to SEQ ID NO: 45831

SEQ ID NO: 80354 - DNA, 1026 bp, Symbiobacterium thermophilum IAM 14863; identical to SEQ ID NO: 45832
  CDS (1)..(1026): transl_table=11

SEQ ID NO: 80355 - protein, 341 aa, Symbiobacterium thermophilum IAM 14863; identical to SEQ ID NO: 45833

SEQ ID NO: 80356 - DNA, 1035 bp, Mannheimia succiniciproducens MBEL55E; identical to SEQ ID NO: 45834
  CDS (1)..(1035): transl_table=11

SEQ ID NO: 80357 - protein, 344 aa, Mannheimia succiniciproducens MBEL55E; identical to SEQ ID NO: 45835

SEQ ID NO: 80358 - DNA, 1020 bp, Bacteroides fragilis YCH46; identical to SEQ ID NO: 45836
  CDS (1)..(1020): transl_table=11

SEQ ID NO: 80359 - protein, 339 aa, Bacteroides fragilis YCH46; identical to SEQ ID NO: 45837

SEQ ID NO: 80360 - DNA, 1014 bp, Methylococcus capsulatus str. Bath; identical to SEQ ID NO: 45838
  CDS (1)..(1014): transl_table=11

SEQ ID NO: 80361 - protein, 337 aa, Methylococcus capsulatus str. Bath; identical to SEQ ID NO: 45839

SEQ ID NO: 80362 - DNA, 1035 bp, Nocardia farcinica IFM 10152; identical to SEQ ID NO: 45840
  CDS (1)..(1035): transl_table=11

SEQ ID NO: 80363 - protein, 344 aa, Nocardia farcinica IFM 10152; identical to SEQ ID NO: 45841

SEQ ID NO: 80364 - DNA, 1002 bp, Legionella pneumophila str. Paris; identical to SEQ ID NO: 45842
  CDS (1)..(1002): transl_table=11

SEQ ID NO: 80365 - protein, 333 aa, Legionella pneumophila str. Paris; identical to SEQ ID NO: 45843

SEQ ID NO: 80366 - DNA, 1020 bp, Photobacterium profundum SS9; identical to SEQ ID NO: 45844
  CDS (1)..(1020): transl_table=11

SEQ ID NO: 80367 - protein, 339 aa, Photobacterium profundum SS9; identical to SEQ ID NO: 45845

SEQ ID NO: 80368 - DNA, 1029 bp, Geobacillus kaustophilus HTA426; identical to SEQ ID NO: 45846
  CDS (1)..(1029): transl_table=11

SEQ ID NO: 80369 - protein, 342 aa, Geobacillus kaustophilus HTA426; identical to SEQ ID NO: 45847

SEQ ID NO: 80370 - DNA, 1026 bp, Anaplasma marginale str. St. Maries; identical to SEQ ID NO: 45848
  CDS (1)..(1026): transl_table=11

SEQ ID NO: 80371 - protein, 341 aa, Anaplasma marginale str. St. Maries; identical to SEQ ID NO: 45849

SEQ ID NO: 80372 - DNA, 1035 bp, Idiomarina loihiensis L2TR; identical to SEQ ID NO: 45850
  CDS (1)..(1035): transl_table=11

SEQ ID NO: 80373 - protein, 344 aa, Idiomarina loihiensis L2TR; identical to SEQ ID NO: 45851

SEQ ID NO: 80374 - DNA, 1029 bp, Azoarcus sp. EbN1; identical to SEQ ID NO: 45852
  CDS (1)..(1029): transl_table=11

SEQ ID NO: 80375 - protein, 342 aa, Azoarcus sp. EbN1; identical to SEQ ID NO: 45853

SEQ ID NO: 80376 - DNA, 1092 bp, Zymomonas mobilis subsp. mobilis ZM4; identical to SEQ ID NO: 45854
  CDS (1)..(1092): transl_table=11

SEQ ID NO: 80377 - protein, 363 aa, Zymomonas mobilis subsp. mobilis ZM4; identical to SEQ ID NO: 45855

SEQ ID NO: 80378 - DNA, 1098 bp, Silicibacter pomeroyi DSS-3; identical to SEQ ID NO: 45856
  CDS (1)..(1098): transl_table=11

SEQ ID NO: 80379 - protein, 365 aa, Silicibacter pomeroyi DSS-3; identical to SEQ ID NO: 45857

SEQ ID NO: 80380 - DNA, 1011 bp, Francisella tularensis subsp. tularensis Schu 4; identical to SEQ ID NO: 45858
  CDS (1)..(1011): transl_table=11

SEQ ID NO: 80381 - protein, 336 aa, Francisella tularensis subsp. tularensis Schu 4; identical to SEQ ID NO: 45859

SEQ ID NO: 80382 - DNA, 1050 bp, Synechococcus elongatus PCC 6301; identical to SEQ ID NO: 45860
  CDS (1)..(1050): transl_table=11

SEQ ID NO: 80383 - protein, 349 aa, Synechococcus elongatus PCC 6301; identical to SEQ ID NO: 45861

SEQ ID NO: 80384 - DNA, 1047 bp, Ehrlichia ruminantium str. Welgevonden; identical to SEQ ID NO: 45862
  CDS (1)..(1047): transl_table=11

SEQ ID NO: 80385 - protein, 348 aa, Ehrlichia ruminantium str. Welgevonden; identical to SEQ ID NO: 45863

SEQ ID NO: 80386 - DNA, 981 bp, Dehalococcoides ethenogenes 195; identical to SEQ ID NO: 45864
  CDS (1)..(981): transl_table=11

SEQ ID NO: 80387 - protein, 326 aa, Dehalococcoides ethenogenes 195; identical to SEQ ID NO: 45865

SEQ ID NO: 80388 - DNA, 1026 bp, Azotobacter vinelandii; identical to SEQ ID NO: 45866
  CDS (1)..(1026)

SEQ ID NO: 80389 - protein, 341 aa, Azotobacter vinelandii; identical to SEQ ID NO: 45867

SEQ ID NO: 80390 - DNA, 909 bp, Desulfitobacterium hafniense DCB-2; identical to SEQ ID NO: 45868
  CDS (1)..(909)

SEQ ID NO: 80391 - protein, 302 aa, Desulfitobacterium hafniense DCB-2; identical to SEQ ID NO: 45869

SEQ ID NO: 80392 - DNA, 1044 bp, Bifidobacterium longum DJO10A; identical to SEQ ID NO: 45870
  CDS (1)..(1044)

SEQ ID NO: 80393 - protein, 347 aa, Bifidobacterium longum DJO10A; identical to SEQ ID NO: 45871

SEQ ID NO: 80394 - DNA, 1053 bp, Desulfovibrio desulfuricans G20; identical to SEQ ID NO: 45872
  CDS (1)..(1053)

SEQ ID NO: 80395 - protein, 350 aa, Desulfovibrio desulfuricans G20; identical to SEQ ID NO: 45873

SEQ ID NO: 80396 - DNA, 1044 bp, Actinobacillus pleuropneumoniae serovar 1 str. 4074; identical to SEQ ID NO: 45874
  CDS (1)..(1044)

SEQ ID NO: 80397 - protein, 347 aa, Actinobacillus pleuropneumoniae serovar 1 str. 4074; identical to SEQ ID NO: 45875

SEQ ID NO: 80398 - DNA, 1026 bp, Fusobacterium nucleatum subsp. vincentii ATCC 49256; identical to SEQ ID NO: 45876
  CDS (1)..(1026): transl_table=11

SEQ ID NO: 80399 - protein, 341 aa, Fusobacterium nucleatum subsp. vincentii ATCC 49256; identical to SEQ ID NO: 45877

SEQ ID NO: 80400 - DNA, 1050 bp, Psychrobacter sp. 273-4; identical to SEQ ID NO: 45878
  CDS (1)..(1050)

SEQ ID NO: 80401 - protein, 349 aa, Psychrobacter sp. 273-4; identical to SEQ ID NO: 45879

SEQ ID NO: 80402 - DNA, 1044 bp, Dechloromonas aromatica RCB; identical to SEQ ID NO: 45880
  CDS (1)..(1044)

SEQ ID NO: 80403 - protein, 347 aa, Dechloromonas aromatica RCB; identical to SEQ ID NO: 45881

SEQ ID NO: 80404 - DNA, 1035 bp, Rickettsia rickettsii; identical to SEQ ID NO: 45882
  CDS (1)..(1035)

SEQ ID NO: 80405 - protein, 344 aa, Rickettsia rickettsii; identical to SEQ ID NO: 45883

SEQ ID NO: 80406 - DNA, 1029 bp, Haemophilus influenzae R2846; identical to SEQ ID NO: 45884
  CDS (1)..(1029)

SEQ ID NO: 80407 - protein, 342 aa, Haemophilus influenzae R2846; identical to SEQ ID NO: 45885

SEQ ID NO: 80408 - DNA, 1041 bp, Anabaena variabilis ATCC 29413; identical to SEQ ID NO: 45886
  CDS (1)..(1041)

SEQ ID NO: 80409 - protein, 346 aa, Anabaena variabilis ATCC 29413; identical to SEQ ID NO: 45887

SEQ ID NO: 80410 - DNA, 1035 bp, Ralstonia eutropha JMP134; identical to SEQ ID NO: 45888
  CDS (1)..(1035)

SEQ ID NO: 80411 - protein, 344 aa, Ralstonia eutropha JMP134; identical to SEQ ID NO: 45889

SEQ ID NO: 80412 - DNA, 1047 bp, Crocosphaera watsonii WH 8501; identical to SEQ ID NO: 45890
  CDS (1)..(1047)

SEQ ID NO: 80413 - protein, 348 aa, Crocosphaera watsonii WH 8501; identical to SEQ ID NO: 45891

SEQ ID NO: 80414 - DNA, 990 bp, Rubrobacter xylanophilus DSM 9941; identical to SEQ ID NO: 45892
  CDS (1)..(990)

SEQ ID NO: 80415 - protein, 329 aa, Rubrobacter xylanophilus DSM 9941; identical to SEQ ID NO: 45893

SEQ ID NO: 80416 - DNA, 1008 bp, Methanococcoides burtonii DSM 6242; identical to SEQ ID NO: 45894
  CDS (1)..(1008)

SEQ ID NO: 80417 - protein, 335 aa, Methanococcoides burtonii DSM 6242; identical to SEQ ID NO: 45895

SEQ ID NO: 80418 - DNA, 1095 bp, Rhodobacter sphaeroides 2.4.1; identical to SEQ ID NO: 45896
  CDS (1)..(1095)

SEQ ID NO: 80419 - protein, 364 aa, Rhodobacter sphaeroides 2.4.1; identical to SEQ ID NO: 45897

SEQ ID NO: 80420 - DNA, 1035 bp, Magnetospirillum magnetotacticum MS-1; identical to SEQ ID NO: 45898
  CDS (1)..(1035)

SEQ ID NO: 80421 - protein, 344 aa, Magnetospirillum magnetotacticum MS-1; identical to SEQ ID NO: 45899

SEQ ID NO: 80422 - DNA, 1053 bp, Ehrlichia canis str. Jake; identical to SEQ ID NO: 45900
  CDS (1)..(1053)

SEQ ID NO: 80423 - protein, 350 aa, Ehrlichia canis str. Jake; identical to SEQ ID NO: 45901

SEQ ID NO: 80424 - DNA, 1047 bp, Rubrivivax gelatinosus PM1; identical to SEQ ID NO: 45902
  CDS (1)..(1047)

SEQ ID NO: 80425 - protein, 348 aa, Rubrivivax gelatinosus PM1; identical to SEQ ID NO: 45903

SEQ ID NO: 80426 - DNA, 1089 bp, Rhodospirillum rubrum; identical to SEQ ID NO: 45904
  CDS (1)..(1089)

SEQ ID NO: 80427 - protein, 362 aa, Rhodospirillum rubrum; identical to SEQ ID NO: 45905

SEQ ID NO: 80428 - DNA, 1068 bp, Burkholderia fungorum LB400; identical to SEQ ID NO: 45906
  CDS (1)..(1068)

SEQ ID NO: 80429 - protein, 355 aa, Burkholderia fungorum LB400; identical to SEQ ID NO: 45907

SEQ ID NO: 80430 - DNA, 1017 bp, Enterococcus faecium; identical to SEQ ID NO: 45908
  CDS (1)..(1017)

SEQ ID NO: 80431 - protein, 338 aa, Enterococcus faecium; identical to SEQ ID NO: 45909

SEQ ID NO: 80432 - DNA, 1062 bp, Magnetococcus sp. MC-1; identical to SEQ ID NO: 45910
  CDS (1)..(1062)

SEQ ID NO: 80433 - protein, 353 aa, Magnetococcus sp. MC-1; identical to SEQ ID NO: 45911

SEQ ID NO: 80434 - DNA, 1044 bp, Thermobifida fusca; identical to SEQ ID NO: 45912
  CDS (1)..(1044)

SEQ ID NO: 80435 - protein, 347 aa, Thermobifida fusca; identical to SEQ ID NO: 45913

SEQ ID NO: 80436 - DNA, 1638 bp, Methanosarcina barkeri str. fusaro; identical to SEQ ID NO: 45914
  CDS (1)..(1638)

SEQ ID NO: 80437 - protein, 545 aa, Methanosarcina barkeri str. fusaro; identical to SEQ ID NO: 45915

SEQ ID NO: 80438 - DNA, 1026 bp, Geobacter metallireducens GS-15; identical to SEQ ID NO: 45916
  CDS (1)..(1026)

SEQ ID NO: 80439 - protein, 341 aa, Geobacter metallireducens GS-15; identical to SEQ ID NO: 45917

SEQ ID NO: 80440 - DNA, 1053 bp, Novosphingobium aromaticivorans DSM 12444; identical to SEQ ID NO: 45918
  CDS (1)..(1053)

SEQ ID NO: 80441 - protein, 350 aa, Novosphingobium aromaticivorans DSM 12444; identical to SEQ ID NO: 45919

SEQ ID NO: 80442 - DNA, 1596 bp, Ferroplasma acidarmanus; identical to SEQ ID NO: 45920
  CDS (1)..(1596)

SEQ ID NO: 80443 - protein, 531 aa, Ferroplasma acidarmanus; identical to SEQ ID NO: 45921

SEQ ID NO: 80444 - DNA, 1017 bp, Cytophaga hutchinsonii; identical to SEQ ID NO: 45922
  CDS (1)..(1017)

SEQ ID NO: 80445 - protein, 338 aa, Cytophaga hutchinsonii; identical to SEQ ID NO: 45923

SEQ ID NO: 80446 - DNA, 1020 bp, Clostridium thermocellum ATCC 27405; identical to SEQ ID NO: 45924
  CDS (1)..(1020)

SEQ ID NO: 80447 - protein, 339 aa, Clostridium thermocellum ATCC 27405; identical to SEQ ID NO: 45925

SEQ ID NO: 80448 - DNA, 1026 bp, Microbulbifer degradans 2-40; identical to SEQ ID NO: 45926
  CDS (1)..(1026)

SEQ ID NO: 80449 - protein, 341 aa, Microbulbifer degradans 2-40; identical to SEQ ID NO: 45927

SEQ ID NO: 80450 - DNA, 1026 bp, Oenococcus oeni PSU-1; identical to SEQ ID NO: 45928
  CDS (1)..(1026)

SEQ ID NO: 80451 - protein, 341 aa, Oenococcus oeni PSU-1; identical to SEQ ID NO: 45929

SEQ ID NO: 80452 - DNA, 1038 bp, Pediococcus pentosaceus ATCC 25745; identical to SEQ ID NO: 45930
  CDS (1)..(1038)

SEQ ID NO: 80453 - protein, 345 aa, Pediococcus pentosaceus ATCC 25745; identical to SEQ ID NO: 45931

SEQ ID NO: 80454 - DNA, 978 bp, Trichodesmium erythraeum IMS101; identical to SEQ ID NO: 45932
  CDS (1)..(978)

SEQ ID NO: 80455 - protein, 325 aa, Trichodesmium erythraeum IMS101; identical to SEQ ID NO: 45933

SEQ ID NO: 80456 - DNA, 1029 bp, Moorella thermoacetica ATCC 39073; identical to SEQ ID NO: 45934
  CDS (1)..(1029)

SEQ ID NO: 80457 - protein, 342 aa, Moorella thermoacetica ATCC 39073; identical to SEQ ID NO: 45935

SEQ ID NO: 80458 - DNA, 1020 bp, Thiobacillus denitrificans ATCC 25259; identical to SEQ ID NO: 45936
  CDS (1)..(1020)

SEQ ID NO: 80459 - protein, 339 aa, Thiobacillus denitrificans ATCC 25259; identical to SEQ ID NO: 45937

SEQ ID NO: 80460 - DNA, 1098 bp, Silicibacter sp. TM1040; identical to SEQ ID NO: 45938
  CDS (1)..(1098)

SEQ ID NO: 80461 - protein, 365 aa, Silicibacter sp. TM1040; identical to SEQ ID NO: 45939

SEQ ID NO: 80462 - DNA, 1047 bp, Lactobacillus gasseri; identical to SEQ ID NO: 45940
  CDS (1)..(1047)

SEQ ID NO: 80463 - protein, 348 aa, Lactobacillus gasseri; identical to SEQ ID NO: 45941

SEQ ID NO: 80464 - DNA, 1017 bp, Leuconostoc mesenteroides subsp. mesenteroides ATCC 8293; identical to SEQ ID NO: 45942
  CDS (1)..(1017)

SEQ ID NO: 80465 - protein, 338 aa, Leuconostoc mesenteroides subsp. mesenteroides ATCC 8293; identical to SEQ ID NO: 45943

SEQ ID NO: 80466 - DNA, 1008 bp, Exiguobacterium sp. 255-15; identical to SEQ ID NO: 45944
  CDS (1)..(1008)

SEQ ID NO: 80467 - protein, 335 aa, Exiguobacterium sp. 255-15; identical to SEQ ID NO: 45945

SEQ ID NO: 80468 - DNA, 1074 bp, Chloroflexus aurantiacus; identical to SEQ ID NO: 45946
  CDS (1)..(1074)

SEQ ID NO: 80469 - protein, 357 aa, Chloroflexus aurantiacus; identical to SEQ ID NO: 45947

SEQ ID NO: 80470 - DNA, 1002 bp, Polaromonas sp. JS666; identical to SEQ ID NO: 45948
  CDS (1)..(1002)

SEQ ID NO: 80471 - protein, 333 aa, Polaromonas sp. JS666; identical to SEQ ID NO: 45949

SEQ ID NO: 80472 - DNA, 1008 bp, Campylobacter lari RM2100; identical to SEQ ID NO: 45950
  CDS (1)..(1008): transl_table=11

SEQ ID NO: 80473 - protein, 335 aa, Campylobacter lari RM2100; identical to SEQ ID NO: 45951

SEQ ID NO: 80474 - DNA, 1008 bp, Brachydanio rerio; identical to SEQ ID NO: 45952
  CDS (1)..(1008)

SEQ ID NO: 80475 - protein, 335 aa, Brachydanio rerio; identical to SEQ ID NO: 45953

SEQ ID NO: 80476 - DNA, 1143 bp, Oryza sativa; identical to SEQ ID NO: 45954
  CDS (1)..(1143)

SEQ ID NO: 80477 - protein, 380 aa, Oryza sativa; identical to SEQ ID NO: 45955

SEQ ID NO: 80478 - DNA, 1245 bp, Mus musculus; identical to SEQ ID NO: 45956
  CDS (1)..(1245)

SEQ ID NO: 80479 - protein, 414 aa, Mus musculus; identical to SEQ ID NO: 45957

SEQ ID NO: 80480 - DNA, 1023 bp, uncultured bacterium 578; identical to SEQ ID NO: 45958
  CDS (1)..(1023): transl_table=11

SEQ ID NO: 80481 - protein, 340 aa, uncultured bacterium 578; identical to SEQ ID NO: 45959

SEQ ID NO: 80482 - DNA, 957 bp, Spiroplasma kunkelii; identical to SEQ ID NO: 45960
  CDS (1)..(957): transl_table=4

SEQ ID NO: 80483 - protein, 318 aa, Spiroplasma kunkelii; identical to SEQ ID NO: 45961

SEQ ID NO: 80484 - DNA, 1053 bp, Cryptosporidium parvum; identical to SEQ ID NO: 45962
  CDS (1)..(1053)

SEQ ID NO: 80485 - protein, 350 aa, Cryptosporidium parvum; identical to SEQ ID NO: 45963

SEQ ID NO: 80486 - DNA, 972 bp, Drosophila melanogaster; identical to SEQ ID NO: 45964
  CDS (1)..(972)

SEQ ID NO: 80487 - protein, 323 aa, Drosophila melanogaster; identical to SEQ ID NO: 45965

SEQ ID NO: 80488 - DNA, 1245 bp, Homo sapiens; identical to SEQ ID NO: 45966
  CDS (1)..(1245)

SEQ ID NO: 80489 - protein, 414 aa, Homo sapiens; identical to SEQ ID NO: 45967

SEQ ID NO: 80490 - DNA, 1095 bp, Homo sapiens; identical to SEQ ID NO: 45968
  CDS (1)..(1095)

SEQ ID NO: 80491 - protein, 364 aa, Homo sapiens [sequence omitted]

SEQ ID NO: 80492 - DNA, 1014 bp, Caenorhabditis elegans; identical to SEQ ID NO: 45970
  CDS (1)..(1014)

SEQ ID NO: 80493 - protein, 337 aa, Caenorhabditis elegans; identical to SEQ ID NO: 45971

SEQ ID NO: 80494 - DNA, 1026 bp, Riemerella anatipestifer; identical to SEQ ID NO: 45972
  CDS (1)..(1026): transl_table=11

SEQ ID NO: 80495 - protein, 341 aa, Riemerella anatipestifer; identical to SEQ ID NO: 45973

SEQ ID NO: 80496 - DNA, 1008 bp, Aquifex aeolicus; identical to SEQ ID NO: 45974
  CDS (1)..(1008): transl_table=11

SEQ ID NO: 80497 - protein, 335 aa, Aquifex aeolicus; identical to SEQ ID NO: 45975

SEQ ID NO: 80498 - DNA, 1041 bp, Borrelia burgdorferi; identical to SEQ ID NO: 45976
  CDS (1)..(1041): transl_table=11

SEQ ID NO: 80499 - protein, 346 aa, Borrelia burgdorferi; identical to SEQ ID NO: 45977

SEQ ID NO: 80500 - DNA, 1014 bp, Buchnera aphidicola; identical to SEQ ID NO: 45978
  CDS (1)..(1014): transl_table=11

SEQ ID NO: 80501 - protein, 337 aa, Buchnera aphidicola; identical to SEQ ID NO: 45979

SEQ ID NO: 80502 - DNA, 1647 bp, Haloarcula marismortui; identical to SEQ ID NO: 45980
  CDS (1)..(1647): transl_table=11

SEQ ID NO: 80503 - protein, 548 aa, Haloarcula marismortui; identical to SEQ ID NO: 45981

SEQ ID NO: 80504 - DNA, 1023 bp, Helicobacter pylori J99; identical to SEQ ID NO: 45982
  CDS (1)..(1023): transl_table=11

SEQ ID NO: 80505 - protein, 340 aa, Helicobacter pylori J99; identical to SEQ ID NO: 45983

SEQ ID NO: 80506 - DNA, 1608 bp, Methanococcus jannaschii; identical to SEQ ID NO: 45984
  CDS (1)..(1608): transl_table=11

SEQ ID NO: 80507 - protein, 535 aa, Methanococcus jannaschii; identical to SEQ ID NO: 45985

SEQ ID NO: 80508 - DNA, 1605 bp, Methanobacterium thermoautotrophicum; identical to SEQ ID NO: 45986
  CDS (1)..(1605): transl_table=11

SEQ ID NO: 80509 - protein, 534 aa, Methanobacterium thermoautotrophicum; identical to SEQ ID NO: 45987

SEQ ID NO: 80510 - DNA, 1008 bp, Mus musculus; identical to SEQ ID NO: 45988
  CDS (1)..(1008)

SEQ ID NO: 80511 - protein, 335 aa, Mus musculus; identical to SEQ ID NO: 45989

SEQ ID NO: 80512 - DNA, 978 bp, Pasteurella haemolytica; identical to SEQ ID NO: 45990
  CDS (1)..(978): transl_table=11

SEQ ID NO: 80513 - protein, 325 aa, Pasteurella haemolytica; identical to SEQ ID NO: 45991

SEQ ID NO: 80514 - DNA, 975 bp, Pyrococcus abyssi; identical to SEQ ID NO: 45992
  CDS (1)..(975): transl_table=11

SEQ ID NO: 80515 - protein, 324 aa, Pyrococcus abyssi; identical to SEQ ID NO: 45993

SEQ ID NO: 80516 - DNA, 975 bp, Pyrococcus horikoshii; identical to SEQ ID NO: 45994
  CDS (1)..(975)

SEQ ID NO: 80517 - protein, 324 aa, Pyrococcus horikoshii; identical to SEQ ID NO: 45995

SEQ ID NO: 80518 - DNA, 1014 bp, Salmonella typhimurium; identical to SEQ ID NO: 45996
  CDS (1)..(1014): transl_table=11

SEQ ID NO: 80519 - protein, 337 aa, Salmonella typhimurium; identical to SEQ ID NO: 45997

SEQ ID NO: 80520 - DNA, 1047 bp, Synechocystis sp; identical to SEQ ID NO: 45998
  CDS (1)..(1047)

SEQ ID NO: 80521 - protein, 348 aa, Synechocystis sp; identical to SEQ ID NO: 45999

SEQ ID NO: 80522 - DNA, 1059 bp, Treponema pallidum; identical to SEQ ID NO: 46000
  CDS (1)..(1059): transl_table=11

SEQ ID NO: 80523 - protein, 352 aa, Treponema pallidum; identical to SEQ ID NO: 46001

SEQ ID NO: 80524 - DNA, 1008 bp, Xenopus laevis; identical to SEQ ID NO: 46002
  CDS (1)..(1008)

SEQ ID NO: 80525 - protein, 335 aa, Xenopus laevis; identical to SEQ ID NO: 46003

SEQ ID NO: 80526 - DNA, 1224 bp, Saccharomyces cerevisiae; identical to SEQ ID NO: 46004
  CDS (1)..(1224)

SEQ ID NO: 80527 - protein, 407 aa, Saccharomyces cerevisiae; identical to SEQ ID NO: 46005

SEQ ID NO: 80528 - DNA, 23 bp, Primer
atgcgtgtactgggtattgaaac

SEQ ID NO: 80529 - DNA, 21 bp, Primer
ttacgcagccggtaactccgc

SEQ ID NO: 80530 - protein, 510 aa, consensus; identical to SEQ ID NO: 46008
  MISC_FEATURE (1)..(510): consensus for the disclosure of xaa see table XV

SEQ ID NO: 80531 - protein, 43 aa, consensus; identical to SEQ ID NO: 46009
  MISC_FEATURE (1)..(43): consensus for the disclosure of xaa see table XV

SEQ ID NO: 80532 - protein, 120 aa, consensus; identical to SEQ ID NO: 46010
  MISC_FEATURE (1)..(120): consensus for the disclosure of xaa see table XV

SEQ ID NO: 80533 - protein, 59 aa, consensus; identical to SEQ ID NO: 46011
  MISC_FEATURE (1)..(59): consensus for the disclosure of xaa see table XV

SEQ ID NO: 80534 - DNA, 1332 bp, Escherichia coli; identical to SEQ ID NO: 63709
  CDS (1)..(1332)

SEQ ID NO: 80535 - protein, 443 aa, Escherichia coli; identical to SEQ ID NO: 63710

SEQ ID NO: 80536 - DNA, 1305 bp, Vibrio fischeri ES114; identical to SEQ ID NO: 63711
  CDS (1)..(1305)

SEQ ID NO: 80537 - protein, 434 aa, Vibrio fischeri ES114; identical to SEQ ID NO: 63712

SEQ ID NO: 80538 - DNA, 1260 bp, Vibrio fischeri ES114; identical to SEQ ID NO: 63713
  CDS (1)..(1260)

SEQ ID NO: 80539 - protein, 419 aa, Vibrio fischeri ES114; identical to SEQ ID NO: 63714

SEQ ID NO: 80540 - DNA, 1242 bp, Helicobacter pylori 26695; identical to SEQ ID NO: 63715
  CDS (1)..(1242): transl_table=11

SEQ ID NO: 80541 - protein, 413 aa, Helicobacter pylori 26695; identical to SEQ ID NO: 63716

SEQ ID NO: 80542 - DNA, 1254 bp, Vibrio cholerae O1 biovar eltor str. N16961; identical to SEQ ID NO: 63717
  CDS (1)..(1254): transl_table=11

SEQ ID NO: 80543 - protein, 417 aa, Vibrio cholerae O1 biovar eltor str. N16961; identical to SEQ ID NO: 63718

SEQ ID NO: 80544 - DNA, 1242 bp, Pasteurella multocida subsp. multocida str. Pm70; identical to SEQ ID NO: 63719
  CDS (1)..(1242): transl_table=11

SEQ ID NO: 80545 - protein, 413 aa, Pasteurella multocida subsp. multocida str. Pm70; identical to SEQ ID NO: 63720

SEQ ID NO: 80546 - DNA, 1251 bp, Campylobacter jejuni subsp. jejuni NCTC 11168; identical to SEQ ID NO: 63721
  CDS (1)..(1251): transl_table=11

SEQ ID NO: 80547 - protein, 416 aa, Campylobacter jejuni subsp. jejuni NCTC 11168; identical to SEQ ID NO: 63722

SEQ ID NO: 80548 - DNA, 1332 bp, Salmonella typhimurium LT2; identical to SEQ ID NO: 63723
  CDS (1)..(1332): transl_table=11

SEQ ID NO: 80549 - protein, 443 aa, Salmonella typhimurium LT2; identical to SEQ ID NO: 63724

SEQ ID NO: 80550 - DNA, 1332 bp, Salmonella typhimurium LT2; identical to SEQ ID NO: 63725
  CDS (1)..(1332): transl_table=11

SEQ ID NO: 80551 - protein, 443 aa, Salmonella typhimurium LT2; identical to SEQ ID NO: 63726

SEQ ID NO: 80552 - DNA, 1287 bp, Yersinia pestis KIM; identical to SEQ ID NO: 63727
  CDS (1)..(1287): transl_table=11

SEQ ID NO: 80553 - protein, 428 aa, Yersinia pestis KIM; identical to SEQ ID NO: 63728

SEQ ID NO: 80554 - DNA, 1119 bp, Shigella flexneri 2a str. 301; identical to SEQ ID NO: 63729
  CDS (1)..(1119): transl_table=11

SEQ ID NO: 80555 - protein, 372 aa, Shigella flexneri 2a str. 301; identical to SEQ ID NO: 63730

SEQ ID NO: 80556 - DNA, 1332 bp, Shigella flexneri 2a str. 301; identical to SEQ ID NO: 63731
  CDS (1)..(1332): transl_table=11

SEQ ID NO: 80557 - protein, 443 aa, Shigella flexneri 2a str. 301; identical to SEQ ID NO: 63732

SEQ ID NO: 80558 - DNA, 1332 bp, Shigella flexneri 2a str. 301; identical to SEQ ID NO: 63733
  CDS (1)..(1332): transl_table=11

SEQ ID NO: 80559 - protein, 443 aa, Shigella flexneri 2a str. 301; identical to SEQ ID NO: 63734

SEQ ID NO: 80560 - DNA, 1272 bp, Shigella flexneri 2a str. 301; identical to SEQ ID NO: 63735
  CDS (1)..(1272): transl_table=11

SEQ ID NO: 80561 - protein, 423 aa, Shigella flexneri 2a str. 301; identical to SEQ ID NO: 63736

SEQ ID NO: 80562 - DNA, 1293 bp, Shewanella oneidensis MR-1; identical to SEQ ID NO: 63737
  CDS (1)..(1293): transl_table=11

SEQ ID NO: 80563 - protein, 430 aa, Shewanella oneidensis MR-1; identical to SEQ ID NO: 63738

SEQ ID NO: 80564 - DNA, 1281 bp, Lactobacillus plantarum WCFS1; identical to SEQ ID NO: 63739
  CDS (1)..(1281): transl_table=11

SEQ ID NO: 80565 - protein, 426 aa, Lactobacillus plantarum WCFS1; identical to SEQ ID NO: 63740

SEQ ID NO: 80566 - DNA, 1326 bp, Vibrio parahaemolyticus RIMD 2210633; identical to SEQ ID NO: 63741
  CDS (1)..(1326): transl_table=11

SEQ ID NO: 80567 - protein, 441 aa, Vibrio parahaemolyticus RIMD 2210633; identical to SEQ ID NO: 63742

SEQ ID NO: 80568 - DNA, 1257 bp, Vibrio parahaemolyticus RIMD 2210633; identical to SEQ ID NO: 63743
  CDS (1)..(1257): transl_table=11

SEQ ID NO: 80569 - protein, 418 aa, Vibrio parahaemolyticus RIMD 2210633; identical to SEQ ID NO: 63744

SEQ ID NO: 80570 - DNA, 1230 bp, Salmonella enterica subsp. enterica serovar Typhi Ty2; identical to SEQ ID NO: 63745
  CDS (1)..(1230): transl_table=11

SEQ ID NO: 80571 - protein, 409 aa, Salmonella enterica subsp. enterica serovar Typhi Ty2; identical to SEQ ID NO: 63746

SEQ ID NO: 80572 - DNA, 1320 bp, Bacillus cereus ATCC 14579; identical to SEQ ID NO: 63747
  CDS (1)..(1320): transl_table=11

SEQ ID NO: 80573 - protein, 439 aa, Bacillus cereus ATCC 14579; identical to SEQ ID NO: 63748

SEQ ID NO: 80574 - DNA, 1380 bp, Helicobacter hepaticus ATCC 51449; identical to SEQ ID NO: 63749
  CDS (1)..(1380): transl_table=11

SEQ ID NO: 80575 - protein, 459 aa, Helicobacter hepaticus ATCC 51449; identical to SEQ ID NO: 63750

SEQ ID NO: 80576 - DNA, 1290 bp, Wigglesworthia glossinidia endosymbiont of Glossina brevipalpis; identical to SEQ ID NO: 63751
  CDS (1)..(1290): transl_table=11

SEQ ID NO: 80577 - protein, 429 aa, Wigglesworthia glossinidia endosymbiont of Glossina brevipalpis; identical to SEQ ID NO: 63752

SEQ ID NO: 80578 - DNA, 1299 bp, Chromobacterium violaceum ATCC 12472; identical to SEQ ID NO: 63753
  CDS (1)..(1299): transl_table=11

SEQ ID NO: 80579 - protein, 432 aa, Chromobacterium violaceum ATCC 12472; identical to SEQ ID NO: 63754

SEQ ID NO: 80580 - DNA, 1299 bp, Photorhabdus luminescens subsp. laumondii TTO1; identical to SEQ ID NO: 63755
  CDS (1)..(1299): transl_table=11

SEQ ID NO: 80581 - protein, 432 aa, Photorhabdus luminescens subsp. laumondii TTO1; identical to SEQ ID NO: 63756

SEQ ID NO: 80582 - DNA, 1254 bp, Vibrio vulnificus YJ016; identical to SEQ ID NO: 63757
  CDS (1)..(1254): transl_table=11

SEQ ID NO: 80583 - protein, 417 aa, Vibrio vulnificus YJ016; identical to SEQ ID NO: 63758

SEQ ID NO: 80584 - DNA, 1344 bp, Corynebacterium diphtheriae NCTC 13129; identical to SEQ ID NO: 63759
  CDS (1)..(1344): transl_table=11

SEQ ID NO: 80585 - protein, 447 aa, Corynebacterium diphtheriae NCTC 13129; identical to SEQ ID NO: 63760

SEQ ID NO: 80586 - DNA, 1320 bp, Bacillus thuringiensis serovar konkukian str. 97-27; identical to SEQ ID NO: 63761
  CDS (1)..(1320): transl_table=11

SEQ ID NO: 80587 - protein, 439 aa, Bacillus thuringiensis serovar konkukian str. 97-27; identical to SEQ ID NO: 63762

SEQ ID NO: 80588 - DNA, 1290 bp, Erwinia carotovora subsp. atroseptica SCRI1043; identical to SEQ ID NO: 63763
  CDS (1)..(1290)

SEQ ID NO: 80589 - protein, 429 aa, Erwinia carotovora subsp. atroseptica SCRI1043; identical to SEQ ID NO: 63764

SEQ ID NO: 80590 - DNA, 1416 bp, Propionibacterium acnes KPA171202; identical to SEQ ID NO: 63765
  CDS (1)..(1416): transl_table=11

SEQ ID NO: 80591 - protein, 471 aa, Propionibacterium acnes KPA171202; identical to SEQ ID NO: 63766

SEQ ID NO: 80592 - DNA, 1302 bp, Yersinia pseudotuberculosis IP 32953; identical to SEQ ID NO: 63767
  CDS (1)..(1302): transl_table=11

SEQ ID NO: 80593 - protein, 433 aa, Yersinia pseudotuberculosis IP 32953; identical to SEQ ID NO: 63768

SEQ ID NO: 80594 - DNA, 1296 bp, Legionella pneumophila str. Lens; identical to SEQ ID NO: 63769
  CDS (1)..(1296): transl_table=11

SEQ ID NO: 80595 - protein, 431 aa, Legionella pneumophila str. Lens; identical to SEQ ID NO: 63770

SEQ ID NO: 80596 - DNA, 1254 bp, Photobacterium profundum SS9; identical to SEQ ID NO: 63771
  CDS (1)..(1254): transl_table=11

SEQ ID NO: 80597 - protein, 417 aa, Photobacterium profundum SS9; identical to SEQ ID NO: 63772

SEQ ID NO: 80598 - DNA, 1257 bp, Photobacterium profundum SS9; identical to SEQ ID NO: 63773
  CDS (1)..(1257): transl_table=11

SEQ ID NO: 80599 - protein, 418 aa, Photobacterium profundum SS9; identical to SEQ ID NO: 63774

SEQ ID NO: 80600 - DNA, 1332 bp, Photobacterium profundum SS9; identical to SEQ ID NO: 63775
  CDS (1)..(1332): transl_table=11

SEQ ID NO: 80601 - protein, 443 aa, Photobacterium profundum SS9; identical to SEQ ID NO: 63776

SEQ ID NO: 80602 - DNA, 1395 bp, Photobacterium profundum SS9; identical to SEQ ID NO: 63777
  CDS (1)..(1395): transl_table=11

SEQ ID NO: 80603 - protein, 464 aa, Photobacterium profundum SS9; identical to SEQ ID NO: 63778

SEQ ID NO: 80604 - DNA, 1329 bp, Zymomonas mobilis subsp. mobilis ZM4; identical to SEQ ID NO: 63779
  CDS (1)..(1329): transl_table=11

SEQ ID NO: 80605 - protein, 442 aa, Zymomonas mobilis subsp. mobilis ZM4; identical to SEQ ID NO: 63780

SEQ ID NO: 80606 - DNA, 1263 bp, Francisella tularensis subsp. tularensis Schu 4; identical to SEQ ID NO: 63781
  CDS (1)..(1263): transl_table=11

SEQ ID NO: 80607 - protein, 420 aa, Francisella tularensis subsp. tularensis Schu 4; identical to SEQ ID NO: 63782

SEQ ID NO: 80608 - DNA, 1224 bp, Francisella tularensis subsp. tularensis Schu 4; identical to SEQ ID NO: 63783
  CDS (1)..(1224): transl_table=11

SEQ ID NO: 80609 - protein, 407 aa, Francisella tularensis subsp. tularensis Schu 4; identical to SEQ ID NO: 63784

SEQ ID NO: 80610 - DNA, 1251 bp, Campylobacter jejuni RM1221; identical to SEQ ID NO: 63785
  CDS (1)..(1251): transl_table=11

SEQ ID NO: 80611 - protein, 416 aa, Campylobacter jejuni RM1221; identical to SEQ ID NO: 63786

SEQ ID NO: 80612 - DNA, 1278 bp, Pseudomonas syringae pv. syringae B728a; identical to SEQ ID NO: 63787
  CDS (1)..(1278)

SEQ ID NO: 80613 - protein, 425 aa, Pseudomonas syringae pv. syringae B728a; identical to SEQ ID NO: 63788

SEQ ID NO: 80614 - DNA, 1230 bp, Actinobacillus pleuropneumoniae serovar 1 str. 4074; identical to SEQ ID NO: 63789
  CDS (1)..(1230)

SEQ ID NO: 80615 - protein, 409 aa, Actinobacillus pleuropneumoniae serovar 1 str. 4074; identical to SEQ ID NO: 63790

SEQ ID NO: 80616 - DNA, 1281 bp, Pseudomonas fluorescens PfO-1; identical to SEQ ID NO: 63791
  CDS (1)..(1281)

SEQ ID NO: 80617 - protein, 426 aa, Pseudomonas fluorescens PfO-1; identical to SEQ ID NO: 63792

SEQ ID NO: 80618 - DNA, 1284 bp, Campylobacter lari RM2100; identical to SEQ ID NO: 63793
  CDS (1)..(1284): transl_table=11

SEQ ID NO: 80619 - protein, 427 aa, Campylobacter lari RM2100; identical to SEQ ID NO: 63794

SEQ ID NO: 80620 - DNA, 1296 bp, Aeromonas salmonicida; identical to SEQ ID NO: 63795
  CDS (1)..(1296): transl_table=11

SEQ ID NO: 80621 - protein, 431 aa, Aeromonas salmonicida; identical to SEQ ID NO: 63796

SEQ ID NO: 80622 - DNA, 1299 bp, Citrobacter freundii; identical to SEQ ID NO: 63797
  CDS (1)..(1299): transl_table=11

SEQ ID NO: 80623 - protein, 432 aa, Citrobacter freundii; identical to SEQ ID NO: 63798

SEQ ID NO: 80624 - DNA, 1290 bp, Escherichia coli; identical to SEQ ID NO: 63799
  CDS (1)..(1290): transl_table=11

SEQ ID NO: 80625 - protein, 429 aa, Escherichia coli; identical to SEQ ID NO: 63800

SEQ ID NO: 80626 - DNA, 1239 bp, Haemophilus influenzae; identical to SEQ ID NO: 63801
  CDS (1)..(1239): transl_table=11

SEQ ID NO: 80627 - protein, 412 aa, Haemophilus influenzae; identical to SEQ ID NO: 63802

SEQ ID NO: 80628 - DNA, 1290 bp, Shigella flexneri; identical to SEQ ID NO: 63803
  CDS (1)..(1290)

SEQ ID NO: 80629 - protein, 429 aa, Shigella flexneri; identical to SEQ ID NO: 63804

SEQ ID NO: 80630 - DNA, 1332 bp, Escherichia coli; identical to SEQ ID NO: 63805
  CDS (1)..(1332)

SEQ ID NO: 80631 - protein, 443 aa, Escherichia coli; identical to SEQ ID NO: 63806

SEQ ID NO: 80632 - DNA, 1272 bp, Escherichia coli; identical to SEQ ID NO: 63807
  CDS (1)..(1272): transl_table=11

SEQ ID NO: 80633 - protein, 423 aa, Escherichia coli; identical to SEQ ID NO: 63808

SEQ ID NO: 80634 - DNA, 26 bp, Primer
atgagtacttcagatagcattgtatc

SEQ ID NO: 80635 - DNA, 27 bp, Primer
ttaaaacagtttgtatacgatgttcag

SEQ ID NO: 80636 - protein, 463 aa, consensus; identical to SEQ ID NO: 63811
  MISC_FEATURE (1)..(463): consensus for the disclosure of xaa see table XV

SEQ ID NO: 80637 - protein, 54 aa, consensus; identical to SEQ ID NO: 63812
  MISC_FEATURE (1)..(54): consensus for the disclosure of xaa see table XV

SEQ ID NO: 80638 - protein, 40 aa, consensus; identical to SEQ ID NO: 63813
  MISC_FEATURE (1)..(40): consensus for the disclosure of xaa see table XV

SEQ ID NO: 80639 - protein, 42 aa, consensus; identical to SEQ ID NO: 63814
  MISC_FEATURE (1)..(42): consensus for the disclosure of xaa see table XV

SEQ ID NO: 80640 - protein, 24 aa, consensus
  MISC_FEATURE (1)..(24): consensus for the disclosure of xaa see table XV
XXXXXXXXXXXXXXXXXXXXXXXX

SEQ ID NO: 80641 - protein, 37 aa, consensus; identical to SEQ ID NO: 63816
  MISC_FEATURE (1)..(37): consensus for the disclosure of xaa see table XV

SEQ ID NO: 80642 - protein, 31 aa, consensus; identical to SEQ ID NO: 63817
  MISC_FEATURE (1)..(31): consensus for the disclosure of xaa see table XV

SEQ ID NO: 80643 - protein, 59 aa, consensus; identical to SEQ ID NO: 63818
  MISC_FEATURE (1)..(59): consensus for the disclosure of xaa see table XV

SEQ ID NO: 80644 - DNA, 1008 bp, Escherichia coli; identical to SEQ ID NO: 42264
  CDS (1)..(1008)

SEQ ID NO: 80645 - protein, 335 aa, Escherichia coli; identical to SEQ ID NO: 42265

SEQ ID NO: 80646 - DNA, 1014 bp, Staphylococcus aureus subsp. aureus COL; identical to SEQ ID NO: 42266
  CDS (1)..(1014)

SEQ ID NO: 80647 - protein, 337 aa, Staphylococcus aureus subsp. aureus COL; identical to SEQ ID NO: 42267

SEQ ID NO: 80648 - DNA, 1176 bp, Xanthomonas oryzae pv. oryzae KACC10331; identical to SEQ ID NO: 42268
  CDS (1)..(1176)

SEQ ID NO: 80649 - protein, 391 aa, Xanthomonas oryzae pv. oryzae KACC10331; identical to SEQ ID NO: 42269

SEQ ID NO: 80650 - DNA, 1008 bp, Bacillus halodurans C-125; identical to SEQ ID NO: 42270
  CDS (1)..(1008): transl_table=11

SEQ ID NO: 80651 - protein, 335 aa, Bacillus halodurans C-125; identical to SEQ ID NO: 42271

SEQ ID NO: 80652 - DNA, 1002 bp, Pseudomonas aeruginosa PAO1; identical to SEQ ID NO: 42272
  CDS (1)..(1002): transl_table=11

SEQ ID NO: 80653 - protein, 333 aa, Pseudomonas aeruginosa PAO1; identical to SEQ ID NO: 42273

SEQ ID NO: 80654 - DNA, 1017 bp, Halobacterium salinarum NRC-1; identical to SEQ ID NO: 42274
  CDS (1)..(1017): transl_table=11

SEQ ID NO: 80655 - protein, 338 aa, Halobacterium salinarum NRC-1; identical to SEQ ID NO: 42275

SEQ ID NO: 80656 - DNA, 1017 bp, Deinococcus radiodurans R1; identical to SEQ ID NO: 42276
  CDS (1)..(1017): transl_table=11

SEQ ID NO: 80657 - protein, 338 aa, Deinococcus radiodurans R1; identical to SEQ ID NO: 42277

SEQ ID NO: 80658 - DNA, 1044 bp, Mycoplasma pulmonis UAB CTIP; identical to SEQ ID NO: 42278
  CDS (1)..(1044): transl_table=4

SEQ ID NO: 80659 - protein, 347 aa, Mycoplasma pulmonis UAB CTIP; identical to SEQ ID NO: 42279

SEQ ID NO: 80660 - DNA, 1008 bp, Agrobacterium tumefaciens str. C58; identical to SEQ ID NO: 42280
  CDS (1)..(1008): transl_table=11

SEQ ID NO: 80661 - protein, 335 aa, Agrobacterium tumefaciens str. C58; identical to SEQ ID NO: 42281

SEQ ID NO: 80662 - DNA, 1026 bp, Staphylococcus aureus subsp. aureus Mu50; identical to SEQ ID NO: 42282
  CDS (1)..(1026): transl_table=11

SEQ ID NO: 80663 - protein, 341 aa, Staphylococcus aureus subsp. aureus Mu50; identical to SEQ ID NO: 42283

SEQ ID NO: 80664 - DNA, 990 bp, Sinorhizobium meliloti 1021; identical to SEQ ID NO: 42284
  CDS (1)..(990): transl_table=11

SEQ ID NO: 80665 - protein, 329 aa, Sinorhizobium meliloti 1021; identical to SEQ ID NO: 42285

SEQ ID NO: 80666 - DNA, 1014 bp, Caulobacter crescentus CB15; identical to SEQ ID NO: 42286
  CDS (1)..(1014): transl_table=11

SEQ ID NO: 80667 - protein, 337 aa, Caulobacter crescentus CB15; identical to SEQ ID NO: 42287

SEQ ID NO: 80668 - DNA, 1008 bp, Salmonella typhimurium LT2; identical to SEQ ID NO: 42288
  CDS (1)..(1008): transl_table=11

SEQ ID NO: 80669 - protein, 335 aa, Salmonella typhimurium LT2; identical to SEQ ID NO: 42289

SEQ ID NO: 80670 - DNA, 996 bp, Listeria innocua Clip11262; identical to SEQ ID NO: 42290
  CDS (1)..(996): transl_table=11

SEQ ID NO: 80671 - protein, 331 aa, Listeria innocua Clip11262; identical to SEQ ID NO: 42291

SEQ ID NO: 80672 - DNA, 1053 bp, Ralstonia solanacearum GMI1000; identical to SEQ ID NO: 42292
  CDS (1)..(1053): transl_table=11

SEQ ID NO: 80673 - protein, 350 aa, Ralstonia solanacearum GMI1000; identical to SEQ ID NO: 42293

SEQ ID NO: 80674 - DNA, 1002 bp, Agrobacterium tumefaciens str. C58; identical to SEQ ID NO: 42294
  CDS (1)..(1002): transl_table=11

SEQ ID NO: 80675 - protein, 333 aa, Agrobacterium tumefaciens str. C58; identical to SEQ ID NO: 42295

SEQ ID NO: 80676 - DNA, 984 bp, Brucella melitensis 16M; identical to SEQ ID NO: 42296
  CDS (1)..(984): transl_table=11

SEQ ID NO: 80677 - protein, 327 aa, Brucella melitensis 16M; identical to SEQ ID NO: 42297

SEQ ID NO: 80678 - DNA, 981 bp, Corynebacterium glutamicum ATCC 13032; identical to SEQ ID NO: 42298
  CDS (1)..(981): transl_table=11

SEQ ID NO: 80679 - protein, 326 aa, Corynebacterium glutamicum ATCC 13032; identical to SEQ ID NO: 42299

SEQ ID NO: 80680 - DNA, 999 bp, Streptococcus pyogenes MGAS8232; identical to SEQ ID NO: 42300
  CDS (1)..(999): transl_table=11

SEQ ID NO: 80681 - protein, 332 aa, Streptococcus pyogenes MGAS8232; identical to SEQ ID NO: 42301

SEQ ID NO: 80682 - DNA, 1101 bp, Streptomyces coelicolor A3(2); identical to SEQ ID NO: 42302
  CDS (1)..(1101)

SEQ ID NO: 80683 - protein, 366 aa, Streptomyces coelicolor A3(2); identical to SEQ ID NO: 42303

SEQ ID NO: 80684 - DNA, 1110 bp, Xanthomonas axonopodis pv. citri str. 306; identical to SEQ ID NO: 42304
  CDS (1)..(1110): transl_table=11

SEQ ID NO: 80685 - protein, 369 aa, Xanthomonas axonopodis pv. citri str. 306; identical to SEQ ID NO: 42305

SEQ ID NO: 80686 - DNA, 1056 bp, Yersinia pestis KIM; identical to SEQ ID NO: 42306
  CDS (1)..(1056): transl_table=11

SEQ ID NO: 80687 - protein, 351 aa, Yersinia pestis KIM; identical to SEQ ID NO: 42307

SEQ ID NO: 80688 - DNA, 1002 bp, Oceanobacillus iheyensis HTE831; identical to SEQ ID NO: 42308
  CDS (1)..(1002): transl_table=11

SEQ ID NO: 80689 - protein, 333 aa, Oceanobacillus iheyensis HTE831; identical to SEQ ID NO: 42309

SEQ ID NO: 80690 - DNA, 912 bp, Oceanobacillus iheyensis HTE831; identical to SEQ ID NO: 42310
  CDS (1)..(912): transl_table=11

SEQ ID NO: 80691 - protein, 303 aa, Oceanobacillus iheyensis HTE831; identical to SEQ ID NO: 42311

SEQ ID NO: 80692 - DNA, 1020 bp, Oceanobacillus iheyensis HTE831; identical to SEQ ID NO: 42312
  CDS (1)..(1020): transl_table=11

SEQ ID NO: 80693 - protein, 339 aa, Oceanobacillus iheyensis HTE831; identical to SEQ ID NO: 42313

SEQ ID NO: 80694 - DNA, 987 bp, Streptococcus agalactiae NEM316; identical to SEQ ID NO: 42314
  CDS (1)..(987): transl_table=11

SEQ ID NO: 80695 - protein, 328 aa, Streptococcus agalactiae NEM316; identical to SEQ ID NO: 42315

SEQ ID NO: 80696 - DNA, 1041 bp, Corynebacterium efficiens YS-314; identical to SEQ ID NO: 42316
  CDS (1)..(1041): transl_table=11

SEQ ID NO: 80697 - protein, 346 aa, Corynebacterium efficiens YS-314; identical to SEQ ID NO: 42317

SEQ ID NO: 80698 - DNA, 966 bp, Corynebacterium efficiens YS-314; identical to SEQ ID NO: 42318
  CDS (1)..(966): transl_table=11

SEQ ID NO: 80699 - protein, 321 aa, Corynebacterium efficiens YS-314; identical to SEQ ID NO: 42319

SEQ ID NO: 80700 - DNA, 1005 bp, Pseudomonas putida KT2440; identical to SEQ ID NO: 42320
  CDS (1)..(1005): transl_table=11

SEQ ID NO: 80701 - protein, 334 aa, Pseudomonas putida KT2440; identical to SEQ ID NO: 42321

SEQ ID NO: 80702 - DNA, 981 bp, Pseudomonas putida KT2440; identical to SEQ ID NO: 42322
  CDS (1)..(981): transl_table=11

SEQ ID NO: 80703 - protein, 326 aa, Pseudomonas putida KT2440; identical to SEQ ID NO: 42323

SEQ ID NO: 80704 - DNA, 996 bp, Staphylococcus epidermidis ATCC 12228; identical to SEQ ID NO: 42324
  CDS (1)..(996): transl_table=11

SEQ ID NO: 80705 - protein, 331 aa, Staphylococcus epidermidis ATCC 12228; identical to SEQ ID NO: 42325

SEQ ID NO: 80706 - DNA, 1047 bp, Staphylococcus epidermidis ATCC 12228; identical to SEQ ID NO: 42326
  CDS (1)..(1047): transl_table=11

SEQ ID NO: 80707 - protein, 348 aa, Staphylococcus epidermidis ATCC 12228; identical to SEQ ID NO: 42327

SEQ ID NO: 80708 - DNA, 1008 bp, Bradyrhizobium japonicum USDA 110; identical to SEQ ID NO: 42328
  CDS (1)..(1008)

SEQ ID NO: 80709 - protein, 335 aa, Bradyrhizobium japonicum USDA 110; identical to SEQ ID NO: 42329

SEQ ID NO: 80710 - DNA, 1014 bp, Bradyrhizobium japonicum USDA 110; identical to SEQ ID NO: 42330
  CDS (1)..(1014)

SEQ ID NO: 80711 - protein, 337 aa, Bradyrhizobium japonicum USDA 110; identical to SEQ ID NO: 42331

SEQ ID NO: 80712 - DNA, 1002 bp, Pseudomonas syringae pv. tomato str. DC3000; identical to SEQ ID NO: 42332
  CDS (1)..(1002): transl_table=11

SEQ ID NO: 80713 - protein, 333 aa, Pseudomonas syringae pv. tomato str. DC3000; identical to SEQ ID NO: 42333

SEQ ID NO: 80714 - DNA, 987 bp, Enterococcus faecalis V583; identical to SEQ ID NO: 42334
  CDS (1)..(987): transl_table=11

SEQ ID NO: 80715 - protein, 328 aa, Enterococcus faecalis V583; identical to SEQ ID NO: 42335

SEQ ID NO: 80716 - DNA, 1017 bp, Streptomyces avermitilis MA-4680; identical to SEQ ID NO: 42336
  CDS (1)..(1017)

SEQ ID NO: 80717 - protein, 338 aa, Streptomyces avermitilis MA-4680; identical to SEQ ID NO: 42337

SEQ ID NO: 80718 - DNA, 1008 bp, Streptomyces avermitilis MA-4680; identical to SEQ ID NO: 42338
  CDS (1)..(1008)

SEQ ID NO: 80719 - protein, 335 aa, Streptomyces avermitilis MA-4680; identical to SEQ ID NO: 42339

SEQ ID NO: 80720 - DNA, 972 bp, Bordetella bronchiseptica RB50; identical to SEQ ID NO: 42340
  CDS (1)..(972): transl_table=11

SEQ ID NO: 80721 - protein, 323 aa, Bordetella bronchiseptica RB50; identical to SEQ ID NO: 42341

SEQ ID NO: 80722 - DNA, 1026 bp, Bordetella bronchiseptica RB50; identical to SEQ ID NO: 42342
  CDS (1)..(1026): transl_table=11

SEQ ID NO: 80723 - protein, 341 aa, Bordetella bronchiseptica RB50; identical to SEQ ID NO: 42343

SEQ ID NO: 80724 - DNA, 1032 bp, Chromobacterium violaceum ATCC 12472; identical to SEQ ID NO: 42344
  CDS (1)..(1032): transl_table=11

SEQ ID NO: 80725 - protein, 343 aa, Chromobacterium violaceum ATCC 12472; identical to SEQ ID NO: 42345

SEQ ID NO: 80726 - DNA, 1017 bp, Rhodopseudomonas palustris CGA009; identical to SEQ ID NO: 42346
  CDS (1)..(1017): transl_table=11

SEQ ID NO: 80727 - protein, 338 aa, Rhodopseudomonas palustris CGA009; identical to SEQ ID NO: 42347

SEQ ID NO: 80728 - DNA, 1122 bp, Mycobacterium avium subsp. paratuberculosis str. k10; identical to SEQ ID NO: 42348
  CDS (1)..(1122): transl_table=11

SEQ ID NO: 80729 - protein, 373 aa, Mycobacterium avium subsp. paratuberculosis str. k10; identical to SEQ ID NO: 42349

SEQ ID NO: 80730 - DNA, 1032 bp, Mycobacterium avium subsp. paratuberculosis str. k10; identical to SEQ ID NO: 42350
  CDS (1)..(1032): transl_table=11

SEQ ID NO: 80731 - protein, 343 aa, Mycobacterium avium subsp. paratuberculosis str. k10; identical to SEQ ID NO: 42351

SEQ ID NO: 80732 - DNA, 1011 bp, Bdellovibrio bacteriovorus HD100; identical to SEQ ID NO: 42352
  CDS (1)..(1011): transl_table=11

SEQ ID NO: 80733 - protein, 336 aa, Bdellovibrio bacteriovorus HD100; identical to SEQ ID NO: 42353

SEQ ID NO: 80734 - DNA, 972 bp, Anopheles gambiae str. PEST; identical to SEQ ID NO: 42354
  CDS (1)..(972)

SEQ ID NO: 80735 - protein, 323 aa, Anopheles gambiae str. PEST; identical to SEQ ID NO: 42355

SEQ ID NO: 80736 - DNA, 1014 bp, Staphylococcus aureus subsp. aureus MRSA252; identical to SEQ ID NO: 42356
  CDS (1)..(1014): transl_table=11

SEQ ID NO: 80737 - protein, 337 aa, Staphylococcus aureus subsp. aureus MRSA252; identical to SEQ ID NO: 42357

SEQ ID NO: 80738 - DNA, 1023 bp, Acinetobacter sp. ADP1; identical to SEQ ID NO: 42358
  CDS (1)..(1023): transl_table=11

SEQ ID NO: 80739 - protein, 340 aa, Acinetobacter sp. ADP1; identical to SEQ ID NO: 42359

SEQ ID NO: 80740 - DNA, 981 bp, Erwinia carotovora subsp. atroseptica SCRI1043; identical to SEQ ID NO: 42360
  CDS (1)..(981)

SEQ ID NO: 80741 - protein, 326 aa, Erwinia carotovora subsp. atroseptica SCRI1043; identical to SEQ ID NO: 42361

SEQ ID NO: 80742 - DNA, 981 bp, Propionibacterium acnes KPA171202; identical to SEQ ID NO: 42362
  CDS (1)..(981): transl_table=11

SEQ ID NO: 80743 - protein, 326 aa, Propionibacterium acnes KPA171202; identical to SEQ ID NO: 42363

SEQ ID NO: 80744 - DNA, 1014 bp, Symbiobacterium thermophilum IAM 14863; identical to SEQ ID NO: 42364
  CDS (1)..(1014): transl_table=11

SEQ ID NO: 80745 - protein, 337 aa, Symbiobacterium thermophilum IAM 14863; identical to SEQ ID NO: 42365

SEQ ID NO: 80746 - DNA, 993 bp, Bacillus licheniformis ATCC 14580; identical to SEQ ID NO: 42366
  CDS (1)..(993): transl_table=11

SEQ ID NO: 80747 - protein, 330 aa, Bacillus licheniformis ATCC 14580; identical to SEQ ID NO: 42367

SEQ ID NO: 80748 - DNA, 1038 bp, Mannheimia succiniciproducens MBEL55E; identical to SEQ ID NO: 42368
  CDS (1)..(1038): transl_table=11

SEQ ID NO: 80749 - protein, 345 aa, Mannheimia succiniciproducens MBEL55E; identical to SEQ ID NO: 42369

SEQ ID NO: 80750 - DNA, 1008 bp, Bacillus licheniformis ATCC 14580; identical to SEQ ID NO: 42370
  CDS (1)..(1008): transl_table=11

SEQ ID NO: 80751 - protein, 335 aa, Bacillus licheniformis ATCC 14580; identical to SEQ ID NO: 42371

SEQ ID NO: 80752 - DNA, 1002 bp, Burkholderia mallei ATCC 23344; identical to SEQ ID NO: 42372
  CDS (1)..(1002): transl_table=11

SEQ ID NO: 80753 - protein, 333 aa, Burkholderia mallei ATCC 23344; identical to SEQ ID NO: 42373

SEQ ID NO: 80754 - DNA, 1059 bp, Burkholderia pseudomallei K96243; identical to SEQ ID NO: 42374
  CDS (1)..(1059): transl_table=11

SEQ ID NO: 80755 - protein, 352 aa, Burkholderia pseudomallei K96243; identical to SEQ ID NO: 42375

SEQ ID NO: 80756 - DNA, 1185 bp, Nocardia farcinica IFM 10152; identical to SEQ ID NO: 42376
  CDS (1)..(1185): transl_table=11

SEQ ID NO: 80757 - protein, 394 aa, Nocardia farcinica IFM 10152; identical to SEQ ID NO: 42377

SEQ ID NO: 80758 - DNA, 1032 bp, Nocardia farcinica IFM 10152; identical to SEQ ID NO: 42378
  CDS (1)..(1032): transl_table=11

SEQ ID NO: 80759 - protein, 343 aa, Nocardia farcinica IFM 10152; identical to SEQ ID NO: 42379

SEQ ID NO: 80760 - DNA, 993 bp, Nocardia farcinica IFM 10152; identical to SEQ ID NO: 42380
  CDS (1)..(993): transl_table=11

SEQ ID NO: 80761 - protein, 330 aa, Nocardia farcinica IFM 10152; identical to SEQ ID NO: 42381

SEQ ID NO: 80762 - DNA, 1029 bp, Haloarcula marismortui ATCC 43049; identical to SEQ ID NO: 42382
  CDS (1)..(1029): transl_table=11

SEQ ID NO: 80763 - protein, 342 aa, Haloarcula marismortui ATCC 43049; identical to SEQ ID NO: 42383

SEQ ID NO: 80764 - DNA, 1011 bp, Geobacillus kaustophilus HTA426; identical to SEQ ID NO: 42384
  CDS (1)..(1011): transl_table=11

SEQ ID NO: 80765 - protein, 336 aa, Geobacillus kaustophilus HTA426; identical to SEQ ID NO: 42385

SEQ ID NO: 80766 - DNA, 984 bp, Idiomarina loihiensis L2TR; identical to SEQ ID NO: 42386
  CDS (1)..(984): transl_table=11

SEQ ID NO: 80767 - protein, 327 aa, Idiomarina loihiensis L2TR; identical to SEQ ID NO: 42387

SEQ ID NO: 80768 - DNA, 1005 bp, Silicibacter pomeroyi DSS-3; identical to SEQ ID NO: 42388
  CDS (1)..(1005): transl_table=11

SEQ ID NO: 80769 - protein, 334 aa, Silicibacter pomeroyi DSS-3; identical to SEQ ID NO: 42389

SEQ ID NO: 80770 - DNA, 999 bp, Bacillus clausii KSM-K16; identical to SEQ ID NO: 42390
  CDS (1)..(999): transl_table=11

SEQ ID NO: 80771 - protein, 332 aa, Bacillus clausii KSM-K16; identical to SEQ ID NO: 42391

SEQ ID NO: 80772 - DNA, 1005 bp, Bacillus clausii KSM-K16; identical to SEQ ID NO: 42392
  CDS (1)..(1005): transl_table=11

SEQ ID NO: 80773 - protein, 334 aa, Bacillus clausii KSM-K16; identical to SEQ ID NO: 42393

SEQ ID NO: 80774 - DNA, 984 bp, Rhodobacter sphaeroides 2.4.1; identical to SEQ ID NO: 42394
  CDS (1)..(984)

SEQ ID NO: 80775 - protein, 327 aa, Rhodobacter sphaeroides 2.4.1; identical to SEQ ID NO: 42395

SEQ ID NO: 80776 - DNA, 996 bp, Azotobacter vinelandii; identical to SEQ ID NO: 42396
  CDS (1)..(996)

SEQ ID NO: 80777 - protein, 331 aa, Azotobacter vinelandii; identical to SEQ ID NO: 42397

SEQ ID NO: 80778 - DNA, 1050 bp, Actinobacillus pleuropneumoniae serovar 1 str. 4074; identical to SEQ ID NO: 42398
  CDS (1)..(1050)

SEQ ID NO: 80779 - protein, 349 aa, Actinobacillus pleuropneumoniae serovar 1 str. 4074; identical to SEQ ID NO: 42399

SEQ ID NO: 80780 - DNA, 972 bp, Pseudomonas aeruginosa UCBPP-PA14; identical to SEQ ID NO: 42400
  CDS (1)..(972)

SEQ ID NO: 80781 - protein, 323 aa, Pseudomonas aeruginosa UCBPP-PA14; identical to SEQ ID NO: 42401

SEQ ID NO: 80782 - DNA, 1005 bp, Dechloromonas aromatica RCB; identical to SEQ ID NO: 42402
  CDS (1)..(1005)

SEQ ID NO: 80783 - protein, 334 aa, Dechloromonas aromatica RCB; identical to SEQ ID NO: 42403

SEQ ID NO: 80784 - DNA, 1026 bp, Ralstonia eutropha JMP134; identical to SEQ ID NO: 42404
  CDS (1)..(1026)

SEQ ID NO: 80785 - protein, 341 aa, Ralstonia eutropha JMP134; identical to SEQ ID NO: 42405

SEQ ID NO: 80786 - DNA, 1002 bp, Methylobacillus flagellatus KT; identical to SEQ ID NO: 42406
  CDS (1)..(1002)

SEQ ID NO: 80787 - protein, 333 aa, Methylobacillus flagellatus KT; identical to SEQ ID NO: 42407

SEQ ID NO: 80788 - DNA, 990 bp, Exiguobacterium sp. 255-15; identical to SEQ ID NO: 42408
  CDS (1)..(990)

SEQ ID NO: 80789 - protein, 329 aa, Exiguobacterium sp. 255-15; identical to SEQ ID NO: 42409

SEQ ID NO: 80790 - DNA, 987 bp, Mesorhizobium sp. BNC1; identical to SEQ ID NO: 42410
  CDS (1)..(987)

SEQ ID NO: 80791 - protein, 328 aa, Mesorhizobium sp. BNC1; identical to SEQ ID NO: 42411

SEQ ID NO: 80792 - DNA, 1011 bp, Exiguobacterium sp. 255-15; identical to SEQ ID NO: 42412
  CDS (1)..(1011)

SEQ ID NO: 80793 - protein, 336 aa, Exiguobacterium sp. 255-15; identical to SEQ ID NO: 42413

SEQ ID NO: 80794 - DNA, 1050 bp, Burkholderia cepacia R18194; identical to SEQ ID NO: 42414
  CDS (1)..(1050)

SEQ ID NO: 80795 - protein, 349 aa, Burkholderia cepacia R18194; identical to SEQ ID NO: 42415

SEQ ID NO: 80796 - DNA, 999 bp, Burkholderia cepacia R1808; identical to SEQ ID NO: 42416
  CDS (1)..(999)

SEQ ID NO: 80797 - protein, 332 aa, Burkholderia cepacia R1808; identical to SEQ ID NO: 42417

SEQ ID NO: 80798 - DNA, 1032 bp, Burkholderia cepacia R1808; identical to SEQ ID NO: 42418
  CDS (1)..(1032)

SEQ ID NO: 80799 - protein, 343 aa, Burkholderia cepacia R1808; identical to SEQ ID NO: 42419

SEQ ID NO: 80800 - DNA, 996 bp, Listeria monocytogenes str. 1/2a F6854; identical to SEQ ID NO: 42420
  CDS (1)..(996): transl_table=11

SEQ ID NO: 80801 - protein, 331 aa, Listeria monocytogenes str. 1/2a F6854; identical to SEQ ID NO: 42421

SEQ ID NO: 80802 - DNA, 1044 bp, Rubrivivax gelatinosus PM1; identical to SEQ ID NO: 42422
  CDS (1)..(1044)

SEQ ID NO: 80803 - protein, 347 aa, Rubrivivax gelatinosus PM1; identical to SEQ ID NO: 42423

SEQ ID NO: 80804 - DNA, 1002 bp, Pseudomonas fluorescens PfO-1; identical to SEQ ID NO: 42424
  CDS (1)..(1002)

SEQ ID NO: 80805 - protein, 333 aa, Pseudomonas fluorescens PfO-1; identical to SEQ ID NO: 42425

SEQ ID NO: 80806 - DNA, 1002 bp, Rhodospirillum rubrum; identical to SEQ ID NO: 42426
  CDS (1)..(1002)

SEQ ID NO: 80807 - protein, 333 aa, Rhodospirillum rubrum; identical to SEQ ID NO: 42427

SEQ ID NO: 80808 - DNA, 1017 bp, Ralstonia metallidurans CH34; identical to SEQ ID NO: 42428
  CDS (1)..(1017)

SEQ ID NO: 80809 - protein, 338 aa, Ralstonia metallidurans CH34; identical to SEQ ID NO: 42429

SEQ ID NO: 80810 - DNA, 1020 bp, Ralstonia metallidurans CH34; identical to SEQ ID NO: 42430
  CDS (1)..(1020)

SEQ ID NO: 80811 - protein, 339 aa, Ralstonia metallidurans CH34; identical to SEQ ID NO: 42431

SEQ ID NO: 80812 - DNA, 999 bp, Burkholderia fungorum LB400; identical to SEQ ID NO: 42432
  CDS (1)..(999)

SEQ ID NO: 80813 - protein, 332 aa, Burkholderia fungorum LB400; identical to SEQ ID NO: 42433

SEQ ID NO: 80814 - DNA, 1002 bp, Burkholderia fungorum LB400; identical to SEQ ID NO: 42434
  CDS (1)..(1002)

SEQ ID NO: 80815 - protein, 333 aa, Burkholderia fungorum LB400; identical to SEQ ID NO: 42435

SEQ ID NO: 80816 - DNA, 996 bp, Burkholderia fungorum LB400; identical to SEQ ID NO: 42436
  CDS (1)..(996)

SEQ ID NO: 80817 - protein, 331 aa, Burkholderia fungorum LB400; identical to SEQ ID NO: 42437

SEQ ID NO: 80818 - DNA, 1020 bp, Burkholderia fungorum LB400; identical to SEQ ID NO: 42438
  CDS (1)..(1020)

SEQ ID NO: 80819 - protein, 339 aa, Burkholderia fungorum LB400; identical to SEQ ID NO: 42439

SEQ ID NO: 80820 - DNA, 993 bp, Novosphingobium aromaticivorans DSM 12444; identical to SEQ ID NO: 42440
  CDS (1)..(993)

SEQ ID NO: 80821 - protein, 330 aa, Novosphingobium aromaticivorans DSM 12444; identical to SEQ ID NO: 42441

SEQ ID NO: 80822 - DNA, 1014 bp, Cytophaga hutchinsonii; identical to SEQ ID NO: 42442
  CDS (1)..(1014)

SEQ ID NO: 80823 - protein, 337 aa, Cytophaga hutchinsonii; identical to SEQ ID NO: 42443

SEQ ID NO: 80824 - DNA, 987 bp, Silicibacter sp. TM1040; identical to SEQ ID NO: 42444
  CDS (1)..(987)

SEQ ID NO: 80825 - protein, 328 aa, Silicibacter sp. TM1040; identical to SEQ ID NO: 42445

SEQ ID NO: 80826 - DNA, 1020 bp, Psychrobacter sp. 273-4; identical to SEQ ID NO: 42446
  CDS (1)..(1020)

SEQ ID NO: 80827 - protein, 339 aa, Psychrobacter sp. 273-4; identical to SEQ ID NO: 42447

SEQ ID NO: 80828 - DNA, 1020 bp, Rubrobacter xylanophilus DSM 9941; identical to SEQ ID NO: 42448
  CDS (1)..(1020)

SEQ ID NO: 80829 - protein, 339 aa, Rubrobacter xylanophilus DSM 9941; identical to SEQ ID NO: 42449

SEQ ID NO: 80830 - DNA, 1002 bp, Polaromonas sp. JS666; identical to SEQ ID NO: 42450
  CDS (1)..(1002)

SEQ ID NO: 80831 - protein, 333 aa, Polaromonas sp. JS666; identical to SEQ ID NO: 42451

SEQ ID NO: 80832 - DNA, 954 bp, Corynebacterium glutamicum; identical to SEQ ID NO: 42452
  CDS (1)..(954): transl_table=11

SEQ ID NO: 80833 - protein, 317 aa, Corynebacterium glutamicum; identical to SEQ ID NO: 42453

SEQ ID NO: 80834 - DNA, 981 bp, uncultured bacterium 311; identical to SEQ ID NO: 42454
  CDS (1)..(981): transl_table=11

SEQ ID NO: 80835 - protein, 326 aa, uncultured bacterium 311; identical to SEQ ID NO: 42455

SEQ ID NO: 80836 - DNA, 1035 bp, Yersinia enterocolitica; identical to SEQ ID NO: 42456
  CDS (1)..(1035): transl_table=11

SEQ ID NO: 80837 - protein, 344 aa, Yersinia enterocolitica; identical to SEQ ID NO: 42457

SEQ ID NO: 80838 - DNA, 942 bp, Bacillus subtilis; identical to SEQ ID NO: 42458
  CDS (1)..(942): transl_table=11

SEQ ID NO: 80839 - protein, 313 aa, Bacillus subtilis; identical to SEQ ID NO: 42459

SEQ ID NO: 80840 - DNA, 1020 bp, Bacillus subtilis; identical to SEQ ID NO: 42460
  CDS (1)..(1020): transl_table=11

SEQ ID NO: 80841 - protein, 339 aa, Bacillus subtilis; identical to SEQ ID NO: 42461

SEQ ID NO: 80842 - DNA, 1005 bp, Bacillus subtilis; identical to SEQ ID NO: 42462
  CDS (1)..(1005): transl_table=11

SEQ ID NO: 80843 - protein, 334 aa, Bacillus subtilis; identical to SEQ ID NO: 42463

SEQ ID NO: 80844 - DNA, 1011 bp, Bacillus subtilis; identical to SEQ ID NO: 42464
  CDS (1)..(1011): transl_table=11

SEQ ID NO: 80845 - protein, 336 aa, Bacillus subtilis; identical to SEQ ID NO: 42465

SEQ ID NO: 80846 - DNA, 1002 bp, Bacillus subtilis; identical to SEQ ID NO: 42466
  CDS (1)..(1002): transl_table=11

SEQ ID NO: 80847 - protein, 333 aa, Bacillus subtilis; identical to SEQ ID NO: 42467

SEQ ID NO: 80848 - DNA, 26 bp, Primer
atgactgataaaaccattgcgttttc

SEQ ID NO: 80849 - DNA, 26 bp, Primer
ttatcccaacaactcttccttaacat

SEQ ID NO: 80850 - protein, 413 aa, consensus; identical to SEQ ID NO: 42470
  MISC_FEATURE (1)..(413): consensus for the disclosure of xaa see table XV

SEQ ID NO: 80851 - protein, 82 aa, consensus; identical to SEQ ID NO: 42471
  MISC_FEATURE (1)..(82): consensus for the disclosure of xaa see table XV

SEQ ID NO: 80852 - protein, 26 aa, consensus
  MISC_FEATURE (1)..(26): consensus for the disclosure of xaa see table XV
XXXXXXXXXXXXXAXXXXXXXXXXXX

SEQ ID NO: 80853 - DNA, 1488 bp, Escherichia coli; identical to SEQ ID NO: 64321
  CDS (1)..(1488)

SEQ ID NO: 80854 - protein, 495 aa, Escherichia coli [sequence omitted]

SEQ ID NO: 80855 - DNA, 1554 bp, Gluconobacter oxydans 621H; identical to SEQ ID NO: 64323
  CDS (1)..(1554)

SEQ ID NO: 80856 - protein, 517 aa, Gluconobacter oxydans 621H; identical to SEQ ID NO: 64324

SEQ ID NO: 80857 - DNA, 1170 bp, Lactobacillus acidophilus NCFM; identical to SEQ ID NO: 64325
  CDS (1)..(1170)

SEQ ID NO: 80858 - protein, 389 aa, Lactobacillus acidophilus NCFM; identical to SEQ ID NO: 64326

SEQ ID NO: 80859 - DNA, 1563 bp, Wolbachia endosymbiont strain TRS of Brugia malayi; identical to SEQ ID NO: 64327
  CDS (1)..(1563)

SEQ ID NO: 80860 - protein, 520 aa, Wolbachia endosymbiont strain TRS of Brugia malayi; identical to SEQ ID NO: 64328

SEQ ID NO: 80861 - DNA, 1377 bp, Ureaplasma parvum serovar 3 str. ATCC 700970; identical to SEQ ID NO: 64329
  CDS (1)..(1377): transl_table=4

SEQ ID NO: 80862 - protein, 458 aa, Ureaplasma parvum serovar 3 str. ATCC 700970; identical to SEQ ID NO: 64330

SEQ ID NO: 80863 - DNA, 1014 bp, Aquifex aeolicus VF5; identical to SEQ ID NO: 64331
  CDS (1)..(1014): transl_table=11

SEQ ID NO: 80864 - protein, 337 aa, Aquifex aeolicus VF5; identical to SEQ ID NO: 64332

SEQ ID NO: 80865 - DNA, 1458 bp, Treponema pallidum subsp. pallidum str. Nichols; identical to SEQ ID NO: 64333
  CDS (1)..(1458): transl_table=11

SEQ ID NO: 80866 - protein, 485 aa, Treponema pallidum subsp. pallidum str. Nichols; identical to SEQ ID NO: 64334

SEQ ID NO: 80867 - DNA, 1035 bp, Thermotoga maritima MSB8; identical to SEQ ID NO: 64335
  CDS (1)..(1035): transl_table=11

SEQ ID NO: 80868 - protein, 344 aa, Thermotoga maritima MSB8; identical to SEQ ID NO: 64336

SEQ ID NO: 80869 - DNA, 1488 bp, Vibrio cholerae O1 biovar eltor str. N16961; identical to SEQ ID NO: 64337
  CDS (1)..(1488): transl_table=11

SEQ ID NO: 80870 - protein, 495 aa, Vibrio cholerae O1 biovar eltor str. N16961; identical to SEQ ID NO: 64338

SEQ ID NO: 80871 - DNA, 1485 bp, Pasteurella multocida subsp. multocida str. Pm70; identical to SEQ ID NO: 64339
  CDS (1)..(1485): transl_table=11

SEQ ID NO: 80872 - protein, 494 aa, Pasteurella multocida subsp. multocida str. Pm70; identical to SEQ ID NO: 64340

SEQ ID NO: 80873 - DNA, 1482 bp, Pseudomonas aeruginosa PAO1; identical to SEQ ID NO: 64341
  CDS (1)..(1482): transl_table=11

SEQ ID NO: 80874 - protein, 493 aa, Pseudomonas aeruginosa PAO1; identical to SEQ ID NO: 64342

SEQ ID NO: 80875 - DNA, 1518 bp, Neisseria meningitidis Z2491; identical to SEQ ID NO: 64343
  CDS (1)..(1518): transl_table=11

SEQ ID NO: 80876 - protein, 505 aa, Neisseria meningitidis Z2491; identical to SEQ ID NO: 64344

SEQ ID NO: 80877 - DNA, 1206 bp, Deinococcus radiodurans R1; identical to SEQ ID NO: 64345
  CDS (1)..(1206): transl_table=11

SEQ ID NO: 80878 - protein, 401 aa, Deinococcus radiodurans R1; identical to SEQ ID NO: 64346

SEQ ID NO: 80879 - DNA, 1305 bp, Chlamydia muridarum; identical to SEQ ID NO: 64347
  CDS (1)..(1305): transl_table=11

SEQ ID NO: 80880 - protein, 434 aa, Chlamydia muridarum; identical to SEQ ID NO: 64348

SEQ ID NO: 80881 - DNA, 1512 bp, Xylella fastidiosa 9a5c; identical to SEQ ID NO: 64349
  CDS (1)..(1512): transl_table=11

SEQ ID NO: 80882 - protein, 503 aa, Xylella fastidiosa 9a5c; identical to SEQ ID NO: 64350

SEQ ID NO: 80883 - DNA, 1653 bp, Mycoplasma pulmonis UAB CTIP; identical to SEQ ID NO: 64351
  CDS (1)..(1653): transl_table=4

SEQ ID NO: 80884 - protein, 550 aa, Mycoplasma pulmonis UAB CTIP; identical to SEQ ID NO: 64352

SEQ ID NO: 80885 - DNA, 1032 bp, Mycobacterium tuberculosis CDC1551; identical to SEQ ID NO: 64353
  CDS (1)..(1032): transl_table=11

SEQ ID NO: 80886 - protein, 343 aa, Mycobacterium tuberculosis CDC1551; identical to SEQ ID NO: 64354

SEQ ID NO: 80887 - DNA, 1062 bp, Clostridium acetobutylicum ATCC 824; identical to SEQ ID NO: 64355
  CDS (1)..(1062): transl_table=11

SEQ ID NO: 80888 - protein, 353 aa, Clostridium acetobutylicum ATCC 824; identical to SEQ ID NO: 64356

SEQ ID NO: 80889 - DNA, 1629 bp, Sinorhizobium meliloti 1021; identical to SEQ ID NO: 64357
  CDS (1)..(1629): transl_table=11

SEQ ID NO: 80890 - protein, 542 aa, Sinorhizobium meliloti 1021; identical to SEQ ID NO: 64358

SEQ ID NO: 80891 - DNA, 1647 bp, Caulobacter crescentus CB15; identical to SEQ ID NO: 64359
  CDS (1)..(1647): transl_table=11

SEQ ID NO: 80892 - protein, 548 aa, Caulobacter crescentus CB15; identical to SEQ ID NO: 64360

SEQ ID NO: 80893 - DNA, 1377 bp, Synechocystis sp. PCC 6803; identical to SEQ ID NO: 64361
  CDS (1)..(1377): transl_table=11

SEQ ID NO: 80894 - protein, 458 aa, Synechocystis sp. PCC 6803; identical to SEQ ID NO: 64362

SEQ ID NO: 80895 - DNA, 1119 bp, Listeria innocua Clip11262; identical to SEQ ID NO: 64363
  CDS (1)..(1119): transl_table=11

SEQ ID NO: 80896 - protein, 372 aa, Listeria innocua Clip11262; identical to SEQ ID NO: 64364

SEQ ID NO: 80897 - DNA, 1278 bp, Nostoc sp. PCC 7120; identical to SEQ ID NO: 64365
  CDS (1)..(1278): transl_table=11

SEQ ID NO: 80898 - protein, 425 aa, Nostoc sp. PCC 7120; identical to SEQ ID NO: 64366

SEQ ID NO: 80899 - DNA, 1617 bp, Agrobacterium tumefaciens str. C58; identical to SEQ ID NO: 64367
  CDS (1)..(1617): transl_table=11

SEQ ID NO: 80900 - protein, 538 aa, Agrobacterium tumefaciens str. C58; identical to SEQ ID NO: 64368

SEQ ID NO: 80901 - DNA, 999 bp, Corynebacterium glutamicum ATCC 13032; identical to SEQ ID NO: 64369
  CDS (1)..(999): transl_table=11

SEQ ID NO: 80902 - protein, 332 aa, Corynebacterium glutamicum ATCC 13032; identical to SEQ ID NO: 64370

SEQ ID NO: 80903 - DNA, 1074 bp, Fusobacterium nucleatum subsp. nucleatum ATCC 25586; identical to SEQ ID NO: 64371
  CDS (1)..(1074): transl_table=11

SEQ ID NO: 80904 - protein, 357 aa, Fusobacterium nucleatum subsp. nucleatum ATCC 25586; identical to SEQ ID NO: 64372

SEQ ID NO: 80905 - DNA, 1041 bp, Thermoanaerobacter tengcongensis MB4; identical to SEQ ID NO: 64373
  CDS (1)..(1041): transl_table=11

SEQ ID NO: 80906 - protein, 346 aa, Thermoanaerobacter tengcongensis MB4; identical to SEQ ID NO: 64374

SEQ ID NO: 80907 - DNA, 1023 bp, Streptomyces coelicolor A3(2); identical to SEQ ID NO: 64375
  CDS (1)..(1023)

SEQ ID NO: 80908 - protein, 340 aa, Streptomyces coelicolor A3(2); identical to SEQ ID NO: 64376

SEQ ID NO: 80909 - DNA, 1512 bp, Xanthomonas campestris pv. campestris str. ATCC 33913; identical to SEQ ID NO: 64377
  CDS (1)..(1512): transl_table=11

SEQ ID NO: 80910 - protein, 503 aa, Xanthomonas campestris pv. campestris str. ATCC 33913; identical to SEQ ID NO: 64378

SEQ ID NO: 80911 - DNA, 1176 bp, Staphylococcus aureus subsp. aureus MW2; identical to SEQ ID NO: 64379
  CDS (1)..(1176): transl_table=11

SEQ ID NO: 80912 - protein, 391 aa, Staphylococcus aureus subsp. aureus MW2; identical to SEQ ID NO: 64380

SEQ ID NO: 80913 - DNA, 1107 bp, Bacillus anthracis str. A2012; identical to SEQ ID NO: 64381
  CDS (1)..(1107): transl_table=11

SEQ ID NO: 80914 - protein, 368 aa, Bacillus anthracis str. A2012; identical to SEQ ID NO: 64382

SEQ ID NO: 80915 - DNA, 1566 bp, Chlorobium tepidum TLS; identical to SEQ ID NO: 64383
  CDS (1)..(1566): transl_table=11

SEQ ID NO: 80916 - protein, 521 aa, Chlorobium tepidum TLS; identical to SEQ ID NO: 64384

SEQ ID NO: 80917 - DNA, 1506 bp, Yersinia pestis KIM; identical to SEQ ID NO: 64385
  CDS (1)..(1506): transl_table=11

SEQ ID NO: 80918 - protein, 501 aa, Yersinia pestis KIM; identical to SEQ ID NO: 64386

SEQ ID NO: 80919 - DNA, 1188 bp, Thermosynechococcus elongatus BP-1; identical to SEQ ID NO: 64387
  CDS (1)..(1188): transl_table=11

SEQ ID NO: 80920 - protein, 395 aa, Thermosynechococcus elongatus BP-1; identical to SEQ ID NO: 64388

SEQ ID NO: 80921 - DNA, 1140 bp, Streptococcus agalactiae 2603V/R; identical to SEQ ID NO: 64389
  CDS (1)..(1140): transl_table=11

SEQ ID NO: 80922 - protein, 379 aa, Streptococcus agalactiae 2603V/R; identical to SEQ ID NO: 64390

SEQ ID NO: 80923 - DNA, 1095 bp, Oceanobacillus iheyensis HTE831; identical to SEQ ID NO: 64391
  CDS (1)..(1095): transl_table=11

SEQ ID NO: 80924 - protein, 364 aa, Oceanobacillus iheyensis HTE831; identical to SEQ ID NO: 64392

SEQ ID NO: 80925 - DNA, 1068 bp, Bifidobacterium longum NCC2705; identical to SEQ ID NO: 64393
  CDS (1)..(1068): transl_table=11

SEQ ID NO: 80926 - protein, 355 aa, Bifidobacterium longum NCC2705; identical to SEQ ID NO: 64394

SEQ ID NO: 80927 - DNA, 1614 bp, Brucella suis 1330; identical to SEQ ID NO: 64395
  CDS (1)..(1614): transl_table=11

SEQ ID NO: 80928 - protein, 537 aa, Brucella suis 1330; identical to SEQ ID NO: 64396

SEQ ID NO: 80929 - DNA, 1383 bp, Leptospira interrogans serovar Lai str. 56601; identical to SEQ ID NO: 64397
  CDS (1)..(1383): transl_table=11

SEQ ID NO: 80930 - protein, 460 aa, Leptospira interrogans serovar Lai str. 56601; identical to SEQ ID NO: 64398

SEQ ID NO: 80931 - DNA, 1500 bp, Shewanella oneidensis MR-1; identical to SEQ ID NO: 64399
  CDS (1)..(1500): transl_table=11

SEQ ID NO: 80932 - protein, 499 aa, Shewanella oneidensis MR-1; identical to SEQ ID NO: 64400

SEQ ID NO: 80933 - DNA, 1794 bp, Mycoplasma penetrans HF-2; identical to SEQ ID NO: 64401
  CDS (1)..(1794): transl_table=4

SEQ ID NO: 80934 - protein, 597 aa, Mycoplasma penetrans HF-2; identical to SEQ ID NO: 64402

SEQ ID NO: 80935 - DNA, 1224 bp, Staphylococcus epidermidis ATCC 12228; identical to SEQ ID NO: 64403
  CDS (1)..(1224): transl_table=11

SEQ ID NO: 80936 - protein, 407 aa, Staphylococcus epidermidis ATCC 12228; identical to SEQ ID NO: 64404

SEQ ID NO: 80937 - DNA, 1611 bp, Bradyrhizobium japonicum USDA 110; identical to SEQ ID NO: 64405
  CDS (1)..(1611)

SEQ ID NO: 80938 - protein, 536 aa, Bradyrhizobium japonicum USDA 110; identical to SEQ ID NO: 64406

SEQ ID NO: 80939 - DNA, 1086 bp, Clostridium tetani E88; identical to SEQ ID NO: 64407
  CDS (1)..(1086): transl_table=11

SEQ ID NO: 80940 - protein, 361 aa, Clostridium tetani E88; identical to SEQ ID NO: 64408

SEQ ID NO: 80941 - DNA, 960 bp, Tropheryma whipplei str. Twist; identical to SEQ ID NO: 64409
  CDS (1)..(960): transl_table=11

SEQ ID NO: 80942 - protein, 319 aa, Tropheryma whipplei str. Twist; identical to SEQ ID NO: 64410

SEQ ID NO: 80943 - DNA, 1503 bp, Salmonella enterica subsp. enterica serovar Typhi Ty2; identical to SEQ ID NO: 64411
  CDS (1)..(1503): transl_table=11

SEQ ID NO: 80944 - protein, 500 aa, Salmonella enterica subsp. enterica serovar Typhi Ty2; identical to SEQ ID NO: 64412

SEQ ID NO: 80945 - DNA, 1320 bp, Bacteroides thetaiotaomicron VPI-5482; identical to SEQ ID NO: 64413
  CDS (1)..(1320): transl_table=11

SEQ ID NO: 80946 - protein, 439 aa, Bacteroides thetaiotaomicron VPI-5482; identical to SEQ ID NO: 64414

SEQ ID NO: 80947 - DNA, 1200 bp, Enterococcus faecalis V583; identical to SEQ ID NO: 64415
  CDS (1)..(1200): transl_table=11

SEQ ID NO: 80948 - protein, 399 aa, Enterococcus faecalis V583; identical to SEQ ID NO: 64416

SEQ ID NO: 80949 - DNA, 1512 bp, Coxiella burnetii RSA 493; identical to SEQ ID NO: 64417
  CDS (1)..(1512): transl_table=11

SEQ ID NO: 80950 - protein, 503 aa, Coxiella burnetii RSA 493; identical to SEQ ID NO: 64418

SEQ ID NO: 80951 - DNA, 1305 bp, Chlamydophila caviae GPIC; identical to SEQ ID NO: 64419
  CDS (1)..(1305): transl_table=11

SEQ ID NO: 80952 - protein, 434 aa, Chlamydophila caviae GPIC; identical to SEQ ID NO: 64420

SEQ ID NO: 80953 - DNA, 1107 bp, Bacillus cereus ATCC 14579; identical to SEQ ID NO: 64421
  CDS (1)..(1107): transl_table=11

SEQ ID NO: 80954 - protein, 368 aa, Bacillus cereus ATCC 14579; identical to SEQ ID NO: 64422

SEQ ID NO: 80955 - DNA, 1473 bp, Nitrosomonas europaea ATCC 19718; identical to SEQ ID NO: 64423
  CDS (1)..(1473): transl_table=11

SEQ ID NO: 80956 - protein, 490 aa, Nitrosomonas europaea ATCC 19718; identical to SEQ ID NO: 64424

SEQ ID NO: 80957 - DNA, 1128 bp, Helicobacter hepaticus ATCC 51449; identical to SEQ ID NO: 64425
  CDS (1)..(1128): transl_table=11

SEQ ID NO: 80958 - protein, 375 aa, Helicobacter hepaticus ATCC 51449; identical to SEQ ID NO: 64426

SEQ ID NO: 80959 - DNA, 1497 bp, Rhodopirellula baltica SH 1; identical to SEQ ID NO: 64427
  CDS (1)..(1497): transl_table=11

SEQ ID NO: 80960 - protein, 498 aa, Rhodopirellula baltica SH 1; identical to SEQ ID NO: 64428

SEQ ID NO: 80961 - DNA, 1485 bp, Wigglesworthia glossinidia endosymbiont of Glossina brevipalpis; identical to SEQ ID NO: 64429
  CDS (1)..(1485): transl_table=11

SEQ ID NO: 80962 - protein, 494 aa, Wigglesworthia glossinidia endosymbiont of Glossina brevipalpis; identical to SEQ ID NO: 64430

SEQ ID NO: 80963 - DNA, 1482 bp, Haemophilus ducreyi 35000HP; identical to SEQ ID NO: 64431
  CDS (1)..(1482): transl_table=11

SEQ ID NO: 80964 - protein, 493 aa, Haemophilus ducreyi 35000HP; identical to SEQ ID NO: 64432

SEQ ID NO: 80965 - DNA, 1419 bp, Prochlorococcus marinus subsp. marinus str. CCMP1375; identical to SEQ ID NO: 64433
  CDS (1)..(1419): transl_table=11

SEQ ID NO: 80966 - protein, 472 aa, Prochlorococcus marinus subsp. marinus str. CCMP1375; identical to SEQ ID NO: 64434

SEQ ID NO: 80967 - DNA, 1506 bp, Candidatus Blochmannia floridanus; identical to SEQ ID NO: 64435
  CDS (1)..(1506): transl_table=11

SEQ ID NO: 80968 - protein, 501 aa, Candidatus Blochmannia floridanus; identical to SEQ ID NO: 64436

SEQ ID NO: 80969 - DNA, 1479 bp, Bordetella bronchiseptica RB50; identical to SEQ ID NO: 64437
  CDS (1)..(1479): transl_table=11

SEQ ID NO: 80970 - protein, 492 aa, Bordetella bronchiseptica RB50; identical to SEQ ID NO: 64438

SEQ ID NO: 80971 - DNA, 1449 bp, Prochlorococcus marinus str. MIT 9313; identical to SEQ ID NO: 64439
  CDS (1)..(1449): transl_table=11

SEQ ID NO: 80972 - protein, 482 aa, Prochlorococcus marinus str. MIT 9313; identical to SEQ ID NO: 64440

SEQ ID NO: 80973 - DNA, 1428 bp, Synechococcus sp. WH 8102; identical to SEQ ID NO: 64441
  CDS (1)..(1428): transl_table=11

SEQ ID NO: 80974 - protein, 475 aa, Synechococcus sp. WH 8102; identical to SEQ ID NO: 64442

SEQ ID NO: 80975 - DNA, 1479 bp, Chromobacterium violaceum ATCC 12472; identical to SEQ ID NO: 64443
  CDS (1)..(1479): transl_table=11

SEQ ID NO: 80976 - protein, 492 aa, Chromobacterium violaceum ATCC 12472; identical to SEQ ID NO: 64444

SEQ ID NO: 80977 - DNA, 1335 bp, Porphyromonas gingivalis W83; identical to SEQ ID NO: 64445
  CDS (1)..(1335): transl_table=11

SEQ ID NO: 80978 - protein, 444 aa, Porphyromonas gingivalis W83; identical to SEQ ID NO: 64446

SEQ ID NO: 80979 - DNA, 1152 bp, Gloeobacter violaceus PCC 7421; identical to SEQ ID NO: 64447
  CDS (1)..(1152): transl_table=11

SEQ ID NO: 80980 - protein, 383 aa, Gloeobacter violaceus PCC 7421; identical to SEQ ID NO: 64448

SEQ ID NO: 80981 - DNA, 1509 bp, Photorhabdus luminescens subsp. laumondii TTO1; identical to SEQ ID NO: 64449
  CDS (1)..(1509): transl_table=11

SEQ ID NO: 80982 - protein, 502 aa, Photorhabdus luminescens subsp. laumondii TTO1; identical to SEQ ID NO: 64450

SEQ ID NO: 80983 - DNA, 1614 bp, Rhodopseudomonas palustris CGA009; identical to SEQ ID NO: 64451
  CDS (1)..(1614): transl_table=11

SEQ ID NO: 80984 - protein, 537 aa, Rhodopseudomonas palustris CGA009; identical to SEQ ID NO: 64452

SEQ ID NO: 80985 - DNA, 1158 bp, Geobacter sulfurreducens PCA; identical to SEQ ID NO: 64453
  CDS (1)..(1158): transl_table=11

SEQ ID NO: 80986 - protein, 385 aa, Geobacter sulfurreducens PCA; identical to SEQ ID NO: 64454

SEQ ID NO: 80987 - DNA, 1389 bp, Bdellovibrio bacteriovorus HD100; identical to SEQ ID NO: 64455
  CDS (1)..(1389): transl_table=11

SEQ ID NO: 80988 - protein, 462 aa, Bdellovibrio bacteriovorus HD100; identical to SEQ ID NO: 64456

SEQ ID NO: 80989 - DNA, 1488 bp, Treponema denticola ATCC 35405; identical to SEQ ID NO: 64457
  CDS (1)..(1488): transl_table=11

SEQ ID NO: 80990 - protein, 495 aa, Treponema denticola ATCC 35405; identical to SEQ ID NO: 64458

SEQ ID NO: 80991 - DNA, 1755 bp, Mycoplasma mycoides subsp. mycoides SC str. PG1; identical to SEQ ID NO: 64459
  CDS (1)..(1755): transl_table=4

SEQ ID NO: 80992 - protein, 584 aa, Mycoplasma mycoides subsp. mycoides SC str. PG1; identical to SEQ ID NO: 64460

SEQ ID NO: 80993 - DNA, 1275 bp, Parachlamydia sp. UWE25; identical to SEQ ID NO: 64461
  CDS (1)..(1275): transl_table=11

SEQ ID NO: 80994 - protein, 424 aa, Parachlamydia sp. UWE25; identical to SEQ ID NO: 64462

SEQ ID NO: 80995 - DNA, 1287 bp, Desulfovibrio vulgaris subsp. vulgaris str. Hildenborough; identical to SEQ ID NO: 64463
  CDS (1)..(1287): transl_table=11

SEQ ID NO: 80996 - protein, 428 aa, Desulfovibrio vulgaris subsp. vulgaris str. Hildenborough; identical to SEQ ID NO: 64464

SEQ ID NO: 80997 - DNA, 1587 bp, Bartonella henselae str. Houston-1; identical to SEQ ID NO: 64465
  CDS (1)..(1587): transl_table=11

SEQ ID NO: 80998 - protein, 528 aa, Bartonella henselae str. Houston-1; identical to SEQ ID NO: 64466

SEQ ID NO: 80999 - DNA, 1485 bp, Acinetobacter sp. ADP1; identical to SEQ ID NO: 64467
  CDS (1)..(1485): transl_table=11

SEQ ID NO: 81000 - protein, 494 aa, Acinetobacter sp. ADP1; identical to SEQ ID NO: 64468

SEQ ID NO: 81001 - DNA, 1530 bp, Erwinia carotovora subsp. atroseptica SCRI1043; identical to SEQ ID NO: 64469
  CDS (1)..(1530)

SEQ ID NO: 81002 - protein, 509 aa, Erwinia carotovora subsp. atroseptica SCRI1043; identical to SEQ ID NO: 64470

SEQ ID NO: 81003 - DNA, 1416 bp, Mesoplasma florum L1; identical to SEQ ID NO: 64471
  CDS (1)..(1416): transl_table=4

SEQ ID NO: 81004 - protein, 471 aa, Mesoplasma florum L1; identical to SEQ ID NO: 64472

SEQ ID NO: 81005 - DNA, 972 bp, Propionibacterium acnes KPA171202; identical to SEQ ID NO: 64473
  CDS (1)..(972): transl_table=11

SEQ ID NO: 81006 - protein, 323 aa, Propionibacterium acnes KPA171202; identical to SEQ ID NO: 64474

SEQ ID NO: 81007 - DNA, 999 bp, Leifsonia xyli subsp. xyli str. CTCB07; identical to SEQ ID NO: 64475
  CDS (1)..(999): transl_table=11

SEQ ID NO: 81008 - protein, 332 aa, Leifsonia xyli subsp. xyli str. CTCB07; identical to SEQ ID NO: 64476

SEQ ID NO: 81009 - DNA, 1401 bp, Desulfotalea psychrophila LSv54; identical to SEQ ID NO: 64477
  CDS (1)..(1401): transl_table=11

SEQ ID NO: 81010 - protein, 466 aa, Desulfotalea psychrophila LSv54; identical to SEQ ID NO: 64478

SEQ ID NO: 81011 - DNA, 1449 bp, Borrelia garinii PBi; identical to SEQ ID NO: 64479
  CDS (1)..(1449): transl_table=11

SEQ ID NO: 81012 - protein, 482 aa, Borrelia garinii PBi; identical to SEQ ID NO: 64480

SEQ ID NO: 81013 - DNA, 1083 bp, Symbiobacterium thermophilum IAM 14863; identical to SEQ ID NO: 64481
  CDS (1)..(1083): transl_table=11

SEQ ID NO: 81014 - protein, 360 aa, Symbiobacterium thermophilum IAM 14863; identical to SEQ ID NO: 64482

SEQ ID NO: 81015 - DNA, 1506 bp, Mannheimia succiniciproducens MBEL55E; identical to SEQ ID NO: 64483
  CDS (1)..(1506): transl_table=11

SEQ ID NO: 81016 - protein, 501 aa, Mannheimia succiniciproducens MBEL55E; identical to SEQ ID NO: 64484

SEQ ID NO: 81017 - DNA, 1263 bp, Bacteroides fragilis YCH46; identical to SEQ ID NO: 64485
  CDS (1)..(1263): transl_table=11

SEQ ID NO: 81018 - protein, 420 aa, Bacteroides fragilis YCH46; identical to SEQ ID NO: 64486

SEQ ID NO: 81019 - DNA, 1500 bp, Methylococcus capsulatus str. Bath; identical to SEQ ID NO: 64487
  CDS (1)..(1500): transl_table=11

SEQ ID NO: 81020 - protein, 499 aa, Methylococcus capsulatus str. Bath; identical to SEQ ID NO: 64488

SEQ ID NO: 81021 - DNA, 1029 bp, Nocardia farcinica IFM 10152; identical to SEQ ID NO: 64489
  CDS (1)..(1029): transl_table=11

SEQ ID NO: 81022 - protein, 342 aa, Nocardia farcinica IFM 10152; identical to SEQ ID NO: 64490

SEQ ID NO: 81023 - DNA, 1479 bp, Legionella pneumophila str. Paris; identical to SEQ ID NO: 64491
  CDS (1)..(1479): transl_table=11

SEQ ID NO: 81024 - protein, 492 aa, Legionella pneumophila str. Paris; identical to SEQ ID NO: 64492

SEQ ID NO: 81025 - DNA, 1488 bp, Photobacterium profundum SS9; identical to SEQ ID NO: 64493
  CDS (1)..(1488): transl_table=11

SEQ ID NO: 81026 - protein, 495 aa, Photobacterium profundum SS9; identical to SEQ ID NO: 64494

SEQ ID NO: 81027 - DNA, 1548 bp, Anaplasma marginale str. St. Maries; identical to SEQ ID NO: 64495
  CDS (1)..(1548): transl_table=11

SEQ ID NO: 81028 - protein, 515 aa, Anaplasma marginale str. St. Maries; identical to SEQ ID NO: 64496

SEQ ID NO: 81029 - DNA, 1500 bp, Idiomarina loihiensis L2TR; identical to SEQ ID NO: 64497
  CDS (1)..(1500): transl_table=11

SEQ ID NO: 81030 - protein, 499 aa, Idiomarina loihiensis L2TR; identical to SEQ ID NO: 64498

SEQ ID NO: 81031 - DNA, 1476 bp, Azoarcus sp. EbN1; identical to SEQ ID NO: 64499
  CDS (1)..(1476): transl_table=11

SEQ ID NO: 81032 - protein, 491 aa, Azoarcus sp. EbN1; identical to SEQ ID NO: 64500

SEQ ID NO: 81033 - DNA, 1626 bp, Zymomonas mobilis subsp. mobilis ZM4; identical to SEQ ID NO: 64501
  CDS (1)..(1626): transl_table=11

SEQ ID NO: 81034 - protein, 541 aa, Zymomonas mobilis subsp. mobilis ZM4; identical to SEQ ID NO: 64502

SEQ ID NO: 81035 - DNA, 1470 bp, Francisella tularensis subsp. tularensis Schu 4; identical to SEQ ID NO: 64503
  CDS (1)..(1470): transl_table=11

SEQ ID NO: 81036 - protein, 489 aa, Francisella tularensis subsp. tularensis Schu 4; identical to SEQ ID NO: 64504

SEQ ID NO: 81037 - DNA, 1326 bp, Synechococcus elongatus PCC 6301; identical to SEQ ID NO: 64505
  CDS (1)..(1326): transl_table=11

SEQ ID NO: 81038 - protein, 441 aa, Synechococcus elongatus PCC 6301; identical to SEQ ID NO: 64506

SEQ ID NO: 81039 - DNA, 1089 bp, Campylobacter jejuni RM1221; identical to SEQ ID NO: 64507
  CDS (1)..(1089): transl_table=11

SEQ ID NO: 81040 - protein, 362 aa, Campylobacter jejuni RM1221; identical to SEQ ID NO: 64508

SEQ ID NO: 81041 - DNA, 1476 bp, Dehalococcoides ethenogenes 195; identical to SEQ ID NO: 64509
  CDS (1)..(1476): transl_table=11

SEQ ID NO: 81042 - protein, 491 aa, Dehalococcoides ethenogenes 195; identical to SEQ ID NO: 64510

SEQ ID NO: 81043 - DNA, 1608 bp, Rhodobacter sphaeroides 2.4.1; identical to SEQ ID NO: 64511
  CDS (1)..(1608)

SEQ ID NO: 81044 - protein, 535 aa, Rhodobacter sphaeroides 2.4.1; identical to SEQ ID NO: 64512

SEQ ID NO: 81045 - DNA, 1509 bp, Magnetospirillum magnetotacticum MS-1; identical to SEQ ID NO: 64513
  CDS (1)..(1509)

SEQ ID NO: 81046 - protein, 502 aa, Magnetospirillum magnetotacticum MS-1; identical to SEQ ID NO: 64514

SEQ ID NO: 81047 - DNA, 1098 bp, Leuconostoc mesenteroides subsp. mesenteroides ATCC 8293; identical to SEQ ID NO: 64515
  CDS (1)..(1098)

SEQ ID NO: 81048 - protein, 365 aa, Leuconostoc mesenteroides subsp. mesenteroides ATCC 8293; identical to SEQ ID NO: 64516

SEQ ID NO: 81049 - DNA, 1419 bp, Azotobacter vinelandii; identical to SEQ ID NO: 64517
  CDS (1)..(1419)

SEQ ID NO: 81050 - protein, 472 aa, Azotobacter vinelandii; identical to SEQ ID NO: 64518

SEQ ID NO: 81051 - DNA, 1389 bp, Desulfitobacterium hafniense DCB-2; identical to SEQ ID NO: 64519
  CDS (1)..(1389)

SEQ ID NO: 81052 - protein, 462 aa, Desulfitobacterium hafniense DCB-2; identical to SEQ ID NO: 64520

SEQ ID NO: 81053 - DNA, 1272 bp, Nostoc punctiforme PCC 73102; identical to SEQ ID NO: 64521
  CDS (1)..(1272)

SEQ ID NO: 81054 - protein, 423 aa, Nostoc punctiforme PCC 73102; identical to SEQ ID NO: 64522

SEQ ID NO: 81055 - DNA, 933 bp, Bifidobacterium longum DJO10A; identical to SEQ ID NO: 64523
  CDS (1)..(933)

SEQ ID NO: 81056 - protein, 310 aa, Bifidobacterium longum DJO10A; identical to SEQ ID NO: 64524

SEQ ID NO: 81057 - DNA, 1482 bp, Actinobacillus pleuropneumoniae serovar 1 str. 4074; identical to SEQ ID NO: 64525
  CDS (1)..(1482)

SEQ ID NO: 81058 - protein, 493 aa, Actinobacillus pleuropneumoniae serovar 1 str. 4074; identical to SEQ ID NO: 64526

SEQ ID NO: 81059 - DNA, 1485 bp, Psychrobacter sp. 273-4; identical to SEQ ID NO: 64527
  CDS (1)..(1485)

SEQ ID NO: 81060 - protein, 494 aa, Psychrobacter sp. 273-4; identical to SEQ ID NO: 64528

SEQ ID NO: 81061 - DNA, 1473 bp, Dechloromonas aromatica RCB; identical to SEQ ID NO: 64529
  CDS (1)..(1473)

SEQ ID NO: 81062 - protein, 490 aa, Dechloromonas aromatica RCB; identical to SEQ ID NO: 64530

SEQ ID NO: 81063 - DNA, 1488 bp, Haemophilus influenzae R2846; identical to SEQ ID NO: 64531
  CDS (1)..(1488)

SEQ ID NO: 81064 - protein, 495 aa, Haemophilus influenzae R2846; identical to SEQ ID NO: 64532

SEQ ID NO: 81065 - DNA, 1467 bp, Methylobacillus flagellatus KT; identical to SEQ ID NO: 64533
  CDS (1)..(1467)

SEQ ID NO: 81066 - protein, 488 aa, Methylobacillus flagellatus KT; identical to SEQ ID NO: 64534

SEQ ID NO: 81067 - DNA, 1275 bp, Crocosphaera watsonii WH 8501; identical to SEQ ID NO: 64535
  CDS (1)..(1275)

SEQ ID NO: 81068 - protein, 424 aa, Crocosphaera watsonii WH 8501; identical to SEQ ID NO: 64536

SEQ ID NO: 81069 - DNA, 1128 bp, Exiguobacterium sp. 255-15; identical to SEQ ID NO: 64537
  CDS (1)..(1128)

SEQ ID NO: 81070 - protein, 375 aa, Exiguobacterium sp. 255-15; identical to SEQ ID NO: 64538

SEQ ID NO: 81071 - DNA, 1611 bp, Mesorhizobium sp. BNC1; identical to SEQ ID NO: 64539
  CDS (1)..(1611)

SEQ ID NO: 81072 - protein, 536 aa, Mesorhizobium sp. BNC1; identical to SEQ ID NO: 64540

SEQ ID NO: 81073 - DNA, 1146 bp, Rubrobacter xylanophilus DSM 9941; identical to SEQ ID NO: 64541
  CDS (1)..(1146)

SEQ ID NO: 81074 - protein, 381 aa, Rubrobacter xylanophilus DSM 9941; identical to SEQ ID NO: 64542

SEQ ID NO: 81075 - DNA, 1554 bp, Ehrlichia canis str. Jake; identical to SEQ ID NO: 64543
  CDS (1)..(1554)

SEQ ID NO: 81076 - protein, 517 aa, Ehrlichia canis str. Jake; identical to SEQ ID NO: 64544

SEQ ID NO: 81077 - DNA, 1479 bp, Rubrivivax gelatinosus PM1; identical to SEQ ID NO: 64545
  CDS (1)..(1479)

SEQ ID NO: 81078 - protein, 492 aa, Rubrivivax gelatinosus PM1; identical to SEQ ID NO: 64546

SEQ ID NO: 81079 - DNA, 1551 bp, Rhodospirillum rubrum; identical to SEQ ID NO: 64547
  CDS (1)..(1551)

SEQ ID NO: 81080 - protein, 516 aa, Rhodospirillum rubrum; identical to SEQ ID NO: 64548

SEQ ID NO: 81081 - DNA, 1476 bp, Ralstonia metallidurans CH34; identical to SEQ ID NO: 64549
  CDS (1)..(1476)

SEQ ID NO: 81082 - protein, 491 aa, Ralstonia metallidurans CH34; identical to SEQ ID NO: 64550

SEQ ID NO: 81083 - DNA, 1476 bp, Burkholderia fungorum LB400; identical to SEQ ID NO: 64551
  CDS (1)..(1476)

SEQ ID NO: 81084 - protein, 491 aa, Burkholderia fungorum LB400; identical to SEQ ID NO: 64552

SEQ ID NO: 81085 - DNA, 1521 bp, Magnetococcus sp. MC-1; identical to SEQ ID NO: 64553
  CDS (1)..(1521)

SEQ ID NO: 81086 - protein, 506 aa, Magnetococcus sp. MC-1; identical to SEQ ID NO: 64554

SEQ ID NO: 81087 - DNA, 1635 bp, Novosphingobium aromaticivorans DSM 12444; identical to SEQ ID NO: 64555
  CDS (1)..(1635)

SEQ ID NO: 81088 - protein, 544 aa, Novosphingobium aromaticivorans DSM 12444; identical to SEQ ID NO: 64556

SEQ ID NO: 81089 - DNA, 1257 bp, Cytophaga hutchinsonii; identical to SEQ ID NO: 64557
  CDS (1)..(1257)

SEQ ID NO: 81090 - protein, 418 aa, Cytophaga hutchinsonii; identical to SEQ ID NO: 64558

SEQ ID NO: 81091 - DNA, 1482 bp, Microbulbifer degradans 2-40; identical to SEQ ID NO: 64559
  CDS (1)..(1482)

SEQ ID NO: 81092 - protein, 493 aa, Microbulbifer degradans 2-40; identical to SEQ ID NO: 64560

SEQ ID NO: 81093 - DNA, 1422 bp, Oenococcus oeni PSU-1; identical to SEQ ID NO: 64561
  CDS (1)..(1422)

SEQ ID NO: 81094 - protein, 473 aa, Oenococcus oeni PSU-1; identical to SEQ ID NO: 64562

SEQ ID NO: 81095 - DNA, 1089 bp, Pediococcus pentosaceus ATCC 25745; identical to SEQ ID NO: 64563
  CDS (1)..(1089)

SEQ ID NO: 81096 - protein, 362 aa, Pediococcus pentosaceus ATCC 25745; identical to SEQ ID NO: 64564

SEQ ID NO: 81097 - DNA, 1281 bp, Trichodesmium erythraeum IMS101; identical to SEQ ID NO: 64565
  CDS (1)..(1281)

SEQ ID NO: 81098 - protein, 426 aa, Trichodesmium erythraeum IMS101; identical to SEQ ID NO: 64566

SEQ ID NO: 81099 - DNA, 1089 bp, Moorella thermoacetica ATCC 39073; identical to SEQ ID NO: 64567
  CDS (1)..(1089)

SEQ ID NO: 81100 - protein, 362 aa, Moorella thermoacetica ATCC 39073; identical to SEQ ID NO: 64568

SEQ ID NO: 81101 - DNA, 1479 bp, Thiobacillus denitrificans ATCC 25259; identical to SEQ ID NO: 64569
  CDS (1)..(1479)

SEQ ID NO: 81102 - protein, 492 aa, Thiobacillus denitrificans ATCC 25259; identical to SEQ ID NO: 64570

SEQ ID NO: 81103 - DNA, 1617 bp, Silicibacter sp. TM1040; identical to SEQ ID NO: 64571
  CDS (1)..(1617)

SEQ ID NO: 81104 - protein, 538 aa, Silicibacter sp. TM1040; identical to SEQ ID NO: 64572

SEQ ID NO: 81105 - DNA, 1512 bp, Rickettsia akari str. Hartford; identical to SEQ ID NO: 64573
  CDS (1)..(1512)

SEQ ID NO: 81106 - protein, 503 aa, Rickettsia akari str. Hartford; identical to SEQ ID NO: 64574

SEQ ID NO: 81107 - DNA, 1476 bp, Ralstonia eutropha JMP134; identical to SEQ ID NO: 64575
  CDS (1)..(1476)

SEQ ID NO: 81108 - protein, 491 aa, Ralstonia eutropha JMP134; identical to SEQ ID NO: 64576

SEQ ID NO: 81109 - DNA, 1329 bp, Chloroflexus aurantiacus; identical to SEQ ID NO: 64577
  CDS (1)..(1329)

SEQ ID NO: 81110 - protein, 442 aa, Chloroflexus aurantiacus; identical to SEQ ID NO: 64578

SEQ ID NO: 81111 - DNA, 1521 bp, Polaromonas sp. JS666; identical to SEQ ID NO: 64579
  CDS (1)..(1521)

SEQ ID NO: 81112 - protein, 506 aa, Polaromonas sp. JS666; identical to SEQ ID NO: 64580

SEQ ID NO: 81113 - DNA, 1116 bp, Bacillus subtilis; identical to SEQ ID NO: 64581
  CDS (1)..(1116): transl_table=11

SEQ ID NO: 81114 - protein, 371 aa, Bacillus subtilis; identical to SEQ ID NO: 64582

SEQ ID NO: 81115 - DNA, 1449 bp, Borrelia burgdorferi; identical to SEQ ID NO: 64583
  CDS (1)..(1449): transl_table=11

SEQ ID NO: 81116 - protein, 482 aa, Borrelia burgdorferi; identical to SEQ ID NO: 64584

SEQ ID NO: 81117 - DNA, 1488 bp, Buchnera aphidicola; identical to SEQ ID NO: 64585
  CDS (1)..(1488): transl_table=11

SEQ ID NO: 81118 - protein, 495 aa, Buchnera aphidicola; identical to SEQ ID NO: 64586

SEQ ID NO: 81119 - DNA, 1494 bp, Buchnera aphidicola; identical to SEQ ID NO: 64587
  CDS (1)..(1494): transl_table=11

SEQ ID NO: 81120 - protein, 497 aa, Buchnera aphidicola; identical to SEQ ID NO: 64588

SEQ ID NO: 81121 - DNA, 1188 bp, Helicobacter pylori J99; identical to SEQ ID NO: 64589
  CDS (1)..(1188): transl_table=11

SEQ ID NO: 81122 - protein, 395 aa, Helicobacter pylori J99; identical to SEQ ID NO: 64590

SEQ ID NO: 81123 - DNA, 1164 bp, Thermus thermophilus; identical to SEQ ID NO: 64591
  CDS (1)..(1164): transl_table=11

SEQ ID NO: 81124 - protein, 387 aa, Thermus thermophilus; identical to SEQ ID NO: 64592

SEQ ID NO: 81125 - DNA, 26 bp, Primer
atgaacaaagaaattttggctgtagt

SEQ ID NO: 81126 - DNA, 22 bp, Primer
ttacgcttcgtcaccgaaccag

SEQ ID NO: 81127 - protein, 427 aa, consensus; identical to SEQ ID NO: 64595
  MISC_FEATURE (1)..(427): consensus for the disclosure of xaa see table XV

SEQ ID NO: 81128 - protein, 153 aa, consensus; identical to SEQ ID NO: 64596
  MISC_FEATURE (1)..(153): consensus for the disclosure of xaa see table XV

SEQ ID NO: 81129 - DNA, 1344 bp, Escherichia coli K12; identical to SEQ ID NO: 25117
  CDS (1)..(1344)

SEQ ID NO: 81130 - protein, 447 aa, Escherichia coli K12; identical to SEQ ID NO: 25118

SEQ ID NO: 81131 - DNA, 1215 bp, Vibrio cholerae; identical to SEQ ID NO: 25119
  CDS (1)..(1215)

SEQ ID NO: 81132 - protein, 404 aa, Vibrio cholerae; identical to SEQ ID NO: 25120

SEQ ID NO: 81133 - DNA, 1215 bp, Listeria monocytogenes; identical to SEQ ID NO: 25121
  CDS (1)..(1215)

SEQ ID NO: 81134 - protein, 404 aa, Listeria monocytogenes; identical to SEQ ID NO: 25122

SEQ ID NO: 81135 - DNA, 1224 bp, Agrobacterium tumefaciens; identical to SEQ ID NO: 25123
  CDS (1)..(1224)

SEQ ID NO: 81136 - protein, 407 aa, Agrobacterium tumefaciens; identical to SEQ ID NO: 25124

SEQ ID NO: 81137 - DNA, 1410 bp, Salmonella enterica subsp. enterica serovar Typhi; identical to SEQ ID NO: 25125
  CDS (1)..(1410)

SEQ ID NO: 81138 - protein, 469 aa, Salmonella enterica subsp. enterica serovar Typhi; identical to SEQ ID NO: 25126

SEQ ID NO: 81139 - DNA, 1368 bp, Yersinia pestis; identical to SEQ ID NO: 25127
  CDS (1)..(1368)

SEQ ID NO: 81140 - protein, 455 aa, Yersinia pestis; identical to SEQ ID NO: 25128

SEQ ID NO: 81141 - DNA, 1203 bp, Nostoc sp. PCC 7120; identical to SEQ ID NO: 25129
  CDS (1)..(1203)

SEQ ID NO: 81142 - protein, 400 aa, Nostoc sp. PCC 7120; identical to SEQ ID NO: 25130

SEQ ID NO: 81143 - DNA, 1215 bp, Listeria innocua; identical to SEQ ID NO: 25131
  CDS (1)..(1215)

SEQ ID NO: 81144 - protein, 404 aa, Listeria innocua; identical to SEQ ID NO: 25132

SEQ ID NO: 81145 - DNA, 2317 bp, Saccharomyces cerevisiae; identical to SEQ ID NO: 25133
  CDS (762)..(2024)

SEQ ID NO: 81146 - protein, 420 aa, Saccharomyces cerevisiae; identical to SEQ ID NO: 25134

SEQ ID NO: 81147 - DNA, 1239 bp, Mus musculus (house mouse); identical to SEQ ID NO: 25135
  CDS (1)..(1239)

SEQ ID NO: 81148 - protein, 412 aa, Mus musculus (house mouse); identical to SEQ ID NO: 25136

SEQ ID NO: 81149 - DNA, 2098 bp, Methanococcus vannielii; identical to SEQ ID NO: 25137
  CDS (798)..(1991)

SEQ ID NO: 81150 - protein, 397 aa, Methanococcus vannielii; identical to SEQ ID NO: 25138

SEQ ID NO: 81151 - DNA, 2171 bp, Streptomyces coelicolor; identical to SEQ ID NO: 25139
  CDS (317)..(1780)

SEQ ID NO: 81152 - protein, 487 aa, Streptomyces coelicolor; identical to SEQ ID NO: 25140

SEQ ID NO: 81153 - DNA, 1212 bp, Bacillus subtilis; identical to SEQ ID NO: 25141
  CDS (1)..(1212)

SEQ ID NO: 81154 - protein, 403 aa, Bacillus subtilis; identical to SEQ ID NO: 25142

SEQ ID NO: 81155 - DNA, 1206 bp, Aquifex aeolicus; identical to SEQ ID NO: 25143
  CDS (1)..(1206)

SEQ ID NO: 81156 - protein, 401 aa, Aquifex aeolicus; identical to SEQ ID NO: 25144

SEQ ID NO: 81157 - DNA, 1206 bp, Staphylococcus aureus; identical to SEQ ID NO: 25145
  CDS (1)..(1206)

SEQ ID NO: 81158 - protein, 401 aa, Staphylococcus aureus; identical to SEQ ID NO: 25146

SEQ ID NO: 81159 - DNA, 1203 bp, Clostridium acetobutylicum; identical to SEQ ID NO: 25147
  CDS (1)..(1203)

SEQ ID NO: 81160 - protein, 400 aa, Clostridium acetobutylicum; identical to SEQ ID NO: 25148

SEQ ID NO: 81161 - DNA, 1221 bp, Campylobacter jejuni; identical to SEQ ID NO: 25149
  CDS (1)..(1221)

SEQ ID NO: 81162 - protein, 406 aa, Campylobacter jejuni; identical to SEQ ID NO: 25150

SEQ ID NO: 81163 - DNA, 1239 bp, Pseudomonas aeruginosa; identical to SEQ ID NO: 25151
  CDS (22)..(1239)

SEQ ID NO: 81164 - protein, 405 aa, Pseudomonas aeruginosa; identical to SEQ ID NO: 25152

SEQ ID NO: 81165 - DNA, 1230 bp, Bacillus halodurans; identical to SEQ ID NO: 25153
  CDS (1)..(1230)

SEQ ID NO: 81166 - protein, 409 aa, Bacillus halodurans; identical to SEQ ID NO: 25154

SEQ ID NO: 81167 - DNA, 1191 bp, Halobacterium sp. NRC-1; identical to SEQ ID NO: 25155
  CDS (1)..(1191)

SEQ ID NO: 81168 - protein, 396 aa, Halobacterium sp. NRC-1; identical to SEQ ID NO: 25156

SEQ ID NO: 81169 - DNA, 1221 bp, Sulfolobus solfataricus; identical to SEQ ID NO: 25157
  CDS (1)..(1221)

SEQ ID NO: 81170 - protein, 406 aa, Sulfolobus solfataricus; identical to SEQ ID NO: 25158

SEQ ID NO: 81171 - DNA, 1173 bp, Archaeoglobus fulgidus; identical to SEQ ID NO: 25159
  CDS (1)..(1173)

SEQ ID NO: 81172 - protein, 390 aa, Archaeoglobus fulgidus; identical to SEQ ID NO: 25160

SEQ ID NO: 81173 - DNA, 1209 bp, Deinococcus radiodurans; identical to SEQ ID NO: 25161
  CDS (1)..(1209)

SEQ ID NO: 81174 - protein, 402 aa, Deinococcus radiodurans; identical to SEQ ID NO: 25162

SEQ ID NO: 81175 - DNA, 1197 bp, Lactococcus lactis subsp. lactis; identical to SEQ ID NO: 25163
  CDS (1)..(1197)

SEQ ID NO: 81176 - protein, 398 aa, Lactococcus lactis subsp. lactis; identical to SEQ ID NO: 25164

SEQ ID NO: 81177 - DNA, 1188 bp, Methanococcus jannaschii; identical to SEQ ID NO: 25165
  CDS (1)..(1188)

SEQ ID NO: 81178 - protein, 395 aa, Methanococcus jannaschii; identical to SEQ ID NO: 25166

SEQ ID NO: 81179 - DNA, 1197 bp, Mycobacterium tuberculosis; identical to SEQ ID NO: 25167
  CDS (1)..(1197)

SEQ ID NO: 81180 - protein, 398 aa, Mycobacterium tuberculosis; identical to SEQ ID NO: 25168

SEQ ID NO: 81181 - DNA, 1335 bp, Haemophilus influenzae; identical to SEQ ID NO: 25169
  CDS (1)..(1335)

SEQ ID NO: 81182 - protein, 444 aa, Haemophilus influenzae; identical to SEQ ID NO: 25170

SEQ ID NO: 81183 - DNA, 1200 bp, Methanobacterium thermoautotrophicum; identical to SEQ ID NO: 25171
  CDS (1)..(1200)

SEQ ID NO: 81184 - protein, 399 aa, Methanobacterium thermoautotrophicum; identical to SEQ ID NO: 25172

SEQ ID NO: 81185 - DNA, 1344 bp, Neisseria meningitidis; identical to SEQ ID NO: 25173
  CDS (1)..(1344)

SEQ ID NO: 81186 - protein, 447 aa, Neisseria meningitidis; identical to SEQ ID NO: 25174

SEQ ID NO: 81187 - DNA, 1200 bp, Mycobacterium leprae; identical to SEQ ID NO: 25175
  CDS (1)..(1200)

SEQ ID NO: 81188 - protein, 399 aa, Mycobacterium leprae; identical to SEQ ID NO: 25176

SEQ ID NO: 81189 - DNA, 1248 bp, Streptococcus pneumoniae; identical to SEQ ID NO: 25177
  CDS (1)..(1248)

SEQ ID NO: 81190 - protein, 415 aa, Streptococcus pneumoniae; identical to SEQ ID NO: 25178

SEQ ID NO: 81191 - DNA, 1206 bp, Xylella fastidiosa; identical to SEQ ID NO: 25179
  CDS (1)..(1206)

SEQ ID NO: 81192 - protein, 401 aa, Xylella fastidiosa; identical to SEQ ID NO: 25180

SEQ ID NO: 81193 - DNA, 1230 bp, Thermotoga maritima; identical to SEQ ID NO: 25181
  CDS (1)..(1230)

SEQ ID NO: 81194 - protein, 409 aa, Thermotoga maritima; identical to SEQ ID NO: 25182

SEQ ID NO: 81195 - DNA, 1227 bp, Caulobacter crescentus; identical to SEQ ID NO: 25183
  CDS (1)..(1227)

SEQ ID NO: 81196 - protein, 408 aa, Caulobacter crescentus; identical to SEQ ID NO: 25184

SEQ ID NO: 81197 - DNA, 1194 bp, Streptomyces clavuligerus; identical to SEQ ID NO: 25185
  CDS (1)..(1194)

SEQ ID NO: 81198 - protein, 397 aa, Streptomyces clavuligerus; identical to SEQ ID NO: 25186

SEQ ID NO: 81199 - DNA, 2449 bp, Streptomyces lavendulae; identical to SEQ ID NO: 25187
  CDS (535)..(1983)

SEQ ID NO: 81200 - protein, 482 aa, Streptomyces lavendulae; identical to SEQ ID NO: 25188

SEQ ID NO: 81201 - DNA, 1203 bp, Synechocystis sp; identical to SEQ ID NO: 25189
  CDS (1)..(1203)

SEQ ID NO: 81202 - protein, 400 aa, Synechocystis sp; identical to SEQ ID NO: 25190

SEQ ID NO: 81203 - DNA, 1233 bp, Schizosaccharomyces pombe; identical to SEQ ID NO: 25191
  CDS (1)..(1233)

SEQ ID NO: 81204 - protein, 410 aa, Schizosaccharomyces pombe; identical to SEQ ID NO: 25192

SEQ ID NO: 81205 - DNA, 1245 bp, Ashbya gossypii; identical to SEQ ID NO: 25193
  CDS (1)..(1245)

SEQ ID NO: 81206 - protein, 414 aa, Ashbya gossypii; identical to SEQ ID NO: 25194

SEQ ID NO: 81207 - DNA, 1245 bp, Brachydanio rerio; identical to SEQ ID NO: 25195
  CDS (1)..(1245)

SEQ ID NO: 81208 - protein, 414 aa, Brachydanio rerio; identical to SEQ ID NO: 25196

SEQ ID NO: 81209 - DNA, 1206 bp, Symbiobacterium thermophilum; identical to SEQ ID NO: 25197
  CDS (1)..(1206)

SEQ ID NO: 81210 - protein, 401 aa, Symbiobacterium thermophilum; identical to SEQ ID NO: 25198

SEQ ID NO: 81211 - DNA, 1425 bp, Propionibacterium acnes; identical to SEQ ID NO: 25199
  CDS (1)..(1425)

SEQ ID NO: 81212 - protein, 474 aa, Propionibacterium acnes; identical to SEQ ID NO: 25200

SEQ ID NO: 81213 - DNA, 1437 bp, Leifsonia xyli; identical to SEQ ID NO: 25201
  CDS (1)..(1437)

SEQ ID NO: 81214 - protein, 478 aa, Leifsonia xyli; identical to SEQ ID NO: 25202

SEQ ID NO: 81215 - DNA, 1197 bp, Desulfotalea psychrophila; identical to SEQ ID NO: 25203
  CDS (1)..(1197)

SEQ ID NO: 81216 - protein, 398 aa, Desulfotalea psychrophila; identical to SEQ ID NO: 25204

SEQ ID NO: 81217 - DNA, 1251 bp, Debaryomyces hansenii CBS767; identical to SEQ ID NO: 25205
  CDS (1)..(1251)

SEQ ID NO: 81218 - protein, 416 aa, Debaryomyces hansenii CBS767; identical to SEQ ID NO: 25206

SEQ ID NO: 81219 - DNA, 1263 bp, Kluyveromyces lactis NRRL Y; identical to SEQ ID NO: 25207
  CDS (1)..(1263)

SEQ ID NO: 81220 - protein, 420 aa, Kluyveromyces lactis NRRL Y; identical to SEQ ID NO: 25208

SEQ ID NO: 81221 - DNA, 1347 bp, Erwinia carotovora; identical to SEQ ID NO: 25209
  CDS (1)..(1347)

SEQ ID NO: 81222 - protein, 448 aa, Erwinia carotovora; identical to SEQ ID NO: 25210

SEQ ID NO: 81223 - DNA, 1341 bp, Acinetobacter sp; identical to SEQ ID NO: 25211
  CDS (1)..(1341)

SEQ ID NO: 81224 - protein, 446 aa, Acinetobacter sp; identical to SEQ ID NO: 25212

SEQ ID NO: 81225 - DNA, 1263 bp, Candida glabrata CBS138; identical to SEQ ID NO: 25213
  CDS (1)..(1263)

SEQ ID NO: 81226 - protein, 420 aa, Candida glabrata CBS138; identical to SEQ ID NO: 25214

SEQ ID NO: 81227 - DNA, 1206 bp, Bacillus thuringiensis; identical to SEQ ID NO: 25215
  CDS (1)..(1206)

SEQ ID NO: 81228 - protein, 401 aa, Bacillus thuringiensis; identical to SEQ ID NO: 25216

SEQ ID NO: 81229 - DNA, 1188 bp, Picrophilus torridus; identical to SEQ ID NO: 25217
  CDS (1)..(1188)

SEQ ID NO: 81230 - protein, 395 aa, Picrophilus torridus; identical to SEQ ID NO: 25218

SEQ ID NO: 81231 - DNA, 1215 bp, Photobacterium profundum; identical to SEQ ID NO: 25219
  CDS (1)..(1215)

SEQ ID NO: 81232 - protein, 404 aa, Photobacterium profundum; identical to SEQ ID NO: 25220

SEQ ID NO: 81233 - DNA, 1338 bp, Rhodopseudomonas palustris; identical to SEQ ID NO: 25221
  CDS (1)..(1338)

SEQ ID NO: 81234 - protein, 445 aa, Rhodopseudomonas palustris; identical to SEQ ID NO: 25222

SEQ ID NO: 81235 - DNA, 1191 bp, Photorhabdus luminescens; identical to SEQ ID NO: 25223
  CDS (1)..(1191)

SEQ ID NO: 81236 - protein, 396 aa, Photorhabdus luminescens; identical to SEQ ID NO: 25224

SEQ ID NO: 81237 - DNA, 1227 bp, Neurospora crassa; identical to SEQ ID NO: 25225
  CDS (1)..(1227)

SEQ ID NO: 81238 - protein, 408 aa, Neurospora crassa; identical to SEQ ID NO: 25226

SEQ ID NO: 81239 - DNA, 1332 bp, Haemophilus ducreyi; identical to SEQ ID NO: 25227
  CDS (1)..(1332)

SEQ ID NO: 81240 - protein, 443 aa, Haemophilus ducreyi; identical to SEQ ID NO: 25228

SEQ ID NO: 81241 - DNA, 1733 bp, Xenopus laevis; identical to SEQ ID NO: 25229
  CDS (81)..(1316)

SEQ ID NO: 81242 - protein, 411 aa, Xenopus laevis; identical to SEQ ID NO: 25230

SEQ ID NO: 81243 - DNA, 1455 bp, Streptomyces avermitilis; identical to SEQ ID NO: 25231
  CDS (1)..(1455)

SEQ ID NO: 81244 - protein, 484 aa, Streptomyces avermitilis; identical to SEQ ID NO: 25232

SEQ ID NO: 81245 - DNA, 1209 bp, Bacteroides thetaiotaomicron; identical to SEQ ID NO: 25233
  CDS (1)..(1209)

SEQ ID NO: 81246 - protein, 402 aa, Bacteroides thetaiotaomicron; identical to SEQ ID NO: 25234

SEQ ID NO: 81247 - DNA, 1215 bp, Vibrio vulnificus; identical to SEQ ID NO: 25235
  CDS (1)..(1215)

SEQ ID NO: 81248 - protein, 404 aa, Vibrio vulnificus; identical to SEQ ID NO: 25236

SEQ ID NO: 81249 - DNA, 1516 bp, Arabidopsis thaliana; identical to SEQ ID NO: 25237
  CDS (1)..(1485)

SEQ ID NO: 81250 - protein, 494 aa, Arabidopsis thaliana; identical to SEQ ID NO: 25238

SEQ ID NO: 81251 - DNA, 1206 bp, Bacillus cereus; identical to SEQ ID NO: 25239
  CDS (1)..(1206)

SEQ ID NO: 81252 - protein, 401 aa, Bacillus cereus; identical to SEQ ID NO: 25240

SEQ ID NO: 81253 - DNA, 1239 bp, Bifidobacterium longum; identical to SEQ ID NO: 25241
  CDS (1)..(1239)

SEQ ID NO: 81254 - protein, 412 aa, Bifidobacterium longum; identical to SEQ ID NO: 25242

SEQ ID NO: 81255 - DNA, 1338 bp, Bordetella bronchiseptica; identical to SEQ ID NO: 25243
  CDS (1)..(1338)

SEQ ID NO: 81256 - protein, 445 aa, Bordetella bronchiseptica; identical to SEQ ID NO: 25244

SEQ ID NO: 81257 - DNA, 1338 bp, Bradyrhizobium japonicum; identical to SEQ ID NO: 25245
  CDS (1)..(1338)

SEQ ID NO: 81258 - protein, 445 aa, Bradyrhizobium japonicum; identical to SEQ ID NO: 25246

SEQ ID NO: 81259 - DNA, 1221 bp, Brucella suis; identical to SEQ ID NO: 25247
  CDS (1)..(1221)

SEQ ID NO: 81260 - protein, 406 aa, Brucella suis; identical to SEQ ID NO: 25248

SEQ ID NO: 81261 - DNA, 1206 bp, Buchnera aphidicola; identical to SEQ ID NO: 25249
  CDS (1)..(1206)

SEQ ID NO: 81262 - protein, 401 aa, Buchnera aphidicola; identical to SEQ ID NO: 25250

SEQ ID NO: 81263 - DNA, 1230 bp, Buchnera aphidicola; identical to SEQ ID NO: 25251
  CDS (1)..(1230)

SEQ ID NO: 81264 - protein, 409 aa, Buchnera aphidicola; identical to SEQ ID NO: 25252

SEQ ID NO: 81265 - DNA, 1338 bp, Burkholderia multivorans; identical to SEQ ID NO: 25253
  CDS (1)..(1338)

SEQ ID NO: 81266 - protein, 445 aa, Burkholderia multivorans; identical to SEQ ID NO: 25254

SEQ ID NO: 81267 - DNA, 1206 bp, Chlorobium tepidum; identical to SEQ ID NO: 25255
  CDS (1)..(1206)

SEQ ID NO: 81268 - protein, 401 aa, Chlorobium tepidum; identical to SEQ ID NO: 25256

SEQ ID NO: 81269 - DNA, 1227 bp, Chromobacterium violaceum; identical to SEQ ID NO: 25257
  CDS (1)..(1227)

SEQ ID NO: 81270 - protein, 408 aa, Chromobacterium violaceum; identical to SEQ ID NO: 25258

SEQ ID NO: 81271 - DNA, 1218 bp, Clostridium perfringens; identical to SEQ ID NO: 25259
  CDS (1)..(1218)

SEQ ID NO: 81272 - protein, 405 aa, Clostridium perfringens; identical to SEQ ID NO: 25260

SEQ ID NO: 81273 - DNA, 1197 bp, Clostridium tetani; identical to SEQ ID NO: 25261
  CDS (1)..(1197)

SEQ ID NO: 81274 - protein, 398 aa, Clostridium tetani; identical to SEQ ID NO: 25262

SEQ ID NO: 81275 - DNA, 1200 bp, Corynebacterium diphtheriae; identical to SEQ ID NO: 25263
  CDS (1)..(1200)

SEQ ID NO: 81276 - protein, 399 aa, Corynebacterium diphtheriae; identical to SEQ ID NO: 25264

SEQ ID NO: 81277 - DNA, 1206 bp, Corynebacterium efficiens; identical to SEQ ID NO: 25265
  CDS (1)..(1206)

SEQ ID NO: 81278 - protein, 401 aa, Corynebacterium efficiens; identical to SEQ ID NO: 25266

SEQ ID NO: 81279 - DNA, 1206 bp, Corynebacterium glutamicum; identical to SEQ ID NO: 25267
  CDS (1)..(1206)

SEQ ID NO: 81280 - protein, 401 aa, Corynebacterium glutamicum; identical to SEQ ID NO: 25268

SEQ ID NO: 81281 - DNA, 1191 bp, Desulfovibrio vulgaris; identical to SEQ ID NO: 25269
  CDS (1)..(1191)

SEQ ID NO: 81282 - protein, 396 aa, Desulfovibrio vulgaris; identical to SEQ ID NO: 25270

SEQ ID NO: 81283 - DNA, 1274 bp, Drosophila melanogaster; identical to SEQ ID NO: 25271
  CDS (15)..(1274)

SEQ ID NO: 81284 - protein, 419 aa, Drosophila melanogaster; identical to SEQ ID NO: 25272

SEQ ID NO: 81285 - DNA, 1221 bp, Geobacter sulfurreducens; identical to SEQ ID NO: 25273
  CDS (1)..(1221)

SEQ ID NO: 81286 - protein, 406 aa, Geobacter sulfurreducens; identical to SEQ ID NO: 25274

SEQ ID NO: 81287 - DNA, 1197 bp, Gloeobacter violaceus; identical to SEQ ID NO: 25275
  CDS (1)..(1197)

SEQ ID NO: 81288 - protein, 398 aa, Gloeobacter violaceus; identical to SEQ ID NO: 25276

SEQ ID NO: 81289 - DNA, 1215 bp, Helicobacter hepaticus; identical to SEQ ID NO: 25277
  CDS (1)..(1215)

SEQ ID NO: 81290 - protein, 404 aa, Helicobacter hepaticus; identical to SEQ ID NO: 25278

SEQ ID NO: 81291 - DNA, 1236 bp, Lactobacillus plantarum; identical to SEQ ID NO: 25279
  CDS (1)..(1236)

SEQ ID NO: 81292 - protein, 411 aa, Lactobacillus plantarum; identical to SEQ ID NO: 25280

SEQ ID NO: 81293 - DNA, 1212 bp, Leptospira interrogans; identical to SEQ ID NO: 25281
  CDS (1)..(1212)

SEQ ID NO: 81294 - protein, 403 aa, Leptospira interrogans; identical to SEQ ID NO: 25282

SEQ ID NO: 81295 - DNA, 1185 bp, Methanopyrus kandleri; identical to SEQ ID NO: 25283
  CDS (1)..(1185)

SEQ ID NO: 81296 - protein, 394 aa, Methanopyrus kandleri; identical to SEQ ID NO: 25284

SEQ ID NO: 81297 - DNA, 1185 bp, Methanosarcina mazei; identical to SEQ ID NO: 25285
  CDS (1)..(1185)

SEQ ID NO: 81298 - protein, 394 aa, Methanosarcina mazei; identical to SEQ ID NO: 25286

SEQ ID NO: 81299 - DNA, 1194 bp, Methanococcus maripaludis; identical to SEQ ID NO: 25287
  CDS (1)..(1194)

SEQ ID NO: 81300 - protein, 397 aa, Methanococcus maripaludis; identical to SEQ ID NO: 25288

SEQ ID NO: 81301 - DNA, 1215 bp, Moritella abyssi; identical to SEQ ID NO: 25289
  CDS (1)..(1215)

SEQ ID NO: 81302 - protein, 404 aa, Moritella abyssi; identical to SEQ ID NO: 25290

SEQ ID NO: 81303 - DNA, 1215 bp, Moritella profunda; identical to SEQ ID NO: 25291
  CDS (1)..(1215)

SEQ ID NO: 81304 - protein, 404 aa, Moritella profunda; identical to SEQ ID NO: 25292

SEQ ID NO: 81305 - DNA, 1197 bp, Mycobacterium paratuberculosis; identical to SEQ ID NO: 25293
  CDS (1)..(1197)

SEQ ID NO: 81306 - protein, 398 aa, Mycobacterium paratuberculosis; identical to SEQ ID NO: 25294

SEQ ID NO: 81307 - DNA, 1215 bp, Nitrosomonas europaea; identical to SEQ ID NO: 25295
  CDS (1)..(1215)

SEQ ID NO: 81308 - protein, 404 aa, Nitrosomonas europaea; identical to SEQ ID NO: 25296

SEQ ID NO: 81309 - DNA, 1254 bp, Oceanobacillus iheyensis; identical to SEQ ID NO: 25297
  CDS (1)..(1254)

SEQ ID NO: 81310 - protein, 417 aa, Oceanobacillus iheyensis; identical to SEQ ID NO: 25298

SEQ ID NO: 81311 - DNA, 1338 bp, Pasteurella multocida; identical to SEQ ID NO: 25299
  CDS (1)..(1338)

SEQ ID NO: 81312 - protein, 445 aa, Pasteurella multocida; identical to SEQ ID NO: 25300

SEQ ID NO: 81313 - DNA, 1215 bp, Photorhabdus luminescens; identical to SEQ ID NO: 25301
  CDS (1)..(1215)

SEQ ID NO: 81314 - protein, 404 aa, Photorhabdus luminescens; identical to SEQ ID NO: 25302

SEQ ID NO: 81315 - DNA, 1209 bp, Prochlorococcus marinus; identical to SEQ ID NO: 25303
  CDS (1)..(1209)

SEQ ID NO: 81316 - protein, 402 aa, Prochlorococcus marinus; identical to SEQ ID NO: 25304

SEQ ID NO: 81317 - DNA, 1206 bp, Prochlorococcus marinus; identical to SEQ ID NO: 25305
  CDS (1)..(1206)

SEQ ID NO: 81318 - protein, 401 aa, Prochlorococcus marinus; identical to SEQ ID NO: 25306

SEQ ID NO: 81319 - DNA, 1215 bp, Prochlorococcus marinus subsp; identical to SEQ ID NO: 25307
  CDS (1)..(1215)

SEQ ID NO: 81320 - protein, 404 aa, Prochlorococcus marinus subsp; identical to SEQ ID NO: 25308

SEQ ID NO: 81321 - DNA, 1218 bp, Pseudomonas putida; identical to SEQ ID NO: 25309
  CDS (1)..(1218)

SEQ ID NO: 81322 - protein, 405 aa, Pseudomonas putida; identical to SEQ ID NO: 25310

SEQ ID NO: 81323 - DNA, 1218 bp, Pseudomonas syringae; identical to SEQ ID NO: 25311
  CDS (1)..(1218)

SEQ ID NO: 81324 - protein, 405 aa, Pseudomonas syringae; identical to SEQ ID NO: 25312

SEQ ID NO: 81325 - DNA, 1233 bp, Pyrococcus furiosus; identical to SEQ ID NO: 25313
  CDS (1)..(1233)

SEQ ID NO: 81326 - protein, 410 aa, Pyrococcus furiosus; identical to SEQ ID NO: 25314

SEQ ID NO: 81327 - DNA, 1338 bp, Ralstonia solanacearum; identical to SEQ ID NO: 25315
  CDS (1)..(1338)

SEQ ID NO: 81328 - protein, 445 aa, Ralstonia solanacearum; identical to SEQ ID NO: 25316

SEQ ID NO: 81329 - DNA, 1224 bp, Rhizobium loti; identical to SEQ ID NO: 25317
  CDS (1)..(1224)

SEQ ID NO: 81330 - protein, 407 aa, Rhizobium loti; identical to SEQ ID NO: 25318

SEQ ID NO: 81331 - DNA, 1218 bp, Rhizobium meliloti; identical to SEQ ID NO: 25319
  CDS (1)..(1218)

SEQ ID NO: 81332 - protein, 405 aa, Rhizobium meliloti; identical to SEQ ID NO: 25320

SEQ ID NO: 81333 - DNA, 1215 bp, Rhodopirellula baltica; identical to SEQ ID NO: 25321
  CDS (1)..(1215)

SEQ ID NO: 81334 - protein, 404 aa, Rhodopirellula baltica; identical to SEQ ID NO: 25322

SEQ ID NO: 81335 - DNA, 1188 bp, Rhodococcus fascians; identical to SEQ ID NO: 25323
  CDS (1)..(1188)

SEQ ID NO: 81336 - protein, 395 aa, Rhodococcus fascians; identical to SEQ ID NO: 25324

SEQ ID NO: 81337 - DNA, 1224 bp, Shewanella oneidensis; identical to SEQ ID NO: 25325
  CDS (1)..(1224)

SEQ ID NO: 81338 - protein, 407 aa, Shewanella oneidensis; identical to SEQ ID NO: 25326

SEQ ID NO: 81339 - DNA, 1215 bp, Staphylococcus epidermidis; identical to SEQ ID NO: 25327
  CDS (10)..(1215)

SEQ ID NO: 81340 - protein, 401 aa, Staphylococcus epidermidis; identical to SEQ ID NO: 25328

SEQ ID NO: 81341 - DNA, 1215 bp, Streptomyces avermitilis; identical to SEQ ID NO: 25329
  CDS (1)..(1215)

SEQ ID NO: 81342 - protein, 404 aa, Streptomyces avermitilis; identical to SEQ ID NO: 25330

SEQ ID NO: 81343 - DNA, 1446 bp, Streptomyces coelicolor; identical to SEQ ID NO: 25331
  CDS (1)..(1446)

SEQ ID NO: 81344 - protein, 481 aa, Streptomyces coelicolor; identical to SEQ ID NO: 25332

SEQ ID NO: 81345 - DNA, 1191 bp, Streptococcus mutans; identical to SEQ ID NO: 25333
  CDS (1)..(1191)

SEQ ID NO: 81346 - protein, 396 aa, Streptococcus mutans; identical to SEQ ID NO: 25334

SEQ ID NO: 81347 - DNA, 1173 bp, Sulfolobus tokodaii; identical to SEQ ID NO: 25335
  CDS (1)..(1173)

SEQ ID NO: 81348 - protein, 390 aa, Sulfolobus tokodaii; identical to SEQ ID NO: 25336

SEQ ID NO: 81349 - DNA, 1206 bp, Synechococcus elongatus; identical to SEQ ID NO: 25337
  CDS (1)..(1206)

SEQ ID NO: 81350 - protein, 401 aa, Synechococcus elongatus; identical to SEQ ID NO: 25338

SEQ ID NO: 81351 - DNA, 1212 bp, Synechococcus sp; identical to SEQ ID NO: 25339
  CDS (1)..(1212)

SEQ ID NO: 81352 - protein, 403 aa, Synechococcus sp; identical to SEQ ID NO: 25340

SEQ ID NO: 81353 - DNA, 1218 bp, Thermoplasma acidophilum; identical to SEQ ID NO: 25341
  CDS (1)..(1218)

SEQ ID NO: 81354 - protein, 405 aa, Thermoplasma acidophilum; identical to SEQ ID NO: 25342

SEQ ID NO: 81355 - DNA, 1203 bp, Thermus thermophilus; identical to SEQ ID NO: 25343
  CDS (1)..(1203)

SEQ ID NO: 81356 - protein, 400 aa, Thermus thermophilus; identical to SEQ ID NO: 25344

SEQ ID NO: 81357 - DNA, 1233 bp, Thermoanaerobacter tengcongensis; identical to SEQ ID NO: 25345
  CDS (1)..(1233)

SEQ ID NO: 81358 - protein, 410 aa, Thermoanaerobacter tengcongensis; identical to SEQ ID NO: 25346

SEQ ID NO: 81359 - DNA, 1212 bp, Vibrio vulnificus; identical to SEQ ID NO: 25347
  CDS (1)..(1212)

SEQ ID NO: 81360 - protein, 403 aa, Vibrio vulnificus; identical to SEQ ID NO: 25348

SEQ ID NO: 81361 - DNA, 1215 bp, Wolinella succinogenes; identical to SEQ ID NO: 25349
  CDS (1)..(1215)

SEQ ID NO: 81362 - protein, 404 aa, Wolinella succinogenes; identical to SEQ ID NO: 25350

SEQ ID NO: 81363 - DNA, 1194 bp, Xanthomonas campestris; identical to SEQ ID NO: 25351
  CDS (1)..(1194)

SEQ ID NO: 81364 - protein, 397 aa, Xanthomonas campestris; identical to SEQ ID NO: 25352

SEQ ID NO: 81365 - DNA, 1206 bp, Xylella fastidiosa; identical to SEQ ID NO: 25353
  CDS (1)..(1206)

SEQ ID NO: 81366 - protein, 401 aa, Xylella fastidiosa; identical to SEQ ID NO: 25354

SEQ ID NO: 81367 - DNA, 24 bp, Primer
atgacgacgattctcaagcatctc

SEQ ID NO: 81368 - DNA, 25 bp, Primer
ttactggcctttgttttccagattc

SEQ ID NO: 81369 - protein, 409 aa, consensus; identical to SEQ ID NO: 25521
  MISC_FEATURE (1)..(409): consensus for the disclosure of xaa see table XV

SEQ ID NO: 81370 - protein, 36 aa, consensus; identical to SEQ ID NO: 25515
  MISC_FEATURE (1)..(36): consensus for the disclosure of xaa see table XV

SEQ ID NO: 81371 - protein, 42 aa, consensus; identical to SEQ ID NO: 25516
  MISC_FEATURE (1)..(42): consensus for the disclosure of xaa see table XV

SEQ ID NO: 81372 - protein, 18 aa, consensus
  MISC_FEATURE (1)..(18): consensus for the disclosure of xaa see table XV
XXXXXNXXXXXXXXXXXX

SEQ ID NO: 81373 - protein, 13 aa, consensus
  MISC_FEATURE (1)..(13): consensus for the disclosure of xaa see table XV
XXXXXXXGXXXXX

SEQ ID NO: 81374 - protein, 36 aa, consensus; identical to SEQ ID NO: 25519
  MISC_FEATURE (1)..(36): consensus for the disclosure of xaa see table XV

SEQ ID NO: 81375 - protein, 37 aa, consensus; identical to SEQ ID NO: 25520
  MISC_FEATURE (1)..(37): consensus for the disclosure of xaa see table XV

SEQ ID NO: 81376 - DNA, 725 bp, Escherichia coli K12; identical to SEQ ID NO: 31626
  CDS (4)..(432)

SEQ ID NO: 81377 - protein, 142 aa, Escherichia coli K12 [sequence omitted]

SEQ ID NO: 81378 - DNA, 982 bp, Spinacia oleracea (spinach); identical to SEQ ID NO: 31628
  CDS (40)..(792)

SEQ ID NO: 81379 - protein, 250 aa, Spinacia oleracea (spinach); identical to SEQ ID NO: 31629

SEQ ID NO: 81380 - DNA, 444 bp, Mycobacterium tuberculosis; identical to SEQ ID NO: 31630
  CDS (1)..(444)

SEQ ID NO: 81381 - protein, 147 aa, Mycobacterium tuberculosis; identical to SEQ ID NO: 31631

SEQ ID NO: 81382 - DNA, 453 bp, Chlamydia trachomatis; identical to SEQ ID NO: 31632
  CDS (1)..(453)

SEQ ID NO: 81383 - protein, 150 aa, Chlamydia trachomatis; identical to SEQ ID NO: 31633

SEQ ID NO: 81384 - DNA, 429 bp, Pseudomonas aeruginosa; identical to SEQ ID NO: 31634
  CDS (1)..(429)

SEQ ID NO: 81385 - protein, 142 aa, Pseudomonas aeruginosa; identical to SEQ ID NO: 31635

SEQ ID NO: 81386 - DNA, 474 bp, Caulobacter crescentus; identical to SEQ ID NO: 31636
  CDS (1)..(474)

SEQ ID NO: 81387 - protein, 157 aa, Caulobacter crescentus; identical to SEQ ID NO: 31637

SEQ ID NO: 81388 - DNA, 757 bp, Arabidopsis thaliana (mouse-ear cress); identical to SEQ ID NO: 31638
  CDS (1)..(726)

SEQ ID NO: 81389 - protein, 241 aa, Arabidopsis thaliana (mouse-ear cress); identical to SEQ ID NO: 31639

SEQ ID NO: 81390 - DNA, 465 bp, Agrobacterium tumefaciens; identical to SEQ ID NO: 31640
  CDS (1)..(465)

SEQ ID NO: 81391 - protein, 154 aa, Agrobacterium tumefaciens; identical to SEQ ID NO: 31641

SEQ ID NO: 81392 - DNA, 465 bp, Brucella melitensis; identical to SEQ ID NO: 31642
  CDS (1)..(465)

SEQ ID NO: 81393 - protein, 154 aa, Brucella melitensis; identical to SEQ ID NO: 31643

SEQ ID NO: 81394 - DNA, 438 bp, Listeria monocytogenes; identical to SEQ ID NO: 31644
  CDS (1)..(438)

SEQ ID NO: 81395 - protein, 145 aa, Listeria monocytogenes; identical to SEQ ID NO: 31645

SEQ ID NO: 81396 - DNA, 456 bp, Nostoc sp. PCC 7120; identical to SEQ ID NO: 31646
  CDS (1)..(456)

SEQ ID NO: 81397 - protein, 151 aa, Nostoc sp. PCC 7120; identical to SEQ ID NO: 31647

SEQ ID NO: 81398 - DNA, 438 bp, Haloarcula marismortui; identical to SEQ ID NO: 31648
  CDS (1)..(438)

SEQ ID NO: 81399 - protein, 145 aa, Haloarcula marismortui; identical to SEQ ID NO: 31649

SEQ ID NO: 81400 - DNA, 441 bp, Mycoplasma genitalium; identical to SEQ ID NO: 31650
  CDS (1)..(441): transl_table=4

SEQ ID NO: 81401 - protein, 146 aa, Mycoplasma genitalium; identical to SEQ ID NO: 31651

SEQ ID NO: 81402 - DNA, 441 bp, Borrelia burgdorferi (Lyme disease spirochete); identical to SEQ ID NO: 31652
  CDS (1)..(441)

SEQ ID NO: 81403 - protein, 146 aa, Borrelia burgdorferi (Lyme disease spirochete); identical to SEQ ID NO: 31653

SEQ ID NO: 81404 - DNA, 429 bp, Pyrococcus horikoshii; identical to SEQ ID NO: 31654
  CDS (1)..(429)

SEQ ID NO: 81405 - protein, 142 aa, Pyrococcus horikoshii; identical to SEQ ID NO: 31655

SEQ ID NO: 81406 - DNA, 432 bp, Neisseria meningitidis; identical to SEQ ID NO: 31656
  CDS (1)..(432)

SEQ ID NO: 81407 - protein, 143 aa, Neisseria meningitidis; identical to SEQ ID NO: 31657

SEQ ID NO: 81408 - DNA, 429 bp, Vibrio cholerae; identical to SEQ ID NO: 31658
  CDS (1)..(429)

SEQ ID NO: 81409 - protein, 142 aa, Vibrio cholerae; identical to SEQ ID NO: 31659

SEQ ID NO: 81410 - DNA, 423 bp, Methanococcus jannaschii; identical to SEQ ID NO: 31660
  CDS (1)..(423)

SEQ ID NO: 81411 - protein, 140 aa, Methanococcus jannaschii; identical to SEQ ID NO: 31661

SEQ ID NO: 81412 - DNA, 435 bp, Clostridium acetobutylicum; identical to SEQ ID NO: 31662
  CDS (1)..(435)

SEQ ID NO: 81413 - protein, 144 aa, Clostridium acetobutylicum; identical to SEQ ID NO: 31663

SEQ ID NO: 81414 - DNA, 483 bp, Helicobacter pylori; identical to SEQ ID NO: 31664
  CDS (19)..(444)

SEQ ID NO: 81415 - protein, 141 aa, Helicobacter pylori; identical to SEQ ID NO: 31665

SEQ ID NO: 81416 - DNA, 429 bp, Treponema pallidum subsp. pallidum (syphilis spirochete); identical to SEQ ID NO: 31666
  CDS (1)..(429)

SEQ ID NO: 81417 - protein, 142 aa, Treponema pallidum subsp. pallidum (syphilis spirochete); identical to SEQ ID NO: 31667

SEQ ID NO: 81418 - DNA, 849 bp, Methanobacterium thermoautotrophicum; identical to SEQ ID NO: 31668
  CDS (1)..(849)

SEQ ID NO: 81419 - protein, 282 aa, Methanobacterium thermoautotrophicum; identical to SEQ ID NO: 31669

SEQ ID NO: 81420 - DNA, 525 bp, Deinococcus radiodurans; identical to SEQ ID NO: 31670
  CDS (1)..(525)

SEQ ID NO: 81421 - protein, 174 aa, Deinococcus radiodurans; identical to SEQ ID NO: 31671

SEQ ID NO: 81422 - DNA, 426 bp, Campylobacter jejuni; identical to SEQ ID NO: 31672
  CDS (1)..(426)

SEQ ID NO: 81423 - protein, 141 aa, Campylobacter jejuni; identical to SEQ ID NO: 31673

SEQ ID NO: 81424 - DNA, 447 bp, Ureaplasma urealyticum; identical to SEQ ID NO: 31674
  CDS (1)..(447): transl_table=4

SEQ ID NO: 81425 - protein, 148 aa, Ureaplasma urealyticum; identical to SEQ ID NO: 31675

SEQ ID NO: 81426 - DNA, 438 bp, Staphylococcus aureus; identical to SEQ ID NO: 31676
  CDS (1)..(438)

SEQ ID NO: 81427 - protein, 145 aa, Staphylococcus aureus; identical to SEQ ID NO: 31677

SEQ ID NO: 81428 - DNA, 522 bp, Plasmodium falciparum; identical to SEQ ID NO: 31678
  CDS (1)..(522)

SEQ ID NO: 81429 - protein, 173 aa, Plasmodium falciparum; identical to SEQ ID NO: 31679

SEQ ID NO: 81430 - DNA, 468 bp, Rickettsia prowazekii; identical to SEQ ID NO: 31680
  CDS (1)..(468)

SEQ ID NO: 81431 - protein, 155 aa, Rickettsia prowazekii; identical to SEQ ID NO: 31681

SEQ ID NO: 81432 - DNA, 429 bp, Xylella fastidiosa; identical to SEQ ID NO: 31682
  CDS (1)..(429)

SEQ ID NO: 81433 - protein, 142 aa, Xylella fastidiosa; identical to SEQ ID NO: 31683

SEQ ID NO: 81434 - DNA, 438 bp, Halobacterium sp. NRC-1; identical to SEQ ID NO: 31684
  CDS (1)..(438)

SEQ ID NO: 81435 - protein, 145 aa, Halobacterium sp. NRC-1; identical to SEQ ID NO: 31685

SEQ ID NO: 81436 - DNA, 429 bp, Buchnera sp; identical to SEQ ID NO: 31686
  CDS (1)..(429)

SEQ ID NO: 81437 - protein, 142 aa, Buchnera sp; identical to SEQ ID NO: 31687

SEQ ID NO: 81438 - DNA, 447 bp, Lactococcus lactis subsp. lactis; identical to SEQ ID NO: 31688
  CDS (1)..(447)

SEQ ID NO: 81439 - protein, 148 aa, Lactococcus lactis subsp. lactis; identical to SEQ ID NO: 31689

SEQ ID NO: 81440 - DNA, 429 bp, Haemophilus influenzae; identical to SEQ ID NO: 31690
  CDS (1)..(429)

SEQ ID NO: 81441 - protein, 142 aa, Haemophilus influenzae; identical to SEQ ID NO: 31691

SEQ ID NO: 81442 - DNA, 471 bp, Archaeoglobus fulgidus; identical to SEQ ID NO: 31692
  CDS (1)..(471)

SEQ ID NO: 81443 - protein, 156 aa, Archaeoglobus fulgidus; identical to SEQ ID NO: 31693

SEQ ID NO: 81444 - DNA, 438 bp, Bacillus subtilis; identical to SEQ ID NO: 31694
  CDS (1)..(438)

SEQ ID NO: 81445 - protein, 145 aa, Bacillus subtilis; identical to SEQ ID NO: 31695

SEQ ID NO: 81446 - DNA, 450 bp, Thermotoga maritima; identical to SEQ ID NO: 31696
  CDS (1)..(450)

SEQ ID NO: 81447 - protein, 149 aa, Thermotoga maritima; identical to SEQ ID NO: 31697

SEQ ID NO: 81448 - DNA, 468 bp, Aeropyrum pernix; identical to SEQ ID NO: 31698
  CDS (1)..(468)

SEQ ID NO: 81449 - protein, 155 aa, Aeropyrum pernix; identical to SEQ ID NO: 31699

SEQ ID NO: 81450 - DNA, 450 bp, Chlamydophila pneumoniae, Chlamydia pneumoniae; identical to SEQ ID NO: 31700
  CDS (1)..(450)

SEQ ID NO: 81451 - protein, 149 aa, Chlamydophila pneumoniae, Chlamydia pneumoniae; identical to SEQ ID NO: 31701

SEQ ID NO: 81452 - DNA, 435 bp, Mycoplasma pulmonis; identical to SEQ ID NO: 31702
  CDS (1)..(435): transl_table=4

SEQ ID NO: 81453 - protein, 144 aa, Mycoplasma pulmonis; identical to SEQ ID NO: 31703

SEQ ID NO: 81454 - DNA, 447 bp, Streptococcus pneumoniae; identical to SEQ ID NO: 31704
  CDS (1)..(447)

SEQ ID NO: 81455 - protein, 148 aa, Streptococcus pneumoniae; identical to SEQ ID NO: 31705

SEQ ID NO: 81456 - DNA, 435 bp, Aquifex aeolicus; identical to SEQ ID NO: 31706
  CDS (1)..(435)

SEQ ID NO: 81457 - protein, 144 aa, Aquifex aeolicus; identical to SEQ ID NO: 31707

SEQ ID NO: 81458 - DNA, 438 bp, Bacillus halodurans; identical to SEQ ID NO: 31708
  CDS (1)..(438)

SEQ ID NO: 81459 - protein, 145 aa, Bacillus halodurans; identical to SEQ ID NO: 31709

SEQ ID NO: 81460 - DNA, 438 bp, Staphylococcus carnosus; identical to SEQ ID NO: 31710
  CDS (1)..(438)

SEQ ID NO: 81461 - protein, 145 aa, Staphylococcus carnosus; identical to SEQ ID NO: 31711

SEQ ID NO: 81462 - DNA, 438 bp, Sulfolobus acidocaldarius; identical to SEQ ID NO: 31712
  CDS (1)..(438)

SEQ ID NO: 81463 - protein, 145 aa, Sulfolobus acidocaldarius; identical to SEQ ID NO: 31713

SEQ ID NO: 81464 - DNA, 492 bp, Saccharomyces cerevisiae; identical to SEQ ID NO: 31714
  CDS (1)..(492)

SEQ ID NO: 81465 - protein, 163 aa, Saccharomyces cerevisiae; identical to SEQ ID NO: 31715

SEQ ID NO: 81466 - DNA, 444 bp, Mycobacterium leprae; identical to SEQ ID NO: 31716
  CDS (1)..(444)

SEQ ID NO: 81467 - protein, 147 aa, Mycobacterium leprae; identical to SEQ ID NO: 31717

SEQ ID NO: 81468 - DNA, 429 bp, chloroplast Porphyra purpurea; identical to SEQ ID NO: 31718
  CDS (1)..(429)

SEQ ID NO: 81469 - protein, 142 aa, chloroplast Porphyra purpurea; identical to SEQ ID NO: 31719

SEQ ID NO: 81470 - DNA, 450 bp, Sulfolobus solfataricus; identical to SEQ ID NO: 31720
  CDS (1)..(450)

SEQ ID NO: 81471 - protein, 149 aa, Sulfolobus solfataricus; identical to SEQ ID NO: 31721

SEQ ID NO: 81472 - DNA, 456 bp, Synechocystis sp; identical to SEQ ID NO: 31722
  CDS (1)..(456)

SEQ ID NO: 81473 - protein, 151 aa, Synechocystis sp; identical to SEQ ID NO: 31723

SEQ ID NO: 81474 - DNA, 420 bp, chloroplast Odontella sinensis; identical to SEQ ID NO: 31724
  CDS (1)..(420)

SEQ ID NO: 81475 - protein, 139 aa, chloroplast Odontella sinensis; identical to SEQ ID NO: 31725

SEQ ID NO: 81476 - DNA, 444 bp, Streptomyces coelicolor; identical to SEQ ID NO: 31726
  CDS (1)..(444)

SEQ ID NO: 81477 - protein, 147 aa, Streptomyces coelicolor; identical to SEQ ID NO: 31727

SEQ ID NO: 81478 - DNA, 474 bp, Schizosaccharomyces pombe; identical to SEQ ID NO: 31728
  CDS (1)..(474)

SEQ ID NO: 81479 - protein, 157 aa, Schizosaccharomyces pombe; identical to SEQ ID NO: 31729

SEQ ID NO: 81480 - DNA, 540 bp, Burkholderia mallei ATCC 23344; identical to SEQ ID NO: 31730
  CDS (112)..(540)

SEQ ID NO: 81481 - protein, 142 aa, Burkholderia mallei ATCC 23344; identical to SEQ ID NO: 31731

SEQ ID NO: 81482 - DNA, 438 bp, Bacillus cereus ZK; identical to SEQ ID NO: 31732
  CDS (1)..(438)

SEQ ID NO: 81483 - protein, 145 aa, Bacillus cereus ZK; identical to SEQ ID NO: 31733

SEQ ID NO: 81484 - DNA, 462 bp, Bacteroides fragilis; identical to SEQ ID NO: 31734
  CDS (1)..(462)

SEQ ID NO: 81485 - protein, 153 aa, Bacteroides fragilis; identical to SEQ ID NO: 31735

SEQ ID NO: 81486 - DNA, 438 bp, Bacillus licheniformis DSM 13; identical to SEQ ID NO: 31736
  CDS (1)..(438)

SEQ ID NO: 81487 - protein, 145 aa, Bacillus licheniformis DSM 13; identical to SEQ ID NO: 31737

SEQ ID NO: 81488 - DNA, 444 bp, Mannheimia succiniciproducens MBEL55E; identical to SEQ ID NO: 31738
  CDS (1)..(444)

SEQ ID NO: 81489 - protein, 147 aa, Mannheimia succiniciproducens MBEL55E; identical to SEQ ID NO: 31739

SEQ ID NO: 81490 - DNA, 465 bp, Borrelia garinii PBi; identical to SEQ ID NO: 31740
  CDS (1)..(465)

SEQ ID NO: 81491 - protein, 154 aa, Borrelia garinii PBi; identical to SEQ ID NO: 31741

SEQ ID NO: 81492 - DNA, 432 bp, Symbiobacterium thermophilum; identical to SEQ ID NO: 31742
  CDS (1)..(432)

SEQ ID NO: 81493 - protein, 143 aa, Symbiobacterium thermophilum; identical to SEQ ID NO: 31743

SEQ ID NO: 81494 - DNA, 468 bp, Rickettsia typhi; identical to SEQ ID NO: 31744
  CDS (1)..(468)

SEQ ID NO: 81495 - protein, 155 aa, Rickettsia typhi; identical to SEQ ID NO: 31745

SEQ ID NO: 81496 - DNA, 444 bp, Propionibacterium acnes; identical to SEQ ID NO: 31746
  CDS (1)..(444)

SEQ ID NO: 81497 - protein, 147 aa, Propionibacterium acnes; identical to SEQ ID NO: 31747

SEQ ID NO: 81498 - DNA, 447 bp, Leifsonia xyli; identical to SEQ ID NO: 31748
  CDS (1)..(447)

SEQ ID NO: 81499 - protein, 148 aa, Leifsonia xyli; identical to SEQ ID NO: 31749

SEQ ID NO: 81500 - DNA, 429 bp, Desulfotalea psychrophila; identical to SEQ ID NO: 31750
  CDS (1)..(429)

SEQ ID NO: 81501 - protein, 142 aa, Desulfotalea psychrophila; identical to SEQ ID NO: 31751

SEQ ID NO: 81502 - DNA, 432 bp, Gracilaria tenuistipitata var; identical to SEQ ID NO: 31752
  CDS (1)..(432)

SEQ ID NO: 81503 - protein, 143 aa, Gracilaria tenuistipitata var; identical to SEQ ID NO: 31753

SEQ ID NO: 81504 - DNA, 525 bp, Debaryomyces hansenii CBS767; identical to SEQ ID NO: 31754
  CDS (1)..(525)

SEQ ID NO: 81505 - protein, 174 aa, Debaryomyces hansenii CBS767; identical to SEQ ID NO: 31755

SEQ ID NO: 81506 - DNA, 468 bp, Kluyveromyces lactis NRRL Y; identical to SEQ ID NO: 31756
  CDS (1)..(468)

SEQ ID NO: 81507 - protein, 155 aa, Kluyveromyces lactis NRRL Y; identical to SEQ ID NO: 31757

SEQ ID NO: 81508 - DNA, 453 bp, Mesoplasma florum; identical to SEQ ID NO: 31758
  CDS (1)..(453): transl_table=4

SEQ ID NO: 81509 - protein, 150 aa, Mesoplasma florum; identical to SEQ ID NO: 31759

SEQ ID NO: 81510 - DNA, 429 bp, Acinetobacter sp; identical to SEQ ID NO: 31760
  CDS (1)..(429)

SEQ ID NO: 81511 - protein, 142 aa, Acinetobacter sp; identical to SEQ ID NO: 31761

SEQ ID NO: 81512 - DNA, 504 bp, Candida glabrata CBS138; identical to SEQ ID NO: 31762
  CDS (1)..(504)

SEQ ID NO: 81513 - protein, 167 aa, Candida glabrata CBS138; identical to SEQ ID NO: 31763

SEQ ID NO: 81514 - DNA, 465 bp, Bartonella quintana; identical to SEQ ID NO: 31764
  CDS (1)..(465)

SEQ ID NO: 81515 - protein, 154 aa, Bartonella quintana; identical to SEQ ID NO: 31765

SEQ ID NO: 81516 - DNA, 465 bp, Bartonella henselae; identical to SEQ ID NO: 31766
  CDS (1)..(465)

SEQ ID NO: 81517 - protein, 154 aa, Bartonella henselae; identical to SEQ ID NO: 31767

SEQ ID NO: 81518 - DNA, 477 bp, Fremyella diplosiphon; identical to SEQ ID NO: 31768
  CDS (1)..(477)

SEQ ID NO: 81519 - protein, 158 aa, Fremyella diplosiphon; identical to SEQ ID NO: 31769

SEQ ID NO: 81520 - DNA, 435 bp, Mycoplasma mobile; identical to SEQ ID NO: 31770
  CDS (1)..(435): transl_table=4

SEQ ID NO: 81521 - protein, 144 aa, Mycoplasma mobile; identical to SEQ ID NO: 31771

SEQ ID NO: 81522 - DNA, 429 bp, Photobacterium profundum; identical to SEQ ID NO: 31772
  CDS (1)..(429)

SEQ ID NO: 81523 - protein, 142 aa, Photobacterium profundum; identical to SEQ ID NO: 31773

SEQ ID NO: 81524 - DNA, 432 bp, Parachlamydia sp; identical to SEQ ID NO: 31774
  CDS (1)..(432)

SEQ ID NO: 81525 - protein, 143 aa, Parachlamydia sp; identical to SEQ ID NO: 31775

SEQ ID NO: 81526 - DNA, 441 bp, Bdellovibrio bacteriovorus; identical to SEQ ID NO: 31776
  CDS (1)..(441)

SEQ ID NO: 81527 - protein, 146 aa, Bdellovibrio bacteriovorus; identical to SEQ ID NO: 31777

SEQ ID NO: 81528 - DNA, 456 bp, Mycoplasma mycoides; identical to SEQ ID NO: 31778
  CDS (1)..(456): transl_table=4

SEQ ID NO: 81529 - protein, 151 aa, Mycoplasma mycoides; identical to SEQ ID NO: 31779

SEQ ID NO: 81530 - DNA, 444 bp, Corynebacterium diphtheriae; identical to SEQ ID NO: 31780
  CDS (1)..(444)

SEQ ID NO: 81531 - protein, 147 aa, Corynebacterium diphtheriae; identical to SEQ ID NO: 31781

SEQ ID NO: 81532 - DNA, 459 bp, Onion yellows phytoplasma; identical to SEQ ID NO: 31782
  CDS (1)..(459)

SEQ ID NO: 81533 - protein, 152 aa, Onion yellows phytoplasma; identical to SEQ ID NO: 31783

SEQ ID NO: 81534 - DNA, 435 bp, Desulfovibrio vulgaris; identical to SEQ ID NO: 31784
  CDS (1)..(435)

SEQ ID NO: 81535 - protein, 144 aa, Desulfovibrio vulgaris; identical to SEQ ID NO: 31785

SEQ ID NO: 81536 - DNA, 492 bp, Thermus thermophilus; identical to SEQ ID NO: 31786
  CDS (1)..(492)

SEQ ID NO: 81537 - protein, 163 aa, Thermus thermophilus; identical to SEQ ID NO: 31787

SEQ ID NO: 81538 - DNA, 450 bp, Leptospira interrogans; identical to SEQ ID NO: 31788
  CDS (1)..(450)

SEQ ID NO: 81539 - protein, 149 aa, Leptospira interrogans; identical to SEQ ID NO: 31789

SEQ ID NO: 81540 - DNA, 438 bp, Bacillus cereus; identical to SEQ ID NO: 31790
  CDS (1)..(438)

SEQ ID NO: 81541 - protein, 145 aa, Bacillus cereus; identical to SEQ ID NO: 31791

SEQ ID NO: 81542 - DNA, 459 bp, Wolbachia pipientis wMel; identical to SEQ ID NO: 31792
  CDS (1)..(459)

SEQ ID NO: 81543 - protein, 152 aa, Wolbachia pipientis wMel; identical to SEQ ID NO: 31793

SEQ ID NO: 81544 - DNA, 429 bp, Treponema denticola; identical to SEQ ID NO: 31794
  CDS (1)..(429)

SEQ ID NO: 81545 - protein, 142 aa, Treponema denticola; identical to SEQ ID NO: 31795

SEQ ID NO: 81546 - DNA, 444 bp, Mycobacterium paratuberculosis; identical to SEQ ID NO: 31796
  CDS (1)..(444)

SEQ ID NO: 81547 - protein, 147 aa, Mycobacterium paratuberculosis; identical to SEQ ID NO: 31797

SEQ ID NO: 81548 - DNA, 432 bp, Geobacter sulfurreducens; identical to SEQ ID NO: 31798
  CDS (1)..(432)

SEQ ID NO: 81549 - protein, 143 aa, Geobacter sulfurreducens; identical to SEQ ID NO: 31799

SEQ ID NO: 81550 - DNA, 444 bp, Lactobacillus johnsonii; identical to SEQ ID NO: 31800
  CDS (1)..(444)

SEQ ID NO: 81551 - protein, 147 aa, Lactobacillus johnsonii; identical to SEQ ID NO: 31801

SEQ ID NO: 81552 - DNA, 489 bp, Nanoarchaeum equitans; identical to SEQ ID NO: 31802
  CDS (1)..(489)

SEQ ID NO: 81553 - protein, 162 aa, Nanoarchaeum equitans; identical to SEQ ID NO: 31803

SEQ ID NO: 81554 - DNA, 471 bp, Ashbya gossypii; identical to SEQ ID NO: 31804
  CDS (1)..(471)

SEQ ID NO: 81555 - protein, 156 aa, Ashbya gossypii; identical to SEQ ID NO: 31805

SEQ ID NO: 81556 - DNA, 690 bp, Oryza sativa; identical to SEQ ID NO: 31806
  CDS (1)..(690)

SEQ ID NO: 81557 - protein, 229 aa, Oryza sativa; identical to SEQ ID NO: 31807

SEQ ID NO: 81558 - DNA, 420 bp, Wolinella succinogenes; identical to SEQ ID NO: 31808
  CDS (1)..(420)

SEQ ID NO: 81559 - protein, 139 aa, Wolinella succinogenes; identical to SEQ ID NO: 31809

SEQ ID NO: 81560 - DNA, 429 bp, Vibrio vulnificus; identical to SEQ ID NO: 31810
  CDS (1)..(429)

SEQ ID NO: 81561 - protein, 142 aa, Vibrio vulnificus; identical to SEQ ID NO: 31811

SEQ ID NO: 81562 - DNA, 456 bp, Porphyromonas gingivalis; identical to SEQ ID NO: 31812
  CDS (1)..(456)

SEQ ID NO: 81563 - protein, 151 aa, Porphyromonas gingivalis; identical to SEQ ID NO: 31813

SEQ ID NO: 81564 - DNA, 429 bp, Photorhabdus luminescens; identical to SEQ ID NO: 31814
  CDS (1)..(429)

SEQ ID NO: 81565 - protein, 142 aa, Photorhabdus luminescens; identical to SEQ ID NO: 31815

SEQ ID NO: 81566 - DNA, 459 bp, Gloeobacter violaceus; identical to SEQ ID NO: 31816
  CDS (1)..(459)

SEQ ID NO: 81567 - protein, 152 aa, Gloeobacter violaceus; identical to SEQ ID NO: 31817

SEQ ID NO: 81568 - DNA, 429 bp, Chromobacterium violaceum; identical to SEQ ID NO: 31818
  CDS (1)..(429)

SEQ ID NO: 81569 - protein, 142 aa, Chromobacterium violaceum; identical to SEQ ID NO: 31819

SEQ ID NO: 81570 - DNA, 552 bp, Neurospora crassa; identical to SEQ ID NO: 31820
  CDS (1)..(552)

SEQ ID NO: 81571 - protein, 183 aa, Neurospora crassa; identical to SEQ ID NO: 31821

SEQ ID NO: 81572 - DNA, 453 bp, Synechococcus sp; identical to SEQ ID NO: 31822
  CDS (1)..(453)

SEQ ID NO: 81573 - protein, 150 aa, Synechococcus sp; identical to SEQ ID NO: 31823

SEQ ID NO: 81574 - DNA, 456 bp, Rhodopirellula baltica; identical to SEQ ID NO: 31824
  CDS (1)..(456)

SEQ ID NO: 81575 - protein, 151 aa, Rhodopirellula baltica; identical to SEQ ID NO: 31825

SEQ ID NO: 81576 - DNA, 432 bp, Prochlorococcus marinus subsp; identical to SEQ ID NO: 31826
  CDS (1)..(432)

SEQ ID NO: 81577 - protein, 143 aa, Prochlorococcus marinus subsp; identical to SEQ ID NO: 31827

SEQ ID NO: 81578 - DNA, 453 bp, Prochlorococcus marinus; identical to SEQ ID NO: 31828
  CDS (1)..(453)

SEQ ID NO: 81579 - protein, 150 aa, Prochlorococcus marinus; identical to SEQ ID NO: 31829

SEQ ID NO: 81580 - DNA, 453 bp, Prochlorococcus marinus; identical to SEQ ID NO: 31830
  CDS (1)..(453)

SEQ ID NO: 81581 - protein, 150 aa, Prochlorococcus marinus; identical to SEQ ID NO: 31831

SEQ ID NO: 81582 - DNA, 429 bp, Helicobacter hepaticus; identical to SEQ ID NO: 31832
  CDS (1)..(429)

SEQ ID NO: 81583 - protein, 142 aa, Helicobacter hepaticus; identical to SEQ ID NO: 31833

SEQ ID NO: 81584 - DNA, 423 bp, Haemophilus ducreyi; identical to SEQ ID NO: 31834
  CDS (1)..(423)

SEQ ID NO: 81585 - protein, 140 aa, Haemophilus ducreyi; identical to SEQ ID NO: 31835

SEQ ID NO: 81586 - DNA, 420 bp, Candidatus Blochmannia floridanus; identical to SEQ ID NO: 31836
  CDS (1)..(420)

SEQ ID NO: 81587 - protein, 139 aa, Candidatus Blochmannia floridanus; identical to SEQ ID NO: 31837

SEQ ID NO: 81588 - DNA, 429 bp, Bordetella pertussis; identical to SEQ ID NO: 31838
  CDS (1)..(429)

SEQ ID NO: 81589 - protein, 142 aa, Bordetella pertussis; identical to SEQ ID NO: 31839

SEQ ID NO: 81590 - DNA, 618 bp, Arabidopsis thaliana; identical to SEQ ID NO: 31840
  CDS (1)..(618)

SEQ ID NO: 81591 - protein, 205 aa, Arabidopsis thaliana; identical to SEQ ID NO: 31841

SEQ ID NO: 81592 - DNA, 1001 bp, Chlorarachnion sp; identical to SEQ ID NO: 31842
  CDS (48)..(869)

SEQ ID NO: 81593 - protein, 273 aa, Chlorarachnion sp; identical to SEQ ID NO: 31843

SEQ ID NO: 81594 - DNA, 453 bp, Chlamydophila caviae; identical to SEQ ID NO: 31844
  CDS (1)..(453)

SEQ ID NO: 81595 - protein, 150 aa, Chlamydophila caviae; identical to SEQ ID NO: 31845

SEQ ID NO: 81596 - DNA, 444 bp, Streptomyces avermitilis; identical to SEQ ID NO: 31846
  CDS (1)..(444)

SEQ ID NO: 81597 - protein, 147 aa, Streptomyces avermitilis; identical to SEQ ID NO: 31847

SEQ ID NO: 81598 - DNA, 435 bp, Nitrosomonas europaea; identical to SEQ ID NO: 31848
  CDS (1)..(435)

SEQ ID NO: 81599 - protein, 144 aa, Nitrosomonas europaea; identical to SEQ ID NO: 31849

SEQ ID NO: 81600 - DNA, 429 bp, Coxiella burnetii; identical to SEQ ID NO: 31850
  CDS (1)..(429)

SEQ ID NO: 81601 - protein, 142 aa, Coxiella burnetii; identical to SEQ ID NO: 31851

SEQ ID NO: 81602 - DNA, 426 bp, Tropheryma whipplei; identical to SEQ ID NO: 31852
  CDS (1)..(426)

SEQ ID NO: 81603 - protein, 141 aa, Tropheryma whipplei; identical to SEQ ID NO: 31853

SEQ ID NO: 81604 - DNA, 603 bp, Dictyostelium discoideum; identical to SEQ ID NO: 31854
  CDS (1)..(603)

SEQ ID NO: 81605 - protein, 200 aa, Dictyostelium discoideum; identical to SEQ ID NO: 31855

SEQ ID NO: 81606 - DNA, 429 bp, Xylella fastidiosa; identical to SEQ ID NO: 31856
  CDS (1)..(429)

SEQ ID NO: 81607 - protein, 142 aa, Xylella fastidiosa; identical to SEQ ID NO: 31857

SEQ ID NO: 81608 - DNA, 429 bp, Vibrio parahaemolyticus; identical to SEQ ID NO: 31858
  CDS (1)..(429)

SEQ ID NO: 81609 - protein, 142 aa, Vibrio parahaemolyticus; identical to SEQ ID NO: 31859

SEQ ID NO: 81610 - DNA, 429 bp, Pseudomonas syringae; identical to SEQ ID NO: 31860
  CDS (1)..(429)

SEQ ID NO: 81611 - protein, 142 aa, Pseudomonas syringae; identical to SEQ ID NO: 31861

SEQ ID NO: 81612 - DNA, 444 bp, Lactobacillus plantarum; identical to SEQ ID NO: 31862
  CDS (1)..(444)

SEQ ID NO: 81613 - protein, 147 aa, Lactobacillus plantarum; identical to SEQ ID NO: 31863

SEQ ID NO: 81614 - DNA, 435 bp, Clostridium tetani; identical to SEQ ID NO: 31864
  CDS (1)..(435)

SEQ ID NO: 81615 - protein, 144 aa, Clostridium tetani; identical to SEQ ID NO: 31865

SEQ ID NO: 81616 - DNA, 462 bp, Bacteroides thetaiotaomicron; identical to SEQ ID NO: 31866
  CDS (1)..(462)

SEQ ID NO: 81617 - protein, 153 aa, Bacteroides thetaiotaomicron; identical to SEQ ID NO: 31867

SEQ ID NO: 81618 - DNA, 438 bp, Staphylococcus epidermidis; identical to SEQ ID NO: 31868
  CDS (1)..(438)

SEQ ID NO: 81619 - protein, 145 aa, Staphylococcus epidermidis; identical to SEQ ID NO: 31869

SEQ ID NO: 81620 - DNA, 444 bp, Yersinia pestis; identical to SEQ ID NO: 31870
  CDS (1)..(444)

SEQ ID NO: 81621 - protein, 147 aa, Yersinia pestis; identical to SEQ ID NO: 31871

SEQ ID NO: 81622 - DNA, 429 bp, Wigglesworthia glossinidia brevipalpis; identical to SEQ ID NO: 31872
  CDS (1)..(429)

SEQ ID NO: 81623 - protein, 142 aa, Wigglesworthia glossinidia brevipalpis; identical to SEQ ID NO: 31873

SEQ ID NO: 81624 - DNA, 459 bp, Synechococcus elongatus; identical to SEQ ID NO: 31874
  CDS (1)..(459)

SEQ ID NO: 81625 - protein, 152 aa, Synechococcus elongatus; identical to SEQ ID NO: 31875

SEQ ID NO: 81626 - DNA, 447 bp, Streptococcus mutans; identical to SEQ ID NO: 31876
  CDS (1)..(447)

SEQ ID NO: 81627 - protein, 148 aa, Streptococcus mutans; identical to SEQ ID NO: 31877

SEQ ID NO: 81628 - DNA, 447 bp, Streptococcus agalactiae; identical to SEQ ID NO: 31878
  CDS (1)..(447)

SEQ ID NO: 81629 - protein, 148 aa, Streptococcus agalactiae; identical to SEQ ID NO: 31879

SEQ ID NO: 81630 - DNA, 429 bp, Shewanella oneidensis; identical to SEQ ID NO: 31880
  CDS (1)..(429)

SEQ ID NO: 81631 - protein, 142 aa, Shewanella oneidensis; identical to SEQ ID NO: 31881

SEQ ID NO: 81632 - DNA, 438 bp, Oceanobacillus iheyensis; identical to SEQ ID NO: 31882
  CDS (1)..(438)

SEQ ID NO: 81633 - protein, 145 aa, Oceanobacillus iheyensis; identical to SEQ ID NO: 31883

SEQ ID NO: 81634 - DNA, 441 bp, Mycoplasma penetrans; identical to SEQ ID NO: 31884
  CDS (1)..(441): transl_table=4

SEQ ID NO: 81635 - protein, 146 aa, Mycoplasma penetrans; identical to SEQ ID NO: 31885

SEQ ID NO: 81636 - DNA, 444 bp, Corynebacterium efficiens; identical to SEQ ID NO: 31886
  CDS (1)..(444)

SEQ ID NO: 81637 - protein, 147 aa, Corynebacterium efficiens; identical to SEQ ID NO: 31887

SEQ ID NO: 81638 - DNA, 465 bp, Brucella suis; identical to SEQ ID NO: 31888
  CDS (1)..(465)

SEQ ID NO: 81639 - protein, 154 aa, Brucella suis; identical to SEQ ID NO: 31889

SEQ ID NO: 81640 - DNA, 450 bp, Bifidobacterium longum; identical to SEQ ID NO: 31890
  CDS (1)..(450)

SEQ ID NO: 81641 - protein, 149 aa, Bifidobacterium longum; identical to SEQ ID NO: 31891

SEQ ID NO: 81642 - DNA, 447 bp, Streptococcus pyogenes; identical to SEQ ID NO: 31892
  CDS (1)..(447)

SEQ ID NO: 81643 - protein, 148 aa, Streptococcus pyogenes; identical to SEQ ID NO: 31893

SEQ ID NO: 81644 - DNA, 453 bp, Chlorobium tepidum; identical to SEQ ID NO: 31894
  CDS (1)..(453)

SEQ ID NO: 81645 - protein, 150 aa, Chlorobium tepidum; identical to SEQ ID NO: 31895

SEQ ID NO: 81646 - DNA, 375 bp, Candidatus Tremblaya princeps; identical to SEQ ID NO: 31896
  CDS (1)..(375)

SEQ ID NO: 81647 - protein, 124 aa, Candidatus Tremblaya princeps; identical to SEQ ID NO: 31897

SEQ ID NO: 81648 - DNA, 429 bp, Xanthomonas axonopodis; identical to SEQ ID NO: 31898
  CDS (1)..(429)

SEQ ID NO: 81649 - protein, 142 aa, Xanthomonas axonopodis; identical to SEQ ID NO: 31899

SEQ ID NO: 81650 - DNA, 444 bp, Corynebacterium glutamicum; identical to SEQ ID NO: 31900
  CDS (1)..(444)

SEQ ID NO: 81651 - protein, 147 aa, Corynebacterium glutamicum; identical to SEQ ID NO: 31901

SEQ ID NO: 81652 - DNA, 429 bp, Streptococcus pyogenes; identical to SEQ ID NO: 31902
  CDS (1)..(429)

SEQ ID NO: 81653 - protein, 142 aa, Streptococcus pyogenes; identical to SEQ ID NO: 31903

SEQ ID NO: 81654 - DNA, 489 bp, Methanosarcina mazei; identical to SEQ ID NO: 31904
  CDS (1)..(489)

SEQ ID NO: 81655 - protein, 162 aa, Methanosarcina mazei; identical to SEQ ID NO: 31905

SEQ ID NO: 81656 - DNA, 432 bp, Thermoanaerobacter tengcongensis; identical to SEQ ID NO: 31906
  CDS (1)..(432)

SEQ ID NO: 81657 - protein, 143 aa, Thermoanaerobacter tengcongensis; identical to SEQ ID NO: 31907

SEQ ID NO: 81658 - DNA, 435 bp, Fusobacterium nucleatum; identical to SEQ ID NO: 31908
  CDS (1)..(435)

SEQ ID NO: 81659 - protein, 144 aa, Fusobacterium nucleatum; identical to SEQ ID NO: 31909

SEQ ID NO: 81660 - DNA, 432 bp, Methanosarcina acetivorans; identical to SEQ ID NO: 31910
  CDS (1)..(432)

SEQ ID NO: 81661 - protein, 143 aa, Methanosarcina acetivorans; identical to SEQ ID NO: 31911

SEQ ID NO: 81662 - DNA, 480 bp, Methanopyrus kandleri; identical to SEQ ID NO: 31912
  CDS (1)..(480)

SEQ ID NO: 81663 - protein, 159 aa, Methanopyrus kandleri; identical to SEQ ID NO: 31913

SEQ ID NO: 81664 - DNA, 429 bp, Pyrococcus furiosus; identical to SEQ ID NO: 31914
  CDS (1)..(429)

SEQ ID NO: 81665 - protein, 142 aa, Pyrococcus furiosus; identical to SEQ ID NO: 31915

SEQ ID NO: 81666 - DNA, 435 bp, Clostridium perfringens; identical to SEQ ID NO: 31916
  CDS (1)..(435)

SEQ ID NO: 81667 - protein, 144 aa, Clostridium perfringens; identical to SEQ ID NO: 31917

SEQ ID NO: 81668 - DNA, 429 bp, Ralstonia solanacearum; identical to SEQ ID NO: 31918
  CDS (1)..(429)

SEQ ID NO: 81669 - protein, 142 aa, Ralstonia solanacearum; identical to SEQ ID NO: 31919

SEQ ID NO: 81670 - DNA, 564 bp, Pyrobaculum aerophilum; identical to SEQ ID NO: 31920
  CDS (1)..(564)

SEQ ID NO: 81671 - protein, 187 aa, Pyrobaculum aerophilum; identical to SEQ ID NO: 31921

SEQ ID NO: 81672 - DNA, 465 bp, Rhizobium meliloti; identical to SEQ ID NO: 31922
  CDS (1)..(465)

SEQ ID NO: 81673 - protein, 154 aa, Rhizobium meliloti; identical to SEQ ID NO: 31923

SEQ ID NO: 81674 - DNA, 702 bp, Oryza sativa; identical to SEQ ID NO: 31924
  CDS (1)..(702)

SEQ ID NO: 81675 - protein, 233 aa, Oryza sativa; identical to SEQ ID NO: 31925

SEQ ID NO: 81676 - DNA, 465 bp, Rhizobium loti; identical to SEQ ID NO: 31926
  CDS (1)..(465)

SEQ ID NO: 81677 - protein, 154 aa, Rhizobium loti; identical to SEQ ID NO: 31927

SEQ ID NO: 81678 - DNA, 429 bp, Pasteurella multocida; identical to SEQ ID NO: 31928
  CDS (1)..(429)

SEQ ID NO: 81679 - protein, 142 aa, Pasteurella multocida; identical to SEQ ID NO: 31929

SEQ ID NO: 81680 - DNA, 846 bp, Ceratopteris richardii; identical to SEQ ID NO: 31930
  CDS (54)..(479): n means a or g or c or t/u

SEQ ID NO: 81681 - protein, 141 aa, Ceratopteris richardii; identical to SEQ ID NO: 31931
  misc_feature (101)..(101): Xaa can be Arg or Gln or Leu or Pro
  misc_feature (134)..(134): Xaa can be Asn or Asp or His or Tyr

SEQ ID NO: 81682 - DNA, 414 bp, Arabidopsis thaliana; identical to SEQ ID NO: 31932
  CDS (1)..(414)

SEQ ID NO: 81683 - protein, 137 aa, Arabidopsis thaliana; identical to SEQ ID NO: 31933

SEQ ID NO: 81684 - DNA, 432 bp, Cyanidium caldarium; identical to SEQ ID NO: 31934
  CDS (1)..(432)

SEQ ID NO: 81685 - protein, 143 aa, Cyanidium caldarium; identical to SEQ ID NO: 31935

SEQ ID NO: 81686 - DNA, 432 bp, Guillardia theta; identical to SEQ ID NO: 31936
  CDS (1)..(432)

SEQ ID NO: 81687 - protein, 143 aa, Guillardia theta; identical to SEQ ID NO: 31937

SEQ ID NO: 81688 - DNA, 435 bp, Buchnera aphidicola; identical to SEQ ID NO: 31938
  CDS (1)..(435)

SEQ ID NO: 81689 - protein, 144 aa, Buchnera aphidicola; identical to SEQ ID NO: 31939

SEQ ID NO: 81690 - DNA, 618 bp, Drosophila melanogaster; identical to SEQ ID NO: 31940
  CDS (31)..(567)

SEQ ID NO: 81691 - protein, 178 aa, Drosophila melanogaster; identical to SEQ ID NO: 31941

SEQ ID NO: 81692 - DNA, 839 bp, Homo sapiens; identical to SEQ ID NO: 31942
  CDS (40)..(576)

SEQ ID NO: 81693 - protein, 178 aa, Homo sapiens; identical to SEQ ID NO: 31943

SEQ ID NO: 81694 - DNA, 26 bp, Primer
atgaaaacttttacagctaaaccaga

SEQ ID NO: 81695 - DNA, 24 bp, Primer
ttagatgtcaagaacttgcggttg

SEQ ID NO: 81696 - protein, 162 aa, consensus; identical to SEQ ID NO: 31946
  MISC_FEATURE (1)..(162): consensus for the disclosure of xaa see table XV

SEQ ID NO: 81697 - protein, 58 aa, consensus; identical to SEQ ID NO: 31947
  MISC_FEATURE (1)..(58): consensus for the disclosure of xaa see table XV

SEQ ID NO: 81698 - protein, 26 aa, consensus
  MISC_FEATURE (1)..(26): consensus for the disclosure of xaa see table XV
XXXXXXXMXXXXXXXXXXXXXXXXXX

SEQ ID NO: 81699 - DNA, 933 bp, Escherichia coli
  CDS (1)..(933)
atgaaaacactaataagaaaattctcccgtacggccatcacggtcgtattagtcattctggccttcatcgcaatttttaatgcctgggtctattacaccgaatccccctggacgcgtgacgcgcgctttagcgctgacgtcgttgcgatcgcgccggacgtttctggactcattacccaggtgaatgttcatgataaccagctggtgaaaaaaggacagatactgttcaccatcgaccagccgcgctatcaaaaggcgcttgaggaagcgcaagccgatgttgcttattatcaggtactggcacaggagaaacgccaggaggccggacgtcgtaaccgtctcggtgtgcaggcgatgtctcgcgaagagatcgaccaggccaacaacgtactacaaacggttctgcatcagttagcgaaagcgcaggcgacccgcgatctggcaaaactggatcttgaacgcacggtgatccgcgcgccagcagatggctgggtgaccaacctcaacgtctataccggtgagtttattactcgaggatcaacggcggttgcgctggtgaaacagaactccttctatgtactggcctatatggaagaaactaagctggaaggggtgcgtccggggtatcgtgcagagatcacgccgcttggcagtaacaaagtgctgaaagggactgttgatagtgttgccgcaggggtcaccaacgccagcagcacgcgtgacgacaaagggatggcgactatagactctaaccttgaatgggtgcgtcttgcgcaacgtgttccggttcgtattcgtctcgacaaccagcaagagaacatctggcctgcgggcaccactgctacagtggtggtcactggcaaacaagatcgcgacgaaagccaggattcgttcttccgtaaaatggcccatcgcctgcgtgagtttggttaa

SEQ ID NO: 81700 - protein, 310 aa, Escherichia coli
MKTLIRKFSRTAITVVLVILAFIAIFNAWVYYTESPWTRDARFSADVVAIAPDVSGLITQVNVHDNQLVKKGQILFTIDQPRYQKALEEAQADVAYYQVLAQEKRQEAGRRNRLGVQAMSREEIDQANNVLQTVLHQLAKAQATRDLAKLDLERTVIRAPADGWVTNLNVYTGEFITRGSTAVALVKQNSFYVLAYMEETKLEGVRPGYRAEITPLGSNKVLKGTVDSVAAGVTNASSTRDDKGMATIDSNLEWVRLAQRVPVRIRLDNQQENIWPAGTTATVVVTGKQDRDESQDSFFRKMAHRLREFG

SEQ ID NO: 81701 - DNA, 1146 bp, Novosphingobium aromaticivorans
  CDS (1)..(1146): transl_table=11
atgagcgatactgcgacacaagctgccgaagtcgatccggaactgtccgcctttcgcaaggcacgccggacgatgtggctcaagcgcctggccatcgtgctcgcagtggtggctctcgcatggggtgcttggtacgtgctggtcgcccgcaactatgtcagcaccgacaacgcctacgtaaatgcgcgaatggcgcaggtcacgccgctgattgctggatcggccatcgaggtgctggtcgaagatacgcagcaggtgaaggcgggtgatgtcctggtccggctcgaccaggccaacgccaaaatcgccgtcgcgcaggccgaagccgatcttgccgccgcccgccgcaaattcgggcaggctgtcgcgaccaacagcgcgctgtcggcccagatcgacacctcaagcgccggtctcgtacaggcccgggcgcgacttcgcactgcagagtccgagttcgacaaggcgcggatcgacttgcggcgccgtgaggccgtcattgccagcggcgcgatctcgggtgaggaactgacccaggcgcgcaaggcctacgcctccgccaacgcggcgctcgaggcggcccgcgggggcatctccgaagtcacttcggcccgacgggtcgcgcaagggcaacttgccgccaacgacgccctggtgcgcggctccagcgtagataccgacccagcggttcaggcggccaaggcccggctcgatgccgccttgctcgacctccagcgtaccgaaattcgcgcgccggtttccggggtggtgagccgcctgcagattcaggtgggacagcgcctgagccccggtcagactatcatgaccatcgtcccgatcgacaagctctacgtcgatgccaacttcaaggaaggccaactcggccgtgtccgtcctggcatggctgtaaccctcaagtcggatctttatggcggcgatgtcgtctaccacggcaaggtcaccgggctggccggcggtacgggatcgtcgatggcaatcatccccgcccagaacgccaccggcaactggatcaagactgtccagcgcctgccggtgcggatcgagcttgatcctgccgaactgcgcaagcacccgttgcgcgtcgggctgtcgatggaagtcgagatcgatgtttccggtgagtga

SEQ ID NO: 81702 - protein, 381 aa, Novosphingobium aromaticivorans
MSDTATQAAEVDPELSAFRKARRTMWLKRLAIVLAVVALAWGAWYVLVARNYVSTDNAYVNARMAQVTPLIAGSAIEVLVEDTQQVKAGDVLVRLDQANAKIAVAQAEADLAAARRKFGQAVATNSALSAQIDTSSAGLVQARARLRTAESEFDKARIDLRRREAVIASGAISGEELTQARKAYASANAALEAARGGISEVTSARRVAQGQLAANDALVRGSSVDTDPAVQAAKARLDAALLDLQRTEIRAPVSGVVSRLQIQVGQRLSPGQTIMTIVPIDKLYVDANFKEGQLGRVRPGMAVTLKSDLYGGDVVYHGKVTGLAGGTGSSMAIIPAQNATGNWIKTVQRLPVRIELDPAELRKHPLRVGLSMEVEIDVSGE

SEQ ID NO: 81703 - DNA, 1104 bp, Mesorhizobium loti MAFF303099
  CDS (1)..(1104): transl_table=11
atgaacaaggttctctccgccgccgagttgcagccggcgcagccatccgccgtccagatacccgcgcccgccaaaagccgccgcaagccgatcgtcatgctgggcgccgcgatcgccatcggcgtcgccggctggtatggctttcagtggtggcaggcaggccggttcgtgatgtcgaccgacgatgcctatgtcggcggcaatgtcacgccgctggcgccacgcgtcgccgggcatatcgatcagatcctcgtcgaggacaatcagcatgtcgacgccggccagctcatcatccgcatcgacgaccggccgttcaaggcggcggtggagcgtgcgcgggcttccgtccagcagcagcaatcggcgctcgacaatcttcgcgcccaggtctcgctgcagaattcgctgatcgaacaggcagaggccgatctcgaggcgaagagtgcagccgccacatttactacacaggatgccaagcgctacgaggtgctggccagcaccagggccggctcgcagcaggacgcgcagagaagccttgccgccgacgggcaggcgaaggcttccgtttccgcctcgcgtgccgggcttgcggccgccaggcaacagctcgacgtgctgaacacgcagatctcggaagcgaccgccgcggttctggccgccaaggccgatctcgacacggctgagctcgatcttggcttcacgcagatccgcgctccgatcgacggcctcgtcggcaaccggctggcgcaggtcggcacctatgtctcgccgggcagctatctgctgacgatcgtcccgcagagcgggctgtgggtcgatgccaatttcaaggaagatcagttgcggcgcatggcggacggacaggcggcgacggtctataccgacatcgcgcccgaccagccgctcaagggccatgtcagcagcctgggaccggcgacgggggcgatcttcagcgtcatcccggcgcagaacgccaccggcaatttcaccaagatcgtccagcgtgttcctgtccgcatcaccatcgacccggaccaggcgcggaaggtcgcgctgcggccaggcctctccaccgtcgtgaccgtcgataccggcgcgcactga

SEQ ID NO: 81704 - protein, 367 aa, Mesorhizobium loti MAFF303099
MNKVLSAAELQPAQPSAVQIPAPAKSRRKPIVMLGAAIAIGVAGWYGFQWWQAGRFVMSTDDAYVGGNVTPLAPRVAGHIDQILVEDNQHVDAGQLIIRIDDRPFKAAVERARASVQQQQSALDNLRAQVSLQNSLIEQAEADLEAKSAAATFTTQDAKRYEVLASTRAGSQQDAQRSLAADGQAKASVSASRAGLAAARQQLDVLNTQISEATAAVLAAKADLDTAELDLGFTQIRAPIDGLVGNRLAQVGTYVSPGSYLLTIVPQSGLWVDANFKEDQLRRMADGQAATVYTDIAPDQPLKGHVSSLGPATGAIFSVIPAQNATGNFTKIVQRVPVRITIDPDQARKVALRPGLSTVVTVDTGAH

SEQ ID NO: 81705 - DNA, 1131 bp, Mesorhizobium loti MAFF303099
  CDS (1)..(1131): transl_table=11
gtgtcggcggcattcctgctcggtatggctttcagcagcactgcgtttgcgcagaaccagcagctacccgtggtgacggcggccaagccggtggtccgtgaaatcgtcgaagacgacgagttcgtcgggcgcttcgaagccgtcgaccaggtcgccatccgttcgcgcgtcagcggctatctggacaaggtcagcttccaggacggcgcactggtcaacaagggcgacctgctcttcaccatcgaccagcgtccttaccaggcggcttatgatgccgccaaatcgcaagtggatgtcgccaagagtctgctcgaattctccaagatgcagctggatcgcgcagacgaactcgccaagaccggcaatatctcaaccgcgacggtcgacgaccgccggcgggaatacctttccgcgcaggcgcagatgcagggcgcgacggctgcgctgacgacggctagcctgaacatggaattcaccgagatcaaggcgcccttgtccggccgcatcgaccgccgcctggtgtcggttggcaaccttgtgcagccggattccaccttgctgacgaccatcgttacgcgcgatccgatcgacttctatttcgacgtcgatgagcgcctgtatttcagctacgcccgcgacgcgaaggtgcgtggcggcagcatgcaggaaggcgctggcgggctcgacgtcgtggttcgcgtcgccgaccgcgccgaggcggtattcaaaggcaagctcgattttgccgagaaccggatcgacaacgcgaccggcaccatgcgggtgcgtgcaaggtttcccaacgccgacggcattctccagccaggcatgttcgggcgcatcaacgtgccggggtcgctgccgcatagcggcgtgctggtgcccgacgaggcgatcggcgccgatcaggatcgccgcatcgtgttcctggtggataacgccgggacggtgtcggcgaagcccgtgcgcaccggcccgcttctcgacggctaccgggtgatccgcgggggcctgaccggcgacgagacgattgtcgtcaacgggctgatgcacgccaggcccggcaccaaggtgaaggtcgagatggtgacgttgccacccaaggccgagaccgccgggttgcagcaatga

SEQ ID NO: 81706 - protein, 376 aa, Mesorhizobium loti MAFF303099
MSAAFLLGMAFSSTAFAQNQQLPVVTAAKPVVREIVEDDEFVGRFEAVDQVAIRSRVSGYLDKVSFQDGALVNKGDLLFTIDQRPYQAAYDAAKSQVDVAKSLLEFSKMQLDRADELAKTGNISTATVDDRRREYLSAQAQMQGATAALTTASLNMEFTEIKAPLSGRIDRRLVSVGNLVQPDSTLLTTIVTRDPIDFYFDVDERLYFSYARDAKVRGGSMQEGAGGLDVVVRVADRAEAVFKGKLDFAENRIDNATGTMRVRARFPNADGILQPGMFGRINVPGSLPHSGVLVPDEAIGADQDRRIVFLVDNAGTVSAKPVRTGPLLDGYRVIRGGLTGDETIVVNGLMHARPGTKVKVEMVTLPPKAETAGLQQ

SEQ ID NO: 81707 - DNA, 1083 bp, Mesorhizobium loti MAFF303099
  CDS (1)..(1083): transl_table=11
gtggagccggtcccggcgccgaagaagaagcgccgcacgggccgcttcttcttgatgcttgccttgccggcggcgctggtcatcggtggcggctatatctgggtgaccggcggacgctaccaggagacggagaacgccaatctgcagcaggccaaggtgtcgatcgcctcggacacggccggccgcatcgtccaggtcgccataacagatcatcagatggtcaagcagggcgaccttctgttcaccatcgatcccgagccttatcgcatcgcgcttgcccaggccgacgccgcggttgccgccgcgcgcctcaatgtcgagcagctgcgcgccgcctacagccagtcgatggcgcaggagaagtccgccagcagcgaagtcgactacgcccagtcgcagtacgaccgcgccgccgatctcgcgcagaagggcatcaacgccaaatcgtcgctggatcaggcccgcaacgacctcgacaaggcaaagcagcaggtcgccgtcgcccagcagggcatcatcagcgccaaggccgcgcttggcggcaaccccgacatcgaaaccgacaagcatccgactgtgatggccgcgctcgccgcgcgcgacaaggccgcctacgacctggcgcggaccacggtgaaggcgcccgccgatggcgtcatctcccaggcctcgtccttcaaggtcggccagttcgtcggctccggcacgccgctgttttcgctggtcgagagcgatgacacctggatcgatgccaatttcaaggaaacccagctcaccaacatgaagccgggccagaaggccgagatcgtcgtcgacacctatccaggcaagacgttcgaggcgacggtcaaggcgatcggtgcgggaacgggtgctgaattctcgctgctgcccgcgcagaacgccaccggcaactgggtcaaggtcacgcaacgcatcccggtgcgcctggagctgaccgatcccgacgccaagatggcgctgcggaccggcatgagcgcctcggtcaccgtcgataccggcactgcccgcggctttcccgccatattcggccacgccacggctggcgaggtcgcgcagtaa

SEQ ID NO: 81708 - protein, 360 aa, Mesorhizobium loti MAFF303099
MEPVPAPKKKRRTGRFFLMLALPAALVIGGGYIWVTGGRYQETENANLQQAKVSIASDTAGRIVQVAITDHQMVKQGDLLFTIDPEPYRIALAQADAAVAAARLNVEQLRAAYSQSMAQEKSASSEVDYAQSQYDRAADLAQKGINAKSSLDQARNDLDKAKQQVAVAQQGIISAKAALGGNPDIETDKHPTVMAALAARDKAAYDLARTTVKAPADGVISQASSFKVGQFVGSGTPLFSLVESDDTWIDANFKETQLTNMKPGQKAEIVVDTYPGKTFEATVKAIGAGTGAEFSLLPAQNATGNWVKVTQRIPVRLELTDPDAKMALRTGMSASVTVDTGTARGFPAIFGHATAGEVAQ

SEQ ID NO: 81709 - DNA, 1053 bp, Rickettsia prowazekii str. Madrid E
  CDS (1)..(1053): transl_table=11
atgtttagtgtattacaacaagttatctataaatataaacattattcatttattaaacatgtcattattatagttttaataatatttacttattttggatatagaatttatgtttgggcgaatacgcaatctactgataatgcttatatagatgcagatatttcgaatattagtgctgaagttagcggtgttttaacaaagttattcgttaccaataatactagagttaataaaggtgagcttataggtgaaattgatgatagagattataaagcaaggcttgcagcacttgacgcagctattcaagcttgcataaaaaatatagaaattatagagcaaaaaatttcaataggcaagatgcgtctagaacaagtggctgaaaaattaaagctgactaaaataagctttgatattatttcaatagattttactagagtacaggcattaagtaatgctaaatttgttagctctaaaacgttagatgattctaaaaacgaatatcaaaaagtgaaaacggagtataaacaagcacaattagatttagacatatctaagcacaatttacagcttcttgaacttgaaaaatcagcagcacaggaaaaacttaaagaactaacagaaaataaaaaaataaccttaaggagcttacaaaatactaaaattattgctatggtaccaggcatatttagtaatagtaatttagcagtcgggaattatatagtaatgggtaaggcattattttctatagtgcaggataatactatgtatattaaggctaattttaaagaaacccaaattaagaactttaagtctgggatgaaagtcaaaattgtatttgatgctttccctacaaaggtaatttatgggaaaattcgtaatattgctcctgctaccggagctaaatttagtttaataccaccagataatgcaactggtaattttactaaaattgtacaacgtgtatctgttttaatagattttgtatccccaaatgctaatctagtcccaggtatgtcggcaagagtatcaatccgaactgatcaaagcacataa

SEQ ID NO: 81710 - protein, 350 aa, Rickettsia prowazekii str. Madrid E
MFSVLQQVIYKYKHYSFIKHVIIIVLIIFTYFGYRIYVWANTQSTDNAYIDADISNISAEVSGVLTKLFVTNNTRVNKGELIGEIDDRDYKARLAALDAAIQACIKNIEIIEQKISIGKMRLEQVAEKLKLTKISFDIISIDFTRVQALSNAKFVSSKTLDDSKNEYQKVKTEYKQAQLDLDISKHNLQLLELEKSAAQEKLKELTENKKITLRSLQNTKIIAMVPGIFSNSNLAVGNYIVMGKALFSIVQDNTMYIKANFKETQIKNFKSGMKVKIVFDAFPTKVIYGKIRNIAPATGAKFSLIPPDNATGNFTKIVQRVSVLIDFVSPNANLVPGMSARVSIRTDQST

SEQ ID NO: 81711 - DNA, 909 bp, Pseudomonas aeruginosa PAO1
  CDS (1)..(909): transl_table=11
atgtccatcgttcgtctttccaaggtggctgcgaccttcgcctgcggcctgctcgccctgtgcctggcgttgcagttgtggcaagcctacgtgctggcgccctggacccgcgacgggcgggtcagcgcgcaggtgatccgcatcgcgccggaagtctccggcagcgtcgaggcggtgttcgtcgcagataaccagcgggtggcccgcggcgatccgctgtaccgcatcgatccgcgcagctatcgcctggccgtgcgccagcgcgaggcggagctggagcaggcgcgggaaacactgcgccaacgtgacgagcaatggcgccgacgcatgcagttggccggcgcggtttcgcgcgaggaggtcgccaacgccggtcgcgccctgcgtatcgcccgcgcccgcgccgaggccgccggggcggcgctcgaccaggcgcggctggacctgcggcgcagcgagttgcgctcaccggtggacggctatgtgacgcagttgcgcgtgcagcccggcgattacgcggcggcgggccggaccaacatcttcatcgtcgatcggcgaagcttctgggtcaccggctatttcgaggaaaccaagctgcgcaatgtacaggtcggcgcgccggcgacgatcaagctgatggggttcgatccgctgctcgacggccatgtcgcgagcatcggtcgcggtgtcgccgacctcaacgaaagccgtgccgacagcggcctgccgcaggtcagcccgaacttcagctggatacgcctggcgcagcgcgtgccggtgcgcatcgaactcgaccgggtaccggcgggcgtggtgcttgccgccggcatgaccggcagtgtcgaggtgctgcaggcggggaccgcgcggcactggcggctgacccgctggttgcaggagtacctttga

SEQ ID NO: 81712 - protein, 302 aa, Pseudomonas aeruginosa PAO1
MSIVRLSKVAATFACGLLALCLALQLWQAYVLAPWTRDGRVSAQVIRIAPEVSGSVEAVFVADNQRVARGDPLYRIDPRSYRLAVRQREAELEQARETLRQRDEQWRRRMQLAGAVSREEVANAGRALRIARARAEAAGAALDQARLDLRRSELRSPVDGYVTQLRVQPGDYAAAGRTNIFIVDRRSFWVTGYFEETKLRNVQVGAPATIKLMGFDPLLDGHVASIGRGVADLNESRADSGLPQVSPNFSWIRLAQRVPVRIELDRVPAGVVLAAGMTGSVEVLQAGTARHWRLTRWLQEYL

SEQ ID NO: 81713 - DNA, 1158 bp, Pseudomonas aeruginosa PAO1
  CDS (1)..(1158): transl_table=11
atgcaggcgttgcgcagtggtgggggacgggtcctggtgggcgtgctggcggcgggcctggtcgccttcggcggttgggcatggctcggcggcgacgccggggcgaaggcggcgcccgcgccggccagggtcccggtgatcgtggcgcgggtggagcggcgcgacgtcgagcaacaggtcagcggcatcggcacggtgacttcgttgcacaacgtggtgatccgcacccagatcgacggccagttgacccgcctgctggtgagcgaagggcagatggtcgaggcgggcgagttgctggcgaccatcgatgaccgcgccgtcgtcgccgcgctggagcaggcgcaggcctccagggcgagcaaccaggcccagctgaaatccgccgagcaggacctgcaacgctaccgcagcctgtatgccgagcgtgcggtgtcacgccaactgctggaccagcagcaggcgacggtcgaccagttgcgcgcgaccctgaaggccaacgatgccaccatcaacgccgagcgggtgcgcctgtcctacacccggatcacctcgccggtatccggcaaggtcggtatccgcaacgtcgatgtcggcaacctggtgcgggtcggcgacagtctcggcctgttcagcgtgacccagatcgcaccgatctccgtagtcttctccctgcaacaggaacagttgctccagttgcaggcgctgctcggcggcgaggcggcggtgcgcgcctacagccgcgacggcgggagcgcgctgggcgagggccggttgctgaccatcgacaaccagatcgacagttccaccggcaccatccgcgtgcgcgcctccttcgataaccgccaggcccggctctggcccgggcagttcgtcgcggtgagcctgcacaccggggtccggcgcgaccagttggtgctgtcgagcaaggcggtgcgccgcggcctggagggcaatttcgtctaccgggtcgccgacgaccgggtcgaggcggtgccggtgcgggtgctccaggacatcgacggcctcagtgtggtggaaggcctggccagcggtgaccaggtggtggtggacggccactcgcggctgatgcccggcgccctggtcgatatccaggagccgcgcccgagcctggcccaggccacggagcggcggccgtga

SEQ ID NO: 81714 - protein, 385 aa, Pseudomonas aeruginosa PAO1
MQALRSGGGRVLVGVLAAGLVAFGGWAWLGGDAGAKAAPAPARVPVIVARVERRDVEQQVSGIGTVTSLHNVVIRTQIDGQLTRLLVSEGQMVEAGELLATIDDRAVVAALEQAQASRASNQAQLKSAEQDLQRYRSLYAERAVSRQLLDQQQATVDQLRATLKANDATINAERVRLSYTRITSPVSGKVGIRNVDVGNLVRVGDSLGLFSVTQIAPISVVFSLQQEQLLQLQALLGGEAAVRAYSRDGGSALGEGRLLTIDNQIDSSTGTIRVRASFDNRQARLWPGQFVAVSLHTGVRRDQLVLSSKAVRRGLEGNFVYRVADDRVEAVPVRVLQDIDGLSVVEGLASGDQVVVDGHSRLMPGALVDIQEPRPSLAQATERRP

SEQ ID NO: 81715 - DNA, 858 bp, Pseudomonas aeruginosa PAO1
  CDS (1)..(858): transl_table=11
atgcgtgcatcgcttcgcgtcgtcgtcaccctgctggtggtcgctgccgctgtcctcgccggcatctggctctggcgctactacatgctctcgccctggacccgcgatgcccgggtgcgggccgacgtggtggtggtggcgccggacgtgtccggctgggtgaccgacctggaggtcaaggacaaccaggtggtcaaggtcggcgacgtgctgatgcgcatcgaccaggaacgctaccaggccaacctggagcaggcccgcgccgtcgccgagacccgtcaccagcaatacctgttgcgccagaacgaggcggcccggcgcagccgcctgggcatcggcgcgatcagcgccgaggacaaggaaaacgcccagatcaatgccgccatcgctcgcagcgagtaccaggaggcgctggcccaggtgaagatcgccgaactcaacctcaagcgcagcgagctgcgcgccgcgcgcaacggccaggtaaccaacctgcgcctggcccagggcaactacgccacggcgggccaggcggtgatggcgttggtcgaccagcagtccttctatgtggtcgcctacttcgaggaaaccaagctgcccggcatccgcgtcggcatgcgcgcccaggtccgcctgatgagcggcgatcagccgatcgacggcacggtggagagcatcagcagcggtatcaccgaccgcaactcgacgccggacggccagttgctggccaatgtcgagccgaccttcaactgggtgcgcctggcgcagcgtattccggtgcgcatccgcctcgaccaggtgccggcggatgtccacctgagcgccgggatgaccgccagcgtcaccgtgcagggggactga

SEQ ID NO: 81716 - protein, 285 aa, Pseudomonas aeruginosa PAO1
MRASLRVVVTLLVVAAAVLAGIWLWRYYMLSPWTRDARVRADVVVVAPDVSGWVTDLEVKDNQVVKVGDVLMRIDQERYQANLEQARAVAETRHQQYLLRQNEAARRSRLGIGAISAEDKENAQINAAIARSEYQEALAQVKIAELNLKRSELRAARNGQVTNLRLAQGNYATAGQAVMALVDQQSFYVVAYFEETKLPGIRVGMRAQVRLMSGDQPIDGTVESISSGITDRNSTPDGQLLANVEPTFNWVRLAQRIPVRIRLDQVPADVHLSAGMTASVTVQGD

SEQ ID NO: 81717 - DNA, 1059 bp, Pseudomonas aeruginosa PAO1
  CDS (1)..(1059): transl_table=11
atgactcccgatcaacgatttgcccgttgggttcaagtcgctatcgcggtattcgtgttgctgttcgtctacttcctggtcgccgacctgtggatgccgctcaccccgcaggcccagttgacccggccggtggtgcgcgtcgcgccgcgtgtcagcggtcaggtcgccgaggtgctggtgtccaacaacggccacgtgcagcccggcgaagtattgttccgcctcgatcccgagcctttccgactggccgtgcgccaggccgaactggcactggaggaagccgagcgcaccaaccgcgagctggatgccgccatcgcctcggccaaggccgacctcctggccgcgcgcagcagcgccggcgagctggacagcgaggcgcgccgcaccgcccaactggtgcagcgccaccatgtgtcgcagcagatgcacgagcaggtcagcgcccaggcccaggccgcccgtgcccgggtcgccgcggcccaggcgcggatcggcgagctgaccgcgcgacgcggcacggccggcgaggacaacctgcgcctgcgccaggcgcgcaatgccctggcccaggctcgtctgcaactgcaatacagcagcgtccgggccgaccgcgccgggaccctgagcaacctgcaactgaccccgggcacctacgttccggccggaacgccggtggcggcgctggtggacgaccgtatcgacatcgtcgccgacttccgcgagaaatcgctgcgctacgtgcgccctggcgaccgtgcggcggtggtgttcgacgcgcgtcccggcgaagtgttcggcgcgcgagtggcggccatcgacgccggggtcaaggagggccagctggacgccaacggcgacctcgccgcgccggtcacctccgaccgctgggtccgcgacgcccagcgccagcgcctgcacgtggtgctcgacgaacttcccgaaggcctgctgcccaccggtgccaaggccaccgtgcagctctatcccggcgacggcctgagccatctgctcggtcgcgcgcagatcgtcgccatcagcctgctgcactacgtctactga

SEQ ID NO: 81718 - protein, 352 aa, Pseudomonas aeruginosa PAO1
MTPDQRFARWVQVAIAVFVLLFVYFLVADLWMPLTPQAQLTRPVVRVAPRVSGQVAEVLVSNNGHVQPGEVLFRLDPEPFRLAVRQAELALEEAERTNRELDAAIASAKADLLAARSSAGELDSEARRTAQLVQRHHVSQQMHEQVSAQAQAARARVAAAQARIGELTARRGTAGEDNLRLRQARNALAQARLQLQYSSVRADRAGTLSNLQLTPGTYVPAGTPVAALVDDRIDIVADFREKSLRYVRPGDRAAVVFDARPGEVFGARVAAIDAGVKEGQLDANGDLAAPVTSDRWVRDAQRQRLHVVLDELPEGLLPTGAKATVQLYPGDGLSHLLGRAQIVAISLLHYVY

SEQ ID NO: 81719 - DNA, 909 bp, Pseudomonas aeruginosa PAO1
  CDS (1)..(909): transl_table=11
atgaccttgaaatccgtaatcagcctgctggcgaccctgctgatcctgctggtcgccgtattcatcgggcggaccctgtgggtcaactacatggacaccccctggacccgtgacggtcgcgtgcgcgccgacgtgatcaatgtcgccgccgacgtttccgggatcgtcgtcgacgtcccggtgcgcgacaaccagttggtgaagaaaggcgacctgctgatgcagatcgaccccgaccactaccgtattgcggtgaagcaggccgagtcgctggttgcctcgcgcaaggcgaccctggagatgcgccagttgaacgcccggcggcgggcggaaatggatgagatggtggtctcccgcgaaagccgcgacgacgcccacaacaccgccgccgcggcgatggccgactacgagcaggccaaggcccagctcgacgccgcgcgcctgaacctggagcgcacccgggtggtggcgcaggtcgacggctacgtcaccaacctcaacgtgcaccgtggcgactacgcgcgggtcggcgaggcgaagatggcggtgatcgacaagaactcctactgggtctacggctacttcgaggaaaccaagctgccgtacatccgcgaaggcgacccggtggacatgcagctgatgagcggcgaacacctcaagggccacgtggaaagcatcgcccgcggcatctacgaccgcgacaacccggaaagccgcgagctgaccgccgacgtcaaccccactttcaactgggtgcgcctggcccagcgcgtgccggtgcgggtacacatcgacgaagtgccggacggcgtgctgctctcggcggggatcacctgcacggtgatcgtcaagccgcaagggcgcgacgaccaggcctcggcggcgcaggcgccggggcgggccggttga

SEQ ID NO: 81720 - protein, 302 aa, Pseudomonas aeruginosa PAO1
MTLKSVISLLATLLILLVAVFIGRTLWVNYMDTPWTRDGRVRADVINVAADVSGIVVDVPVRDNQLVKKGDLLMQIDPDHYRIAVKQAESLVASRKATLEMRQLNARRRAEMDEMVVSRESRDDAHNTAAAAMADYEQAKAQLDAARLNLERTRVVAQVDGYVTNLNVHRGDYARVGEAKMAVIDKNSYWVYGYFEETKLPYIREGDPVDMQLMSGEHLKGHVESIARGIYDRDNPESRELTADVNPTFNWVRLAQRVPVRVHIDEVPDGVLLSAGITCTVIVKPQGRDDQASAAQAPGRAG

SEQ ID NO: 81721 - DNA, 1185 bp, Pseudomonas aeruginosa PAO1
  CDS (1)..(1185): transl_table=11
atgactaccgccaacagcgaaacccctgccggcaacccgaagcgcaagcgctggttgctgatcctgctcgccatgatcgtcctcgccaccctggccagcgtggcctgggagttcttctacggccgctggcacgaggacaccgacgacgcctacatcaacggcaacgtggtacagatcaccccgcagatcgtcggcaccgtggtcagcatcggcgccgacgacggcgacctggtgcgcaagggccaggaactggtcaggttcgatcccagcgacgccgacatcgccctccaacgcgccgaggccaacctggcccacaccgtgcgccaggtgcgcgggctgttcagcaacgtcgacggctatcgcgccgaggtcgccacccgcaaggtcgcgctggccaaggccgaggccgactacaagcggcgcaagaacctcgcagacgacggcgccatttcccaggaggaactggcccacgcccgcgacgccttggacagcgcgaaagcctcgctgaccagctcggaacagcagttgaacaccaatcgcgcgctggtcgacgacacccagatcacctcccatccggacgtcaaggccgccgccgcgcaactgcgccaggcctacctggacgacgcccgctcgaccatcgtcgcgccggtcaccggctacgtcgccaagcgcagcgtacaagtcggccagcgcgtgcaaccgggcaatgcgctgatggccgtggtcccgctggaccagatctggatcgacgccaacttcaaggaaacccagctcaagcacatgcgtatcggccagccggtggagatccgctccgacctctacggcagcgacgtgcgctacagcggcaccgtcgacagcctcggcgtgggcaccggcagcgcgttctccctgctgccggcgcagaacgccaccggcaactggatcaagatcgtccagcgggtgccggtgcgcatccatatcgatccgcaagaattgcagaagcatccgctgcgcatcggcctgtcgatggacgtcaaggtcgacctgcatgaccagagcggcccggccctggcccagcaaccaccgcgcgaagcgctgttctccaccgatgtctaccagcagcaactggcctcggccgacaagctgatcgaacgcctgatcgaagccaacctcgccgaagaccacggcaagaccgcccagcgttga

SEQ ID NO: 81722 - protein, 394 aa, Pseudomonas aeruginosa PAO1
MTTANSETPAGNPKRKRWLLILLAMIVLATLASVAWEFFYGRWHEDTDDAYINGNVVQITPQIVGTVVSIGADDGDLVRKGQELVRFDPSDADIALQRAEANLAHTVRQVRGLFSNVDGYRAEVATRKVALAKAEADYKRRKNLADDGAISQEELAHARDALDSAKASLTSSEQQLNTNRALVDDTQITSHPDVKAAAAQLRQAYLDDARSTIVAPVTGYVAKRSVQVGQRVQPGNALMAVVPLDQIWIDANFKETQLKHMRIGQPVEIRSDLYGSDVRYSGTVDSLGVGTGSAFSLLPAQNATGNWIKIVQRVPVRIHIDPQELQKHPLRIGLSMDVKVDLHDQSGPALAQQPPREALFSTDVYQQQLASADKLIERLIEANLAEDHGKTAQR

SEQ ID NO: 81723 - DNA, 1104 bp, Campylobacter jejuni subsp. jejuni NCTC 11168
  CDS (1)..(1104): transl_table=11
atgaaattatttcaaaaaaatactattttagctttaggtgttgtgcttttactcactgcttgcagcaaagaagaagcaccaaaaatacaaatgccgcctcaacctgtaacaaccatgagtgctaaatctgaagatttaccacttagttttacttaccctgctaaacttgtcagtgattatgatgtcattataaagcctcaagttagtggcgtaatagaaaataaactttttaaagctggagataaagtaaaaaaaggacaaacattatttattatagaacaagacaaatttaaagctagtgttgattcggcttacggacaagctttgatggctaaggcaactttcgaaaatgcaagcaaggattttaatcgttctaaagctctttttagtaaaagtgcaatctctcaaaaggaatacgactcttctcttgctacatttaacaattcaaaagctagtctagcaagtgctagagcacagcttgcaaatgcaagaattgatctagatcataccgaaataaaagctccttttgatggtactataggagatgctttagttaatataggagattatgtaagtgcttcaacaactgaactagttagagttacaaatttaaatcctatttacgcagatttctttatttcagatacagataaactaaatttagtccgcaatactcaaaatggaaaatgggatttagacagcattcatgcaaatttaaatcttaatggagaaaccgttcaaggcaaactttattttattgattctgttatagatgctaatagtggaacagtaaaagccaaagctatatttgacaacaacaactcaacacttttaccaggtgcttttgcaacaattacttcagaaggttttatacaaaaaaatggctttaaagtgcctcaaatagctgttaaacaaaatcaaaatgatgtttatgttcttcttgttaaaaatggaaaagtagaaaaatcttctgtacatataagctaccaaaacaatgaatatgccattattgacaaaggattacaaaatggcgataaaatcattttagataactttaaaaaaattcaagttggtagcgaagttaaagaaattggagcacaataa

SEQ ID NO: 81724 - protein, 367 aa, Campylobacter jejuni subsp. jejuni NCTC 11168
MKLFQKNTILALGVVLLLTACSKEEAPKIQMPPQPVTTMSAKSEDLPLSFTYPAKLVSDYDVIIKPQVSGVIENKLFKAGDKVKKGQTLFIIEQDKFKASVDSAYGQALMAKATFENASKDFNRSKALFSKSAISQKEYDSSLATFNNSKASLASARAQLANARIDLDHTEIKAPFDGTIGDALVNIGDYVSASTTELVRVTNLNPIYADFFISDTDKLNLVRNTQNGKWDLDSIHANLNLNGETVQGKLYFIDSVIDANSGTVKAKAIFDNNNSTLLPGAFATITSEGFIQKNGFKVPQIAVKQNQNDVYVLLVKNGKVEKSSVHISYQNNEYAIIDKGLQNGDKIILDNFKKIQVGSEVKEIGAQ

SEQ ID NO: 81725 - DNA, 1185 bp, Neisseria meningitidis Z2491
  CDS (1)..(1185): transl_table=11
atgaaatcaggaaattcggaacccaatcttatggatacgcacacggacgaaacaaaacttcaaaacacgcaagccaaacgcaaacgccgcctgacggcattgacgctgctgttcgcgcttgccgccgcagccgccgggtcggcgttttttttatggtggcagcacgaagaggaaacggaagacgcttatgttgccggacgcgtggttcaggttacgccgcaaaagggcggtacggtgcggaaggttttgcacgacgatacggatgccgtgaaaaaaggcgacgtgctggcggtattggacgacgataatgatgtgctggcttacgagcgggcaaaaaacgagctggttcaggcggtgcggcaaaaccgccggcaaaatgccgccacttcgcaggcgggggcgcaggttgccttgcgccgggcggatttggcacgcgcacaggatgatttgcgccgccggtctgctttggcggaatcgggcgcggtgtccgccgaagagctggcacacgcccgtgcggcagtgtctcaggcgcaggcggcggtcaaagcggctttggcggaagaatcttcggcacgtgcggctttgggcggtcaggtttctttgcgcgaacagccggcggttcagacggcaatcggcaggttgaaagatgcgtggttgaaccttcagcggacgcaaatccgcgcgccggcggacggtcaggtggcgaagcgttcggtgcaggtcgggcagcaggtggcggcaggcgcgccgctgatggcggtggtgccgctgtcggatgtgtgggtggatgctaattttaaagagacgcagttgcggcatatgaaaatcggacagcctgccgagctggtgtccgatttgtacggcaaacaaattgtttatcgcggcagggtggcaggtttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctga

SEQ ID NO: 81726 - protein, 394 aa, Neisseria meningitidis Z2491
MKSGNSEPNLMDTHTDETKLQNTQAKRKRRLTALTLLFALAAAAAGSAFFLWWQHEEETEDAYVAGRVVQVTPQKGGTVRKVLHDDTDAVKKGDVLAVLDDDNDVLAYERAKNELVQAVRQNRRQNAATSQAGAQVALRRADLARAQDDLRRRSALAESGAVSAEELAHARAAVSQAQAAVKAALAEESSARAALGGQVSLREQPAVQTAIGRLKDAWLNLQRTQIRAPADGQVAKRSVQVGQQVAAGAPLMAVVPLSDVWVDANFKETQLRHMKIGQPAELVSDLYGKQIVYRGRVAGFSAGTGSAFSLIPAQNATGNWIKVVQRVPVRIVLNREDVDRHPLRIGLSMTVKVDTSAAGAPVSKTPGAALPEMESTDWSEVDRTVDEILGQSAP

SEQ ID NO: 81727 - DNA, 1158 bp, Agrobacterium tumefaciens str. C58
  CDS (1)..(1158): transl_table=11
ttgtctggatgcgtgtccgacctttcctgtcgcgggaaaagaccgatactgcgccggcgctacagtcatgaaaattccaagagtgacaaaatgctgaagaagttttttacccccgtttccatcctcgtgctgctcggcggcatcgccggcgttgcgctggtgctttacgcctggcggctgccgcctttcctgtccaccgtcgaaatgaccgacaacgccttcgtgcgcggttatgtgacgaccatgagcccgcaggtcagcggttatgtcgtcaatgtcccggtgaaggactatcaggaagtcaagcaggggacgctgctggccaagatcgatgaccgcatctaccaccagaaacaggcgcaggcggaagccacgctcgatacccacaaggcagcactcgacaattcccgccagcaggaaaatgccgccaatgccaatatccgctccagcgaggcggctgtcgacagtgccgaagcctcactgaagcaggcgcagctcgcctccgaccggcaggataatctgatcaagagcggcgtcggaacttccagccttcaggaagaagcccatgcggcgcttgaaaaggcgcgcgcatcactgtcccaggcgaaagcggcgctcgaggtttcccgtcaggatttgcagaccatcatcgtcaaccgcagctcgttacaggcggccgtcgccaatgccgaggccgccgttgaactcgcccgcatcgatcttgccaataccgagattcgcgcgccggtggatggcaggctcggcgaagtcggcgtgcgcaccggccaatatgtcaccgctggcacgcaactgatggccgtcgttccgcatgatgtctgggttatcgccaatttcaaggagacccagctcgccggtatgcaggtgggccagccggtgacgatttcggtcgatgcgctgcatcgccgcaagctgaccggccatgtggagcgcttttcgcccgccaccggctcggaattcgccgtcatcaagcccgacaatgcgaccggcaatttcgtgaagatcgcccagcgtctcggcgtgcggatcgtgatcgatgcggatcagccgctcgcggcggagctttcgcctggtatgtcggtggtggtgcatctggacaagagcaaggcgcctgatggggcggagacggcggcgaagtag

SEQ ID NO: 81728 - protein, 385 aa, Agrobacterium tumefaciens str. C58
MSGCVSDLSCRGKRPILRRRYSHENSKSDKMLKKFFTPVSILVLLGGIAGVALVLYAWRLPPFLSTVEMTDNAFVRGYVTTMSPQVSGYVVNVPVKDYQEVKQGTLLAKIDDRIYHQKQAQAEATLDTHKAALDNSRQQENAANANIRSSEAAVDSAEASLKQAQLASDRQDNLIKSGVGTSSLQEEAHAALEKARASLSQAKAALEVSRQDLQTIIVNRSSLQAAVANAEAAVELARIDLANTEIRAPVDGRLGEVGVRTGQYVTAGTQLMAVVPHDVWVIANFKETQLAGMQVGQPVTISVDALHRRKLTGHVERFSPATGSEFAVIKPDNATGNFVKIAQRLGVRIVIDADQPLAAELSPGMSVVVHLDKSKAPDGAETAAK

SEQ ID NO: 81729 - DNA, 1299 bp, Agrobacterium tumefaciens str. C58
  CDS (1)..(1299): transl_table=11
atgtgtcaggaaagagattatgtcaatcgaaccgaacggttcagttcgaaaactttcttcaatctatcacggtacaatctcatgtcggcccagaagaatagcgcggttcgcgccgtcaacgatgcggaagaggcggatatttccgccaaggccgagacctccccggcaaagccggctgacgcaccgccgcaggcgactccggctcccgccgttgctgcgccgaaggcgaagaagcgttcgccgcttctgccgatcttcgcgcttgcgcttctggtcggtgccggctggtacggttacaactggtggatcgacggccgcttcatggtgtcgaccgatgacgcctatatacaaggtgatattgcggtcatcgcgccgaaggttgccggttacgtcgccaaggtgaacgtcgtcgaaaaccaggaagtcaaggcgggcgatccgctggtgacgcttgacgatggcgactaccgcatcgcattcgaacaggccgacgcacagatccgcaccgaacaactgtcgctgaagcgcatcgatgcgcagatcattggcggcgaggcagcgcaggaacaggccgtcgcccagaagggtgcgctggatgccgcccttcgcggtgccgaaatcacccagaagcgcgccaccgaattgcaggcaaaggacgtcggcacggttgccgcatccgataacgcgcaggtcgcactcgatcaggccagggcaaatgtcgtggccggcgaggcggcgatctcttctgcgaaagccaatgtcgagcttctgcgcgcccagcgcgaggaagccgaaagcaccatccgttcgctgcagctttcgaaggacaaggccgcccgcgacctggcctttacggttctgaaggcaccttatgacggcgtcatcggcaatcttgcggtacagacgggtgatctcgtctcggtcggcaagcgtctggcatcgctggtgccgatgaacgagctttatatcgacgccaatttcaaggaaacgcagcttgcccgcgttgtgcccggttcgaaggtccgcgtccacgtggatgccttcgacgacgaggccatcgaaggcacggtccagtcgatctcgcccggctcgggctcggtcttctccatgctgccgccggaaaatgcgacgggcaacttcaccaaggtcatccagcgcgtgcctgttcgcatcgtcttctccaaggaagaccttgccaagcacaatctgcgcgcgggcctcagtgtcgttgttgatgtcgacacccgcacggcacctgaaaacaccagaacggcgcaagttaacccgcaggccaagtaa

SEQ ID NO: 81730 - protein, 432 aa, Agrobacterium tumefaciens str. C58
MCQERDYVNRTERFSSKTFFNLSRYNLMSAQKNSAVRAVNDAEEADISAKAETSPAKPADAPPQATPAPAVAAPKAKKRSPLLPIFALALLVGAGWYGYNWWIDGRFMVSTDDAYIQGDIAVIAPKVAGYVAKVNVVENQEVKAGDPLVTLDDGDYRIAFEQADAQIRTEQLSLKRIDAQIIGGEAAQEQAVAQKGALDAALRGAEITQKRATELQAKDVGTVAASDNAQVALDQARANVVAGEAAISSAKANVELLRAQREEAESTIRSLQLSKDKAARDLAFTVLKAPYDGVIGNLAVQTGDLVSVGKRLASLVPMNELYIDANFKETQLARVVPGSKVRVHVDAFDDEAIEGTVQSISPGSGSVFSMLPPENATGNFTKVIQRVPVRIVFSKEDLAKHNLRAGLSVVVDVDTRTAPENTRTAQVNPQAK

SEQ ID NO: 81731 - DNA, 1359 bp, Agrobacterium tumefaciens str. C58
  CDS (1)..(1359): transl_table=11
gtgtcttgtgggggaaagctgctcccaaggcttgccgcacatgttcgggaaacatgtactctcattacgcggaatcgtcagatgaaacgtttctggaccgcccttagcgttcttgccattgcagccgccggtacctggtattttagggatcgcctgccgctcgatcaaattccctatctcaaacaattttccagcgcgtctccgcagcccggcgccgaaactgcagcgcaatcctcccaaaacggccagccggcccggcagtcgggacaaagacagggcggcggacgtcgcaatggcgcgccgcccacggtcagcaccatcgccgtcgccaaggcgacgctgccgatggatgcaacggcgacgggatgggcagttgcggccgatatcaccaatatcgccccgcttcaggccggtctcgtcacggaaattagcgcgaaggacggccagcatatcaaggcgggcgatctgatcctcaagttggatgaccgcatcgcccgtgccgccgtcgacaaggacaaggccaatatcgccgccgaccaggcgacgctggagcagaccgaggccgccttccagcgtgccaccaatctggtcaagcagagcgcggaatcgcaacaggtactggatcaggccagggcagcgcgcgacggcgccagcgccaagatcgatgccgacaaggcaacgctcgcctcagatcaggtgacgctcgaacatatggaaatccgtgccccattcgacgggcggctcggcgatatcaccgtcagccccggcgcctacctcagtgccggcgtcaatatcgtgacgattaccaaatatgatccgatctcggtcagtttccggctttcccagcgctacctgccgcaattgcgtgaaggcgtgacaaaagaaaccgccgttgatgtcgatccggcggcgacggggggcgagcccatgcgcggcgtcctgcgtttttacgacaatgcggtggaccagacctcgggcaccgtgctggcaaaagcggagttcaagaatgaccgcggtcttttgtggcccggccagtcagtgaacgtcaccgcccacttcgtctcggacgatgaaatgatcgtggtgccgactgtcgccgtgcggcccgggccgaagggcaatttcgtctatacggtcgatagcgaacaccatgcccatatgacatcggtggaagttgcccgctcgaatggcgacctcaccgccataacaagcggcctcaatggcggcgaacatatcatcgttgaaggtcagtccgaacttgccgatggccagacggtggtcgagcaattttccgacaagggcggtgcggctgccaatgtggccgccaatattccgcaggaacaggttggcggccaatga

SEQ ID NO: 81732 - protein, 452 aa, Agrobacterium tumefaciens str. C58
MSCGGKLLPRLAAHVRETCTLITRNRQMKRFWTALSVLAIAAAGTWYFRDRLPLDQIPYLKQFSSASPQPGAETAAQSSQNGQPARQSGQRQGGGRRNGAPPTVSTIAVAKATLPMDATATGWAVAADITNIAPLQAGLVTEISAKDGQHIKAGDLILKLDDRIARAAVDKDKANIAADQATLEQTEAAFQRATNLVKQSAESQQVLDQARAARDGASAKIDADKATLASDQVTLEHMEIRAPFDGRLGDITVSPGAYLSAGVNIVTITKYDPISVSFRLSQRYLPQLREGVTKETAVDVDPAATGGEPMRGVLRFYDNAVDQTSGTVLAKAEFKNDRGLLWPGQSVNVTAHFVSDDEMIVVPTVAVRPGPKGNFVYTVDSEHHAHMTSVEVARSNGDLTAITSGLNGGEHIIVEGQSELADGQTVVEQFSDKGGAAANVAANIPQEQVGGQ

SEQ ID NO: 81733 - DNA, 1089 bp, Sinorhizobium meliloti 1021
  CDS (1)..(1089): transl_table=11
ttgaacaatgaagtcgttatcatgctgaaaaatttccgctctcccaccacgcttatcgttcttcttgccggcctcgccggtctttcgctcgtcctctacgcctggcgtctgccgcccttcgcgagctccgtcgaaaccacggagaacgcctatgtccgcggctatgtcacgaccatcagcccgcaactttccggctatgtcgcggaggtgccggtgcgcgactacgaggaggtaagggctggtcagctcctcgtcaggatcgatgaccggatttacgtccagaagcttgcgcaggcaaaagcgacactcgcgacacaaaggtcggcgttggcgaactcgttcgaacaggagctgtcggcaaaggccggaatcgctgcgagcgaggcccagctcgacggggccaaagcggctctggcaacggcgagagccacctgggaccgcattcgtccgctcgccgacaaaggtgtcgcgacgcggagcgacgccgaccaggcccgggcggccttcgagcaggcggacgcgggcgtcaagcaggcgatcgccaatctcgaggtttcgcgccagtcgcttgcgacgacgctcggcgcccgcgccggcctcgagggttcggtagccggcgccgaggcggccgtggagctcgccgagatcgacctcgacaacaccaggatcgttgcgccgcgtgccggcaggctcggcgagatcggcgcccgtgtcggacaatatgtcaccgccggcacgcagctgctttcggtcgtgccgcacgaggtctggatcgtcgccaacttcaaggagacgcagcttgacggaatgagggttggtcagcccgtcaccatttcggtagacgccttgaaccggcaggtgctgagaggccacatcgagcgcttctctcccgctgccggatcggaattcagcatcatccggccggataacgccaccggcaatttcaccaaggtggcgcaacgtctcggcgtgcgcatcgccgtcgaccccgaacagccgatggccgatcgccttgctcccgggctctctgtcgtggtgagggtcgacaaggcgggcgaaccgcaggcggcaatcgcgtccgccggatag

SEQ ID NO: 81734 - protein, 362 aa, Sinorhizobium meliloti 1021
MNNEVVIMLKNFRSPTTLIVLLAGLAGLSLVLYAWRLPPFASSVETTENAYVRGYVTTISPQLSGYVAEVPVRDYEEVRAGQLLVRIDDRIYVQKLAQAKATLATQRSALANSFEQELSAKAGIAASEAQLDGAKAALATARATWDRIRPLADKGVATRSDADQARAAFEQADAGVKQAIANLEVSRQSLATTLGARAGLEGSVAGAEAAVELAEIDLDNTRIVAPRAGRLGEIGARVGQYVTAGTQLLSVVPHEVWIVANFKETQLDGMRVGQPVTISVDALNRQVLRGHIERFSPAAGSEFSIIRPDNATGNFTKVAQRLGVRIAVDPEQPMADRLAPGLSVVVRVDKAGEPQAAIASAG

SEQ ID NO: 81735 - DNA, 1149 bp, Sinorhizobium meliloti 1021
  CDS (1)..(1149): transl_table=11
atggatactcattcggccgaggccaagagccccgggaccggcgaggccgcagccgcaggacaagcggacgcggagatctctgcgtccccgaagaagcgccgcaaaatccttccggtgctgggtctcgtgctcctcggtgccgccggctggtacggctatgattggtggaccaacggccgtttcctggtctcgacggacgacgcttacatagaaggggacatcgcgacgatttcgcccaaggtgtccggctatgtcgccaaggtcgacgttgtcgccaaccagcatgtgaaggctggcgatccgctggtgacgctcgacgacggagattaccgcattgcggccgagcaggccgaggcgcagatcgccacgcagaagctcgccctcagccgtttcgacgcgcagatctccggcgcaaaggcgagcctcgctcagtccgaagcgcagaagaaggcgcttgaggcgaccgtccgcggcgccgaactggcacagaagcgcgccagcgagctccagtcgaagtcgttcgggacggatgcatcgcgcgacagcgcccaggtcgcgctcgatcaggcgcgcgcaaatctagccggtgccgaggccaatatcgctgcggccaaggccaatatcaccgtgctcgaggcccagcagatggaagcggaaagcacgatccgctcgctggagcttgcccgggacaaggcagaccgcgacctgggcttcaccatactcaaggcgccctatgacggtgtcatcggcaatgtcgcggtccaggtcggcgacctcgtctcggccggccagcggctcgcagcgctcgtgccgaccgatcagctctatatcgacgccaatttcaaggagacgcagatcgcgcatctggtgccgggctccaaggttgagatccatgtcgacgcctatgaggatcacccgatcgaaggcaccgtcgcatcgatctcgccggcctccggttcggtcttctcgctgctgccggcggaaaacgcgacgggcaacttcaccaaggtcatccagcgcgttccggtgcgcatcacgctgccggccgatgtgctggcggaagggcacctgcgcgcggggctgagcgtcgtcgtcgacgtcgatacccgcaccgcaccggaacagtcgaaggtcgctgcggcgaagtaa

SEQ ID NO: 81736 - protein, 382 aa, Sinorhizobium meliloti 1021
MDTHSAEAKSPGTGEAAAAGQADAEISASPKKRRKILPVLGLVLLGAAGWYGYDWWTNGRFLVSTDDAYIEGDIATISPKVSGYVAKVDVVANQHVKAGDPLVTLDDGDYRIAAEQAEAQIATQKLALSRFDAQISGAKASLAQSEAQKKALEATVRGAELAQKRASELQSKSFGTDASRDSAQVALDQARANLAGAEANIAAAKANITVLEAQQMEAESTIRSLELARDKADRDLGFTILKAPYDGVIGNVAVQVGDLVSAGQRLAALVPTDQLYIDANFKETQIAHLVPGSKVEIHVDAYEDHPIEGTVASISPASGSVFSLLPAENATGNFTKVIQRVPVRITLPADVLAEGHLRAGLSVVVDVDTRTAPEQSKVAAAK

SEQ ID NO: 81737 - DNA, 900 bp, Escherichia coli K12
  CDS (1)..(900): transl_table=11
ttgcgtttgccttgctctggcaatactgattgcgtggtaactatgtcaattaaaacaattaagtatttctcaacaatcattgtagcggtagttgcggttcttgccggatggtggctgtggaattattacatgcaatctccgtggacacgcgacgggaaaatacgcgcagaacaggtttctatcaccccacaggtgtcgggacgtattgttgagctgaatataaaagacaaccagctggttaacgcgggggatcttctgctcacgatcgataaaacgccctttcagatcgccgagctgaacgcacaggctcagctggcgaaagcgcaatctgacctcgcaaaagccaataacgaagcgaatcgtcgtcgtcatctctcacaaaattttatttctgccgaagaactcgataccgctaacctcaatgttaaagcgatgcaggccagtgttgatgccgcacaggcgacgctgaaacaggcacaatggcaactggcgcaaacggaaattcgcgccccggtgagtggatgggtgactaaccttactacccgcatcggcgattacgctgataccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtttccagtatcggtcgggcgatttatgatcagagcgttgaaagtgactcaagccttattccggatgttaaacctaacgtcccctgggttcgactcgcccaacgcgttcccgtccgctttgcgctggataaagtcccaggcgatgtcacgttggtgtcgggcaccacctgtagcattgccgtaggtcaataa

SEQ ID NO: 81738 - protein, 299 aa, Escherichia coli K12
MRLPCSGNTDCVVTMSIKTIKYFSTIIVAVVAVLAGWWLWNYYMQSPWTRDGKIRAEQVSITPQVSGRIVELNIKDNQLVNAGDLLLTIDKTPFQIAELNAQAQLAKAQSDLAKANNEANRRRHLSQNFISAEELDTANLNVKAMQASVDAAQATLKQAQWQLAQTEIRAPVSGWVTNLTTRIGDYADTGKPLFALVDSHSFYVIGYFEETKLRHIREGAPAQITLYSDNKTLQGHVSSIGRAIYDQSVESDSSLIPDVKPNVPWVRLAQRVPVRFALDKVPGDVTLVSGTTCSIAVGQ

SEQ ID NO: 81739 - DNA, 1191 bp, Caulobacter crescentus CB15
  CDS (1)..(1191): transl_table=11
ttggacgactgcgtccatttatcccttgtatgttgcgccggacctgactatccggcgcgcttgttgtcattcgacaagggcttggccatggcggcgtcagagaagaagaagctggttcccctgatcgtcggtggcgtggcgatcgctgcggttctggtcggcggaaccctgtggttccttgacaagcagcacttcgagagcacggacaacgccttcgtccaggccgacactgtgcaggtcagcccgcaagtctccggctatgtcgccgaggtgcttgtcgcggataaccaacgcgtcgagcccggtcaggtgctggccaagatcgatccgtcgaccttccaggcgcgggtggaccaggcgatcgccaacgccgcggcggcggacgccgccgttagggcgatcgatgacaagaacagcctggagcaggccgtgatcgcccagagggcggccggcgtgaccagcgcccaggccgacgccagccgcgccaaggccgaccttgaccgctacaacgccctggccgaccagggctgggtgtcgcagcagaaggtgcagaccacacgcgcggccgcgacccagtccgccgccggcgtcgccagcgcccaggccgcgctggaagccgagaagcgcgccgcccaatcgctgggctcggccaaggcccaggcaatcgcccaggccgccgccgcccatgccgctgtcgaacaggccaagctggaccttgaacgcaccgtgatccgcgcgccggtcagcggtgtggtcggcgcccgcgccgtccgcccgggccaactggttcagccgggcgtcgccctgatgtcggtggtgccgctgggccaggcctatgtcgtcgccaacttcaaggagacccaggtcgcccgcctgcgcatcggccagcccgtcgaaatcaaggcagacgccttcggcaaagaaaagatcgtcggcaaggtcgacagcttcgcacccgctacgggccaagagttcgcgctgatcccgattgagaacgccgtcggcaacttcaccaagatcacccagcgcctcccggtgaagatcgccgtcgaccgcagccagctgggcgcagccctgcggcccggtctgtcggtcgagatcaaggtggatgtccgcgatcgctcgggcccctcgttcgcagaggcggcgcaagtgacgccgcaggtggcccgacagggcgcggcccgctag

SEQ ID NO: 81740 - protein, 396 aa, Caulobacter crescentus CB15
MDDCVHLSLVCCAGPDYPARLLSFDKGLAMAASEKKKLVPLIVGGVAIAAVLVGGTLWFLDKQHFESTDNAFVQADTVQVSPQVSGYVAEVLVADNQRVEPGQVLAKIDPSTFQARVDQAIANAAAADAAVRAIDDKNSLEQAVIAQRAAGVTSAQADASRAKADLDRYNALADQGWVSQQKVQTTRAAATQSAAGVASAQAALEAEKRAAQSLGSAKAQAIAQAAAAHAAVEQAKLDLERTVIRAPVSGVVGARAVRPGQLVQPGVALMSVVPLGQAYVVANFKETQVARLRIGQPVEIKADAFGKEKIVGKVDSFAPATGQEFALIPIENAVGNFTKITQRLPVKIAVDRSQLGAALRPGLSVEIKVDVRDRSGPSFAEAAQVTPQVARQGAAR

SEQ ID NO: 81741 - DNA, 1122 bp, Sinorhizobium meliloti 1021
  CDS (1)..(1122): transl_table=11
atgcgcgtttcgagagttctggctgcggctctttcatgcgggctgctcacgaccatcggcatcgtcgcgggaaacgcttatgcgcagcagccccctccagccgtcaacgtggcgccggccgcgatcatggacctgcgcgaaagcgtggatctaacgggcaaggtcgttgcagttcagaaggtcgatatccgcgcccgtgtgtccggcttcctcgagaaggtcaatttcgaggatgggcagaaggtctcggcgggaacggtgctttatcaggtggaagacggcgcctatcgcgccgccctgcaggagatcgacggttcgatcgcggcagcggaggctcaacgggacctcgccgttctcgaacgtgaccgtgcccagcggttgatcgccaccaatacggttgcgcaggcgacgctcgacactgcgaacgcacaggtgaaaaaggccgaggccgatatcctgcgcctcaagggcagcaagcagaatgccgaactcaatctttcctacacgaagatcctcgcgccgttcgatggcgtcgtcggcctgaccacggtcgatgtcggcgccctcgtcgcgccggacagcggatcgctggtgacgctgacgcgcctcgacccgatctatgtcgagtttcccgtcgcgacctctctttatttctcctaccgcgagcgcgtcgaaaagggtgagatgtcgagcggcgccaatgtcagcatcacgcttccgaacggcaccgactacccggagaaaggcacgatagacttcgtcgcgagcacggtctcgcaagggaccgacaccgttacggttcgcgccgagtttcccaatcccggcgggacccttctcgacggcacgctcgtcagggtcgttctcgagcagtccgatccgcaggacgtgctggccgtgccacagcaggcggtccagcgcgaccagcagggcgccttcgtcatggtggtcgacgccaattccaaggtcgagcttcgccgcgtcgacgtcagccgctccagccgcggccaagccgtcgtcgccaaggggctgaaggagggcgagaacgtcataacggagggcgtgggcaaggtgcggccggggatcgtcgtcgacgctgtagccgcaacgacgacgggtggctga

SEQ ID NO: 81742 - protein, 373 aa, Sinorhizobium meliloti 1021
MRVSRVLAAALSCGLLTTIGIVAGNAYAQQPPPAVNVAPAAIMDLRESVDLTGKVVAVQKVDIRARVSGFLEKVNFEDGQKVSAGTVLYQVEDGAYRAALQEIDGSIAAAEAQRDLAVLERDRAQRLIATNTVAQATLDTANAQVKKAEADILRLKGSKQNAELNLSYTKILAPFDGVVGLTTVDVGALVAPDSGSLVTLTRLDPIYVEFPVATSLYFSYRERVEKGEMSSGANVSITLPNGTDYPEKGTIDFVASTVSQGTDTVTVRAEFPNPGGTLLDGTLVRVVLEQSDPQDVLAVPQQAVQRDQQGAFVMVVDANSKVELRRVDVSRSSRGQAVVAKGLKEGENVITEGVGKVRPGIVVDAVAATTTGG

SEQ ID NO: 81743 - DNA, 1098 bp, Sinorhizobium meliloti 1021
  CDS (1)..(1098): transl_table=11
atggaatcgctggaggagaaggtcgccatcatcaccggcgcaaggtccgggaacggtgtcgccgtggcgcgacccaacaggaaaaagatgatcggcctggcgctgtgcctcggcgcggtcgtcgtcgtcgttgccgggtggacctgggcccgcgagagcggagcggcgtcgaccgacaacgcctatgtccgcggggatgttacctcgcttgccccaaaggtcgcaggctacgtcacggctgtcgaagtcgaggacaaccaagcggtacgggcgggcgacgtgctcttccggatcgacgatcgggactaccgcgcaaagcttgcgcaagcggtggccaatgtcgaagcggcagaggcacggctgaccaacgtcgatgcggagatggcgcttcagcatgccctgatccgccaggccgaagcgcagcgacgttcggtcgtggccgagttgaacctggcggccaaggcctatgaccgccgccgcgagcttatccgcagcgagaccatcagccaggcccatgtcgacgagagcgacgcggcgaaatcgagggccgaggcgaacgtgttggcggcttcggcaacggtggaggcgcagcagcagcgcatcgccgtgcttgccgcacagcgcgaagctgccgttgctgcggtggcgcaggcggaggccgcgcgcgacctcgccgggatcgatctcgagagcaccgtggtgcgcgcccccgtcggcggcgtcatcggcaaccggcaggtccgcgtcggccggctggtcgcgccgggcgcttccctgctcgatatcgttccgctcgacaatgtatggatcgtcgcgaatttcaaggaaacccagctcgaacatatccggcccggtcagcgcgccagcatcaccatcgatggttacaagagcggagcgcttgaaggcgtggtcgacagttttgcaccaggcagcggctctgccttcagcctgctgccagcggacaacgccacgggcaacttcgtccgcgtcgtccagcgcgttccggtgaagatccggtttgccggcaatccgctgtcgggccgcctcctgccgggcctgtcagcgcgcgtcgagatcgatctggagggcggttcatga

SEQ ID NO: 81744 - protein, 365 aa, Sinorhizobium meliloti 1021
MESLEEKVAIITGARSGNGVAVARPNRKKMIGLALCLGAVVVVVAGWTWARESGAASTDNAYVRGDVTSLAPKVAGYVTAVEVEDNQAVRAGDVLFRIDDRDYRAKLAQAVANVEAAEARLTNVDAEMALQHALIRQAEAQRRSVVAELNLAAKAYDRRRELIRSETISQAHVDESDAAKSRAEANVLAASATVEAQQQRIAVLAAQREAAVAAVAQAEAARDLAGIDLESTVVRAPVGGVIGNRQVRVGRLVAPGASLLDIVPLDNVWIVANFKETQLEHIRPGQRASITIDGYKSGALEGVVDSFAPGSGSAFSLLPADNATGNFVRVVQRVPVKIRFAGNPLSGRLLPGLSARVEIDLEGGS

SEQ ID NO: 81745 - DNA, 933 bp, Salmonella typhimurium LT2
  CDS (1)..(933): transl_table=11
gtgaaaacactaacaagaaaactctcccgtacggccattaccctcgtactggttattctggcctttatcgccattttccgcgcctgggtgtattacaccgaatctccctggacgcgcgacgcgcgttttagcgccgatgtcgtcgctattgccccggatgtcgcgggcctgattacccatgtaaacgtgcatgataaccaactggtgaaaaaggatcaggtcctgtttaccatcgatcagccacgctatcaaaaagcgctggcggaagcggaagctgatgtagcctattatcaggtactggcgcaggaaaaacgccaggaagccggtcgccgtaatcgcctcggcgtacaggcgatgtcccgggaagagatcgatcaggcgaacaacgtcttgcagacggtactgcatcaactggctaaagcccaggcgacgcgcgacctggctaaactcgatctggagcgcaccgttattcgcgcgcctgctgacggctgggtgactaacctcaatgtttatgccggtgaatttattacccgcggttccacggccgtcgccctggtgaaaaagaactctttttacgtgcaggcctatatggaagagaccaagctggaaggcgtgcgtccgggatatcgtgccgaaatcacgccgcttggcagcaaccgggtattaaaaggtaccgtcgatagcgtggcggcaggggtaacgaatgccagcagtaccagcgatgcgaaagggatggcgacgatagactctaacctcgaatgggtgcgtctggcccagcgtgttccggtgcgcatccggctcgacgagcagcaggggaatttgtggcctgccggtacgacggcaaccgtcgtgatcaccggtaagcaggatcgtgacgcaagccaggactccttcttccgtaaactggcgcaccggctgcgcgaattcggttaa

SEQ ID NO: 81746 - protein, 310 aa, Salmonella typhimurium LT2
MKTLTRKLSRTAITLVLVILAFIAIFRAWVYYTESPWTRDARFSADVVAIAPDVAGLITHVNVHDNQLVKKDQVLFTIDQPRYQKALAEAEADVAYYQVLAQEKRQEAGRRNRLGVQAMSREEIDQANNVLQTVLHQLAKAQATRDLAKLDLERTVIRAPADGWVTNLNVYAGEFITRGSTAVALVKKNSFYVQAYMEETKLEGVRPGYRAEITPLGSNRVLKGTVDSVAAGVTNASSTSDAKGMATIDSNLEWVRLAQRVPVRIRLDEQQGNLWPAGTTATVVITGKQDRDASQDSFFRKLAHRLREFG

SEQ ID NO: 81747 - DNA, 1158 bp, Ralstonia solanacearum GMI1000
  CDS (1)..(1158): transl_table=11
atgtccgacaacaaccaaacggccgacgccactgcggctgcgccttccaagcaacgccgcgcccggctctttctgatcctggctgctgtggtggccgcaggcgccatcggcggcacggcctactggcagctctatgcctcgcgcttcgtctccaccgacaacgcctatgccgccgtcgaaatcgcccaggtgacgcccgccatcgatggcacgatcgccgaagtgcgtgtcagcgacacccaggcggtcaagaagggcgacgtgctggtggtgatcgacccgaccgacgccaagctggcgctggaacaggccgaggcccaactgggcagcgccgtgcgccgggtgcgcggctacgtcgccaacgacagcagcctgggtgcgcagatcatcgccagagaggcggacgagaagcgcgccgcggccgacctgttctcggcgcaagccgacttcgagcgggccaagatcgacctgcgccgccgtgaggcgctggtagcctccggctcggtctcgggcgaggaactgaccaaagcccgcaacgcccacgccacggcggatgcggcgcgggccgcgcccgcatccgcccaggcgcgggcaaatcgcaatgccgccgtgggttcgcggcaggccaacgcggtgctgatcgccaacgccacggaagacaccaaccccgaagtcgccctggcccgcgccaagcgggatcaggccgcggtcgatctgggccgcaccgtcattcgcgcgccggtggacggcgtggtcgccaagcgccaggtgcagctcggccagcgggtgaagtccggcacggcgctgctgtccatcgtgccggtgcaggacatgcacgtggatgccaacttcaaggaagtgcagttggagaacgtgcgaatcggccagcccgccaccgtcaaggctgacatctacggcggctcggccagctaccgcggcgtggtggaaggcttctccggtggttccggcgcggcgttcgcggccattcccgcccagaacgccacgggcaactggatcaaggtggtgcagcgcttgcccgtgcgcatcaagctcgatgcggcggagctggaaaagcacccgctgaaagtggggctgtcgatggtggtcacgatcgacaccagcgcctccggtagccaggccacccaggcccgtcggtaa

SEQ ID NO: 81748 - protein, 385 aa, Ralstonia solanacearum GMI1000
MSDNNQTADATAAAPSKQRRARLFLILAAVVAAGAIGGTAYWQLYASRFVSTDNAYAAVEIAQVTPAIDGTIAEVRVSDTQAVKKGDVLVVIDPTDAKLALEQAEAQLGSAVRRVRGYVANDSSLGAQIIAREADEKRAAADLFSAQADFERAKIDLRRREALVASGSVSGEELTKARNAHATADAARAAPASAQARANRNAAVGSRQANAVLIANATEDTNPEVALARAKRDQAAVDLGRTVIRAPVDGVVAKRQVQLGQRVKSGTALLSIVPVQDMHVDANFKEVQLENVRIGQPATVKADIYGGSASYRGVVEGFSGGSGAAFAAIPAQNATGNWIKVVQRLPVRIKLDAAELEKHPLKVGLSMVVTIDTSASGSQATQARR

SEQ ID NO: 81749 - DNA, 1092 bp, Ralstonia solanacearum GMI1000
  CDS (1)..(1092): transl_table=11
atgactacacactctcgctttcgtgcatttgccggcctcactgttgctgccacgctggccggcgccttcctcgtcctgaatcgcccggagtccgaggcttccgagcagagcaccgacgatgcctatgtgcaggccgactccacggtgatcgtctcgcaggtggccggcaccatcacccgggtggaggtcgccgaccaccaggaagtgcaggccggcgccccactggccagcatcgatgagcgcgacctgcgcatcgccgccgacaatgcgaaggcccacatcgccagcgcccaggccaccatcgacggcctgcaagcccagatcgcccggcagcagagcgcgatcgaacaggcgcgcgccgcagtcgccgccaccggcgccaatctgaagctcgccgaggccaaccgcaaccgcttcgccaatctggcccgcgacggctcgggcacggtccaggcccagcagcaggccgacgcgcaatgggatatccagcgcgccgcgcgcgagcgggacctggccggtctgcactcggccgagcagcagaccgcgatcctgcgcgcggaccttgaaaaggcgcgggcgagcctgctgtcggcgcaagcggaaaaggcgaccgcggagctgaacctgtcctacgcccgcgtgatcgcgcccgtcagcggcgtggtcgcccaacgcagcgcccgcgtcggcggctatgcccgcgtgggccagccgttgctgacgctggtcccgctggacgcggtctacgtggaggccaacttccgcgaaacgcagctcgcccacgtgcgggtcgggcagccggcgaccatcaccgtggatgcgctgccgaacgtccggctcaagggtcgggtagaaagcctcgggccggccagcggggtcagcttctccacgaccccgccccataacgccaccggcaacttcaccaagatcgtccagcgcctgccggtgcgcatccgcatcgagccggggcaggaagacgcccgcctgctgcgcgtcggcatgtcggtgcgcccgtccatcgatgtgcgggcccaggagacccaggcgaagcatccggggaaaagcccggcgaaggcgatcgcgtcgtcgtga

SEQ ID NO: 81750 - protein, 363 aa, Ralstonia solanacearum GMI1000
MTTHSRFRAFAGLTVAATLAGAFLVLNRPESEASEQSTDDAYVQADSTVIVSQVAGTITRVEVADHQEVQAGAPLASIDERDLRIAADNAKAHIASAQATIDGLQAQIARQQSAIEQARAAVAATGANLKLAEANRNRFANLARDGSGTVQAQQQADAQWDIQRAARERDLAGLHSAEQQTAILRADLEKARASLLSAQAEKATAELNLSYARVIAPVSGVVAQRSARVGGYARVGQPLLTLVPLDAVYVEANFRETQLAHVRVGQPATITVDALPNVRLKGRVESLGPASGVSFSTTPPHNATGNFTKIVQRLPVRIRIEPGQEDARLLRVGMSVRPSIDVRAQETQAKHPGKSPAKAIASS

SEQ ID NO: 81751 - DNA, 1068 bp, Agrobacterium tumefaciens str. C58
  CDS (1)..(1068): transl_table=11
atgctgaagaagttttttacccccgtttccatcctcgtgctgctcggcggcatcgccggcgttgcgctggtgctttacgcctggcggctgccgcctttcctgtccaccgtcgaaatgaccgacaacgccttcgtgcgcggttatgtgacgaccatgagcccgcaggtcagcggttatgtcgtcaatgtcccggtgaaggactatcaggaagtcaagcaggggacgctgctggccaagatcgatgaccgcatctaccaccagaaacaggcgcaggcggaagccacgctcgatacccacaaggcagcactcgacaattcccgccagcaggaaaatgccgccaatgccaatatccgctccagcgaggcggctgtcgacagtgccgaagcctcactgaagcaggcgcagctcgcctccgaccggcaggataatctgatcaagagcggcgtcggaacttccagccttcaggaagaagcccatgcggcgcttgaaaaggcgcgcgcatcactgtcccaggcgaaagcggcgctcgaggtttcccgtcaggatttgcagaccatcatcgtcaaccgcagctcgttacaggcggccgtcgccaatgccgaggccgccgttgaactcgcccgcatcgatcttgccaataccgagattcgcgcgccggtggatggcaggctcggcgaagtcggcgtgcgcaccggccaatatgtcaccgctggcacgcaactgatggccgtcgttccgcatgatgtctgggttatcgccaatttcaaggagacccagctcgccggtatgcaggtgggccagccggtgacgatttcggtcgatgcgctgcatcgccgcaagctgaccggccatgtggagcgcttttcgcccgccaccggctcggaattcgccgtcatcaagcccgacaatgcgaccggcaatttcgtgaagatcgcccagcgtctcggcgtgcggatcgtgatcgatgcggatcagccgctcgcggcggagctttcgcctggtatgtcggtggtggtgcatctggacaagagcaaggcgcctgatggggcggagacggcggcgaagtag

SEQ ID NO: 81752 - protein, 355 aa, Agrobacterium tumefaciens str. C58
MLKKFFTPVSILVLLGGIAGVALVLYAWRLPPFLSTVEMTDNAFVRGYVTTMSPQVSGYVVNVPVKDYQEVKQGTLLAKIDDRIYHQKQAQAEATLDTHKAALDNSRQQENAANANIRSSEAAVDSAEASLKQAQLASDRQDNLIKSGVGTSSLQEEAHAALEKARASLSQAKAALEVSRQDLQTIIVNRSSLQAAVANAEAAVELARIDLANTEIRAPVDGRLGEVGVRTGQYVTAGTQLMAVVPHDVWVIANFKETQLAGMQVGQPVTISVDALHRRKLTGHVERFSPATGSEFAVIKPDNATGNFVKIAQRLGVRIVIDADQPLAAELSPGMSVVVHLDKSKAPDGAETAAK

SEQ ID NO: 81753 - DNA, 1191 bp, Agrobacterium tumefaciens str. C58
  CDS (1)..(1191): transl_table=11
atgacgctgaacacaaagcgccgggccctgacgggtgccggcatcgggcttgccatgtccgttgcagcaggagcactgtttttcgacctccccaccagccgcaatgcgacggccgcgtccacgcccgccgaaacgccggcaatcccggtcaccgtcgccaaggtggagagccgcgacgtgatgcgctgggaagaattttccggccgtctggaggccgttgaccgcgtgcagatccgctcccgcgtcgccggccagatcaaggccgtacatttccgcgaaggcgcgctggtgaaggaaggtgacccgctcttcaccatcgacccggccccctatcaggccgcagtcgcgggcgctgaaggacaggtcgcttccgccgaagccaaggtcagccttgcaaagacggaactcgaccgtggccgcaggctttccgataaccgtaccatctcccagagtgatctcgaccagcgtcaaagctcgtttgcggatgccgaagcccagcttcgcgccgcccgcgcagcattgaccaccgcccagcttgatctcggttacaccgaaatcatcgcgccggtttccggcagggtcggcaggatcgaaatcaccgccggcaatctcgtcgctgcgggctccacctcgccggcactgaccacgctcgtctcggtcaacccgatctatgcaagcttcaacgccagcgaaggcgtcgtggccaaggctcttgccgagctgccgaagaccgatggcgccctgcccgctctggaacagatcccggtggaaatcggcacgctttcggatgaaggcacgccgatcaagggcacgctgcacctgatcgacaaccaggtggattcggcaagcggcaccatcggtgtgcgcgccatcttcgacaatccggatggcaggctgatccccggccagttcgtgcgggtacgcatgggcgaaccgaagccggaaaaccgcatcgtcatcagcgaccgcgccatcggcacggatcaggacaagcgcttcgtcttcgtggtcgatgccgaaaacaaggtaagctaccgccagatcaagcccggcgcaccggctgatggccagcgcatcatcgacagcggccttgccgccggtgatacgatcgtcgtcaacggcctgcagcgcatccgtcccggtgcgaccatcgcgccccaggcggaagacaaggttgctgcttcgcagtaa

SEQ ID NO: 81754 - protein, 396 aa, Agrobacterium tumefaciens str. C58
MTLNTKRRALTGAGIGLAMSVAAGALFFDLPTSRNATAASTPAETPAIPVTVAKVESRDVMRWEEFSGRLEAVDRVQIRSRVAGQIKAVHFREGALVKEGDPLFTIDPAPYQAAVAGAEGQVASAEAKVSLAKTELDRGRRLSDNRTISQSDLDQRQSSFADAEAQLRAARAALTTAQLDLGYTEIIAPVSGRVGRIEITAGNLVAAGSTSPALTTLVSVNPIYASFNASEGVVAKALAELPKTDGALPALEQIPVEIGTLSDEGTPIKGTLHLIDNQVDSASGTIGVRAIFDNPDGRLIPGQFVRVRMGEPKPENRIVISDRAIGTDQDKRFVFVVDAENKVSYRQIKPGAPADGQRIIDSGLAAGDTIVVNGLQRIRPGATIAPQAEDKVAASQ

SEQ ID NO: 81755 - DNA, 876 bp, Agrobacterium tumefaciens str. C58
  CDS (1)..(876): transl_table=11
atgaaaaacctcgtgtttatctcgggtcgagttcttttgaccttatccatgtcaagctgcgcagcagttatgggctggcatttatggtctttccatataggcacaccctggacacgtgatgctcatgtgcgcgcagacatcgtccgacttgcacctgatatatccgggcctgtcactgaagttctcgtttcagacaacgcgctagtggagaaagacgcgcccctgtttcgtatcgaaaaagaccgtttcgaacttgctcttcgcgaggcagaagcgcaggtaacaggggccaaggccgggacggatgcggccaaagttgattttgaacgatatcaacgcctcgcatcgaaagaggctgccagcgtgagagaacggcagcacgcggaaacccagatgtatcaggcagaagcagcatatcagtctgcgctggttgcccgcgatcttgctaaactgaaccttgaacgcacaactgtgcgagcaccggcatctggagcgatcacgaacttctccctacgcaaggggaactatgtcttggccgggaatgccgttggcgtactggtggaaaaagaatccgtctacgtcgcggggtattttgaagagacaaaactcccacggattcatatcggtgatcgggtgaagattgacatcatgggtgagccggaatcggccatcggacatgttgccggtgtcgccgccgggatcgaggatcgggagagaagcgatactgctggctcactggcaagcgtggcaccgacgttctcatgggtacgcctggcccagagaattccggttcggatcgaaatcgatcacgtcccgaacaatgttcgactgattgcgggcaggacggcaacgatcgcaatcgagcaaagtaaatga

SEQ ID NO: 81756 - protein, 291 aa, Agrobacterium tumefaciens str. C58
MKNLVFISGRVLLTLSMSSCAAVMGWHLWSFHIGTPWTRDAHVRADIVRLAPDISGPVTEVLVSDNALVEKDAPLFRIEKDRFELALREAEAQVTGAKAGTDAAKVDFERYQRLASKEAASVRERQHAETQMYQAEAAYQSALVARDLAKLNLERTTVRAPASGAITNFSLRKGNYVLAGNAVGVLVEKESVYVAGYFEETKLPRIHIGDRVKIDIMGEPESAIGHVAGVAAGIEDRERSDTAGSLASVAPTFSWVRLAQRIPVRIEIDHVPNNVRLIAGRTATIAIEQSK

SEQ ID NO: 81757 - DNA, 1194 bp, Xanthomonas campestris pv. campestris str. ATCC 33913
  CDS (1)..(1194): transl_table=11
atgagccagacgactcctacctcttcgcatcccgcgccggccgcaccgagcaagcgccgtacactgctgcgcatcgtcgccatcctggtgatccttgcggtcatcggcctggtggtgtggtacttcctgatcgggcgctgggctgaagacaccgacgacgcctacgtgcagggcaaccaggtgcagatcaccccgatggtgggtggcaccgtggtgagcatcggcgccgaagacggcatgcgtgtggagcgcggccagctgctggtgcagctggacccgtccgacaccgcggtcgccttgcagcaggccgaagccaacctcgccaagaccgtgcgccaggtgcgtggtctgtaccgcagcgtggaaggtgcgcaggccgagctctccgcacgcgaagtgacattgcgcagcgcacgtgccgacttcgcacgccgcaaggaccttgctgcaagcggcgcgatttccaacgaagaactggcccatgcgcgcgatgaactcgctgccgccgaagcggcggtgagcggctcgcgcgaaagcttcgagcgcaatcgcgcgttgatcgacgataccgaagtggccacccagcccgacgtgcaggccgccgcggcgcagttgcgccaggccttcctcaaccatgcgcgtaccggcgtggtagcaccggtgtccggatatgtcgcgcggcgttcggcgcaggtaggccagcgggtgcagcctggcaccgtgctgatggcggtggtgccgccggagcagatgtgggtggaagccaatttcaaggaaacccagctcaagcacatgcgtctgggccagaccgtggaactgcattcggatctgtacggcggtggcgtggattacaccggccggatcgaaagcctgggcctgggcaccggcagcgcgttctcgttgttgccggcgcagaacgccagcggcaactggatcaagatcgtgcagcgcgtgccggtgcgtatcgccatcgaacccaagcaactggcggccaacccgctgcgtctggggttgtcgatgaaggccgacgtcaacctgcgcgaccagcagggcagcgtgctgccgaccaagtttgccagcggcgcggtgttctccaccgatgtctacgcgcagcagctcaaggccgccgacgccgacatccatcgcatcatccaggacaacctgccgacgcaggctgccaccaaggcgggctaa

SEQ ID NO: 81758 - protein, 397 aa, Xanthomonas campestris pv. campestris str. ATCC 33913
MSQTTPTSSHPAPAAPSKRRTLLRIVAILVILAVIGLVVWYFLIGRWAEDTDDAYVQGNQVQITPMVGGTVVSIGAEDGMRVERGQLLVQLDPSDTAVALQQAEANLAKTVRQVRGLYRSVEGAQAELSAREVTLRSARADFARRKDLAASGAISNEELAHARDELAAAEAAVSGSRESFERNRALIDDTEVATQPDVQAAAAQLRQAFLNHARTGVVAPVSGYVARRSAQVGQRVQPGTVLMAVVPPEQMWVEANFKETQLKHMRLGQTVELHSDLYGGGVDYTGRIESLGLGTGSAFSLLPAQNASGNWIKIVQRVPVRIAIEPKQLAANPLRLGLSMKADVNLRDQQGSVLPTKFASGAVFSTDVYAQQLKAADADIHRIIQDNLPTQAATKAG

SEQ ID NO: 81759 - DNA, 1200 bp, Xanthomonas campestris pv. campestris str. ATCC 33913
  CDS (1)..(1200): transl_table=11
ttgagcaaccacgatcagcagtccaccgatggccagtccacagcagcggacgggcagggcaatgcgtcccgcgacgacgacgccaagaagccctcgccgctgaagaatcccaaggtgaagtggacgctgatcatcgtcggcgtgctggtggtggtgctgctggtgatctggctggcctactacctgatcaagggccgctacatgcaggacaccaacaacgcctacctgcaggcggactcggtggcggtggctccgcgcgtcagcggctatgtcactcaggtgatggtgggcgacaaccagattgtcgacgccggccagcccctgctgcagatcgacgaccgcacctaccaggccacgctgcaacaggccgaagccgcaatcgccgcgcgcgaagccgacatcgccgccgccaccgccaatgtggccgcgcaggaatcgtcgctggtgcaggcgcgcacccaggtggcctcggccgcggcaagcctgcgctttgcccaggccgaggtgaagcgcttcgcgccgctggccgcctccggcgccgacacccacgaacaccaggaaagcctgcagcacgatctggagcgcgcccgcgcccagtacgaggccgcacaggcgcaggccaagggggcgcagagccagatccaggccagcagcgcccagctggagcaggccaaggccggggtgaagcaggccaccgccgatgccgaccaggcgcgcgtggcggtggaagacacccgcctgaccagccgtatccacggccgggtgggcgacaagaccgtgcaggtggggcagttcctggccgccggcacccgcaccatgaccatcgtgccgcagcagtcgctgtacctggtggccaacttcaaggaaacccaggtcggcctgatgcgccccggccagccagccgagatcgaggtcgacgcgctgtcgggcgtgaagctgcacggcaaggtggaaagcctgtcgcccggcaccggctcgcagttcgcgctgttgccgccggagaacgccaccggcaacttcaccaaggtggtgcagcgcgtgccggtgcgcatccgcgtgctggccggtgaggaagcgcgcaaggtgctggtgcctggcatgtcggtggaggtcaccgtggatacccgctcggccaaggacgccaagcagcgcgccgaggaggaatcggaccgcgtgcaggcgcaggagcgcgcgcgatga

SEQ ID NO: 81760 - protein, 399 aa, Xanthomonas campestris pv. campestris str. ATCC 33913
MSNHDQQSTDGQSTAADGQGNASRDDDAKKPSPLKNPKVKWTLIIVGVLVVVLLVIWLAYYLIKGRYMQDTNNAYLQADSVAVAPRVSGYVTQVMVGDNQIVDAGQPLLQIDDRTYQATLQQAEAAIAAREADIAAATANVAAQESSLVQARTQVASAAASLRFAQAEVKRFAPLAASGADTHEHQESLQHDLERARAQYEAAQAQAKGAQSQIQASSAQLEQAKAGVKQATADADQARVAVEDTRLTSRIHGRVGDKTVQVGQFLAAGTRTMTIVPQQSLYLVANFKETQVGLMRPGQPAEIEVDALSGVKLHGKVESLSPGTGSQFALLPPENATGNFTKVVQRVPVRIRVLAGEEARKVLVPGMSVEVTVDTRSAKDAKQRAEEESDRVQAQERAR

SEQ ID NO: 81761 - DNA, 1173 bp, Xanthomonas campestris pv. campestris str. ATCC 33913
  CDS (1)..(1173): transl_table=11
gtggattctctccgtgctggtgtggcgccgttatctgcgcccgccggttgccccctctccttctgttccgactgcgcgcccatgaatacacctgccgacaccgctccaaccgccgcacagagacggcgtcgccgtcgccgccgtctgtatggcgtgctcgggttcggtgggcttgcgctgatcggcgtggcgttggtgctgtatgcgtggcggctgccgccgttcaccagcgcggtggagcgcaccgaaaacgcgatggtgcatggccaggtcacggtgatcgcgccacaggtcagtggctatgtcacgcaggtgccggtgcaggattttgcgcatgtgcgccgcggccagctgttggcaaagatcgacgaccgcatctatgcgcagcatttggaacaggccaaggcgcaactgcagaccacgcaggccaacctggccaactgggaacagcagcgccacagcgccgaggccaccatcgccgagcaacgcgccaccctgagcagcaaccaggcccagcgcgatcgcacgcgctcggcgtatgcacgcgcgcagcaactggccaaccagaaactggtgtccgagcaggaccgcgacaccgcatttgccgcgcgcgcacaggccgacgccggcgtggctcaggcgcgcgccgcagtgcaggccgccgaagagaacgcgcgcagtgtcaccgtcaatcgtgcagcgctggaagcggcggtagccaatgcgcaggcagccgtgcagctggcacaaatcaacctggacaacacgcgcatcctcgcgccgcgcgacggccagctgggtcagctcggcgtgcgccagggcgcctatgtcaccaacggcacgcagttgatggccttggtgccggacaccttgtgggtggtggccaacttcaaggaaacccaaatggccaatgtgcgtgtgggccagcgcgccagcttcaccgtggatgcgctggccaatgcgcgcctgcagggccgcgtgcaggagatctcgccagcggccggctccgagttcagcgtgttacgcgcggacaacgccaccggcaacttcgtcaagattgcccagcgcattccgctgcgcatcagtgtcgatcccggccagccgcaggccgcgcggctgcgtccgggcatgtcggtggtggtggccatcgacaccgcccagcgcgccgagtaa

SEQ ID NO: 81762 - protein, 390 aa, Xanthomonas campestris pv. campestris str. ATCC 33913
MDSLRAGVAPLSAPAGCPLSFCSDCAPMNTPADTAPTAAQRRRRRRRRLYGVLGFGGLALIGVALVLYAWRLPPFTSAVERTENAMVHGQVTVIAPQVSGYVTQVPVQDFAHVRRGQLLAKIDDRIYAQHLEQAKAQLQTTQANLANWEQQRHSAEATIAEQRATLSSNQAQRDRTRSAYARAQQLANQKLVSEQDRDTAFAARAQADAGVAQARAAVQAAEENARSVTVNRAALEAAVANAQAAVQLAQINLDNTRILAPRDGQLGQLGVRQGAYVTNGTQLMALVPDTLWVVANFKETQMANVRVGQRASFTVDALANARLQGRVQEISPAAGSEFSVLRADNATGNFVKIAQRIPLRISVDPGQPQAARLRPGMSVVVAIDTAQRAE

SEQ ID NO: 81763 - DNA, 936 bp, Xanthomonas campestris pv. campestris str. ATCC 33913
  CDS (1)..(936): transl_table=11
ttggatgcaatcgtgaagaagctgatcaagacggccgggccggcgctgctgaccttggcaatggtggtggtggccgcagtggtgctgcagcacctgtggcggtactacatggatgcaccgtggacgcgcgatgcgcacgtgggcgccgatgtggttcaggtggcgccggatgtgtccgggctggtggagcaggtggcggtggccgacaaccaggcggtcacgcgcgggcagctgctgttcgtggtggaccgcgcgcgttatgcgattgcgctggaacaggcccgcgccgcactggccgaacgccaggccaccctgacccagctgcgccgcgagatcgcacgcgaccgcagcctgcaggacctggtggccgccgaagatgccgaagtgcgccgctccaacgtgcagaaggcgcaggccgctgtggccaccgcgcaatcggcagtggacctggcccagctcaacctggaccgtaccgaagtgcgcagcccggccgatggccatatcagcgaccgcaccgtgcgcgtgggcgactatgtcagcgcagggcgcccggtggtggcagtgctggacaccggctcgttccgcgtcgatggctatttcgaggaaacccgcctgcagggcgtgcacccgggccagcgcgtggacgtgcacctgatgggcgagccggtgacgctgcacggccacgtgcagagcatcgccgccggcatcgaagaccgctaccgcaccggcagcgccggcgccctgcccaacgtcactcccgccttcgactgggtgcggctggcgcagcgcatcccggtgcgcattgcgctggatgcggtaccggcgcaggtgcagttgatcgccgggcgcaccgccaccgtcaccatcctgccggatgccgcgcgccccgcagcggccactgcgcctgcccgcgtgcaggcgaaggccgcgccatga

SEQ ID NO: 81764 - protein, 311 aa, Xanthomonas campestris pv. campestris str. ATCC 33913
MDAIVKKLIKTAGPALLTLAMVVVAAVVLQHLWRYYMDAPWTRDAHVGADVVQVAPDVSGLVEQVAVADNQAVTRGQLLFVVDRARYAIALEQARAALAERQATLTQLRREIARDRSLQDLVAAEDAEVRRSNVQKAQAAVATAQSAVDLAQLNLDRTEVRSPADGHISDRTVRVGDYVSAGRPVVAVLDTGSFRVDGYFEETRLQGVHPGQRVDVHLMGEPVTLHGHVQSIAAGIEDRYRTGSAGALPNVTPAFDWVRLAQRIPVRIALDAVPAQVQLIAGRTATVTILPDAARPAAATAPARVQAKAAP

SEQ ID NO: 81765 - DNA, 1227 bp, Xanthomonas axonopodis pv. citri str. 306
  CDS (1)..(1227): transl_table=11
atgctgcccgtcgccgcccatcgttttcgcactgcgtccctgcgctggctgttgcccgccgccgtgaccacgctcatggccgcgtgttcctccaggcagccgccgcagatgccgcagacgcaggtcggtgtgcagacgctgaaggtgcagcggctggccgtggaccagaccttgtccggccgcaccgtggcctatgtcacctcggacgtgcgcccgcaggtcggcggcattgtgcgcaagcgcctgttcaccgaaggccaggacgtccaggccgggcaagtgctgtatgaaatcgatccggccagctaccaggccgcgtacgacaccgccaagggcgatctggcgcaagccgaggcggcggtgttgtcggccaggcccaaggcgcagcgctaccagaccctggtcgggctggatgcggtcagcaagcaggacggcgacgatgcgttggccacgctgcgctcgaacgaggcggcggtggtcgcggccaaggcgtcgttgcagaccgcgcgcatcaatctcgactacacccgcatcaccgcgccggtgtccggccgcatcggcacctccagctacacgtcgggcgcgctggtcagtgccggccagagcgaggtgctggccaccatcaaccaactcgacccgatctatgtggacgtgacccagtccagcgcacagctgctgcagttgcgccgccagctcgacgccggccagctcaaggcggtggacggcaaggccgaggtgacgctgcaactggaggacggcagcacctatgcacacagcggcacgttggaggtggtggatgccgcggtcgataccgccaccggcaccgtcaagctgcgcgcggtggtgcccaatcccgagcgcctgttgctgccgggcatgtatgtcaccgcgaaactgtcgatggccgtggacgagcaggccatcctggtgccgcagcaggcgatcagccgcaacagcaagggccaggcggtggcgctggtggtcggcagcgacaacaaggtcgcgcagcgggtgctgaccaccggcgatgcgatcggcgacaagtgggtggtgcgccagggattgaaggctggcgacaaggtcatcgtgcagggcttgcagaaggcgtcggtcggtgccgaggtcaaggccgtggaagtgaccgcggccgcgatggccggcaatgccgccgccaccgccccggcggccacgcagggcaccgccgcggcggcgcccaaggccgactga

SEQ ID NO: 81766 - protein, 408 aa, Xanthomonas axonopodis pv. citri str. 306
MLPVAAHRFRTASLRWLLPAAVTTLMAACSSRQPPQMPQTQVGVQTLKVQRLAVDQTLSGRTVAYVTSDVRPQVGGIVRKRLFTEGQDVQAGQVLYEIDPASYQAAYDTAKGDLAQAEAAVLSARPKAQRYQTLVGLDAVSKQDGDDALATLRSNEAAVVAAKASLQTARINLDYTRITAPVSGRIGTSSYTSGALVSAGQSEVLATINQLDPIYVDVTQSSAQLLQLRRQLDAGQLKAVDGKAEVTLQLEDGSTYAHSGTLEVVDAAVDTATGTVKLRAVVPNPERLLLPGMYVTAKLSMAVDEQAILVPQQAISRNSKGQAVALVVGSDNKVAQRVLTTGDAIGDKWVVRQGLKAGDKVIVQGLQKASVGAEVKAVEVTAAAMAGNAAATAPAATQGTAAAAPKAD

SEQ ID NO: 81767 - DNA, 1203 bp, Xanthomonas axonopodis pv. citri str. 306
  CDS (1)..(1203): transl_table=11
ttgagcaaccacgaccatcagtccaatgacggccagtcctcggccacggatgcgcagggcgcaggcgcgcgcggcgagcaggagccgcccaaaccctcgccgttgaagaaccccaaggtgaagtggacgctgatcctggtcggggtgctggtgctgatcctgctggtggtgtgggtggcctattacctgatcaagggccgctacatgcaggacaccaacaacgcctatctgcaggccgattcggtggccgtggcaccgcgcgtcagcggctacgtgaccaaggtgctggtgagcgacaaccagatcgtggaggctggccagccgctgctgcagatcgacgaccgcacctaccaggccacgctgcagcaggccgaagccgccattgccgcacgccaggccgatatcgtcgcggccaccgccaatgtctccgcacaggaatcggcgctgctgcaggcgcgcacccaggtcaccgcagctgctgccagcctcaagttcgcccaggccgaagtgaagcgcttcgcgccgttggccgcctccggtgcagacacccacgaacatcaggaaagcctgcagcacgatctggcacgcgcacgcgcccagtacgacgccgcgcaggcgcaggccaaggccggcgagagccagatccaggccagccgcgcgcaactggaacaggcacaggccggcgtgaaacaggccaccgccgatgccgaccaggcgcgcgtggcggtggaagacacccgtctgaccagccgtatccacggccgggttggcgacaagaccgtgcaggtgggccagttcctcggcgccggcacccgcaccatgaccatcgtgccgcaggaatcgctgtatctggttgccaatttcaaggaaacccaggtcggcctgatgcgtcccggccagccggccgagatcgaggtcgatgcgctttcgggcgtaaaactgcacggcaaagtcgagagcctgtcgccgggcaccggctcgcagttcgcgttgctgccgccggaaaatgccaccggcaatttcaccaaggtggtccagcgcgtgccggtgcgcatccgtgtgctggccggtgacgaggcgcgcaaggtgctggtgccgggcatgtcggtggaagtcactgtcgacacgcgctcggccaaggacgccaagcagcgtgccgaacaagaatccgaccgcgtgcaggagcaggagcgcgcgcgatga

SEQ ID NO: 81768 - protein, 400 aa, Xanthomonas axonopodis pv. citri str. 306
MSNHDHQSNDGQSSATDAQGAGARGEQEPPKPSPLKNPKVKWTLILVGVLVLILLVVWVAYYLIKGRYMQDTNNAYLQADSVAVAPRVSGYVTKVLVSDNQIVEAGQPLLQIDDRTYQATLQQAEAAIAARQADIVAATANVSAQESALLQARTQVTAAAASLKFAQAEVKRFAPLAASGADTHEHQESLQHDLARARAQYDAAQAQAKAGESQIQASRAQLEQAQAGVKQATADADQARVAVEDTRLTSRIHGRVGDKTVQVGQFLGAGTRTMTIVPQESLYLVANFKETQVGLMRPGQPAEIEVDALSGVKLHGKVESLSPGTGSQFALLPPENATGNFTKVVQRVPVRIRVLAGDEARKVLVPGMSVEVTVDTRSAKDAKQRAEQESDRVQEQERAR

SEQ ID NO: 81769 - DNA, 945 bp, Xanthomonas axonopodis pv. citri str. 306
  CDS (1)..(945): transl_table=11
ttggatgcaatcgtgaaaaagctgatcaagaccgcggggccggcactgctgaccctgtcaatggtggtggtggccgcgttggtgttgcagcacctgtggcggtattacatgcaggcgccgtggacgcgcgatgcgcacgtgggcgccgatgtggtgcaggtggcgccggatgtctccgggctggtggagtcggtggccgtggccgacaaccagccggtgaggcgcgggcaattgctgttcgtggtggaccgcgcgcgctacgcgatcgcgctggaacaggcgcgcgccgcgctggccgaacgccgggccacgctgacgcagttgcgccgcgagatcgcgcgcgaccgcagcctgcaggacctggtcgccgccgaagatgccgaagtgcgccgctccaacgtacaaaaggcgcaggccgcagtggccaccgcgcaatcggcggtggatctggcccagctcaacctggaccgcacccaggtgcgcagcccggccgacggtcgcgtcagcgaccgcaccgtgcgggtgggcgactacgtcaacgccgggcgtccggtggtggcggtgctggacaccggctcgttccgtgtcgatggctacttcgaagaaacccgcctgcagggcgtgcaccccggccagcgcgtggacgtacagctgatgggcgagccggtcacgctgcaggggcatgtacagagcatcgccgccgggatcgaagaccgttaccgcagcggcagcgcaggcgcattgcccaatgtcacgccggcgttcgattgggtacggctggcgcaacgcatcccggtgcgcatcgtgctggatcgcgtacctgcgcatgtgcagttgatcgcagggcgcactgccacggtgagcattctgcccgacacggccaatacggctccggcaaccccggccgtcgcgcctgcccgtgtgcaggccaaggcggcgccatga

SEQ ID NO: 81770 - protein, 314 aa, Xanthomonas axonopodis pv. citri str. 306
MDAIVKKLIKTAGPALLTLSMVVVAALVLQHLWRYYMQAPWTRDAHVGADVVQVAPDVSGLVESVAVADNQPVRRGQLLFVVDRARYAIALEQARAALAERRATLTQLRREIARDRSLQDLVAAEDAEVRRSNVQKAQAAVATAQSAVDLAQLNLDRTQVRSPADGRVSDRTVRVGDYVNAGRPVVAVLDTGSFRVDGYFEETRLQGVHPGQRVDVQLMGEPVTLQGHVQSIAAGIEDRYRSGSAGALPNVTPAFDWVRLAQRIPVRIVLDRVPAHVQLIAGRTATVSILPDTANTAPATPAVAPARVQAKAAP

SEQ ID NO: 81771 - DNA, 993 bp, Chlorobium tepidum TLS
  CDS (1)..(993): transl_table=11
atggcagaaacgcagcaatccaacatcgaagcaccggacaacgaaaaaggcaagccaaaaccggaacgctcgatgggccgcctggtcatcttcggcattttgctggccatcggccttgtctggggcggcatgaagctcatccgctcgctcagttacgaagagaccgatgacgcgcagatcgccggcaacatctatccggtcattccgcgcgtgccgggcaaggtggtcgaagtgcttgccaacgacaaccagatggtgaaaaaaggcgacgtgctcatccggctcgatccttcggactaccagatcaagcgcgatatggccgaagcgcagctcctgaaagcgcgggcggcagtatcgggagcgaaggccgacatcatagcggcggcggcggcgcaaatcaagcttgccgccgaccttcgccgcagccagaacctccagaaacaggatgtgatctcccgagcggagctcgatgccgccacggctggcgcgaccgccgcgtctgcacagcacgccgccgccggagacaactacaaggccgcactcgcccaggcaaaacttgccgaggccgagctgaaaaacgccgaactccagctgtcatggacaaccattaccgctccggctgacggcaaggtttcgaaaaagaacgtccagcccggccagtatgttactcccggccaacagctcatcgccattgtcggcagcggcgacttgtgggtcgtggccaacttcaaggaaacgcaactcgaacacatgcgccccggccaaaaggtaatcatcaaagtcgatgccttcccaggcaaggagctgaaaggccatatcgattcaatctccgcaggaacaggcgccgagttcgccctgcttccccccgataacgccagcggcaacttcgtaaaagtgacccagcgtgtgccggtcaagatcgtcttcgacgaaaaaaccgacctgccgcttgccgctggaatgaatgtgatcgcagaagtgaaggtgaagtga

SEQ ID NO: 81772 - protein, 330 aa, Chlorobium tepidum TLS
MAETQQSNIEAPDNEKGKPKPERSMGRLVIFGILLAIGLVWGGMKLIRSLSYEETDDAQIAGNIYPVIPRVPGKVVEVLANDNQMVKKGDVLIRLDPSDYQIKRDMAEAQLLKARAAVSGAKADIIAAAAAQIKLAADLRRSQNLQKQDVISRAELDAATAGATAASAQHAAAGDNYKAALAQAKLAEAELKNAELQLSWTTITAPADGKVSKKNVQPGQYVTPGQQLIAIVGSGDLWVVANFKETQLEHMRPGQKVIIKVDAFPGKELKGHIDSISAGTGAEFALLPPDNASGNFVKVTQRVPVKIVFDEKTDLPLAAGMNVIAEVKVK

SEQ ID NO: 81773 - DNA, 936 bp, Yersinia pestis KIM
  CDS (1)..(936): transl_table=11
gtgagtacattttcattaaaaataatccgcgttggcatcaccgtcttggtggtcgtactggctgttatcgcgattttcaacgtgtgggccttctatactgaatcgccgtggacccgtgatgctaaatttaccgcagacgtggtcgctatcgcaccggatgtcagcggcttactgaccgaagtaccggtaaaagacaaccaactggtgcagaaaggccagattctgtttgtcattgatcagccccgttatcagcaggcgttggctgaagccgaggccgatgtggcctattaccagaccctggctgcggagaagcaacgggagtccagtaggcgtcaccgcctgggtattcaggcgctgtcacaagaagagattgaccaggcaagcaatgtgttgcaaaccgtccagcatcagttggcaaaagccattgccgtgcgggatttagcccgccttgatctggaaaggaccacggtacgtgcaccagcagaagggtgggtgaccaacctgaatgtacatgctggcgagtttattaaccgtggggccacggcggtcgcattggtgaaaaaagatactttctacattttagcctatctggaggagacgaagctcgaaggggttaaaccgggctaccgagcggaaattaccccgctgggcagtaaccgcatcctgcatggtacggtcgatagcatttcagccggtgttaccaatagcagtagcagtgccgacagcaaagggctggcgaccattgataataatcttgaatgggtacgcttggcgcaacgggtaccggtgaagattcatctggatagcgaagaccagcaatatttgtatccggcgggcaccacggccacggtggtgatcaccgggccgaatgatcgtgatcctcatcaggcatcgcccatgaccaagttgatgcatcgtctacgtgagtttggctaa

SEQ ID NO: 81774 - protein, 311 aa, Yersinia pestis KIM
MSTFSLKIIRVGITVLVVVLAVIAIFNVWAFYTESPWTRDAKFTADVVAIAPDVSGLLTEVPVKDNQLVQKGQILFVIDQPRYQQALAEAEADVAYYQTLAAEKQRESSRRHRLGIQALSQEEIDQASNVLQTVQHQLAKAIAVRDLARLDLERTTVRAPAEGWVTNLNVHAGEFINRGATAVALVKKDTFYILAYLEETKLEGVKPGYRAEITPLGSNRILHGTVDSISAGVTNSSSSADSKGLATIDNNLEWVRLAQRVPVKIHLDSEDQQYLYPAGTTATVVITGPNDRDPHQASPMTKLMHRLREFG

SEQ ID NO: 81775 - DNA, 1101 bp, Brucella suis 1330
  CDS (1)..(1101): transl_table=11
gtggccgaaaccaatacctcgccttctcccgctcaagaccagtctcccaaacatccaatgctacgtcggattctgcttatcgtagggccggtcgtcgcgattgccatcggcctgtggatctatttcagtggagggcaatatgtgagcgaggatgattcctatgtcggcgcggcggcagtggccataacaccgcaggtttccggtcaggttatacgtgtcgccgttggcccgaaccagcccgtcaaggaaggcgatcttctgtttgaaatagacccacagccgttccagatcgaacttgaccaggcaaaggccaatctggcgcaagcgagcgaaaaactcgcagggcttgtcctcacctacaagcaacaattggcaagtgtggctcaggcaaaggacgatgtcaccttcgcacaggagcaattcaaccgtgtttcggcactggttcacgacaagtttgaggcgcgcgcgcaattcgatcaggctgagcgggccttgcaggtggccaagcaggagcaaaatgccgccgcgtcggcagccgccgcaacactggcacagcttggcggcacactcgataaaccgttacaacaacatgcatcctatctggcggccaaagccgaagtggagcttgccgaacgcaatgtcaggctaacccgcgtgctcgccccattcgccggaacagtgacgcaagtggaaaacatccagctgggaagttttcttgccgtaggcgatccggctttcaccctgatcggcgccgatgcctgggtaaacagcaatatcaaggaaacggacctgacccatatcaaggttggcgatcctgccacggtcgtgctcgattcctatccggaccagcccctgcaaggcgaggtgcagagcataacgcccgcaagcggttctgtttttgccctgctgcccgcccagaatgcctccggcaactgggtcaaggtggtgcagcgcatgccggtgcggatcaagattacaaaaccccatcctgacgtggtgatgcgtgatggcggcagcgcaaccgttaccatcaatacaggctatcatcgcacatttgctaccttgtggcgcgatctgaccggcatggtggggatcgactga

SEQ ID NO: 81776 - protein, 366 aa, Brucella suis 1330
MAETNTSPSPAQDQSPKHPMLRRILLIVGPVVAIAIGLWIYFSGGQYVSEDDSYVGAAAVAITPQVSGQVIRVAVGPNQPVKEGDLLFEIDPQPFQIELDQAKANLAQASEKLAGLVLTYKQQLASVAQAKDDVTFAQEQFNRVSALVHDKFEARAQFDQAERALQVAKQEQNAAASAAAATLAQLGGTLDKPLQQHASYLAAKAEVELAERNVRLTRVLAPFAGTVTQVENIQLGSFLAVGDPAFTLIGADAWVNSNIKETDLTHIKVGDPATVVLDSYPDQPLQGEVQSITPASGSVFALLPAQNASGNWVKVVQRMPVRIKITKPHPDVVMRDGGSATVTINTGYHRTFATLWRDLTGMVGID

SEQ ID NO: 81777 - DNA, 867 bp, Brucella suis 1330
  CDS (1)..(867): transl_table=11
atgaaaaagctccttgcacattccggccgggtttttctcaccctcgtcatggttgttatggcggggctgctcggctggcatctctgggattattacatgaatgcgccgtggacccgtgacggcaaaatccgtgccgatgtggtgcgcattgcgcccgatgtctcgggccttgtgagcgaggttctggtgcatgacaaccagacggtccataaaggcgatgtgattttccgcatcgaccaggcgcgctacaagcttgctttgcagactgctgaggccaaggctgacagcagcaaggcagcactggacatggccaatcgtgatcttgtccgctatcgccagctcaacgatacgaccgtgacgcgccagaaactggaacaggtagaaaccgcagaccagcaggcagaggccgcccaccgccaggccgaactcgaccgcgatctggctgcgcttaatatggagcgttcgtctatcaaggctccggtcaatggcgttatcaccaatttctcgcttcagccgggcgattatgtttcggcgggttcggccgttacggcgctggtcgatacggattcctattatgtctccggttattttgaggaaaacaagctggagcgtatccatatcggtgatccggtggtggtcgatgtgatgggcagcaaggtgcagctcaagggtaaggtggaaggtattgcgggcggcatcgaggatcgcgagcgcagcgattcccaaagcctgctcgccaatgtctcgccgacgttcaactgggtgcgccttgcgcagcgcgtgccggtgcgtgtgaaactggaagatgtgccgcaaggcatccatctggtggcaggccgcacggtgagcgtttcggtggtggattga

SEQ ID NO: 81778 - protein, 288 aa, Brucella suis 1330
MKKLLAHSGRVFLTLVMVVMAGLLGWHLWDYYMNAPWTRDGKIRADVVRIAPDVSGLVSEVLVHDNQTVHKGDVIFRIDQARYKLALQTAEAKADSSKAALDMANRDLVRYRQLNDTTVTRQKLEQVETADQQAEAAHRQAELDRDLAALNMERSSIKAPVNGVITNFSLQPGDYVSAGSAVTALVDTDSYYVSGYFEENKLERIHIGDPVVVDVMGSKVQLKGKVEGIAGGIEDRERSDSQSLLANVSPTFNWVRLAQRVPVRVKLEDVPQGIHLVAGRTVSVSVVD

SEQ ID NO: 81779 - DNA, 867 bp, Shigella flexneri 2a str. 301
  CDS (1)..(867): transl_table=11
gtggtaactatgtcaattaaaacaattaagtatttctcaacaatcattgtagcgatagttgcggttcttgccggatggtggctgtggaattattacatgcaatctccgtggacacgcgacgggaaaatacgcgcagaacaggtttctatcaccccacaggtgtcgggacgtattgttgagctgaatataaaagacaaccaactggttaacgcgggggaacttctgctcacgatcgataaaacgccctttcagatcgccgagctgaacgcacaggctcagctggcgaaagcgcaatctgacctcgcaaaagccaataacgaagcgaatcgtcgtcgtcatctctcacaaaattttatttttgccgaagaactcgataccgctaacctcaatgttaaagcgatgcaggccagtgttaatgccgcacaggcgacgctgaaacagacacaatggcaactggcgcaaacggaaattcgcgccccggtgagtggatgggtgactaacctcactacccgcatcggcgattacgctgacaccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtttccagtatcggtcgggcgatttatgatcagagcgttgaaagtgactcaagccttattccggatgtgaaacctaacgtcccctgggttcgtctcgcccaactcgttcccgtccgctttgcgctggataaagttccaggcgatgtcacgctggtgtcgggcaccacctgtagcattgccgtaggtcaataa

SEQ ID NO: 81780 - protein, 288 aa, Shigella flexneri 2a str. 301
MVTMSIKTIKYFSTIIVAIVAVLAGWWLWNYYMQSPWTRDGKIRAEQVSITPQVSGRIVELNIKDNQLVNAGELLLTIDKTPFQIAELNAQAQLAKAQSDLAKANNEANRRRHLSQNFIFAEELDTANLNVKAMQASVNAAQATLKQTQWQLAQTEIRAPVSGWVTNLTTRIGDYADTGKPLFALVDSHSFYVIGYFEETKLRHIREGAPAQITLYSDNKTLQGHVSSIGRAIYDQSVESDSSLIPDVKPNVPWVRLAQLVPVRFALDKVPGDVTLVSGTTCSIAVGQ

SEQ ID NO: 81781 - DNA, 1164 bp, Shigella flexneri 2a str. 301
  CDS (1)..(1164): transl_table=11
gtggaacagattaattcaaataaaaaacagtctaacagaaaaaaatacttttctttattggtgatagttttatttattgcgttttcaggtgcctatgcctattggtcaatggaattagaagacatgattagtacagatgacgcctatgtcacggggaatgcagatccaatttctgcacaagtctcaggtagtgtcactgtagttaatcataaagatacgaactacgttcgacagggtgacattttagtttcactggataaaactgatgccactatcgcactcaataaagctaaaaataatctggcaaatattgttcggcaaacgaataaactgtacttacaggataaacaatacagtgccgaagtcgcttcagcacgtattcagtatcaacaatctttagaagattataaccgtcgtgtgcctttagcgaagcagggggttatttcaaaagaaacgctggagcataccaaagatacgttaataagtagcaaagcggcactgaatgccgctatccaggcttataaagcgaataaagctttagtaatgaacacaccattaaaccgtcagccacaagtagttgaagcggcggatgcaaccaaagaagcctggttggtgcttaaacgtacggatataaggagtccggttactggctatattgcccagcgaagtgttcaggtcggcgaaacagtgagttccggacaatcgttaatggctgtcgtaccggcacgtcaaatgtgggttaatgccaactttaaagaaacacaactcacggatgtacggattggtcaatcagtcaatattatcagcgatctttatggtgaaaatgttgtgtttcatggtcgggtgacagggatcaatatgggaaccggcaatgcgttctccttattacctgcacaaaatgcgacagggaactggatcaaaatcgttcagcgtgtaccggttgaagtttctcttgatccaaaagaactcatggaacaccccttgcgcattggtttatcgatgactgcaactattgatacgaaggacgaagacattgctgagatgcctgatctggcttcaaccgtgacctccatgcctgcttataccagtaaggctttagttatcgataccagtccgatagaaaaagaaattagcaacattatttcgcataatggacaactttaa

SEQ ID NO: 81782 - protein, 387 aa, Shigella flexneri 2a str. 301
MEQINSNKKQSNRKKYFSLLVIVLFIAFSGAYAYWSMELEDMISTDDAYVTGNADPISAQVSGSVTVVNHKDTNYVRQGDILVSLDKTDATIALNKAKNNLANIVRQTNKLYLQDKQYSAEVASARIQYQQSLEDYNRRVPLAKQGVISKETLEHTKDTLISSKAALNAAIQAYKANKALVMNTPLNRQPQVVEAADATKEAWLVLKRTDIRSPVTGYIAQRSVQVGETVSSGQSLMAVVPARQMWVNANFKETQLTDVRIGQSVNIISDLYGENVVFHGRVTGINMGTGNAFSLLPAQNATGNWIKIVQRVPVEVSLDPKELMEHPLRIGLSMTATIDTKDEDIAEMPDLASTVTSMPAYTSKALVIDTSPIEKEISNIISHNGQL

SEQ ID NO: 81783 - DNA, 1218 bp, Shewanella oneidensis MR-1
  CDS (1)..(1218): transl_table=11
atgaaaaaatcctcaaagcgtaaattgatattgatcctaagcggcctcatccttctcgggggcggcgcttattttctgttgcataaacccgaggcggcaccaagctatgtgacggagcccgtcaggcgaggcgatattgaaaactcggtgctcgccaatggcatgttgcaggcttctaaattggtgagtgtgggcgcgcaagtttcagggcaaattttgagtttgtccgtagcgcttggcgaagaggtgaaaaagggcgatcttatcgcgcaaatcgacagccttgcccagcaaaacaacttgcaaaatgcgctggcttccctaaaaaacatcaatgcccagtaccgagcgaagcaggcgcaaatacgtcaggcaaagctcgaatatacccgtcagcagcaaatgctcgccgataaggccagctcccgcgctgactttgaagccgccgaagccacgctcacggtttatcaggcagagcttgagcagttagaggcgcagaaacaacaggctgagattaatgtcgacagtgccagaatcgatttaggttataccaaaatcactgcgcctatggatggcactgtcgtttactctgcggttgaagtgggtcaaaccgtaaacgccaatcaaaccacgccaaccatagtcgagatggcgcagctcgataccatgacggtcaaggcgcagatctccgaagccgatatcgttaatgtgcgccccggacagccagtgtatttcactattcttggcagacctaaccatccctatcgcggcagcttaagggctattgagcctggcccgacgtcaatggatggtgacgatagcaatatgagctccagcgattcagacgccatttattaccatggcctgttcgatgtcgaaaaccccgaccgtaccctacgcattgggatgacggcgcagatctcgattgtactcgccaagtctgatgatgcgctgttagtgccatcgcaagtgctcaaggttaaaccaaaggataaagcagcctcgccagcggaacgtaagtcccgtgggccgcaatatcaagtgcctgtgctggtggacaaccaagtgcaatatgtggatgtcaccgtcgggattaataataaaatcaatgctgaaattctttctggtttaaaggaaggcgaccaagtagtgctcgggatgccttcgtccgatgatggcagcgcgcgtatgcgtcgcccgcctagtgtgaggttttaa

SEQ ID NO: 81784 - protein, 405 aa, Shewanella oneidensis MR-1
MKKSSKRKLILILSGLILLGGGAYFLLHKPEAAPSYVTEPVRRGDIENSVLANGMLQASKLVSVGAQVSGQILSLSVALGEEVKKGDLIAQIDSLAQQNNLQNALASLKNINAQYRAKQAQIRQAKLEYTRQQQMLADKASSRADFEAAEATLTVYQAELEQLEAQKQQAEINVDSARIDLGYTKITAPMDGTVVYSAVEVGQTVNANQTTPTIVEMAQLDTMTVKAQISEADIVNVRPGQPVYFTILGRPNHPYRGSLRAIEPGPTSMDGDDSNMSSSDSDAIYYHGLFDVENPDRTLRIGMTAQISIVLAKSDDALLVPSQVLKVKPKDKAASPAERKSRGPQYQVPVLVDNQVQYVDVTVGINNKINAEILSGLKEGDQVVLGMPSSDDGSARMRRPPSVRF

SEQ ID NO: 81785 - DNA, 1065 bp, Shewanella oneidensis MR-1
  CDS (1)..(1065): transl_table=11
atggaaaagtctaaaattgtgaagttcgccctgcccgtactattagtgtcaatgttggcggcttgtggtgaagaggaagtggctaaaaaagaagaaaaatatgccattcccgttgaaaccaccaccgtcattcagggaaatgtctcatctttttatagcaccacagccacccttgaagcaccacaggaagccaacgtggtgagccgcattgcaggcctcattgaagttataaatgtggaagaaggcgatcgtgtaaaaaaaggacaaagtctggccattattgatgctaaacgtcagcaatatgatttagaccgttcagaagccgaggtcaaaattatcgagcaagagttaaaccgcttaaagaaaatgaacaataaagagtttatcagtgccgattctatggccaagcttgaatacaacttacaagcagccattgctagacgggatcttgccgagttgcaagtgaaagaaagccacgtggtttcaccaattgatggcattattgccaagcgttatgtgaaagcgggaaatatggcaaaagaattcggcgatttgttctacatcgtaaatcaagatgaactgcacggcattgtgcatttgccagagcagcaattaaccagtttgcgcttaggtcaagaagctcaagtctttagcaatcaacaaagtaaaaatgcaattaacgcgaaagtgttacgtatcagcccagtcgttgatccacaaagtggtacctttaaagtcactttagctgtccccaatcaagatgcacgcttaaaagcaggcatgttcacacgggtcgaactgaaatatgacacccatgaaaatgtcattaccgtgccctatagcgccctcattaatcaagacaataagcaagcactatatgtgattgccggtactaatgccaaccgccgcgaagtcgaaattggctaccgcgaaggtgacgctgtcgaaattgtgtccggtatcaaacctggcgaggtcgtcgtcacccgcggtcagcaaaatttgaaagaccagtccttagttgaagtcattactccactcgatttggcctcagcgaaaaactga

SEQ ID NO: 81786 - protein, 354 aa, Shewanella oneidensis MR-1
MEKSKIVKFALPVLLVSMLAACGEEEVAKKEEKYAIPVETTTVIQGNVSSFYSTTATLEAPQEANVVSRIAGLIEVINVEEGDRVKKGQSLAIIDAKRQQYDLDRSEAEVKIIEQELNRLKKMNNKEFISADSMAKLEYNLQAAIARRDLAELQVKESHVVSPIDGIIAKRYVKAGNMAKEFGDLFYIVNQDELHGIVHLPEQQLTSLRLGQEAQVFSNQQSKNAINAKVLRISPVVDPQSGTFKVTLAVPNQDARLKAGMFTRVELKYDTHENVITVPYSALINQDNKQALYVIAGTNANRREVEIGYREGDAVEIVSGIKPGEVVVTRGQQNLKDQSLVEVITPLDLASAKN

SEQ ID NO: 81787 - DNA, 1074 bp, Shewanella oneidensis MR-1
  CDS (1)..(1074): transl_table=11
atgacaccggatcaacaatttgcccgtttggtcaaaatcgccatgctcggttttgtggccgtatttggctattttatgtttgccgacactatgatgccattaaccccgcaggctatggccacccgcgtagtgactaaggtgactccgcagatcagcggcaagatccaaagcattaatgtgaacaataaccaagtggtcgccaaaggcgatttactgtttcaagtcgacccagcgccctttgaattagccgtatcgcatgccaaattggccctagaacaagtgcgccaagataatgcggagcttgatgcttctcttttagccgctaaggcagaagtcaatgcgagtgcgacgactgcccagcaaaaacgccgtgaggccaaacgtttagatgcactttatgtgactcatggggtttcgcagcaactgcgcgatcaagccgatagtgatgcggccgccgccgaggcgaatttgttagctgcgaatgctcgccttgaaaagcttaaagtgagccgtggtttctatggcgaagataaccttagagttcgccaagcgatgaatgcgttagcgcaagctgagctgaatctgtcttacacccaaatccgtgccgaccaagatggggtggtgaccaacctgcaacttgaagtgggcagttttgccgctgtgggccaaccactactcgctttagtttctgataaattggatattattgccgattttcgcgaaaaaaccttacggggtgtgaatgccgcttatcccgcattaatcgccttcgatggtgagccgggccgcttgtatcacgcccaagtgagtagtgtcgatgcaggggtgagtgcggggcagtttgatgccaatggccgtttagccgcgccgcaggagtcagatcgctgggtgcgtgatgcgcagcgcttaagactgcacttagtgttagatgacagcaagtcaggcaacagtgcaatgaataacctacccgcaggggcacgcgccacagtgcaattactgcctgacaataccctgtttaatctgcttgccaaggtgcagattaaggttatcagcctgcttcactatatctattaa

SEQ ID NO: 81788 - protein, 357 aa, Shewanella oneidensis MR-1
MTPDQQFARLVKIAMLGFVAVFGYFMFADTMMPLTPQAMATRVVTKVTPQISGKIQSINVNNNQVVAKGDLLFQVDPAPFELAVSHAKLALEQVRQDNAELDASLLAAKAEVNASATTAQQKRREAKRLDALYVTHGVSQQLRDQADSDAAAAEANLLAANARLEKLKVSRGFYGEDNLRVRQAMNALAQAELNLSYTQIRADQDGVVTNLQLEVGSFAAVGQPLLALVSDKLDIIADFREKTLRGVNAAYPALIAFDGEPGRLYHAQVSSVDAGVSAGQFDANGRLAAPQESDRWVRDAQRLRLHLVLDDSKSGNSAMNNLPAGARATVQLLPDNTLFNLLAKVQIKVISLLHYIY

SEQ ID NO: 81789 - DNA, 1098 bp, Pseudomonas putida KT2440
  CDS (1)..(1098): transl_table=11
atgagcgacgccacgccaacgccgcccccatcagccccggatcgcggcatacgctgggtgctgctgctgattgccgtcagcctgctctggtacttgctggctgaccgctatacgccgtacacccagcaagctcgcctgcaggcttacgtagtcccggtggccgccgaagtggccgggcagatcaagcgtgtggccgtaggcaacaaccaggaggtgcgccagggcgatgtgctgttcgaactcgatcaggagcagtaccgcattgccttggcccgtgccgaagccgacctcgataccgtgcggcggcagatcggcgccagtaccgctggtatcgattcggcgcaagcagcgctggtggccgcccaggccaacgaacgcaaggcgcggcaggacgccgagcgcctcaaacggctgattgacgaagaccccggtacggtgtcggtgcgccgtctggaaggcgcccaggccacccgtgaccaggccatcagccaagtggcggcggcccgcgccgaggtggagcgcgcccgtgagcagcagggcggggcacaggaagacaacgcccaactgcgcagtgccgcggccaatttggaaaaggcccgcctggaccttgcccgtactgtggtgcgtgccgacgcaaacggcctgatcaccgacctgcgcacagacgttggccactatgtcggggcaggtagcccgatgatgaccctgatcagtatccatgacgtgtggataagtgccgacatgaccgagaacaacctcggtcgcttgcgccctgaaaccccggtgctggtggtgctcgatgcgctaccgggcaccgtgttgaaagggcgtatacgcagcattggctatggcgtgagcgtggggcagagcacgccgccgggtacgctgccgaccgtgcagaatagccgcgagtggctgcgttcggcgcagcgctttccggtgattatcgaactggagcgcgatcagcttcaggacaagaccgtgctgcgggtcggtgggcaggccgaggtcatggccctgcctagcgaaggcaacccactgaacctgctgggccggttgttcatgtggctgatgagctggctgtcgtatgcctattga

SEQ ID NO: 81790 - protein, 365 aa, Pseudomonas putida KT2440
MSDATPTPPPSAPDRGIRWVLLLIAVSLLWYLLADRYTPYTQQARLQAYVVPVAAEVAGQIKRVAVGNNQEVRQGDVLFELDQEQYRIALARAEADLDTVRRQIGASTAGIDSAQAALVAAQANERKARQDAERLKRLIDEDPGTVSVRRLEGAQATRDQAISQVAAARAEVERAREQQGGAQEDNAQLRSAAANLEKARLDLARTVVRADANGLITDLRTDVGHYVGAGSPMMTLISIHDVWISADMTENNLGRLRPETPVLVVLDALPGTVLKGRIRSIGYGVSVGQSTPPGTLPTVQNSREWLRSAQRFPVIIELERDQLQDKTVLRVGGQAEVMALPSEGNPLNLLGRLFMWLMSWLSYAY

SEQ ID NO: 81791 - DNA, 870 bp, Pseudomonas putida KT2440
  CDS (1)..(870): transl_table=11
atgcgtgcggccgtacgtattctggtgaccctgtgtgtggtggccctggccgtgttggccggctaccagctgtggcagtactacatgctcaccccatggacgcgtgatgcccgtgtgcgcgccgatgtggtggtgattgcgcctgatgtgtccggctgggttcgcgaactcaaggtccatgacaaccagcaggtcaaggctggcgacttgttgatgagtattgaccgcgagcgcttccaggccgcgctcgatcaggccagcgcggtgaccgagacacgcgcccagcaactgcgcttgcgcgagcgtgaagcagcccggcgtactgccctggggccagaggcgatcagtgccgagttgcgtgaaaacgcccagatcaatgccgccatcgcgcgtggcgagctgcatgaagccgaggcgcagttgcaggtggccaggatcaacctggcgcgcagtgaagtgcgggccccgcgcagcgggcatatcaccaatctgcgtctggccgagggcaattatgtgaacaccggggaatcggtgatggcgctggtggatgattcgacgttctacatccaggcctatttcgaggaaaccaagttgccgcgcattcgcgttggggacactgtgaaggtgtggctgatgggcacgggtgaaccgatgcaggggcacgtggagagcatcagccgcggcatcaccgaccgcaacagcaacccggacagccagttgctgccggaggtagagccgaccttcaactgggtgcgactggcccagcgcataccggtgaggattcgcctggatcaggtgccggaagggctgaccttgagtgcggggatgacggcgagtgtgcaagtgcacgaggaccgcgagccgcagtga

SEQ ID NO: 81792 - protein, 289 aa, Pseudomonas putida KT2440
MRAAVRILVTLCVVALAVLAGYQLWQYYMLTPWTRDARVRADVVVIAPDVSGWVRELKVHDNQQVKAGDLLMSIDRERFQAALDQASAVTETRAQQLRLREREAARRTALGPEAISAELRENAQINAAIARGELHEAEAQLQVARINLARSEVRAPRSGHITNLRLAEGNYVNTGESVMALVDDSTFYIQAYFEETKLPRIRVGDTVKVWLMGTGEPMQGHVESISRGITDRNSNPDSQLLPEVEPTFNWVRLAQRIPVRIRLDQVPEGLTLSAGMTASVQVHEDREPQ

SEQ ID NO: 81793 - DNA, 861 bp, Pseudomonas putida KT2440
  CDS (1)..(861): transl_table=11
atgaaaaagttcttcagcctgatcgccaccctgctggtgctggtcgctgccgtggccatcggtcgccagttgtggctgcactacatgaccacgccatggacccgtgatggccgtgtgcgtgccgacatcatcaacgtcgcagccgacgtgcccggctacgtggtggatgtaccggtcaaggacaaccagcgggtgaagaagggcgacctgctgatccagatcgaccctgagcactaccagttggccgtcgaccaggccaaggcactggtcgcctcgcgcaaggccacctgggaaatgcgcaaggtcaatgccaagcgccgtgccgacatggacaacctggtgatttccaaggaaaaccgcgacgacgccagcaacatcgccaattccgcccaagccgattatcaacaagcccttgccgagttggccgcagccgagctgaacctcaagcgtacgcacatcgtggcgacggttgacggctatgtgaccaacctgaatatccacaagggcgactatgcgcgtaccggtgaagcggtgatggcggtggtcgacgagaattcgttctgggtttacgggttcttcgaggagaccaagctgccgcatgtgaaggtgggtgaccaggccgaattgcagatgatgagcggcgagcgtctcaaggggcatgtggagagcatcgcccgcggcatctatgaccgcgacaacccacagagccgcgagctgatcgccgacgtgaacccgaccttcaactgggtgcggctggcacagcgggtgccggtgcgcattcacatcgatgaagtgccggaagggtttttgctggcggcggggacgacgtgtacggtggtagtcaagcctggcgaaggttga

SEQ ID NO: 81794 - protein, 286 aa, Pseudomonas putida KT2440
MKKFFSLIATLLVLVAAVAIGRQLWLHYMTTPWTRDGRVRADIINVAADVPGYVVDVPVKDNQRVKKGDLLIQIDPEHYQLAVDQAKALVASRKATWEMRKVNAKRRADMDNLVISKENRDDASNIANSAQADYQQALAELAAAELNLKRTHIVATVDGYVTNLNIHKGDYARTGEAVMAVVDENSFWVYGFFEETKLPHVKVGDQAELQMMSGERLKGHVESIARGIYDRDNPQSRELIADVNPTFNWVRLAQRVPVRIHIDEVPEGFLLAAGTTCTVVVKPGEG

SEQ ID NO: 81795 - DNA, 1278 bp, Pseudomonas putida KT2440
  CDS (1)..(1278): transl_table=11
gtggatggcacgggcttcgcccgtgttcgcgggcaagcccgctcccacacgcgccagcttttagaaattgagcaagacagtggctcccacaaccgacagccagcaggcccaattcgagattggaaaccaaccatgaatgttgccgtagacaaaccctcacccgccgaaactgaacagcggccgagcgctaaaacccgtcgccgcctggcagtcatcgccagcggcagcctggccgcaatcaccctgctggccttcaccagctactggttcagcaccggccgctatctggaaaccaccgacgatgcctatgtccgcgccgactgggtggccctgagcccacgcgtggcgggctacgtagccaaggtcgaggtggctgacgaccagccggtgaaagccggcgatgtgctggtgcgcctgcaaaaccgcgactaccgcgcccgcctcgaccaggcccgggctggcgtgaccgaggcacaggcggcactggccgccgcccaggccagccaacaggtagcgaccgagcgcatcgaccagcaacagcaagccatcctgcaggccgaggccgtcgtgcgcagcgccaccgccgaacagcgccgcagtgaactggatgtccaacgctaccgtggcctggtgcgtgacgacgcagcgaccgtgcagcgcctggaaaccgccagtgcccatgccagccaggcacaagccgcgctgcaaggtgcccaggccgcgctgcgccagcaacgctcacaactggccatggccaaggcccgggcagcccaggccgaggccgagctgcaacaacgggcagcggccctggcacgcgcccaggcccaccagcagctcgccgagcaggacgaacaggacaccgtgatccgcgcgccgatcaccggcgtggtcggccagcgccgcgtgcgcaccggccagtacgtggtgccgggccagccgctgttggctgtggtgcccctgcagcaagcctatgtagtggccaactacaaggaaacccaactggcccgcatgcgccccgggcaaccggtagaaatacgtgtcgacagcttcgccagccagccactgcatggccatgtggccagtttttcgccagcctcgggcaatgtcttcgccttgctgccgtcggacaacgccaccggcaacttcaccaagatcgtccagcgtttcccggtgcgcattttgctcgacaaaccgctggatggcccgcaggtactgcccggcatgtcggtggtcagtacagtcgacacacgccccgcagaggttgccgatgcgcactga

SEQ ID NO: 81796 - protein, 425 aa, Pseudomonas putida KT2440
MDGTGFARVRGQARSHTRQLLEIEQDSGSHNRQPAGPIRDWKPTMNVAVDKPSPAETEQRPSAKTRRRLAVIASGSLAAITLLAFTSYWFSTGRYLETTDDAYVRADWVALSPRVAGYVAKVEVADDQPVKAGDVLVRLQNRDYRARLDQARAGVTEAQAALAAAQASQQVATERIDQQQQAILQAEAVVRSATAEQRRSELDVQRYRGLVRDDAATVQRLETASAHASQAQAALQGAQAALRQQRSQLAMAKARAAQAEAELQQRAAALARAQAHQQLAEQDEQDTVIRAPITGVVGQRRVRTGQYVVPGQPLLAVVPLQQAYVVANYKETQLARMRPGQPVEIRVDSFASQPLHGHVASFSPASGNVFALLPSDNATGNFTKIVQRFPVRILLDKPLDGPQVLPGMSVVSTVDTRPAEVADAH

SEQ ID NO: 81797 - DNA, 1194 bp, Pseudomonas putida KT2440
  CDS (1)..(1194): transl_table=11
atggccactcccacagacaccccgactccctccgtcgcgcctgagccgtcgcgcaagcgcaaggcttggctgcttggcctgctgttgctgctgatccttgccggggtcggcacctgggcctggtacagcattgtcgggcgttggcacgaaagcaccgacgatgcctacgtcaacggcaacgtggtggaaatcaccccgctggtcgctggcaccgttaccagcatcggggccgatgacggcgacctggtccatgccggccaggtattgctgcaattcgacccggccgacagcgaagtggccttgcagtccgccgaagccaagctggcacgcagcgtgcggcaggtgcgcgggctttacagcaacgtcgactcgctgaaggctcaactggaaacgcgccaagccgaactgcgcaaggcgcaacaggacttcaaccggcgcaaggtgctggctgacagcggtgcgattgccgcagaagaactgtcccacgcccgtgacgacctgagcgttgcccaggctgccgtcaacagcgcgcggcaacagctcagcaccagcagcgcgctggtcgacgacaccgtggtgtcctcgcaccccgatgtcatggctgcagctgccgacctgcgccaggcctacctcgaccacgcccgcaccacgttggtcgcgccggtcaccggctacgtcgccaagcgtaccgtccagttgggccagcgcctgcagccgggcaccgcgaccatggcggtcatcccgctggatcaggtgtggatcgatgccaacttcaaggaaacccagctgcgagagatgcgcatcggccagccggtggaaatcaccgctgatgtgtacggcagtgaggtcaagtacagcggcacggtcgacagccttggtgcgggcaccggcagcgcctttgccttgctgccggcgcagaacgccaccggcaactggatcaagattgtccagcgagtacccgtgcgcatccacctcagccccgaccagctcaaggaccacccgctacgtatcggcctgtccaccgtggttgaagtcgacctgcatgaccagagcggcccgaccctggcccagcagccaccgcagaaggccagctacaccacccaggtgtatgaccaccagctgatggaagccgacaacctgatcgcccggctgattcacgagaacagcgcaaccggcaagacggcgcaacgatga

SEQ ID NO: 81798 - protein, 397 aa, Pseudomonas putida KT2440
MATPTDTPTPSVAPEPSRKRKAWLLGLLLLLILAGVGTWAWYSIVGRWHESTDDAYVNGNVVEITPLVAGTVTSIGADDGDLVHAGQVLLQFDPADSEVALQSAEAKLARSVRQVRGLYSNVDSLKAQLETRQAELRKAQQDFNRRKVLADSGAIAAEELSHARDDLSVAQAAVNSARQQLSTSSALVDDTVVSSHPDVMAAAADLRQAYLDHARTTLVAPVTGYVAKRTVQLGQRLQPGTATMAVIPLDQVWIDANFKETQLREMRIGQPVEITADVYGSEVKYSGTVDSLGAGTGSAFALLPAQNATGNWIKIVQRVPVRIHLSPDQLKDHPLRIGLSTVVEVDLHDQSGPTLAQQPPQKASYTTQVYDHQLMEADNLIARLIHENSATGKTAQR

SEQ ID NO: 81799 - DNA, 1230 bp, Vibrio vulnificus CMCP6
  CDS (1)..(1230): transl_table=11
atggctgttacttctgcttttaatggctgtacctatcgtgttgtacaacaatgcaagaagggaggtgtatccatcacatcaaagccgcttgcttggcatgtattaaatgttcaattaaatggtatactttcgcaaattagcttaacgcaaaatagagaattactgatgtctgacacgcaatcatcatcgagaaaactaagtatctacattattaccacgattttagtaatttggctttatagtctttgggccgacagggttacaccaatcaccagcagtgcccggatccattcttatcttgtacagatcgcacctgaggtaacaggcaatatcattgacgtttcagtcagtgacaatcagatcgtgaatgccggcgaccttttgttccgaatcgatccaagaaactacgacattgctcttagagcggctcaagcagagttggagttagtcggtcaaagtattggtgcaaatactgcggccgtagaggttgcacaggctagagttgtagaagctctggctgcgagaaataatgctcgtgagcaagcagccagaacggaaacactggctaagcggggggtcttaagtaaggcagatctggacaatgcactagaatcaaaaactcgtgcgcaagctgggctggaggccgcggaagcagcattagtgcaagcaaaacaaaacttggggcctgctggtaataacaacccgcaaattctcgcggcgatggccaaacttgaaaaagctcagcttgaccttcaaaaaaccaatgttactgcgccttcaaagggagttttgactaatgtccaactcacgaacggacaacgtgctaatgctggcacgccattattaacattcattgaccctcgtggcgtatggatctcggcccagctacgagaaaactctcttgaacatattcgagaagggcaacgtgtcgatattgtattggatgcgctgccaggtcgtgttctctccggaaaaattgacagcattggctgggggacaggaggcagtaataatgtagatgccactacaggttttttagtcgcagataacaaggcaatcagtgcccagcgttaccctgttaatattgtctttgatgacgtagagagactttcaaacgtccgatttggttctcaagctaccgttgcagtctatactgagaaaagcaaatttggtgagtggctagcaagcatttggatgcatgtactgagtgtttggacttatgtttcgtag

SEQ ID NO: 81800 - protein, 409 aa, Vibrio vulnificus CMCP6
MAVTSAFNGCTYRVVQQCKKGGVSITSKPLAWHVLNVQLNGILSQISLTQNRELLMSDTQSSSRKLSIYIITTILVIWLYSLWADRVTPITSSARIHSYLVQIAPEVTGNIIDVSVSDNQIVNAGDLLFRIDPRNYDIALRAAQAELELVGQSIGANTAAVEVAQARVVEALAARNNAREQAARTETLAKRGVLSKADLDNALESKTRAQAGLEAAEAALVQAKQNLGPAGNNNPQILAAMAKLEKAQLDLQKTNVTAPSKGVLTNVQLTNGQRANAGTPLLTFIDPRGVWISAQLRENSLEHIREGQRVDIVLDALPGRVLSGKIDSIGWGTGGSNNVDATTGFLVADNKAISAQRYPVNIVFDDVERLSNVRFGSQATVAVYTEKSKFGEWLASIWMHVLSVWTYVS

SEQ ID NO: 81801 - DNA, 1296 bp, Bradyrhizobium japonicum USDA 110
  CDS (1)..(1296)
atggaagctaccctgccccgcgacgccgccccgcttcgcagcgaaccatcagccgaagcaccgggcgatgcctcaagtaccgcggagggctccgccgcaccggagaccgtggcacgcgacaccagcgatcgcacggcggacaccgtcagacctccgacacaggcaacgccctccgcgaggccgctgcgcaaggctgtcggccgattcatgctcggcgcaggcaagcatctcgcgaccctcggcatcgcattggtcgccgtcttgatatcggttgcgacctggcagcactacgtcactgctccctggacgcggaacggcagcgtgcgtgtccaggtcgccaatgtcgcgccgcaggttgcaggcaagatcgtggcgctgcgggttggcgacaaccagttcgtccacaagggcgacgtcctttacgtcatcgaccccttcgacttcgaagtggccgtccgaatcggcaaggcgctggtcgaccagcgggccgcggatctggaggtgaagcaggccgagttcgaccggcgtcgacatctgtccaacctcgcaacgacgcccgaagagcagcagatctatgcaggcaacgcagcgcaggcgaaggccgcctacgaggcggcggcacaccagctcgcacaggcggagctgaatttgaaacggaccagcgtgaccagtcccgtcgacggttacgtcaccaatctcctgctgcgcgcgggcgactatgccgtcaccggcgtcagcaacatctcggtgatcgattccaacagtttctggatcgacggctatttcgaggaaaccaagatggctcgcgtctgcgtcggggatcgcgcggaagcgcaattgattggttacgccaagccgatcctggggcatgtgaagaccgtgacgcgaggcgtcagcgtgtcgaacgccgctgcgggcacgcagggcctgcccagtgtcgacccgatctacacctgggtgcggcttgcccagcgcgtaccggttcgcgtcgccatcgacacggtgccgccggatgtgccactggtctcgggcatgacggcgacggtgacaatccgacagccctccgcgggcgatcaccagacccggttcgaccggttccgcgcgagcttcgtggatcccgtcactgatctgttcggcgcaggacaaccgccgcgtgcgaactgcctgcaggccacatcccagcaacgccccgaggtggaagcgatcccgtattcgcgcgaacccccggttccctcggcacagtcgatcgcgcccggccttacacccggcatcgacgcctcgccacgtctgccctga

SEQ ID NO: 81802 - protein, 431 aa, Bradyrhizobium japonicum USDA 110
MEATLPRDAAPLRSEPSAEAPGDASSTAEGSAAPETVARDTSDRTADTVRPPTQATPSARPLRKAVGRFMLGAGKHLATLGIALVAVLISVATWQHYVTAPWTRNGSVRVQVANVAPQVAGKIVALRVGDNQFVHKGDVLYVIDPFDFEVAVRIGKALVDQRAADLEVKQAEFDRRRHLSNLATTPEEQQIYAGNAAQAKAAYEAAAHQLAQAELNLKRTSVTSPVDGYVTNLLLRAGDYAVTGVSNISVIDSNSFWIDGYFEETKMARVCVGDRAEAQLIGYAKPILGHVKTVTRGVSVSNAAAGTQGLPSVDPIYTWVRLAQRVPVRVAIDTVPPDVPLVSGMTATVTIRQPSAGDHQTRFDRFRASFVDPVTDLFGAGQPPRANCLQATSQQRPEVEAIPYSREPPVPSAQSIAPGLTPGIDASPRLP

SEQ ID NO: 81803 - DNA, 1164 bp, Bradyrhizobium japonicum USDA 110
  CDS (1)..(1164)
atggctgatcaagtcatcaagttccagcccgagcagaagatcgacagcggcaagcccaccaagaaagccggcaccgatccccgccgccgcatcatcgcaggcctgcggcgctatcgccgcttcctgctgatggtcgtgctgccgatcgtcgccgccattggcggcttgaccctctatctgaatggcggccgctatgtcggtaccgatgacgcctatgtcggtgcgcagaaggtgctggtgacgcccgacatctccggcaagatcgagaaggtcgtcgtgagggaaggtcagctcgtcaagcagggcgatgagctgttcgagatcgatcccgtgccgttccgcctcgcggtggacgaggccagggcgcagctcgcgcaggcgcagtcgacctacgacaatctccgcgccaacatcaagatctacggcgacatgctgagcctcgcccagcagggcgtcgacctcaagcagcgcgacgtcgagcgcaagcaggcgctggtcaagaacagctacggctcgcagctcgacctcgacaacgcggcgaacgcgctggtcacgtcaggctcgatcgcgcaatacgtcaagcagcagatctcggcggccaagacgcaactgctcggcgataccgacctgccgctggagaaattcccgccctacgcgcaggccaagtccaagctcgacaacgccgagcgcaatctcgatcacgccgtggtgcgcgcgccgatgggcggcgtcgcgacgcaggtcgagcagattcagctcggccgctacgtcacggccggcacgccggtgttctccatcatcgacgtcgcccatccctgggtcgacgccaatccgaaggaaagcgacctcacctacgtcaccgaaggccagcctgttaccctcgaggtcgacgcgttcccgaaccacgtgttcaagggcaagatcggctcgctctcgcccggtaccggcgcgcagttcgcgatcctgccgccgcagaacgccaccggcaatttcgtcaaggtggtgcagcgcgtgccgatccgcatctatttcgacgagaccgacaaatacgtgcggaagctgaaggccggcatgagcgtctacgccaccatcgacaccggccatcggcgctcgctcgccggcctgttcggcctgtcggcgaccgcgggccaggacaaggactga

SEQ ID NO: 81804 - protein, 387 aa, Bradyrhizobium japonicum USDA 110
MADQVIKFQPEQKIDSGKPTKKAGTDPRRRIIAGLRRYRRFLLMVVLPIVAAIGGLTLYLNGGRYVGTDDAYVGAQKVLVTPDISGKIEKVVVREGQLVKQGDELFEIDPVPFRLAVDEARAQLAQAQSTYDNLRANIKIYGDMLSLAQQGVDLKQRDVERKQALVKNSYGSQLDLDNAANALVTSGSIAQYVKQQISAAKTQLLGDTDLPLEKFPPYAQAKSKLDNAERNLDHAVVRAPMGGVATQVEQIQLGRYVTAGTPVFSIIDVAHPWVDANPKESDLTYVTEGQPVTLEVDAFPNHVFKGKIGSLSPGTGAQFAILPPQNATGNFVKVVQRVPIRIYFDETDKYVRKLKAGMSVYATIDTGHRRSLAGLFGLSATAGQDKD

SEQ ID NO: 81805 - DNA, 867 bp, Bradyrhizobium japonicum USDA 110
  CDS (1)..(867)
atgaaaggcaatttcgcctggctcggccgcctcgcgctgaccgtcatcgttgtcgtcgccgcgctcgcagtgggccgcgagctctgggtctactacatggagcagccctggacccgcgacggccgcgtccgcgccgacgtggtccaggtcgcgcccgacgtgtccggattcgtgaccgaggtgctggtcaaggacaaccagaaggtccgccgcggcgacgtgctgttccggatcgaccgcgaacgtttcgcgctggcgctgcgccaggccgaggcgtcggttgcgggtcatcaggcgacgctcgatcaggccaatgccgatctgaagcgttacaacgcgctgacgaccgacgcggtgtcgcagcagaagcaggagcaggttctcgccacccagctccaggccaaggcggccttcgatcaagccgtggccgatcgcgcgttggcgcagctcaacctcgaccgcagcgaggtccatgcctccgtgaacggtgtgatcaccaacatggacctgcgccccggcgcctacgtcacggccgggaagggcgtgatggcgctggtcgataccgacacgctgcatgtggaaggctacttcgaggagacaaagctcgcgcgcatccgcaccggtgacaaggtccgggtccgcctgatgggcgagaaggtcacgctgtcaggccgcgtcgagagcatcgccgccggcatcgaggaccgcgaccgcgcggagggagccagcatgctcgccaacgtcaacccgaccttcagttgggtgcggctggcacagcgtgtcccggtgcgcatcgcgctcgatccggtgccggagaacatgtcgctggtcgccggtcgctccgcgacggtggaggtattggactag

SEQ ID NO: 81806 - protein, 288 aa, Bradyrhizobium japonicum USDA 110
MKGNFAWLGRLALTVIVVVAALAVGRELWVYYMEQPWTRDGRVRADVVQVAPDVSGFVTEVLVKDNQKVRRGDVLFRIDRERFALALRQAEASVAGHQATLDQANADLKRYNALTTDAVSQQKQEQVLATQLQAKAAFDQAVADRALAQLNLDRSEVHASVNGVITNMDLRPGAYVTAGKGVMALVDTDTLHVEGYFEETKLARIRTGDKVRVRLMGEKVTLSGRVESIAAGIEDRDRAEGASMLANVNPTFSWVRLAQRVPVRIALDPVPENMSLVAGRSATVEVLD

SEQ ID NO: 81807 - DNA, 1203 bp, Bradyrhizobium japonicum USDA 110
  CDS (1)..(1203)
atgagggcacaagagccgacacgagccgatatgaaaaaaacacggccgatcctctggattctgatcatcgcggccgtggcctccgcgggttactatggttggcagaaattcggctcgccgaatgccggaaaaacccagacggcacaaaaaggtccgccccgcgcccccgccgttcccgtgagcgttgcgccggtccagaaggtcgatttcccggtctacctgaccggtctcggcacggttcagggtttcaacaccgtccaggtccggccccgggttgacggccagatcgacaggatcgcctttaccgaaggccagatcgtcaaagagggcgagcttctggtctcgatcgatccccgtccctatcaagccgcgctcgaccaggccaaggccaagaaggcgcaggacgaggcaaatctggcgaacgccaatctcgagctccagcgcgccatgaagctcggcgaattcgccaccgcgcagcgggtcgacacccagcgctccactgtcgcccagctcaccgcccagatcgccgccgacgacgccgcgatctccaatgcccagacccagctcgactacacccagatcaaggcgccgatcaccggcgtcgccggcctgcgccaggtcgacgtcggcaacatcgtcaacgcctcgacgcagacgggtatcgtcacgatctcgcaggtcgagccgatctcggtgatcttcaccgcgcctgaagatcagctcgcctatatcagcgagggccagaaggccggggcactcaaggtgatcgcgttcaccaccgacggcaagaagacactggccgagggcaagctcgccgtcatcaacaaccaggtcgacacgaccagcgggacgatccggctcaaggcggtgttcgacaacaaggaccacacgctgtggccgggacagtcggtctcgacgcggcttctggtgcggacgctgaaggacgcgacggtggtcccggatgatgcggtccagcattcgaccaacggcctttacgcctataccgtcaatcaggacaacaaggccgaagtgcacaaggtcaaggtcagctacgcgatcgacggacgttcggtcgtcgacgaaggcctcgcgccggggcagcaggtgatcaccggtggccagttcaaggtgcagcccggaagcctcgtctcgacggcggtggcgagttcggatccggcccagaacaaggttcgacaggaatga

SEQ ID NO: 81808 - protein, 400 aa, Bradyrhizobium japonicum USDA 110
MRAQEPTRADMKKTRPILWILIIAAVASAGYYGWQKFGSPNAGKTQTAQKGPPRAPAVPVSVAPVQKVDFPVYLTGLGTVQGFNTVQVRPRVDGQIDRIAFTEGQIVKEGELLVSIDPRPYQAALDQAKAKKAQDEANLANANLELQRAMKLGEFATAQRVDTQRSTVAQLTAQIAADDAAISNAQTQLDYTQIKAPITGVAGLRQVDVGNIVNASTQTGIVTISQVEPISVIFTAPEDQLAYISEGQKAGALKVIAFTTDGKKTLAEGKLAVINNQVDTTSGTIRLKAVFDNKDHTLWPGQSVSTRLLVRTLKDATVVPDDAVQHSTNGLYAYTVNQDNKAEVHKVKVSYAIDGRSVVDEGLAPGQQVITGGQFKVQPGSLVSTAVASSDPAQNKVRQE

SEQ ID NO: 81809 - DNA, 1317 bp, Bradyrhizobium japonicum USDA 110
  CDS (1)..(1317)
atggccgtatcgagagaccaggctgcgcgcgtccttcgccaggatacggtggagacgaattcggcgaacggtgaacctgtgaccgagacgtccgccgttctcgccgagcagttgcgctcccatgtggccgaggaagcgaagcgccgcagcgacgcgccggggaagcccgtgaccgacaagccggccacacccgggtcagacgcgcccgctgccagcggcacgccgaaatccggcaagcgcaaattcgtcctggtgggcgtcggtctcgtgctggcgctcgcggcagccggctatgccggctattacacgctggtcggccgcttctacatcgccaccgacgacgcctatgtccgcgccaacaacaccatgctcggcgcgcgcgttgccggccacatttcctcgatccttgctggcgacaacacgacggtgcgcgccggcgacgtcatcttccgcatcgacgacggcgactacaagatcgcggtcgatgccgccgcgaccaggatcgcgacccagcaggccaccatcgatcgcatcggtcgccagatcgcggcgctcgagagccaggttgcccaggccaaggcgcagctcgtctcggccgaagcgggcctcaagcgcgcggacctcgattatgagcgccagcaggcgctgagcagcaagggctttgcctcgcgcgccaccttcgagagctcggaagccgggcgcgaccagggcgccgccgcggtcaaggccgcgcaggccgcctatgacgtcgccgtcagcaacgtcgacgtcaccaaggcgcagcaggccgaagcccaggcccagcttgcggagctcaagacctcgctcgccaaggccgagcgcgatctcgccttcaccgcggtgcgcgcgccggtcaacggcacgttctcgaatcgcctcgtcagcgccggcgacttcgtcgcggtcggccagcggctcggcaacgtcgtgccgctcgacgacgtctatatcgacgccaacttcaaggaaacgcagctcaagcgcatccgccccggccagccggtgacgatcaaggtcgatgcctatggcatgcgcaagttctccggcgtcgtcgacagcatcgcggcgggcgcgggctcggtgttcacgctgctgccgccggataacgccaccggcaatttcaccaagatcgtgcagcgcgtgccggtccgcatccgcgtgccgaagtcggtggcgaaacagaacctgctccgcgccggcatgtcggtctacgcgaccgtcgacaccaacaagggcgcggccgacgccgacagcgaggtcgatctcgacgatcccacaatgatccatccgcagtaa

SEQ ID NO: 81810 - protein, 438 aa, Bradyrhizobium japonicum USDA 110
MAVSRDQAARVLRQDTVETNSANGEPVTETSAVLAEQLRSHVAEEAKRRSDAPGKPVTDKPATPGSDAPAASGTPKSGKRKFVLVGVGLVLALAAAGYAGYYTLVGRFYIATDDAYVRANNTMLGARVAGHISSILAGDNTTVRAGDVIFRIDDGDYKIAVDAAATRIATQQATIDRIGRQIAALESQVAQAKAQLVSAEAGLKRADLDYERQQALSSKGFASRATFESSEAGRDQGAAAVKAAQAAYDVAVSNVDVTKAQQAEAQAQLAELKTSLAKAERDLAFTAVRAPVNGTFSNRLVSAGDFVAVGQRLGNVVPLDDVYIDANFKETQLKRIRPGQPVTIKVDAYGMRKFSGVVDSIAAGAGSVFTLLPPDNATGNFTKIVQRVPVRIRVPKSVAKQNLLRAGMSVYATVDTNKGAADADSEVDLDDPTMIHPQ

SEQ ID NO: 81811 - DNA, 1236 bp, Xylella fastidiosa Temecula1
  CDS (1)..(1236): transl_table=11
atgccatattttttaaaaatctccctgcttgccgcagcactcatgaccacgtcatgcagccaaggcgacaagaatagtgcacatcctgctggcgctgacaacacacaaagcgttgagaaacagggggataacgctccaattcctgtcacagtagtcgcagcaagcagccaaaatgttcctgtgtacgctgccgccccaggcacagtggccgcaatgaataccgtcacgattaacccgcaggtcagtggtcaattgatcagcctacacttccgcgagggtgaatcagtaaaaaaaggccaattactcgccgaaattgacgcacgcgcacttcaggccagctacgatcaagccgcagcggcgaagcgtcagaaccaagcactgctggcaaccgcacgtgccaactacacccgctccagcacgttggaataccaaccgtacgtcgccaagacagaattagatacacaacataaccaggtcacgcagtatgaagcggcagtcgcagcaaacgaagccgcaatgcgagcagcccaagtacagctgcaatacactaagattgtcgcaccgatcgacggcgtcgccgggatccgcagcgtagatgctgggaacgtggtcacaactagcacctccatcgtgacactgacacagatgcatccaatctacgtctcattcaatcttcccgagcgcttgttgcaggaagtacgccaagcccatgcctccggccccgtgatggtggccgcgctggaccgcggagatgcacacccactgaccgaagatggcacattggatgcgatcaataaccaaataaacactgatagcggcactttcagcgcacgtgccgtgttctccaaccgcaataacgcactatggcctggccagttcgtcaacgcgcgtctgcaactacgtacgattgccaatggtgtcgtgattccggcgcaagcagtgcaacgcggccccaatggcgactacgtttaccttgtcaagcaagatcacacggtcgttactcaggaagtcacccaaggtgtggaaatcggtgacagccatgtacaaatcgccaaaggcttgaatgtcggcgacacagtagtcacagaaggtcaattccggctcaaaccaggcagtaaagtcatcgcgctagcaccaggtgaaactccaccagcaccaaccgaagccgaattgaaggctgctgcggaaaaacgcagcaaaaatagcatgggtggtcctcctcgcggcggcccataa

SEQ ID NO: 81812 - protein, 411 aa, Xylella fastidiosa Temecula1
MPYFLKISLLAAALMTTSCSQGDKNSAHPAGADNTQSVEKQGDNAPIPVTVVAASSQNVPVYAAAPGTVAAMNTVTINPQVSGQLISLHFREGESVKKGQLLAEIDARALQASYDQAAAAKRQNQALLATARANYTRSSTLEYQPYVAKTELDTQHNQVTQYEAAVAANEAAMRAAQVQLQYTKIVAPIDGVAGIRSVDAGNVVTTSTSIVTLTQMHPIYVSFNLPERLLQEVRQAHASGPVMVAALDRGDAHPLTEDGTLDAINNQINTDSGTFSARAVFSNRNNALWPGQFVNARLQLRTIANGVVIPAQAVQRGPNGDYVYLVKQDHTVVTQEVTQGVEIGDSHVQIAKGLNVGDTVVTEGQFRLKPGSKVIALAPGETPPAPTEAELKAAAEKRSKNSMGGPPRGGP

SEQ ID NO: 81813 - DNA, 1164 bp, Pseudomonas syringae pv. tomato str. DC3000
  CDS (1)..(1164): transl_table=11
atgaccgaatccaagacccctgataccgaagcacctcgcagctcgcctgcaccggccccggcacccttgacgtccccggtcaccagcaagccgcgctcgacccgcaagcgagtggtgtcttcagtgattttcggtgccgtcgcactggccggggtgctgctggtgttgtacgcctggcagtttccaccgtttgccagccccatcgagagcaccgagaacgcgcaggtcaaaggccagaccacgctgatcgcgccgcaactgagcggttatgtttatgaggtgccggtgcaagactttcagttcgtcaaggcgggcgacttgctggtgcgtctggatgaccgcatctaccgtcagcgcctcgatcaggccttggcgcaactggctgtgcagaaggcatcgctggccaataacctgcaacagcggcgcagcgccgaagcgacgatcggccagcgtcaggccgagttgcagaacagcatcgcccagagccgcaagagcgccgccgatctgcgccgcaatcaggcgctggtgaccgatggttcggtgtcgaaaagcgagctggacgtgacccgggcggccgatgcccaggccaatgccgccgttgcagaggcgaaggcagtattgctcatcgcccgtgaggacctgcaaaccgtcatcgtcaaccgtggctcgctggaagcctcggtggccaacgcccaggcagccatcgaactggcgcgcatcgacctggacaacacccgcattgttgctccgcgtgacggtcagttggggcagattggtgtacgtttgggtgcctacgtcaattcgggtgcgcaactgatggcgctggtgccggagcagcgctggatcgtcgccaacatgaaagaaacccagatggccaacgtgcgcctcggccagccggtgagtttcaccgtcgatgcgctggacggtcgtgaaatgcacggccatgtacaaagaatatcgccctcagcaggttcggagttcagcctgctgcccgccgataacgcgaccggcaacttcgtgaaaatctcccagcgcatcccggtgcgcattgtcgtcgatgccgaccagccgatgcttgagcatctacggccggggatgtcggtggtggtaagtatcgataccagcgtagagggggatgagccaccggacgctgaggcacgataa

SEQ ID NO: 81814 - protein, 387 aa, Pseudomonas syringae pv. tomato str. DC3000
MTESKTPDTEAPRSSPAPAPAPLTSPVTSKPRSTRKRVVSSVIFGAVALAGVLLVLYAWQFPPFASPIESTENAQVKGQTTLIAPQLSGYVYEVPVQDFQFVKAGDLLVRLDDRIYRQRLDQALAQLAVQKASLANNLQQRRSAEATIGQRQAELQNSIAQSRKSAADLRRNQALVTDGSVSKSELDVTRAADAQANAAVAEAKAVLLIAREDLQTVIVNRGSLEASVANAQAAIELARIDLDNTRIVAPRDGQLGQIGVRLGAYVNSGAQLMALVPEQRWIVANMKETQMANVRLGQPVSFTVDALDGREMHGHVQRISPSAGSEFSLLPADNATGNFVKISQRIPVRIVVDADQPMLEHLRPGMSVVVSIDTSVEGDEPPDAEAR

SEQ ID NO: 81815 - DNA, 864 bp, Vibrio parahaemolyticus RIMD 2210633
  CDS (1)..(864): transl_table=11
gtgattaaacgttatctcattacccttattttgttgtgtaccgcgggtactgtgctttacacccactaccaaacatacacaaacaatccatggacgcgagacggacaagtgagtgcctatgttatctccattacgcctcgagtcactgggcaggttacacaggtgtatgttgctgataactcaaaagtaaaaaagggagatttgctgtttgagattgatccaagcacatacgctgcgtcttaccacaaagcactggcaaaccagaaacaagcgactgcattgctagcaaaggcacaaaatgaagaacagcgtgcgcgaaaattagagaaacgtacgcacggtgcggtacctgcgttaacacttagcaatttacacaatgccgtacaaacagcgcaggcaaatgttgaacttgcgaaggcgaacattgaagaagcgcagcttaacttggacttcaccaaagtttacgcgccgaccgatggttacatcaccaatctaaacgttcgagtgggctctcaagtggtcgctaactcccctgttgtcgcccttattgatgaaaatagcttctggattgaaggttactttaaagaaacagacctcgcgggcattgcccctaacgaccgcgcaaccgtgacattactcatgcatgatgacgtcgcgttagaaggcaaaatcaaaagtattggttttggcattgcgaaaaaagatggcacaacaggaaatgaccttctgccaacagtgaaccctaactttcagtggattcgcttagctcaacgtatcccagtcaaagtgacattgaatgaaatgccaaaagatctgcagcttcgcgtaggcatgacggcatcgataaaaatcatcaaacactaa

SEQ ID NO: 81816 - protein, 287 aa, Vibrio parahaemolyticus RIMD 2210633
MIKRYLITLILLCTAGTVLYTHYQTYTNNPWTRDGQVSAYVISITPRVTGQVTQVYVADNSKVKKGDLLFEIDPSTYAASYHKALANQKQATALLAKAQNEEQRARKLEKRTHGAVPALTLSNLHNAVQTAQANVELAKANIEEAQLNLDFTKVYAPTDGYITNLNVRVGSQVVANSPVVALIDENSFWIEGYFKETDLAGIAPNDRATVTLLMHDDVALEGKIKSIGFGIAKKDGTTGNDLLPTVNPNFQWIRLAQRIPVKVTLNEMPKDLQLRVGMTASIKIIKH

SEQ ID NO: 81817 - DNA, 1065 bp, Vibrio parahaemolyticus RIMD 2210633
  CDS (1)..(1065): transl_table=11
atgacggctgaccaaaaattcaaacactggatgcgaacgttgattgtcctgttcatcgtactatttttgtacattatcattgctgaccgccacgcccccttaacgaccgaaggacgagtgcaaggatacgttgtccaagtcgcgcccgaggtatctggtaaagtgaccgacgttctcatcgagaataaccagtccgttcaaaaaggcgatgtgttgtttacgattgatgatcgtaaatacaagatagcgcttgaacaggcggagctgtctctgcaatccgcttatgaaaaagaagcaacactgtattctcaacgcgaagccgctcttgccaatattgcccgcgcccaagcgacatttgataatgcgcaccgcgagtacacccgcttactgacactatcgaagcagaaagtcatctctcaatcgacacttgataatgcctttgcccaaaatcaggtatcacgcgcagcgcttaaagcggaacgacaaaacttaaaagtcattgaggcgcaattaggcgatcaaaaaggtcaaagcaccgccgttcgaattgccaaaaacgggatcgaaaaggcgcaacttgatttggcaaataccgcagtactcgctcccagtgatggtgtcgtgaccaacctgcaactagaagttggcacgatggcaaacaccaacatgccattgctgacatttgtaccaacaggatcactctgggtagccgctgattttcgtgaaaagtccgtcgcgaacgtagacaagactttccacgccttggtcacatttgatgccaacccaggttcggtgtacgactttgatttagctagccgcgattacggtgtagcagccgcacaacaaacgcctaatggcgcactaaccaaagtggaagtgaacaaccgctgggtacgtgatgcgcagcgtacacgagtgaacctaaccagcagcgaagagttaccaccagcactgtttgtcggctctcgcgctaccattgttttgtacccagacaacagcattttctggcagttgatggcgcaagcacagattcacctcgcaagctggttccacttcatttactag

SEQ ID NO: 81818 - protein, 354 aa, Vibrio parahaemolyticus RIMD 2210633
MTADQKFKHWMRTLIVLFIVLFLYIIIADRHAPLTTEGRVQGYVVQVAPEVSGKVTDVLIENNQSVQKGDVLFTIDDRKYKIALEQAELSLQSAYEKEATLYSQREAALANIARAQATFDNAHREYTRLLTLSKQKVISQSTLDNAFAQNQVSRAALKAERQNLKVIEAQLGDQKGQSTAVRIAKNGIEKAQLDLANTAVLAPSDGVVTNLQLEVGTMANTNMPLLTFVPTGSLWVAADFREKSVANVDKTFHALVTFDANPGSVYDFDLASRDYGVAAAQQTPNGALTKVEVNNRWVRDAQRTRVNLTSSEELPPALFVGSRATIVLYPDNSIFWQLMAQAQIHLASWFHFIY

SEQ ID NO: 81819 - DNA, 1026 bp, Vibrio parahaemolyticus RIMD 2210633
  CDS (1)..(1026): transl_table=11
atgagcggcgacatcgcgaagcattcttcctccagatctaagctggtaaaaactcttttcttcactctctgtgttattgcatttggtgcgatgtattggtcttggcagtattcagacagtcacccaagcacagaagatgcctatgttagggcaaaaattttgtcggtagcgcctcaggtaaaaggccaagtggtttctgtggatgtcaaagacttccaatctgttaacaaaggtgacctactgctgaagatagattcacgcccatatttgttggcagtgaagcaagcaaaagcggcataccaattggcggtccagcaacatgacgttgccgataagcaggtaactgaagctgttgcgggcttagatgcggcgcgatctaacctgacagaagcgcaagtggagtacaaacgtacggattctctagtgaaacgcaaactggcgtcagaccaagatttagatacggcgaaaaacaaactagccaatgcccaagcgagcctagagcaagcgcgcgcgacggtagaaaaagccattgcgaaccgtggtgaagaaggcgcagaggctgcggtcgttcaacaagctgcagcacagttagcgcaagcggagctgaacttgagctacaccgacattacgtcaccagtggatggcattgccggtgaaatcaatacgcacgtaggctcggtcgttagcgtgggtcaaacgctgttccctgtgattttaaaagacagctattgggtacgcgcgaactttaaagaaaccgatcttactcacatcaaacctggtatgcatgcggatgtggtgattgatatgtacccagacgtggtgtggaaagcaacggtagagcagctgtcgcctgcgagtggtacatcgttctccttgatgccaccagaaaacgcaacgggtaactgggttaaaatcaaacagcgtttccctgtacgtttggcattagaagtaccggccgatgcgccgcaacttcgcgtgggtgcgagctcagaagtcaccattgatttgcaaagtagcgtgcaatga

SEQ ID NO: 81820 - protein, 341 aa, Vibrio parahaemolyticus RIMD 2210633
MSGDIAKHSSSRSKLVKTLFFTLCVIAFGAMYWSWQYSDSHPSTEDAYVRAKILSVAPQVKGQVVSVDVKDFQSVNKGDLLLKIDSRPYLLAVKQAKAAYQLAVQQHDVADKQVTEAVAGLDAARSNLTEAQVEYKRTDSLVKRKLASDQDLDTAKNKLANAQASLEQARATVEKAIANRGEEGAEAAVVQQAAAQLAQAELNLSYTDITSPVDGIAGEINTHVGSVVSVGQTLFPVILKDSYWVRANFKETDLTHIKPGMHADVVIDMYPDVVWKATVEQLSPASGTSFSLMPPENATGNWVKIKQRFPVRLALEVPADAPQLRVGASSEVTIDLQSSVQ

SEQ ID NO: 81821 - DNA, 1176 bp, Vibrio parahaemolyticus RIMD 2210633
  CDS (1)..(1176): transl_table=11
atgaaactcaataaaaaatggctcgttttgtgtggcctacttgctattggtgctggtggttatcattatctgcaacgtccagaacccatttctccttacgcgacagaagtcgttcgcaaaggcaatatcgaaaaggcggtattagccaacggcatgttgcaagcgtccaaattggtgaatgtaggtgcgcaagtatctgggcaaattcaacgcctcgctgtgaacttaggggatgagatcaaacagggagatttgattgcacagattgacagcctgactcagcaaaacagcctcaaagaagcccaagcgtctcttaatagtctcaacgctcagtaccaggctaagcaagcgcagattaaacaagcaaactatgaatacgtgcgccaaaaaggcatgttggcagcgaaagcgagctcacgagctgattacgagaatgccgaagcgacgctcgccatctacaaagccgagttagcgcaactggatgccgaaatcgagaaagccaaaatcaacgtcgacaatgcgcagttagatctcggttacaccaccatcaacgcaccgatggatggcacggtggtttacaccgcggtggaagaaggacaaaccgtaaacgccaatcaaaccacgccaactattatcgagttagccaagttagatacgatgacggtgaaagccgaaatttcggaagccgatgtgatttttgttcacccaggccaaacggcgctgttcaccattttaggcaaaccgaatcagcagtttaaaggtacattgcgcgccattgagccggggccaaccatcatggatggcgatgacagcgatttgagcatttcagatagcgatgccatttactacaacgctgtatttgatgtgaagaacccgcaaggtattttgcgcatcggcatgactgcgcaagtttcgattgtccttgagcaatcggaaaataccttgattgtcccttcacaagtgctgcaaaaatctggcggcaaaggcaactataccgtgccagtgcttgaacagggccaagtggtgcaaaagcccgtgacagtgggtattaacaacaaagtgaacgcagaaattctctcaggtttgaaggagggcgaccaagttgttcttggcaatgctatggatggagaatcatcaagccgaggtgatcgtcgtcgacctccaatgaggttctaa

SEQ ID NO: 81822 - protein, 391 aa, Vibrio parahaemolyticus RIMD 2210633
MKLNKKWLVLCGLLAIGAGGYHYLQRPEPISPYATEVVRKGNIEKAVLANGMLQASKLVNVGAQVSGQIQRLAVNLGDEIKQGDLIAQIDSLTQQNSLKEAQASLNSLNAQYQAKQAQIKQANYEYVRQKGMLAAKASSRADYENAEATLAIYKAELAQLDAEIEKAKINVDNAQLDLGYTTINAPMDGTVVYTAVEEGQTVNANQTTPTIIELAKLDTMTVKAEISEADVIFVHPGQTALFTILGKPNQQFKGTLRAIEPGPTIMDGDDSDLSISDSDAIYYNAVFDVKNPQGILRIGMTAQVSIVLEQSENTLIVPSQVLQKSGGKGNYTVPVLEQGQVVQKPVTVGINNKVNAEILSGLKEGDQVVLGNAMDGESSSRGDRRRPPMRF

SEQ ID NO: 81823 - DNA, 891 bp, Vibrio parahaemolyticus RIMD 2210633
  CDS (1)..(891): transl_table=11
atgaaaaaactattcgtaatcgcactcaatcttgtcattcttggtggcgcagcttggctcggctatcaaaaatttgaagagtattttaataatccatggacacgcgatggccaagtacgcgcgaacgtcatcaaggtcgcaccgcgagtgtctggcccaattgtgaatgtttcggtgcaagacaaccaagaagtgaaaacgggcgatttactgtttgaaatcgacccaaccacttacgaagtcgcactatctcaagccgaagtggcgttggaaaaatccatcgtgagctctcgcggtaaaaaaatcgaatacgatcgccttaaagacattcgtgcgaaagaccgcggcgctgtttctcacaaggatctgattcgtcgtgaaatagcttacgaagaatcgctactgcaaatcaaatctgcagaagagcaattaaagtcagcgcgccttaacctcagtttcaccaaagtttatgcgaccgtcgatggttttgtgtctaacctcgatattcgaaacggtacacaagcggtcgcaaaccaaccgctgctcgcactgatcgacaaaaacagtttctgggtatttggcttcttccgcgaaaaccaactcgcgcaaatcgaaccgggtagccgagctcgtgtcaccttgatgtctcacccagacacgcctatcgacgcgaccgttgactctatcggttggggtattgcgccgaaagacggcacggtcggttacaaccttcttccaaacgtgaaccctgtttttcagtggattcgcttagcacaacgtattccggtacgaatctccatccaagagcttcctgaagatgttgatcttcgattcgggctttctgcgtccattatggtgatgaaagattcatcggcagaaaatgaacagtaa

SEQ ID NO: 81824 - protein, 296 aa, Vibrio parahaemolyticus RIMD 2210633
MKKLFVIALNLVILGGAAWLGYQKFEEYFNNPWTRDGQVRANVIKVAPRVSGPIVNVSVQDNQEVKTGDLLFEIDPTTYEVALSQAEVALEKSIVSSRGKKIEYDRLKDIRAKDRGAVSHKDLIRREIAYEESLLQIKSAEEQLKSARLNLSFTKVYATVDGFVSNLDIRNGTQAVANQPLLALIDKNSFWVFGFFRENQLAQIEPGSRARVTLMSHPDTPIDATVDSIGWGIAPKDGTVGYNLLPNVNPVFQWIRLAQRIPVRISIQELPEDVDLRFGLSASIMVMKDSSAENEQ

SEQ ID NO: 81825 - DNA, 870 bp, Salmonella enterica subsp. enterica serovar Typhi Ty2
  CDS (1)..(870): transl_table=11
gtggtaaatatgtcgttaaaaacaataaaatatttttctactctcattgtcgccgtcgtcgccgttctggccgcgtggtggttatggaattactatatgcagtcaccgtggacgcgcgatggtaaaatccgcgcggaacaggtcagcgtaacgccacaggtttctggcagcattacccaactcaatatcaaagataatcagttcgtcaacgctggggacgttctctttgtcattgataaaacgcccttccatattgcagaacttaacgcgcaggcacagttggccaaagcgcagtccgatctggcaaaagcgaataatgaagccgatcgacgtcgacatttatcgcgtaactacatctctgctgaagatctggatagcgccaatctgaatgttaaagcgatgcaggccagcgtagatgtcgcactggcaacgttaaaacaggcgcagtggcagcttagccagacggaagtaaaagcgccggtatccggctgggtgaccaacctttccacgcgtaccggtgattatgctagcaccggtaagccacttttcgccctggtagatagccattcattttatgtaatgggatatttcgaagaaaccaaactacgccatatccgcgaaggtgagcctgcattaataacactgtatagtggcaatgttaagttacagggtcacgttggcagtatcgggcgcgctatttacgaccaaagcgtggaaagtgactccggtttagtgcccgatatcaaacccaacgtaccgtgggtacgtctggcgcaacgcgtaccggtacgtatcgaatttgacgctttgccgcaggatatcacgctcgtctccggcactacctgcagcgtagccattggacagcggtaa

SEQ ID NO: 81826 - protein, 289 aa, Salmonella enterica subsp. enterica serovar Typhi Ty2
MVNMSLKTIKYFSTLIVAVVAVLAAWWLWNYYMQSPWTRDGKIRAEQVSVTPQVSGSITQLNIKDNQFVNAGDVLFVIDKTPFHIAELNAQAQLAKAQSDLAKANNEADRRRHLSRNYISAEDLDSANLNVKAMQASVDVALATLKQAQWQLSQTEVKAPVSGWVTNLSTRTGDYASTGKPLFALVDSHSFYVMGYFEETKLRHIREGEPALITLYSGNVKLQGHVGSIGRAIYDQSVESDSGLVPDIKPNVPWVRLAQRVPVRIEFDALPQDITLVSGTTCSVAIGQR

SEQ ID NO: 81827 - DNA, 1029 bp, Bacteroides thetaiotaomicron VPI-5482
  CDS (1)..(1029): transl_table=11
atgagagctcgcaacatcatattaaatatggtgtgtgtatgtttggctgtctccgggctctggtggactattacttatttttggcgttacattaactacgaagtgaccaatgatgcttttgtagaccaatacgttgctccgttaaatatacgtgcttcgggatatatcaaggatatccgtttcaaggaacatcaatatgtgcgtcagggagataccttgttagtgctcgataaccgtgaatatcaaattaaagtgaaggaagccgaagcagctctgctggatgcgcacggtttgcaggatgttcttcactcaggtatcgaaacttcccatactaatatagccgtgcaggatgccaatatagccgaagcgaaggcgaagctctggcaattggaacaggactatcatcgctttgaacgtttgctgaaagaagaatcggtgccggaacaacagtacgagcagaccaaagccgcgtatgaagcagctgaggcacgctatcaggcattagtcgcacaaaaacaggctgctttgtcgcaatatgcggaaacgagtaaaaagacaaccggagttcaagccggtatcttgcgtaaagaagcggatttggatttggctaaattgaacttgtcttatacggtactcactgctccatacgatggatatatgggcaggcgcaccttagaacccggacagtatgtccagacggggcaaaccatctcttatctggtacgcaacaaggataaatggattactgctaattataaggaaacacagattgccaatatctatattggtcagcaggtacgtgttaaagtagatgcgttgcccgggaagatttttaacggggaagtcactgctatctcggaggcaaccgggtcgaaatattctctggttcccacagacaattccgcgggaaactttgtaaaagtacaacagcgtatcccggtacggatagaactggagaatatctcttcagaagaaatggcacaattaagagcgggtatgatggttgaaacagaagctttgcgcaaatga

SEQ ID NO: 81828 - protein, 342 aa, Bacteroides thetaiotaomicron VPI-5482
MRARNIILNMVCVCLAVSGLWWTITYFWRYINYEVTNDAFVDQYVAPLNIRASGYIKDIRFKEHQYVRQGDTLLVLDNREYQIKVKEAEAALLDAHGLQDVLHSGIETSHTNIAVQDANIAEAKAKLWQLEQDYHRFERLLKEESVPEQQYEQTKAAYEAAEARYQALVAQKQAALSQYAETSKKTTGVQAGILRKEADLDLAKLNLSYTVLTAPYDGYMGRRTLEPGQYVQTGQTISYLVRNKDKWITANYKETQIANIYIGQQVRVKVDALPGKIFNGEVTAISEATGSKYSLVPTDNSAGNFVKVQQRIPVRIELENISSEEMAQLRAGMMVETEALRK

SEQ ID NO: 81829 - DNA, 1092 bp, Bacteroides thetaiotaomicron VPI-5482
  CDS (1)..(1092): transl_table=11
atggaaacaatggacaataatacaatctccagtacgcatcaggagaaagctaagaaaatgagaaaattacgccgctggcagattatagtaagtctgtttggagttgctgtgattgtttggggagtaattgaaattgtttttctctttctgggctataagcagacggaaaccagcaatgatgcgcagatagagcaatatgtgtcacctgtcaatctgcgtgcatcgggctatattaataagatttattttacggaacatcagcaggtacgtaaaggtgataccttgctggtgctggacgaccgcgaatataaaatccgggtgatggaagctgaggctgcattgaaggatgcgcaggcaggcgccactgtgataaatgctaccttgcagactacacaaacgactgcatctgtgtatgatgcgtctatagctgaaatagaaatccggctagcaaaactggagaaagaccgtcagcggtatgaaaatttggtcaaacgaaatgcggcgacacctatccagttggaacagattacaacagagtatgaagctacctttaagaagctggaagcaaccaggcgccagcgggaggcggctctttcgggagtgaatgaagtatctcaccgtcgtgagaatacggaagctgccatccagcgtgctacggctgcgcttgaaatggcacggctgaatctttcgtatacggttgtactggctccttgcgatggcaagttaggcagacgttctctggaagaagggcagttcattacagcagggcaatgcattacatatattctgcccgatacacaaaaatggattattgctaattataaagaaacgcagatagagaatctccgcatcgggcaggaggtggctatcacggtagatgctatcagtaagaaagagtttacaggcaaagtgactgctatttccggagcgacaggttctaaatattcgttggtgccgactgacaattctgccggaaactttgtgaaaatacagcagcgtatccctgtccgtattgattttacggatttatcgaaggaagataatgataagctggcggcgggtatgatggtagtagtaaaagctaaactctga

SEQ ID NO: 81830 - protein, 363 aa, Bacteroides thetaiotaomicron VPI-5482
METMDNNTISSTHQEKAKKMRKLRRWQIIVSLFGVAVIVWGVIEIVFLFLGYKQTETSNDAQIEQYVSPVNLRASGYINKIYFTEHQQVRKGDTLLVLDDREYKIRVMEAEAALKDAQAGATVINATLQTTQTTASVYDASIAEIEIRLAKLEKDRQRYENLVKRNAATPIQLEQITTEYEATFKKLEATRRQREAALSGVNEVSHRRENTEAAIQRATAALEMARLNLSYTVVLAPCDGKLGRRSLEEGQFITAGQCITYILPDTQKWIIANYKETQIENLRIGQEVAITVDAISKKEFTGKVTAISGATGSKYSLVPTDNSAGNFVKIQQRIPVRIDFTDLSKEDNDKLAAGMMVVVKAKL

SEQ ID NO: 81831 - DNA, 996 bp, Coxiella burnetii RSA 493
  CDS (1)..(996): transl_table=11
atgataaaaaaatttgttaaagtcattctgcctcttttcataatcgcgattctttccatcggcggttatttttactggcaacatcaaaaccgctaccccagcacagatgacgcctacatccaagctgacgttattaacgtagcttctcgggttagcgggaccgtaagcgagatcgatgttcgcaatgaagaacatgtccaaaaaggacaactcctattcaccattgacccagcgccgtttaccatcgagcttaataaggcgcaagcgcaacgagatgctacccgccaaaaaattcaagcggctgatatggcagtaaaatccgctagggccaccgtggtagaaagaaaagcagaacttacccatacccgtctggaaacaaaacgtatactcaccttaatgaaaaagcaatttgtttctcgctcggacggtgacctcgctattaaaaatttacatgttgctgaagctgccctgaatgcagcacaaaaccaattggaagaaatgattgaaaaacgcggtgaattaggcgacaaaaacgcccaattgcgtctagcgcaagctgccgttgaaaaagccaaattagatttgcaatacactcgcgtttttgcgcccacttcaggctacatcgctaattttaatttacggcacggcgatgtagtgagcgcttatcaacctttattcgctttaatcgaagaccaaacctggtgggctcaagccaattttaaagagacccaactggctcgtattcacactggcgaacaagccaccatcaagttagacatgtaccctcatcaaatatttatcggcaaagtcgtcgatgttaacaaagacagcggcagtagtttttccttgctaccccctgaaaacgctagcggcaattgggttaaagtcactcagcgttttccagtcaaggtcattattacccaacgcaaatcgggctatcctcttcgtttgggcgccagtagcacggttaccatagacacgacctctccaaaataa

SEQ ID NO: 81832 - protein, 331 aa, Coxiella burnetii RSA 493
MIKKFVKVILPLFIIAILSIGGYFYWQHQNRYPSTDDAYIQADVINVASRVSGTVSEIDVRNEEHVQKGQLLFTIDPAPFTIELNKAQAQRDATRQKIQAADMAVKSARATVVERKAELTHTRLETKRILTLMKKQFVSRSDGDLAIKNLHVAEAALNAAQNQLEEMIEKRGELGDKNAQLRLAQAAVEKAKLDLQYTRVFAPTSGYIANFNLRHGDVVSAYQPLFALIEDQTWWAQANFKETQLARIHTGEQATIKLDMYPHQIFIGKVVDVNKDSGSSFSLLPPENASGNWVKVTQRFPVKVIITQRKSGYPLRLGASSTVTIDTTSPK

SEQ ID NO: 81833 - DNA, 1191 bp, Bordetella pertussis Tohama I
  CDS (1)..(1191): transl_table=11
atgagcccctccccgaccacccaccccgcccgcaaacgcctgctgtggctggcaaccggtgtgttcgccgtgctggccatcgcctatgccgtctggtgggcgctgttcggctcgcacttcgagagcaccgacgacgcctatgtccacggcaacctggtgcagatcacgccgcaggtgcccggcaccgtcgtcgccatcgaggccgacgacaccgaggccgtgacggcgggccaggcgctggtgcggctggatccggccgacaccgacgtggcgctgcagcaggccgaggcgcgcctggcccagacggtgcgccaggtccgcacgctctacgtccagaacgacgccctggccgccgacatcgacgtgcggcaggccgagatcgcgcgcgcccaggccgacctgaagcgcgcccagagcgacctgcagcggcgccagacgctggccaagtcgggcggcgtcagcggcgaggaaatcctgcacgccgagaccgcgctcaagtccgcccagtcggccctggcgcaggcgcgcgccaacctggccgccgcccaggccaagctggcgaccaaccaggcgctgaccgagggcacgacggtggccgaacatccggacgtgcgcaatgccgccgcccaggtgcgcaatgcctggctgaaccgttcgcgcaccgtgctgccggcgccagtcgacggcatcgtggcgcgccgcgccgcgcaggtcggccagcgcgtcgcccccggcgccatgctgatgaacgtggtgccgctggaccagatctgggtcgaggccaatttcaaggaagggcagctgcgccacatgcgcatcggccagcccgccaggatcacggccgacctgtacggcggttcggtggtctacgacggcaaggtcatcggcctggacgccggcaccggcagcgccttcgcgctgctgccggcgcagaacgcctcgggcaactggatcaaggtggtgcagcgggtgccggtgcgcatcgcgctggacccggagcagctcaagacccatccgctgcgcgtgggcctgtccatggacgtcgaggtcgatgtcggggccgaggaaggccagcccgtgaccgccgcgccgcgcgccgaaccggccctctcgacccaggtgttcgagccggcgcacgatgaagccgacgcgctgatcgcgcgcatcatccaggccaacctcgcatcatga

SEQ ID NO: 81834 - protein, 396 aa, Bordetella pertussis Tohama I
MSPSPTTHPARKRLLWLATGVFAVLAIAYAVWWALFGSHFESTDDAYVHGNLVQITPQVPGTVVAIEADDTEAVTAGQALVRLDPADTDVALQQAEARLAQTVRQVRTLYVQNDALAADIDVRQAEIARAQADLKRAQSDLQRRQTLAKSGGVSGEEILHAETALKSAQSALAQARANLAAAQAKLATNQALTEGTTVAEHPDVRNAAAQVRNAWLNRSRTVLPAPVDGIVARRAAQVGQRVAPGAMLMNVVPLDQIWVEANFKEGQLRHMRIGQPARITADLYGGSVVYDGKVIGLDAGTGSAFALLPAQNASGNWIKVVQRVPVRIALDPEQLKTHPLRVGLSMDVEVDVGAEEGQPVTAAPRAEPALSTQVFEPAHDEADALIARIIQANLAS

SEQ ID NO: 81835 - DNA, 1182 bp, Bordetella parapertussis 12822
  CDS (1)..(1182)
atgattgtttcacgccatcgtattgcgctgttggcggtcgtcgcgacgctgcttgcagcgggcggcgcctattccctgctccgctcgccgggcggccccgcccaggcccaggccgtcccggcggccgcgccggtggacgtcgcgccggcgctgggccgcaccatcgtggactggcagcgctactcgggccgcctggaagccatcgaccgcatcgacatccggccgctggtctccggcaccctgaccgaggtccatttccaggatggcagcctggtgaaaaagggcgacgtgctgttcaccatcgatccgcggccctatgtggccgaggtcgaccgggcgcgcgcggcgctggcggcggcgcgcgcccgcgtgtcgtacaccgccgccgacctggcgcgcggccagcgcctgctggccgagaacgcgatcgcccggcgcgatttcgaggaaaagcagaacgccgcccgcgaagccgccgccaacctgcagggcgcgcaggccgccctggagtcggccgagctgaacctgggctatacgcgcatcgccgcgccggtcgatggccgcgtgtcgcgcgccgaggtgacggtgggcaacgtcgtggccgccggcgccgcgtcggtgccgctgaccacgctggtatcggtggcccgcatgtatgcctcgttcgatgtggacgagcagaccttcctcaagtatgtgaatccggcgcgcaacggcacggtgccggtgcagctgggactggccaacgaagacggctactcgcgcgaaggccgggtgcaatcggtggataaccgcatggatcccacctcgggcaccatccggatgcgcgccgtgttcgacaacgccgacggcagcctggtgccaggcctgtacgcccgcatccgcctgggcggcggcgcgccgcgcgacgcggtgctggtcgacgaacgggccatcggcaccgaccagaacaagcgcttcgtgctggtgctggaggaaggcaaccgcaccgcctaccgcgaggtgctgctgggcgccaacgtcggcccgctgcgcgtgatcgagaacggcctgcacgcgggcgagcgcatcgtcgtcaacggcctgcagcgcgtgcgcccgggcgatgtggtcgcgcccagccaggtttccatggacacggcgccgggcgcggtcaagaccgcggcggcggcgctgcgctga

SEQ ID NO: 81836 - protein, 393 aa, Bordetella parapertussis 12822
MIVSRHRIALLAVVATLLAAGGAYSLLRSPGGPAQAQAVPAAAPVDVAPALGRTIVDWQRYSGRLEAIDRIDIRPLVSGTLTEVHFQDGSLVKKGDVLFTIDPRPYVAEVDRARAALAAARARVSYTAADLARGQRLLAENAIARRDFEEKQNAAREAAANLQGAQAALESAELNLGYTRIAAPVDGRVSRAEVTVGNVVAAGAASVPLTTLVSVARMYASFDVDEQTFLKYVNPARNGTVPVQLGLANEDGYSREGRVQSVDNRMDPTSGTIRMRAVFDNADGSLVPGLYARIRLGGGAPRDAVLVDERAIGTDQNKRFVLVLEEGNRTAYREVLLGANVGPLRVIENGLHAGERIVVNGLQRVRPGDVVAPSQVSMDTAPGAVKTAAAALR

SEQ ID NO: 81837 - DNA, 1182 bp, Bordetella bronchiseptica RB50
  CDS (1)..(1182)
atgattgtttcacgccatcgtattgcgctgttggcggtcgtcgcgacgctgcttgcagcgggcggcgcctattccctgctccgctcgccgggcggccccgcccaggcccaggccgtcccggcggccgcgccggtggacgtcgcgccggcgctgggccgcaccatcgtggactggcagcgctactcgggccgcctggaagccatcgaccgcatcgacatccggccgctggtctccggcaccctgaccgaggtccatttccaggatggcagcctggtgaaaaagggcgacgtgctgttcaccatcgatccgcggccctatgtggccgaggtcgaccgggcgcgcgcggcgctggcggcggcgcgcgcccgcgtgtcgtacaccgccgccgacctggcgcgcggccagcgcctgctggccgagaacgcgatcgcccggcgcgatttcgaggaaaagcagaacgccgcccgcgaagccgccgccaacctgcagggcgcgcaggccgccctggagtcggccgagctgaacctgggctatacgcgcatcgccgcgccggtcgatggccgcgtgtcgcgcgccgaggtgacggtgggcaacgtcgtggccgccggcgccgcgtcggtgccgctgaccacgctggtatcggtggcccgcatgtatgcctcgttcgatgtggacgagcagaccttcctcaagtatgtgaatccggcgcgcaacggcacggtgccggtgcagctgggactggccaacgaagacggctactcgcgcgaaggccgggtgcaatcggtggataaccgcatggatcccacctcgggcaccatccgggtgcgcgccgtgttcgacaacgccgacggcagcctggtgccaggcctgtacgcccgcatccgcctgggcggcggcgcgccgcgcgacgcggtgctggtcgacgaacgggccatcggcaccgaccagaacaagcgcttcgtgctggtgctggaggaaggcaaccgcaccgcctaccgcgaggtgctgctgggcgccaacgtcggcccgctgcgcgtgatcgagaacggcctgcacgcgggcgagcgcatcgtcgtcaacggcctgcagcgcgtgcgcccgggcgatgtggtcgcgcccagccaggtttccatggacacggcgccgggcgcggtcaagaccgcggcggcggcgctgcgctga

SEQ ID NO: 81838 - protein, 393 aa, Bordetella bronchiseptica RB50
MIVSRHRIALLAVVATLLAAGGAYSLLRSPGGPAQAQAVPAAAPVDVAPALGRTIVDWQRYSGRLEAIDRIDIRPLVSGTLTEVHFQDGSLVKKGDVLFTIDPRPYVAEVDRARAALAAARARVSYTAADLARGQRLLAENAIARRDFEEKQNAAREAAANLQGAQAALESAELNLGYTRIAAPVDGRVSRAEVTVGNVVAAGAASVPLTTLVSVARMYASFDVDEQTFLKYVNPARNGTVPVQLGLANEDGYSREGRVQSVDNRMDPTSGTIRVRAVFDNADGSLVPGLYARIRLGGGAPRDAVLVDERAIGTDQNKRFVLVLEEGNRTAYREVLLGANVGPLRVIENGLHAGERIVVNGLQRVRPGDVVAPSQVSMDTAPGAVKTAAAALR

SEQ ID NO: 81839 - DNA, 894 bp, Bordetella bronchiseptica RB50
  CDS (1)..(894)
atgaaattcccgcaatcgctgcgtgctgccgcgctcggcaaattcgccgtcaccgctgccgtcgtggccgctgccgtgtatgccggctggcagctatgggcgcattacgaactcgaaccctggacgcgcgacggccgggtcaaggcctatgtggtgcaggttgcccccgacgtctcggggctggtgaccgccgtaccggtgcgcgacaaccaggacgtgcaggccggcgacgtcctgttcgagatcgaccgggcgcgcttccagctggcctgcgaccaggcgcaggcggcgctgcgcgcgcagcaggtggcgcacgagcaggcgctgcgcgacgtcaagcgcaatcgcgccctgggccagctggtggccgccgaagcgctcgaacagagccaggcgcgcctgcagcagatcgaggccgcgcgcgcgcaggccgaagtgcagctggacaccgcccggctcaacctggcgcgcagccgcgtggtggcgggcgtggccggacggatcaccaacctggacctgcgcgccggctcctacgccagcgccggcaagcccgtgatggcgctggtcgacgccggctcgttctacgtcgaaggctatttcgaggaaaccaagctggcgcgcatccatgaaggcgatggcgtcaccgtcacgctgatgggcgattcgcgcgcgatccacggccatgtcgagagcatcgcgctgggcatcgccgaccgcgaccgcagcaccggcgccaatctgctgcccaacgtcaatccgaccttcaactgggtgcggctggcccagcgcatcccggtgcgcgtacggatcgaccaggtgcccgccggcgtgcggctggtggccggccagaccgccaccgtcgccatcgaccaagccggcccccgcccatcctga

SEQ ID NO: 81840 - protein, 297 aa, Bordetella bronchiseptica RB50
MKFPQSLRAAALGKFAVTAAVVAAAVYAGWQLWAHYELEPWTRDGRVKAYVVQVAPDVSGLVTAVPVRDNQDVQAGDVLFEIDRARFQLACDQAQAALRAQQVAHEQALRDVKRNRALGQLVAAEALEQSQARLQQIEAARAQAEVQLDTARLNLARSRVVAGVAGRITNLDLRAGSYASAGKPVMALVDAGSFYVEGYFEETKLARIHEGDGVTVTLMGDSRAIHGHVESIALGIADRDRSTGANLLPNVNPTFNWVRLAQRIPVRVRIDQVPAGVRLVAGQTATVAIDQAGPRPS

SEQ ID NO: 81841 - DNA, 1143 bp, Chromobacterium violaceum ATCC 12472
  CDS (1)..(1143): transl_table=11
atgagcgaaaacgcacaagccctgccggccgccgcggcgcccgccgccgccggccgtcccctgcaacgcaagaagctgttcacgctgctgttcggcgccgtcgccgccgcggccgtcgcctacggcggctactggacgctgatcgcctcccatcgcgtcagcaccgacaacgcctatgtcgccgccgagatcgcccaggtcacgcccgaggtggccggcaccgtcaaggaagtgaaggtggtcgacacccagccggtgaaggccggcgaggtgctggtggtgctgaacgacagcgacgccaggctggcgctggcccaggccgaggccgacctcgcccgcgccgagcgccgggtgaagggctacttcgccaacgacgagggcctgtcggcccaagcccaggcgcgcagcgccgaccaggcccgctccgccgcgcagctgggatcggcccgcgccgacctggcgcgcgccaggctcgacctgcagcgccgccaagcgctggcaaagagcggctcggtgtccggcgaggagctgagcaacgcgcagaacgcctactccaccgcgcaggccagcctgaaggccgccgaggccgccagccgccagagcgaggccaactaccgcgccgccgtcggcagcctgaaggccaaccagacgctgaccgcaaacaccacggtggacgacaaccccgaagtgacgctggcgcgcgccaagcgcgaccaggccaggctggacctggaacgcacggtgatccgcgcccaggtggacggcgtggtggccaagcgccaggcccaggtgggccagcgcgtgcagtccggcacgccgctgatgtcggtggtgccgctgcagaacgcccacgtcgacgccaacttcaaggaagtgcagttgaacaaggtacgcgtcggccagccggtggagctgaccgccgacctctacggcaacaaggtggtgtaccacggcaaggtggccggcctgtccggcggctctggttcggccttcgcgatgattccggcgcagaacgccaccggcaactggatcaaggtggtgcagcggctgccggtgcgcatcgcgctggaccaggcggagctgaaagcccatccgctgcaggtggggctgtcgatggaagccacgatagacgtcagcgagtga

SEQ ID NO: 81842 - protein, 380 aa, Chromobacterium violaceum ATCC 12472
MSENAQALPAAAAPAAAGRPLQRKKLFTLLFGAVAAAAVAYGGYWTLIASHRVSTDNAYVAAEIAQVTPEVAGTVKEVKVVDTQPVKAGEVLVVLNDSDARLALAQAEADLARAERRVKGYFANDEGLSAQAQARSADQARSAAQLGSARADLARARLDLQRRQALAKSGSVSGEELSNAQNAYSTAQASLKAAEAASRQSEANYRAAVGSLKANQTLTANTTVDDNPEVTLARAKRDQARLDLERTVIRAQVDGVVAKRQAQVGQRVQSGTPLMSVVPLQNAHVDANFKEVQLNKVRVGQPVELTADLYGNKVVYHGKVAGLSGGSGSAFAMIPAQNATGNWIKVVQRLPVRIALDQAELKAHPLQVGLSMEATIDVSE

SEQ ID NO: 81843 - DNA, 1149 bp, Chromobacterium violaceum ATCC 12472
  CDS (1)..(1149): transl_table=11
atggatcagaaactggaaaccgcgaagactcgcaaacgcaacctgctggtggccaccaccctgttcgccgccatcgccatcggctacggcgcctattgggcgctggtgctgagccaccaggaagacaccgacgacgcctatgtcggcggccacctggttcaggtcaccccggaagtgggcggcaccgtcgccaagattctggtcgacgacaccgtggcggtgaaggccggccaggtgctggtcagctatgacaacagcgacgcccagctggccttcgagcgcgcccgcaacgaattcgcccagaccgtgcgccagacccgccagctgatggccaacagccagcagctggacgcccaggtggcgctgcgccaggccgagctgtcccgcgccgaatccgacctgaagcgccgcaagctgctggccggcagcgaggcgatgtccgccgaggagctgggccacgcgagcgacgccgtcgccgccgcccaggccgcgctggccgccgcgcaggaacaggccaaggccggcctggcgctggtgggcaaggacgagctggcgcaccagcccgcggtgaaggccgccgccagccgcctgaaggaagcctggctcgcgctgcagcgcaccgaaatcaagtcgccggtcaacggcaccgtcgcccgccgcaacgtgcaggtcggccagcgcgtcgccgccggcacgccgctgatggccgtggtgccgctggagcatctgtgggtggacgccaacttcaaggaaggccaactggccaagatccgcatcggccagccggtggagctgaagtccgacctgtacggcggcaaggtggtctaccacggcaaggtgcagggcctgtctgccggcaccggcagcgccttctcgctgctgccggcgcagaacgccaccggcaactggatcaaggtggtgcagcgcgtgccggttcgcatcgcgctcgaccccaaggatctgcaggagcacccgctgcgcgtcggcctgtcgatcgacgcggtggtggacaccagcgaccaggacggcaaatcgctggccgaagccgccccggcgaccgtggtcagcgaacacaacggcaccctgcccgacctgaagcaggccgacaagctggtcgcagaaatcctggccgccaacgccggcaagtaa

SEQ ID NO: 81844 - protein, 382 aa, Chromobacterium violaceum ATCC 12472
MDQKLETAKTRKRNLLVATTLFAAIAIGYGAYWALVLSHQEDTDDAYVGGHLVQVTPEVGGTVAKILVDDTVAVKAGQVLVSYDNSDAQLAFERARNEFAQTVRQTRQLMANSQQLDAQVALRQAELSRAESDLKRRKLLAGSEAMSAEELGHASDAVAAAQAALAAAQEQAKAGLALVGKDELAHQPAVKAAASRLKEAWLALQRTEIKSPVNGTVARRNVQVGQRVAAGTPLMAVVPLEHLWVDANFKEGQLAKIRIGQPVELKSDLYGGKVVYHGKVQGLSAGTGSAFSLLPAQNATGNWIKVVQRVPVRIALDPKDLQEHPLRVGLSIDAVVDTSDQDGKSLAEAAPATVVSEHNGTLPDLKQADKLVAEILAANAGK

SEQ ID NO: 81845 - DNA, 876 bp, Chromobacterium violaceum ATCC 12472
  CDS (1)..(876): transl_table=11
atgaacaaccgcattcgcaaagccgggtccgtgctgctgaccctggccaccgtcgccgtcgccatcgtggtggtgcggcatatctggatctactacaccgacgcgccatggacccgcgacggccatatcgccgccgacgtggtgcaggtggcgccggacgtgtccgggctgatcaccgaagtgaaagtctcggacaaccagctggtcaagaaaggccaggtgttgttcgtggtggaccgcgcgcattacgaactggcgctgcgccaggccgaagccgccctcgccgcgcagcgcgccacgctggcccaagcccgccgcgaggccgcgcgcaaccactcgctgaccgacctggtagccgccgaggcccgcgaggaaggcgacgccaaggtgcagttgggcgaggccaccctggccgccgccgaggccgccgtcggcctggcccggctgaacctggagcgcaccacgatcaaaagcccggtggacggctatctgaacgaccgcaccccgcgcgccggcgactacgccgccagcggccgcgcggtgctgtccatcgtcgactcccattccttccacgtggacggctacttcgaggaaaccaagctgggcggcgtggagctcaaccagccggtggacatccggatcatgggcgaatcgcgcaagctgcgcggccacgtgcagagcatcgccgccggcatcgaaaaccgcgaccgcagcaacggcgcctcgctgctgcccaacgtcaaccccaccttcaactgggtgcggctggcgcagcgcatcccggtccggatcgcgctggacgaagtgccggccaatttccggctgatcgccggccgcaccgccaccgtgtcggtgcgccagggaggccgttcatga

SEQ ID NO: 81846 - protein, 291 aa, Chromobacterium violaceum ATCC 12472
MNNRIRKAGSVLLTLATVAVAIVVVRHIWIYYTDAPWTRDGHIAADVVQVAPDVSGLITEVKVSDNQLVKKGQVLFVVDRAHYELALRQAEAALAAQRATLAQARREAARNHSLTDLVAAEAREEGDAKVQLGEATLAAAEAAVGLARLNLERTTIKSPVDGYLNDRTPRAGDYAASGRAVLSIVDSHSFHVDGYFEETKLGGVELNQPVDIRIMGESRKLRGHVQSIAAGIENRDRSNGASLLPNVNPTFNWVRLAQRIPVRIALDEVPANFRLIAGRTATVSVRQGGRS

SEQ ID NO: 81847 - DNA, 1185 bp, Photorhabdus luminescens subsp. laumondii TTO1
  CDS (1)..(1185): transl_table=11
atgagcgaaaatgaggcaatagaagtacaagcggcacaagatccaaccagtagtaaaaaaaggcaacgcagtcgtgccttagtgctactaacccttatctttaccctgctcggtgttgcctactttttctattggtttctcattttacgccaccatcaagaaacagataacgcctacgttacaggtaatcaagttcagatcatgtcacaagttgctggcagcgtaattacagttaactttgataatactgactttgtgaaaagcggcagtatattggtgcaactcgatccccgtgatgcagaattagcattagaaaaagcaaaaacaacattagccaacagcgttcgccagactcatcaacagatagttaacagcaaacaatatcaggctaacatcgctctacgcagatccgaattaactaaagttcaaaatgatcttagccgtcgtgaaatacttagcgttcaaaaagtcattggtaaagaagagttacaacatgcacaggaagctgtcgccagtgcccgagctgctctagatattgcaattgaacaatacaacgctaatcaagcaattgtcttggatacacccctagagaaacaacctgccattgaacaagctgcaacggaagtccgtaatgcctggctggcattacaacgcacgaaaatagtcagcccaatcgatggttatgtctcacgccgtagtgtacaagttggtgcacaaatcaataaaaatactccactgatggcgatagtttcggcaaacgatatgtggatcgaagctaacttcaaggagacacaaatttctggtatgcgtattggtcaaccagtggaaatcaccagcgatttctatggtggaagcaaagtatttagcggcaaaatcactggccttgatatgggtaccggcagcgccttctctttattacctgctcagaacgccagtggtaattggattaaggttgtacaacgtttacccgtccgtattgagcttaatcctggacaactagaaaaatacccattacgcatcggtctctcgactaaagtcagagtagatactacgagccctgatgggcccgttctgtctgataaaacacgcactaaatcagcttatcacaccactgctctgacaatagatatgtcgcctgccaataaaatagttaacaacattactaatagtaatgctggaaaataa

SEQ ID NO: 81848 - protein, 394 aa, Photorhabdus luminescens subsp. laumondii TTO1
MSENEAIEVQAAQDPTSSKKRQRSRALVLLTLIFTLLGVAYFFYWFLILRHHQETDNAYVTGNQVQIMSQVAGSVITVNFDNTDFVKSGSILVQLDPRDAELALEKAKTTLANSVRQTHQQIVNSKQYQANIALRRSELTKVQNDLSRREILSVQKVIGKEELQHAQEAVASARAALDIAIEQYNANQAIVLDTPLEKQPAIEQAATEVRNAWLALQRTKIVSPIDGYVSRRSVQVGAQINKNTPLMAIVSANDMWIEANFKETQISGMRIGQPVEITSDFYGGSKVFSGKITGLDMGTGSAFSLLPAQNASGNWIKVVQRLPVRIELNPGQLEKYPLRIGLSTKVRVDTTSPDGPVLSDKTRTKSAYHTTALTIDMSPANKIVNNITNSNAGK

SEQ ID NO: 81849 - DNA, 1113 bp, Photorhabdus luminescens subsp. laumondii TTO1
  CDS (1)..(1113): transl_table=11
atgaattttattcgttcgaaacgtcgatggattgtgttgttaactattgtgacagttatcacattggttctgggtcattttctgcgtgggccagaaacaattaaatatcagacagtccctgtcattaaaggtgatttggaaaaaaatgtattggcaacggggaaactggatgcggtcaggaaagtggatgttggtgcacaggtgagtggtcagttgcagaatttgcatgttgaagtgggcgataaggtggtagagggccagctactggctttgattgatcctaagcctgcacaaaaccaagtaaaagaagttgaagctacgatcaaagaactcaacgctgatctgatagaagccaaggcacaattgaaattagcacagcttacattaaagcgtcagaacaatctggcaaaagtgcaggcggtctctctccaggaattggatcaggttaaaacagacgttgaagtgaaaagagcgaagatagagaatttgctggcacaaatcagtaaaaatcaagcaagccttgatactgctcagactaatttgcaatacacccggattaccgcaccaatggatggcattgttgtcaatattaaaacgcttcaggggcaaacagtcattgcggcacaggaagccccgaccattctgacattagctgatcttggcacgatgttggtaaaagcggaagtttcggaggcggatgttatttacctgaaaccgggtcagaaggcctcttttaccgtattaggcgcaccggataaaaattttcctggtgtgttgaaggatattttgccgacgccagaaaagattaatgatgcgattttcttctatgcgcgctttgaggtggctaatccccagcaacttttgcgtttgcaaatgactgcgcaggtgaaaattcaactcgattcctatcgtgacacattaatgatcccgctttctgctttgggtaaacagattacaccgactcgctatgaggtggatatcctgaatgggggtaaagaagagaaacgggaagtgactgttggtgtacgcaatgatgtaaatatacaaattctgtctggtctgaaagagcatgagcaggtgattaccggtcatagtgaagcaggggatgagtaa

SEQ ID NO: 81850 - protein, 370 aa, Photorhabdus luminescens subsp. laumondii TTO1
MNFIRSKRRWIVLLTIVTVITLVLGHFLRGPETIKYQTVPVIKGDLEKNVLATGKLDAVRKVDVGAQVSGQLQNLHVEVGDKVVEGQLLALIDPKPAQNQVKEVEATIKELNADLIEAKAQLKLAQLTLKRQNNLAKVQAVSLQELDQVKTDVEVKRAKIENLLAQISKNQASLDTAQTNLQYTRITAPMDGIVVNIKTLQGQTVIAAQEAPTILTLADLGTMLVKAEVSEADVIYLKPGQKASFTVLGAPDKNFPGVLKDILPTPEKINDAIFFYARFEVANPQQLLRLQMTAQVKIQLDSYRDTLMIPLSALGKQITPTRYEVDILNGGKEEKREVTVGVRNDVNIQILSGLKEHEQVITGHSEAGDE

SEQ ID NO: 81851 - DNA, 1173 bp, Photorhabdus luminescens subsp. laumondii TTO1
  CDS (1)..(1173): transl_table=11
atgaccggagaaatacaatcacctccgcttaatgagaaaaagtcaaaacgtaagttagcactgatcctcgcaactctcttatttgcttttgtcgggttgggttacttcacctattggcttatttcattacgtcattatcaagcgactgatgatgcttacgttgtgggtaatcaggtacaagtgatggcccagatcaccggtagcgtaaccgccatttatgccgataataccgacttcgttcaacaaggcgatattttgctacgtttagactctattgatgcggaacatgcttttgagcgagcgaaaaataccttggctaataatgtcaggcaaactcaccaaaccattattgataatgaaaaactattggctaacattgatctcaaacaaacggcattacaacaggctcaagacgatttaaaacgacgtgaacatttgggactcacaggtgctatcgccaaagaaaatctgattcattcccgcaatagcgtacaaatggcaaaatctgagctgaatgttgcccgacaacaatattatgccaataaagcactagttatagacaccccattagatcaacaacctgcgattaaactggccgcttcccagctccgcgatgcatggttaaccttacagcgcacccagattgtcgcgccggtaacaggctacgtttcacgccgcagtgttcaagtaggctcacaaataaaaagtggtgctccactgatggttatcgtacccgctgaccaactttgggtcgaagctaacttcaaagaagttcaacttgccaatgtgcgtattggtcaacccgtaaccctgattagcgatttctatggtagtgatgtcacttataagggccggatcgttggtcttgatatgggaactggcagtgcattttctttattgccggcacaaaacgccaccggtaactggatcaaagtagttcaacgtttacccgttcgtgttgaactagaagcacaacaacttattgctcatcctttacgcatcggtttatccatgcacgccgcggttgatacccgaaatcagggtggtctggtgcttgctgacacgcctcgtaatggcattgtttatgaaaccaacgttttaacttacaacaccgtagaaattgatcggctaattaacgaaatcattcaagttaataccagtcaaaataagtga

SEQ ID NO: 81852 - protein, 390 aa, Photorhabdus luminescens subsp. laumondii TTO1
MTGEIQSPPLNEKKSKRKLALILATLLFAFVGLGYFTYWLISLRHYQATDDAYVVGNQVQVMAQITGSVTAIYADNTDFVQQGDILLRLDSIDAEHAFERAKNTLANNVRQTHQTIIDNEKLLANIDLKQTALQQAQDDLKRREHLGLTGAIAKENLIHSRNSVQMAKSELNVARQQYYANKALVIDTPLDQQPAIKLAASQLRDAWLTLQRTQIVAPVTGYVSRRSVQVGSQIKSGAPLMVIVPADQLWVEANFKEVQLANVRIGQPVTLISDFYGSDVTYKGRIVGLDMGTGSAFSLLPAQNATGNWIKVVQRLPVRVELEAQQLIAHPLRIGLSMHAAVDTRNQGGLVLADTPRNGIVYETNVLTYNTVEIDRLINEIIQVNTSQNK

SEQ ID NO: 81853 - DNA, 1107 bp, Vibrio vulnificus YJ016
  CDS (1)..(1107): transl_table=11
atgtcagataacaatgtccaaactagtgctgaacaaagcgataaaaaaattagccaagctcgctctttcacttactacatttttgccttagttgctgctctttggctttacaccttatgggcggacagaatgacgccaatgacagatcaagctagagtaaatggccaattgatccgcattagcccagaagtctctggccctatttcacaagtacttattactaacaatagtattgtcaaggcaggagatgaactcgtcacgatcgatccgcgtccttttgaattagccgttaaggccgccaaatttgatttgcaacaagcagctcagtcttatgaagcggattcagcagcaatcagtgtcgctcaagcaaatgaagtcgcagctcgtgttaaggtcaataatgctaagaagaatgtggagcgtaatcgcgtacttgccaataaaggaacgataagtcaagcggtaatggataacataatcgccgaactagagacggcccaagcggggttggctcaagcgtcatcagcactagaaaaagcgaaacaagagtttggcccgagaggaattgataaccctgaaatccaatcggtattaaaccgacaagagcaggctctactaaacctcaatcacaccaaactgacggcacctgctaatggtgttatcactaatatggatgttgctgttggcgattatgctgctgctgggcaaccacttcttacctttatcaataacaacaacttatggctgacggccatggtgagagagaattcactggctcatctaaagcctggcgataaagtcaaaattgtttttgatgcaaaccctggcgaggtctatgaaggaaaaatttcttcaatcggttggggaagtagcggtaatggtagccttgcccaagatgccagtaatggccttatgacgtcaccaacaagcagttcaaaagcacagcgtttccctgtcaatatcgagttcatggagttgcctgccgatcttaatctgagatacggcggtcgagctgtggtgggtttctaccctgatgaaagctacctaggtgagagactacaagatttgtggatctgggcatggagttatatcagctatgtatcatag

SEQ ID NO: 81854 - protein, 368 aa, Vibrio vulnificus YJ016
MSDNNVQTSAEQSDKKISQARSFTYYIFALVAALWLYTLWADRMTPMTDQARVNGQLIRISPEVSGPISQVLITNNSIVKAGDELVTIDPRPFELAVKAAKFDLQQAAQSYEADSAAISVAQANEVAARVKVNNAKKNVERNRVLANKGTISQAVMDNIIAELETAQAGLAQASSALEKAKQEFGPRGIDNPEIQSVLNRQEQALLNLNHTKLTAPANGVITNMDVAVGDYAAAGQPLLTFINNNNLWLTAMVRENSLAHLKPGDKVKIVFDANPGEVYEGKISSIGWGSSGNGSLAQDASNGLMTSPTSSSKAQRFPVNIEFMELPADLNLRYGGRAVVGFYPDESYLGERLQDLWIWAWSYISYVS

SEQ ID NO: 81855 - DNA, 1215 bp, Vibrio vulnificus YJ016
  CDS (1)..(1215): transl_table=11
atgcatcaccgtttgggtaaacagatagagatcatcgagactgacgttcattgtcctacttttagctcattaatgtcttttttcacattctactgcacaacgtcgcccttctctataatcgcactctttctttttaaactgatagattctatgactgcagaacataaattccgcgtttggatgagaagcctgattgtcctattcatcgcactatttttctacatcatcctggctgaccaacacgctcccatcaccaccgaagggcgcgttcaaggttatgttgtgcaagtcgcccctgaagtgtcgggcaaagtgactcaggtgcagatccacaataaccagcatgttcaacaaggggatgtgctgtttagcattgatgcacgtaaataccgcattgccttagagcaagccaagctctcgctgcaatctgccttagaaaaagaagcgacgctctattctcaacgcgaagcggcactggcgaatattgcgcgagcacaagcaacttatgacaacgcccatcgagagtatctgcgcctgcaaaagctctcgacgcagcaagtgatttcccgctcaagcctcgataacgcctttgcgcaaaaccaagtggccaacgccaacttaaaagccgagcagcaaagcctcaacgtgattgaagcgcaactgggccaaggtgaaggacaaagcaccgcagtgcgcgtggcgcaaaatggcattgaaaaagcgcagttggatttagccaatactcaggtgcttgcccccagcgatggtgtggtgaccaacttgcaattggaagtgggcagcatggccaacgccaaccaacccctgctgactttcattccaaccggttcactgtgggtgacgggggatttccgcgaaaaatccgtcgccaaggtggatgatcgctatcatgccatggtggcgtttgatgcctatccggggcaagtgtttgatttctcgctctctagccgagattacggcgttgctgccgcgcagcaaaagcctaacggctcattaaccagcgtggaaatcaacaaccgctgggtacgcgatgcgcagagaacacgcgtcaatctcgccactgacgatgccatgcctgcggcactgtttgttggttcccgcgccaccatcgtgctctacccaccagaggagaccttctggcgttggatggccacttggcaaatcaagctcgccagcctgttccactacgtgtactag

SEQ ID NO: 81856 - protein, 404 aa, Vibrio vulnificus YJ016
MHHRLGKQIEIIETDVHCPTFSSLMSFFTFYCTTSPFSIIALFLFKLIDSMTAEHKFRVWMRSLIVLFIALFFYIILADQHAPITTEGRVQGYVVQVAPEVSGKVTQVQIHNNQHVQQGDVLFSIDARKYRIALEQAKLSLQSALEKEATLYSQREAALANIARAQATYDNAHREYLRLQKLSTQQVISRSSLDNAFAQNQVANANLKAEQQSLNVIEAQLGQGEGQSTAVRVAQNGIEKAQLDLANTQVLAPSDGVVTNLQLEVGSMANANQPLLTFIPTGSLWVTGDFREKSVAKVDDRYHAMVAFDAYPGQVFDFSLSSRDYGVAAAQQKPNGSLTSVEINNRWVRDAQRTRVNLATDDAMPAALFVGSRATIVLYPPEETFWRWMATWQIKLASLFHYVY

SEQ ID NO: 81857 - DNA, 1170 bp, Rhodopseudomonas palustris CGA009
  CDS (1)..(1170): transl_table=11
atggctgaaccggcgctaaaatttccgatcgagcagaaggagcctgcgggggatccggccgtcgccacgagtggcggaccgcgccgcggtatcggcggcacgctgcgtcgctatcggcggccgctgctactgatcgttctgccgctggtggcgctgatcggcggcgttgccttctatctggagggcggccgctacgttaccaccgacgacgcttatgtcggcgcccagaaggtgctgatcacgccggacgtcgccggcaagatcgtcgaagtgaccgtcaaggaaggccaacgcgtccaacccggtgacgagctgttccagatcgatccggtgccgttccgcctcgcggtggcgcaggcccaagccaagctcgccgacgccaagaccagccacgccaatctggtcgccaacgtcaagctgtacggccagaccatcgacctggtgaacgccggcatcgcgctgaagcagcgcgacgtcgagcgcaagacgtcgctggtgcagagccgcgccggttcgcagctcgacctcgacaactccaccgccgcgctggtgaccgcgcaggcacagctgcagctcgtcaagcagcagcagtcgaccgcactgaatcagttgctcggcgatcccgaattgccgctggagaaattccccgcctatgcccaggccaaggcggcgctcgacgacgccgaacgtaacctgcggctgtccaccgtgcgggcaccgatgagcggcaccgccacccaggtcgacaacatccagctcggccgcttcgtcgccgccggcacgccggtgttcagcgtgatcgacaccacgcagccatgggtcgacgccaacccgaaggaaagcgacttcacctatgtggcagtcggccagaccgtgacgctcgatgtcgacgccttcccggatcatcagttcaagggccgggtgtcgtcgctgtcgccgggcactggcgcgcaattcgccgtgctgccgccgcagaacgccaccggcaacttcgtgaaagtggtgcagcgcgtgccgctgcggatcgcgctcgacgagaccgatccgatgatcaagcggctgaaggccggcatgagcgtcaacgtcgcgatcgacacccaccaccgccgttcgttggccggcctgctcggcttcggccacgccgcagctgcaacgccggagcacaactaa

SEQ ID NO: 81858 - protein, 389 aa, Rhodopseudomonas palustris CGA009
MAEPALKFPIEQKEPAGDPAVATSGGPRRGIGGTLRRYRRPLLLIVLPLVALIGGVAFYLEGGRYVTTDDAYVGAQKVLITPDVAGKIVEVTVKEGQRVQPGDELFQIDPVPFRLAVAQAQAKLADAKTSHANLVANVKLYGQTIDLVNAGIALKQRDVERKTSLVQSRAGSQLDLDNSTAALVTAQAQLQLVKQQQSTALNQLLGDPELPLEKFPAYAQAKAALDDAERNLRLSTVRAPMSGTATQVDNIQLGRFVAAGTPVFSVIDTTQPWVDANPKESDFTYVAVGQTVTLDVDAFPDHQFKGRVSSLSPGTGAQFAVLPPQNATGNFVKVVQRVPLRIALDETDPMIKRLKAGMSVNVAIDTHHRRSLAGLLGFGHAAAATPEHN

SEQ ID NO: 81859 - DNA, 942 bp, Rhodopseudomonas palustris CGA009
  CDS (1)..(942): transl_table=11
atgacggccgttgatactcctgcagcacgccggctttcggttgggaaggtgctctcggtcctggccacgctcgccgcgatcgctgcagcggcctatatggggcggatgctgtggcaggcctatatggctgcgccgtggacgcgcgacggcacggtgcgggcctacgtggtcggcgtgacgcctcaggtgtcgggccgcatttcggagctttcggtcaaggcggcgcagtacgtgcgcaagggcgatccgctgatgaagatcgatccggtcgatttccagatcgcgctggcgagcgcggaagcgaccgtcgccagcgccagggccgacctcgccaacaagcaggccgaagccgagcggcgcgaccgtctctcgtccctcgcggtctcaaaggaggagcagcagatctatacagccgcggccgccatggcggctgcggccttgcgtcaggcgctcagcaacctcgacaaggcgcggctggcactcagccggacggagatcgtctcgccggtcgacggttacgtcaccaatctggtcacccaggcgggcgactacgccaccagcggccagcgcgcgttgtcgatcgtcgatagcggcagtttctgggtcgatgcgtatttcgaggaaaccttgcttcgcggcattcgcgtcggcgatcgggcgcgggtcgcgctgatggcgtatccgcagacactcgcgggcgaggtcgtcggaatcgagcggggtatcgcggtccccaacgccgagtccgatccgtccggcctcgccacggtcaacccggtgttcacctgggtgcggctggcgcagcgcgtcccggtccggatcgcgttgaaggatgtaccaccgtcgatcgtgctcgccgcgggcctcacggcgacggtgtcgatccagccgaacagcgctccagctggcgcgaagccgatcgtgccgtcgccagcggagtag

SEQ ID NO: 81860 - protein, 313 aa, Rhodopseudomonas palustris CGA009
MTAVDTPAARRLSVGKVLSVLATLAAIAAAAYMGRMLWQAYMAAPWTRDGTVRAYVVGVTPQVSGRISELSVKAAQYVRKGDPLMKIDPVDFQIALASAEATVASARADLANKQAEAERRDRLSSLAVSKEEQQIYTAAAAMAAAALRQALSNLDKARLALSRTEIVSPVDGYVTNLVTQAGDYATSGQRALSIVDSGSFWVDAYFEETLLRGIRVGDRARVALMAYPQTLAGEVVGIERGIAVPNAESDPSGLATVNPVFTWVRLAQRVPVRIALKDVPPSIVLAAGLTATVSIQPNSAPAGAKPIVPSPAE

SEQ ID NO: 81861 - DNA, 891 bp, Rhodopseudomonas palustris CGA009
  CDS (1)..(891): transl_table=11
atgaaagggccagccatgggaaagactccgcttctattgatccgcctcagcgtcaccacactcggcgtccttgtcgccgcactgatcggctggcggctgtgggtgcactacgagatcgagccgtggacgcgcgacggccgtgtgcgcgccgacatcgtcgcggtggcgccggacgtctccggcctcgtctccgaggtgctggtcgtcgacaaccaagtggtgaagaagggcgacatcctgttccggatcgatcgcgagcgcttcaccttggcgctgcgccaggccgacgccgcggtcgaaggtcgcgtcgccgcgctcgacgccgccaacaaggatctggcccgctatcgcaatctcagcagcgacgccgtcaccgagcaaaagcgcgagcagatcaccgccacccaagccgaagctgaagctgcgctgcatcaggcgatcgccgatcgggatatcgccaagctcaatctcgaccgatcggaagtccgcgcccaggtcggcggcctgatcaccaatttcgatctgcgccccggtgcctatgtcaacgccggcagcggcgtcgccgcgctgatcgatcaggcgacgctgcatgtcgatggttacttcgaggagaccaagctgccctcgatccgtgtcggcgatcgggccgaggtgcggctgatgggcgagcgcaacccgctctccggtcacgtccagagcatcgccggtggcatcgaggaccgcgaccgcagcgccggcgccaagctgctgccgaacgtcaacccgacattcaactgggtgcggctggcacagcgaattccggtgcggatcgcgctcgaccacgtgccgcccgaggtgcgcctcgtggtcggccgcaccgccaccgtggtgatcgagcgccgcggcggctga

SEQ ID NO: 81862 - protein, 296 aa, Rhodopseudomonas palustris CGA009
MKGPAMGKTPLLLIRLSVTTLGVLVAALIGWRLWVHYEIEPWTRDGRVRADIVAVAPDVSGLVSEVLVVDNQVVKKGDILFRIDRERFTLALRQADAAVEGRVAALDAANKDLARYRNLSSDAVTEQKREQITATQAEAEAALHQAIADRDIAKLNLDRSEVRAQVGGLITNFDLRPGAYVNAGSGVAALIDQATLHVDGYFEETKLPSIRVGDRAEVRLMGERNPLSGHVQSIAGGIEDRDRSAGAKLLPNVNPTFNWVRLAQRIPVRIALDHVPPEVRLVVGRTATVVIERRGG

SEQ ID NO: 81863 - DNA, 903 bp, Rhodopseudomonas palustris CGA009
  CDS (1)..(903): transl_table=11
gtgaaaccgcttctatcgttgctcggccactatgctctgactctctgcgtcttcgttgcttcaggattcgtcgccctgcaggcttggagccattacgagcgaacgccctggactcgcgacggcagggtgagtgtggatgtggtccagatcgcgccggaagtctccggaacgatccgcaccgtgccgatagccgataatcagtatgtgaaacgtggcgacgttctttacgagatcgacccggagcgccttcggctcgccgtggcgctggcggaggctgacgtcgaggcgaaataccaggatatgctggtgcggcaagccactgctcagcggaagcagcaactcaaactgaatgacgtggtctcacaggaagcgctccagcaatcgagcggggcagcggcgatggccactgcggcctatcaggcggcgctggcgacacgcgatctggccaaactcaatcttgcgcgctccgtcattcgctccccagtcgacgggtatgtcactaatttgaagctacggcccggcgactatgcgaccgccggcgtgacaaatgtcgctatcctggacggggcgagtttctggatcaccggctatttcgaagagacgaaactgcagcaaatccgtgtaggagctccggcgcgggtcaagctgatgggcttcgatcagccggcggctggccatgtcgagagcatcggtcggggcatcgagaacagcaacgaaacacctggtcgtttcgggctgccgaatgtggcggcgacgttctcctgggtgcgtcttgcccagcgcataccggtccgcattcatctcgatcgggtgccttccggcgtcgagctggccgcgggcatgacagcaacggtcgagatcattcccccggaggtcgaagcgaatgcggggcggaggtcgtga

SEQ ID NO: 81864 - protein, 300 aa, Rhodopseudomonas palustris CGA009
MKPLLSLLGHYALTLCVFVASGFVALQAWSHYERTPWTRDGRVSVDVVQIAPEVSGTIRTVPIADNQYVKRGDVLYEIDPERLRLAVALAEADVEAKYQDMLVRQATAQRKQQLKLNDVVSQEALQQSSGAAAMATAAYQAALATRDLAKLNLARSVIRSPVDGYVTNLKLRPGDYATAGVTNVAILDGASFWITGYFEETKLQQIRVGAPARVKLMGFDQPAAGHVESIGRGIENSNETPGRFGLPNVAATFSWVRLAQRIPVRIHLDRVPSGVELAAGMTATVEIIPPEVEANAGRRS

SEQ ID NO: 81865 - DNA, 1269 bp, Rhodopseudomonas palustris CGA009
  CDS (1)..(1269): transl_table=11
atgtccggacgcgaccaagctgcccgcgtgctgcgctccgagccggagaacggggaggccgtagcggcggccggcgcaacgccgcatccggctgtgccgtcgcaggccgaggcgctgcgctcgctgctggaagatccctcgacgctgaagctcgccgatccgcccgagcccgacgccgagtccgagccggtggcgcctgccgcgcgtccgggcgcggccgccaagccgccgagcaagaagaagttcgtgctgatcggcgtcggcatcgcggcgctggccgcgatcggttacttcggcacgcagtacatgctggtcggccgtttcatggtcggcaccgacgacgcctatgtccgcgccaacaacaccacgctcggcgcccgcgtgtccggccacatcgccgcgatcctgccgcgcgacaattccgaggtgaaggccggcgacgtcgtgttccggatcgacgacggcgactacaagatcgcggtcgactccgcacgcgccaagatcgccactcaggaagccaccatcgcccggatcggccggcagatcgtcgcgcagcagagcgcagtggagcaggcgcaggcgcagctcgcctccgctgaagccgccgccaagcgcgccgacctcgatttcgatcgccagcaggcgctcagcaccaagggctttgcctcgcgcgcggtgttcgaaacctcgcaggcgagccgcgaccagaccgtcgcctcggtggccgccgccaaagctgcctacgacgcggcgcgcgacaatgtcgaagtgaccaaggcgcagcaggccgaagcccgcgcccagctcatcgagctgcaaagcgcgctggccaaggccgaacgcgatctcgctttcaccaatgtgcgcgcgccggtgaccggcgtgttctccaaccgcctcgtcaatgtcggcgactacatcaatgccggccagcggctcgccaacatcgtcccgctcgacggcgtctatatcgacgccaacttcaaggaaacgcagctgcgccggctgaagcccggccagaaggtcggcatctcggtcgacgcgttctccagccgaaagatcgaaggtacggtcgacagcctggcgccggcggccgggcaggtgttcaccctgctgccgcccgacaacgccaccggcaacttcaccaagatcgtgcagcgcgtcccggttcggattcgcgtgcccgccgacgtggcgcgcgaagggctgctgcgcgccggcatgtcggtctatgtcgacgtcgacacccggaccggcgaggccaagtag

SEQ ID NO: 81866 - protein, 422 aa, Rhodopseudomonas palustris CGA009
MSGRDQAARVLRSEPENGEAVAAAGATPHPAVPSQAEALRSLLEDPSTLKLADPPEPDAESEPVAPAARPGAAAKPPSKKKFVLIGVGIAALAAIGYFGTQYMLVGRFMVGTDDAYVRANNTTLGARVSGHIAAILPRDNSEVKAGDVVFRIDDGDYKIAVDSARAKIATQEATIARIGRQIVAQQSAVEQAQAQLASAEAAAKRADLDFDRQQALSTKGFASRAVFETSQASRDQTVASVAAAKAAYDAARDNVEVTKAQQAEARAQLIELQSALAKAERDLAFTNVRAPVTGVFSNRLVNVGDYINAGQRLANIVPLDGVYIDANFKETQLRRLKPGQKVGISVDAFSSRKIEGTVDSLAPAAGQVFTLLPPDNATGNFTKIVQRVPVRIRVPADVAREGLLRAGMSVYVDVDTRTGEAK

SEQ ID NO: 81867 - DNA, 1179 bp, Rhodopseudomonas palustris CGA009
  CDS (1)..(1179): transl_table=11
atggctcgaccggaccaacgcatgaccacgaccaacccgacaacacctgcagatccacgcgccgtccgccgcaagcggctggcgtggttcggcatcctgttggccacgaccgccgtcgctgcaggcgcctgggcttatttgtccaaccccgcactacgccacaccgacgacgcctatgtcggcggccagttggtacagatcacctcggaaatgtccggcgccgtgacgcgcatcctcgccgacaacaccgactgggtcgcggccggcgacgtcttggtcgaacttgattccaccgatgcgcggatcgaactcgccagcgccaaggcggaactcgcgcaggccgtccgcaacgtccgcggcttgtttgccagcgacgcccgttccgacgcggacgtccatctccgcctcgccgaattcaacaaggcgcagggcgacctcaacgtcaagcagacgctgatcagcagcggcgcggtgtcacgcgagagtcttcgccacgccagtgacgcgctcagtgccgcacaggcggcgctcgcttcggcgcagcaggcgcgcgctcaggcgctggcgctcgtcaacaactccacgctggcgtcgaatccgccggtgcaagtcgcagccgaacgcgtccgcgctgcagcactggcgatcgaacggaccaggatcaccgcgccggtgtccggcatggtcgcgcagcgctccattcaactcggccgccgcgtcggcccgggcgaaaagatgatgacggtcgtcccgctcgaccggctgtgggtcgacgcgaacttcaaggagattcagctccaaggcgtctgcgccggacagcctgccaaggtgacggccgacatctatggccggtcgataacgtaccacggcacggtccggggcatcgaggcgggcaccggtgcagccttcgccttgctgccggcgcagaacgccaccggcaactggatcaaagtggtgcagcgggctcctgtgaggatcagcctcgatccctccgaactgatccagcatccgctgcggatcggcatgtcggccgaggtggaggtcgacaccaggacctgtgattccacggcggcgcccgcgaagcggcaagagcagtccgcgatccacgacgcccgggctgcagccgccgacgccgttgtccggcaagtcatcgccgacaacatcggagcagaccgatga

SEQ ID NO: 81868 - protein, 392 aa, Rhodopseudomonas palustris CGA009
MARPDQRMTTTNPTTPADPRAVRRKRLAWFGILLATTAVAAGAWAYLSNPALRHTDDAYVGGQLVQITSEMSGAVTRILADNTDWVAAGDVLVELDSTDARIELASAKAELAQAVRNVRGLFASDARSDADVHLRLAEFNKAQGDLNVKQTLISSGAVSRESLRHASDALSAAQAALASAQQARAQALALVNNSTLASNPPVQVAAERVRAAALAIERTRITAPVSGMVAQRSIQLGRRVGPGEKMMTVVPLDRLWVDANFKEIQLQGVCAGQPAKVTADIYGRSITYHGTVRGIEAGTGAAFALLPAQNATGNWIKVVQRAPVRISLDPSELIQHPLRIGMSAEVEVDTRTCDSTAAPAKRQEQSAIHDARAAAADAVVRQVIADNIGADR

SEQ ID NO: 81869 - DNA, 1215 bp, Rhodopseudomonas palustris CGA009
  CDS (1)..(1215): transl_table=11
atggcgtcggagccggctgacgggaacaaacgctccagggaatctggctcccacgaccaggagcaggctcccccaccaaccgaccacgacgatacgcagggtaagttggccccctcgatgctgtcgaatccctggttacgttggggattgatcaccgctgcgatcctgctgctacttggtggcaccggctatggctggtattggtggaccacgggtagctattttcaaagcaccaatgacgcgtatctcaaggcggatcaggtctcgattgcgccgaacgtctcgggctatctagttggggtaccggtggtccaaaaccagacgatcgcggctggcgatcaactggcgaagatcgacgaccgttcctaccgggttcgagttgagcaggccaaggcccaactcgatcaggcaagggccggcaaagctcgcgcggaagccgagttgaaccgacaatacgcccagatcgaacaggcgaatgctcagcttgggcaatcggaggtgagcctggcttttgccgagaaccaggtcgcgcgttatcggccgttggcagcgagcggcgccgaagcgaccgagcgttacgaccagatccgaaaccagcgcgatcaggcacgcgcccaggtcgccctaaacaacgcgcaggtcgagtcggcgcgtcggatggtcccctcaatcgaagcgcaaattgccgaagcgcaagccgcgattgagcaggccgaggcccaacttcatcaagcgcaaatcgatctggacaacacggtggtggtcagcccgatcgcgggccgcgtcggcgacctgaccgcgcgggtcggccaattcgttcagcccggaatgcggatgatgacggtcgtgccgctccatgatctttacctggaggcaaattataaggagacccagatcggcctgatgcgggtcggccagccagcgaccatcgaagtcgacgccctgccgaacgagaagctgcacggcgaagtgctgagcttctcgcccggcacaggttcggaattctcgttgctgccgccgcagaatgcgaccggaaatttcaccaaggtggtgcagcgcgtgcccgtgcgaatccggattgatgccggcccggaggcgcgcaaggtgctggtgcccggactgtcgatcgtggtggacgtcgatactcgcaacgccaaggccgacatcgaccgccaaagaggagaactgcaggacagccggaaggccgcgcaatga

SEQ ID NO: 81870 - protein, 404 aa, Rhodopseudomonas palustris CGA009
MASEPADGNKRSRESGSHDQEQAPPPTDHDDTQGKLAPSMLSNPWLRWGLITAAILLLLGGTGYGWYWWTTGSYFQSTNDAYLKADQVSIAPNVSGYLVGVPVVQNQTIAAGDQLAKIDDRSYRVRVEQAKAQLDQARAGKARAEAELNRQYAQIEQANAQLGQSEVSLAFAENQVARYRPLAASGAEATERYDQIRNQRDQARAQVALNNAQVESARRMVPSIEAQIAEAQAAIEQAEAQLHQAQIDLDNTVVVSPIAGRVGDLTARVGQFVQPGMRMMTVVPLHDLYLEANYKETQIGLMRVGQPATIEVDALPNEKLHGEVLSFSPGTGSEFSLLPPQNATGNFTKVVQRVPVRIRIDAGPEARKVLVPGLSIVVDVDTRNAKADIDRQRGELQDSRKAAQ

SEQ ID NO: 81871 - DNA, 1173 bp, Geobacter sulfurreducens PCA
  CDS (1)..(1173): transl_table=11
atgacgttgatacacacactgcgcagacacaagaccgccctggtccggaccgcacttctcgcggcgctggtcgtgctcgtcaaggccaccatcctggccccgccgaaggtcacgacggtacgggtcgaacggcgggacctgacggcccgggtctatggcaacgggaccgtggaggccaaggaggtggtgggggtttccagcaaggtgaccggaaggatcgtttcgctccacgctgaccagggggaccgggtgcgccggggccagatcctggcgcgcctggaaagcgacgaatatgccgcgcagctgggtcaagccgaagcaggggtcagccgggcggcggccggccagagcctagaggcggccaccctggcaaaggcgcgggcaaacctggaactggccgagcgtaacgctgcgcgctaccggaatctggccgaccggaacctggtgtcgcgccaggaagccgagcagtacgaaacggcctggcgcctggcacgggaggaggaagcccggagcagtgcggccctggaagcggcccgcatggagtcggcggccggacgcgctgcccggggagtggcccggtcgcggcttgacgacaccgttatccgcgccccccgcgacgggatcatcgtctcccgcgacctggaaaagggggccgtggtctctcccggccagagcatcttcacccttgccgatccggcggtggtctgggtcagggcccatgtggacgaatcgcagcttgccggcgtggccgtgggccgggaggccgcgatctccctccggtccgcgccggagcgtgccatgcagggacgggtggcccgggtcggcatggagagcgaccgggtgactgaagaactggcggtggacgtggccttcgccgccccgccgcccgcgttccgcctgggagagcagtccgacgttctgatcacggtcggcaccaaacgcggcgtgccgtccctgcctgccgcggccctgacgagccacggggggaagcacggggtctggacggtgtcggaaggtcggctccgcttcaagccggtgcaggtcggcatcgaggatcgccagggcgtcaccgagatcctgtcgggcctggccggggccgagccggtggtgctgccgacgccggcccaggcgaagaaattccgtgacggcatgaaggtgagggtgtcgccgtga

SEQ ID NO: 81872 - protein, 390 aa, Geobacter sulfurreducens PCA
MTLIHTLRRHKTALVRTALLAALVVLVKATILAPPKVTTVRVERRDLTARVYGNGTVEAKEVVGVSSKVTGRIVSLHADQGDRVRRGQILARLESDEYAAQLGQAEAGVSRAAAGQSLEAATLAKARANLELAERNAARYRNLADRNLVSRQEAEQYETAWRLAREEEARSSAALEAARMESAAGRAARGVARSRLDDTVIRAPRDGIIVSRDLEKGAVVSPGQSIFTLADPAVVWVRAHVDESQLAGVAVGREAAISLRSAPERAMQGRVARVGMESDRVTEELAVDVAFAAPPPAFRLGEQSDVLITVGTKRGVPSLPAAALTSHGGKHGVWTVSEGRLRFKPVQVGIEDRQGVTEILSGLAGAEPVVLPTPAQAKKFRDGMKVRVSP

SEQ ID NO: 81873 - DNA, 1119 bp, Geobacter sulfurreducens PCA
  CDS (1)..(1119): transl_table=11
atgacaacggaacaggaactaccggaccggggagaaaaccgggaagccccttcggcccagacggcgccacagggcaaggggagcggcggcaaacggagacgagcgggcattttcctactcatactgttcgtggttggagcggttatcggtctgcgctggctcgtccacggcataacgtacatatccacggacaacgccttcgtggaatcccacatccatgcagtatcctcccgggtgccgggcacagtcgctgcggtgtatgtcactgacaaccaagccgtgaaaaagggggatctccttgccgaactggatcccagcgactaccggacccgggtcagcgaggccacggcagcccttgccatggcccgcaacgagacctcgggcgactatgcccaggtggaagcggcgcgtgccgcggtcgaccatgcccgggcgcgcctggcccaggctgacctggatttgacacgcggtacggctttgctggcaaaagaggtcatcccccgcgaacagttcgaccggctcgagacagcaaagcgggtggcggtggcccaggtgcgcgaggcagaggagcagatgcgcaaggcacaggccgagatcggtctgtcgggaagcggtagccgcgaagcccgggtggcgctacgcgatgcccaactagccacggcgtccctcaacctttcctacacgaaaatcctggcgcccgccgatggttacgtcacgcgcaaatcggtggagccaggcaacacggtccaggcgggccagcccctcatggccgtggtcgatctcgatgacgtctggatcactgccaactacaaggagagccagcttacccacatgaagccgggccagaaggtcacctttacggttgacgcctatcctggccgcaccttctcgggcaggatcgacagtatcatggcaggaaccggcgcggccttctcgctgttgccgcccgaaaacgccacgggcaactacgtgaaggtcgtccagcgggttccggtcaagatcgccgtggacagggcaagcgatcccggccacctgttgcgggtgggcatgagcgtggtgccgtcggtggacgtggagcgctctctgggcgacatcctccacgggctctggccgttctag

SEQ ID NO: 81874 - protein, 372 aa, Geobacter sulfurreducens PCA
MTTEQELPDRGENREAPSAQTAPQGKGSGGKRRRAGIFLLILFVVGAVIGLRWLVHGITYISTDNAFVESHIHAVSSRVPGTVAAVYVTDNQAVKKGDLLAELDPSDYRTRVSEATAALAMARNETSGDYAQVEAARAAVDHARARLAQADLDLTRGTALLAKEVIPREQFDRLETAKRVAVAQVREAEEQMRKAQAEIGLSGSGSREARVALRDAQLATASLNLSYTKILAPADGYVTRKSVEPGNTVQAGQPLMAVVDLDDVWITANYKESQLTHMKPGQKVTFTVDAYPGRTFSGRIDSIMAGTGAAFSLLPPENATGNYVKVVQRVPVKIAVDRASDPGHLLRVGMSVVPSVDVERSLGDILHGLWPF

SEQ ID NO: 81875 - DNA, 1185 bp, Geobacter sulfurreducens PCA
  CDS (1)..(1185): transl_table=11
atggctttgatgaatgtgatgacagcctttcgcacgcttcgccgctggggacggcatgccgttgcggcgtctgcggtcgtgcccgctctcgcgttgtgcgcctgctcccccaaggaacagaaaccaacggtaaagcctccggtgccggtcgtgctcgcaaaggtagagcggaagacgattccggttcagatcaaggccatcggcaatgtggagccctatgccacggtggcggtcaaggcccaggtgagtggtgaggtggtgaacgttcactttaccgaagggcaggacgtgaaaaagggcgatctcctgtttgccatagatccgcgcacctatgccgccgccctgaaaaaagcggaagcaaatctttcccggaatctggtccaggcgcgcaatgcccgccaggacgcggaacgctatgcccaactgctgacagaagggatcgtgacccaggagcagtatgagcagtaccggaccaaggcggaggctttcgcggcggatgttgccgccgaccgggccgccgtggagaacgccaaggtcgagctctcctactgcaccatacgctcacccctttcgggccgaaccggcaacctggcggtgcatgcggggaacatcgtcaaggcaaacgagaatccgccgctggttacgatcaaccagataaccccggtctacgtaacctttgccattcccgagaaagaccttgccgagatcaagcaccggctggcgtccggacggctcgcggtggaggcaatcattcccaatgatcagggaccggcggagcaggggaccatcagctttctcgacaatgcggtcgacgccgccaccggtaccatcaaactcaagggaatcttcgagaacaaggggcggcggctctggcccggtcaattcgtcaacgtggtcgtgaccctcgcgtcccgcgccgacgccgttgtggtgccgtcccaggcactccagaccggacagagcggcccctacctttttgtggtaaaggctgacacctccgtggaggttcgccccgtcacaccgggtatcacccatgaaggactcactgtcattgaacagggcgtcgctccgggggaaacggttgtgaccgacggccagatgcggctcaccccgaatgccaaggtaacggaaaaacgacccggaggtgccggcgtttccccccccgaaccgagtaagcgcccatga

SEQ ID NO: 81876 - protein, 394 aa, Geobacter sulfurreducens PCA
MALMNVMTAFRTLRRWGRHAVAASAVVPALALCACSPKEQKPTVKPPVPVVLAKVERKTIPVQIKAIGNVEPYATVAVKAQVSGEVVNVHFTEGQDVKKGDLLFAIDPRTYAAALKKAEANLSRNLVQARNARQDAERYAQLLTEGIVTQEQYEQYRTKAEAFAADVAADRAAVENAKVELSYCTIRSPLSGRTGNLAVHAGNIVKANENPPLVTINQITPVYVTFAIPEKDLAEIKHRLASGRLAVEAIIPNDQGPAEQGTISFLDNAVDAATGTIKLKGIFENKGRRLWPGQFVNVVVTLASRADAVVVPSQALQTGQSGPYLFVVKADTSVEVRPVTPGITHEGLTVIEQGVAPGETVVTDGQMRLTPNAKVTEKRPGGAGVSPPEPSKRP

SEQ ID NO: 81877 - DNA, 1200 bp, Parachlamydia sp. UWE25
  CDS (1)..(1200): transl_table=11
atgactgaaaaagaacctacaactactaatcaagatttttcttctcttaatctagatcttctcaataagaaaaaaagaaataaagttttattaaagattttttttgtttttttattattaactattctaacaactatttattggtatttgttcatccgttttcatgaatcgacagatgatgcttatgtcaatggtaacattgttaatttgatgtctcctgaacaaggaaccattacagctatttatgcagataatacagattttgtaaaacaaggccagctactgatagaacttgatccaacactctatcaattagcttttgaacaagctcaagttgagctagctttagctgtcagggaagttcaacaactttatgaaactgtccaacaaaaaaaagccgctcttgaattaaaacaagccgatttaaaacgagcccaagaagattttgaaagtcgtaattccttaagaaatactgaagctatttcgattgaagatctcaatcatgcacaagctaatttaactgttgcacaagctgcaacgaacttatcaaaacatgaattaaatagcgccattgctgctataggctcaacatcattggagaatcatcccaatattcagaataaagaaattgcactgaagcaaacctatgtcaatttaaagcgatgcaaaattttagctcccgtctcaggttttatttctcaaagaaaaatacaagtaggagaatgggtctcaacaacacgctctctattgagtattattcctctcgatcaaatttggatagatgccaatttcaaagaaacagaattgcgtgatattcgaataggacaacccgtcactgttaaaagtgacatgtatggttcttccgtgctttatcatggtaaagtattaggagtattagctggaactggaagtgttttttctttaatacctcctcaaaatgctactggaaactggatcaaaattgttcaacgtgttccagttagaatttctcttgattctaacgaacttagacaattccccctgtttttaggtctatccacctatgttgttgtcgacacgaaaaatcaactaggcgatcgattagcctccaatcctgtttacaaccccatacttacaacttctgtttatgaaattcctatgcagcctgctcaagaacttattgatagtattattcaagctaatttaaaccacaaatcttga

SEQ ID NO: 81878 - protein, 399 aa, Parachlamydia sp. UWE25
MTEKEPTTTNQDFSSLNLDLLNKKKRNKVLLKIFFVFLLLTILTTIYWYLFIRFHESTDDAYVNGNIVNLMSPEQGTITAIYADNTDFVKQGQLLIELDPTLYQLAFEQAQVELALAVREVQQLYETVQQKKAALELKQADLKRAQEDFESRNSLRNTEAISIEDLNHAQANLTVAQAATNLSKHELNSAIAAIGSTSLENHPNIQNKEIALKQTYVNLKRCKILAPVSGFISQRKIQVGEWVSTTRSLLSIIPLDQIWIDANFKETELRDIRIGQPVTVKSDMYGSSVLYHGKVLGVLAGTGSVFSLIPPQNATGNWIKIVQRVPVRISLDSNELRQFPLFLGLSTYVVVDTKNQLGDRLASNPVYNPILTTSVYEIPMQPAQELIDSIIQANLNHKS

SEQ ID NO: 81879 - DNA, 849 bp, Parachlamydia sp. UWE25
  CDS (1)..(849): transl_table=11
gtgaaacgatttgctttaatttgtcttttcctttttatcttggcagcagtagttcatatttactttcattattttttagaaaaaaaagagagtgaggattctattactctctacggaaatgtcgatgtgaggcaagttgatttaggatttagagtaaaaggaagagtagatcagatgtcttatcaagaaggagattttgtctctgttggacaattaatagccactcttgataaacagccttatgtcgatttagttttacaagccaaagctcaggtagaatcaattgaagcctctttaaaaaatgctgaacagttgatagaacgaagacgtacactgattgggactggagcgatttcaagtgaggaatatgaagatactctatcttctcgtgacgtcttattggcaaatttaaaagaagcacaagcagctttaggagttgctttgactaatttacaagatacagaaatttacgctcccaatgatggaacgattttaacacgtatcagagagccaggttctattgtaagggaagcagatcccgtttatattctgtcattgatttctccgatttgggttagatcgtttgtagcagagcctgaactaggagagatttatcccggtatgatggttgaaatattcactgatacaaaagaaggaaaggtttatcaggggcatattggatttatttctcccgtagctgaatttacccccaaatcagtagaaacaactaaattacgcacagacttagtgtatcgtttacgaattattgctgaaaatcctgataaaggattgcgtcaaggaatgccagtaacacttcgattaaaaaaacaaactaaggaaatcctgtga

SEQ ID NO: 81880 - protein, 282 aa, Parachlamydia sp. UWE25
MKRFALICLFLFILAAVVHIYFHYFLEKKESEDSITLYGNVDVRQVDLGFRVKGRVDQMSYQEGDFVSVGQLIATLDKQPYVDLVLQAKAQVESIEASLKNAEQLIERRRTLIGTGAISSEEYEDTLSSRDVLLANLKEAQAALGVALTNLQDTEIYAPNDGTILTRIREPGSIVREADPVYILSLISPIWVRSFVAEPELGEIYPGMMVEIFTDTKEGKVYQGHIGFISPVAEFTPKSVETTKLRTDLVYRLRIIAENPDKGLRQGMPVTLRLKKQTKEIL

SEQ ID NO: 81881 - DNA, 1062 bp, Bartonella henselae str. Houston-1
  CDS (1)..(1062): transl_table=11
atgtatttaaaaaaaataaaacagataaaaataattcgtcctatcctcgttattcttgcgctttttatgctatggtttggctataagtggataacacattggcgttatattctctccaccgaagatgcctatgtgcaaggagatattgctgccattgcccctaaattaaacggatatattaagaaaattgctattaaagccaatcaagttgttaaaaaagacgatgttttattctgtttagacaatggtgattatcaaatagccttagatcagacagaagcgcgtctcaacacacaacaaaaaacccttctacgtattgatgcgcaaattgtagccgctcacagtgctttagatgatgcgcaagcacaaaaagcagctgcttcagccatagcaaccaatgcacaactaaccttaaaacgcactacagaacttaaagctgatcgttatgctcctcaatccgatgttgatgatgctaaatcagcttatgaacaagccattgctaatgtaaaccgtgcagatgcacaaatagccgcagcacgcgcaaacatccaagtgctagaagcacaacgcagtgaaacagaaagccagacaaagagcctagaactcacacgtgataaagcaaaacgtgatcttgattcaaccattatacgggctccattcgatggaatcattggaaatttaacagcgaaaactggggattttgttgtgaatggtcaacgtcttgcagcactcgtccccatacaggcgctttatattgaagccaactataaagaaacacagttacaaaatattcacgctggacaaacggcttatattacttttgacgccttcaaaaaagaggtttttacagggagagtactttctattgcaccggcaacaggagctgttttttctctcctaccaccacaaaatgccactggtaatttcaccaaaattgtccaacgcattccagtacgtatctctattccagaagaagcattaaaagacaagcgtatccgagcgggaatgagtgtttcagtacaaattgatacacgtacaaaattgcataatcaccccttataa

SEQ ID NO: 81882 - protein, 353 aa, Bartonella henselae str. Houston-1
MYLKKIKQIKIIRPILVILALFMLWFGYKWITHWRYILSTEDAYVQGDIAAIAPKLNGYIKKIAIKANQVVKKDDVLFCLDNGDYQIALDQTEARLNTQQKTLLRIDAQIVAAHSALDDAQAQKAAASAIATNAQLTLKRTTELKADRYAPQSDVDDAKSAYEQAIANVNRADAQIAAARANIQVLEAQRSETESQTKSLELTRDKAKRDLDSTIIRAPFDGIIGNLTAKTGDFVVNGQRLAALVPIQALYIEANYKETQLQNIHAGQTAYITFDAFKKEVFTGRVLSIAPATGAVFSLLPPQNATGNFTKIVQRIPVRISIPEEALKDKRIRAGMSVSVQIDTRTKLHNHPL

SEQ ID NO: 81883 - DNA, 1017 bp, Acinetobacter sp. ADP1
  CDS (1)..(1017): transl_table=11
atgagtcaggtagatttacgcaaaattgttcggcccgtggtgacactactaatggctatagtggcaattgcggtgattattcatttgtggaattactataattcagcaccttggacacgcgatggtcgtgtacgtggtgatgtcatacaagtgtcttcagatgtatctggactggtcacagaagtcttggttcaagataaccagaccgttaaaaaaggacaggttttgtttaaaatcgatgtggttcgtcagcaactggatgtagaacaggcacgttctgatttggccaaggccaaagctggattggctcaatcccaagccaatctgattgcagccaaagcgaatttgaccaaatctgaggcgaatactgcactggctgaaaaaaatgctgcacgttattcaagtttattggatggcgcaatttctaaacaggaacaagaccagatttatgcaacacgcgatcagtcacgtgctgaaattgctcagatgaaagccgcaattgagcaggcggaagcaacaattgttcaacagaaatcactaatagaagttgctcagagtaatttaaatctggcgttgttaaacatgcaacgctcggaagtggttgctccagcagatggtacactgtcaaattttggcctgcaggtaggaaattatgtgaaaacaggtgatgctgttgctgcacttattgatcgtcatcaattgtatgtggtgggatattttgaagaaacaaaattaaatcacattcatattggagatcaagccaccgtacaattgatgggcgatgaccagaagatacggggtcatgtgcaggggattgcttcgggtattgaagatcgtgaacgttcaagtagttcaaccctacttgcgaatgtcaatccaacatttacatgggtgcgtttagctcagcgtgtacctgtaaaaattgtactggatgaagcacctaaaaattctttagcttttgtggctggacgaactgcaacggtgaatattgtacaaagtaattcgcaaaaaaactga

SEQ ID NO: 81884 - protein, 338 aa, Acinetobacter sp. ADP1
MSQVDLRKIVRPVVTLLMAIVAIAVIIHLWNYYNSAPWTRDGRVRGDVIQVSSDVSGLVTEVLVQDNQTVKKGQVLFKIDVVRQQLDVEQARSDLAKAKAGLAQSQANLIAAKANLTKSEANTALAEKNAARYSSLLDGAISKQEQDQIYATRDQSRAEIAQMKAAIEQAEATIVQQKSLIEVAQSNLNLALLNMQRSEVVAPADGTLSNFGLQVGNYVKTGDAVAALIDRHQLYVVGYFEETKLNHIHIGDQATVQLMGDDQKIRGHVQGIASGIEDRERSSSSTLLANVNPTFTWVRLAQRVPVKIVLDEAPKNSLAFVAGRTATVNIVQSNSQKN

SEQ ID NO: 81885 - DNA, 1137 bp, Acinetobacter sp. ADP1
  CDS (1)..(1137): transl_table=11
atgactgaatctgcacaagtgactgcatcagacgtagatgatgatgctttaaaggcgaaacgaaagaaattactgagtatttttgccttggttattgtgattgttgcgattttatatgcaatctggtttttcttctttaatcatactgtcagtactgacaatgcttatgtcggggcggaaactgcacagattacctctatggtgacagggcaggttgctgaaattcgtgtacatgatacgcaacaagtacataaaggcgatatcttggctcaggtggatccaagagatgcacagattgcattgagccaggcacaagcgatgctggccaaagcacaacgtcagtatcgtcagacagaagccaacagtaaatctttaaactctcaagtctttgtaagtgatgatggaattgcaagtgcccaggcacaggtaggcaaggctcaagctgactataataatgccattgaagagttaaaacgtagacagacgcttgaacaatctggcgcaatttctaaagaagaattgagtacggcgcaaacagcggcacaaactgccaaagctgcactagatgtcgctaaggcagctgtttctcaggcacagtcaagtcgcaaggcagcacaaagtaacttggcagccaatcaggccttgattcagggagcctctgaaaactcggcaccagatgtattaagcgctgaagccaatgtacaacaagcgcagcttgatcttgagcgtaccgtaattcgttcacctgttgatggggtcattacaggccgtaatattcaagtgggtcagcgtgtggctcctggtagcgtactcatgaaaattgttccgctttctgcgttatatgtcgatgcaaactttaaagaaagtcaattatctaaagtacgtgtcgggcaagcagcgaccttaacgtctgatttatacggcagtgacgttgaatatcacggtaaggtgattggattctcgggaggaacaggttctgcatttgcgctgattcctgcacaaaatgcaacaggcaattggattaaagtggttcagcgtttaccagtgcgtatcgcacttgatccgaaagaattggctgagcatccgttacgtgttgggctgtctatggatgctagcatcgatttatccaagaagtaa

SEQ ID NO: 81886 - protein, 378 aa, Acinetobacter sp. ADP1
MTESAQVTASDVDDDALKAKRKKLLSIFALVIVIVAILYAIWFFFFNHTVSTDNAYVGAETAQITSMVTGQVAEIRVHDTQQVHKGDILAQVDPRDAQIALSQAQAMLAKAQRQYRQTEANSKSLNSQVFVSDDGIASAQAQVGKAQADYNNAIEELKRRQTLEQSGAISKEELSTAQTAAQTAKAALDVAKAAVSQAQSSRKAAQSNLAANQALIQGASENSAPDVLSAEANVQQAQLDLERTVIRSPVDGVITGRNIQVGQRVAPGSVLMKIVPLSALYVDANFKESQLSKVRVGQAATLTSDLYGSDVEYHGKVIGFSGGTGSAFALIPAQNATGNWIKVVQRLPVRIALDPKELAEHPLRVGLSMDASIDLSKK

SEQ ID NO: 81887 - DNA, 966 bp, Erwinia carotovora subsp. atroseptica SCRI1043
  CDS (1)..(966)
atgaaaagtttctttttaaccttgtttaggcagcaggccgcgctgaccaaaaaactgagtcgtgtggttatcacgctggtgattgtgttgtgtgcgattgtggccatttttcgtgtctgggcgttttataccgaatcgccctggacgcgtgatgccaaatttacggcggatgtggtggcgatcgcgccggacgtcagcgggttgctgaccgacgttcgtgtcacggacaatcagttggtgaacaaaggcgatgtgctgtttgtcatcgaccagccgcgttaccaccaggccgtggcgcaggcggaagccgatgttgcttactatcaggcgctggtgacggaaaaacgccgggaatcaggacgtcgtgcgcggctgggcgtcagtgcgatgtcacaggaaaatatcgatcagtccaacaatgcgctagaaaccgcaacgcaccagcttgctaaagcgcaggcggtaatgtctctggcgaaattggagttggatcgtaccgtggtacgcgcgcctgctgacggctgggtcaccaacctgcatgtgcaaagcggcgagttcattgaacgcggtaatacggcggtcgcgctggtgaagaaggattcgttttacctgctggcgtacatggaagagaccaagctcgaaggcgttcgccgtggctatcgtgcggaaatcaccccgctgggtagcgaaaagatattttacggcaccgttgatagcgtggcggctgggataaataacagtagcaacagtgcgaatactaaaggcctggctaacgtagattctaatctggagtgggtgcgtttagcgcagcgcgtgccggtaaaaattcgcctcgatcggcaaatgggcgacctctacccagctggcacgacggcgactgtggtggttactggcgagcaggtcaacaatgacaaaaagccttcgccacttatccgccttctttatcgcctgcgtgagtttggctaa

SEQ ID NO: 81888 - protein, 321 aa, Erwinia carotovora subsp. atroseptica SCRI1043
MKSFFLTLFRQQAALTKKLSRVVITLVIVLCAIVAIFRVWAFYTESPWTRDAKFTADVVAIAPDVSGLLTDVRVTDNQLVNKGDVLFVIDQPRYHQAVAQAEADVAYYQALVTEKRRESGRRARLGVSAMSQENIDQSNNALETATHQLAKAQAVMSLAKLELDRTVVRAPADGWVTNLHVQSGEFIERGNTAVALVKKDSFYLLAYMEETKLEGVRRGYRAEITPLGSEKIFYGTVDSVAAGINNSSNSANTKGLANVDSNLEWVRLAQRVPVKIRLDRQMGDLYPAGTTATVVVTGEQVNNDKKPSPLIRLLYRLREFG

SEQ ID NO: 81889 - DNA, 1176 bp, Erwinia carotovora subsp. atroseptica SCRI1043
  CDS (1)..(1176)
atgagtgaaagtgtggaaaatcaggtgccacagacgccgcaaagaaacaagaaacagcagcgtaaacgggtcttgtcgctgctgacatttatttttgtcgtgcttggctgtgcctggctggtttactggttcctggtgctcagacatcaccaaagcactgacgacgcctacgtcgcaggcaaccagattcagatcatgccgcaggttacgggtagcgtcacccatgttaacgtcgacaataccgatttcgttaagcaagggcaggtgttggtggagctggatcctaccgatgcgctgcaaacgtttgaacgcgcaaaaaccgcactggccaacagcgtgcgccaaacgcatcagttgattatcaacagcaaacaataccaggccaatatcgagctgcgccaaactgaactgaacaaagcacaaagcgacttgagccgccgtgaagcgctaggcaatgcgaatgctatcggacgtgaagaagtgcaacatgcgcgcgatgccgtcgcgaccgccaaagcggcgttggaagtcgccagacagcaatatcaggcgaatcaggcgatgattctggatacaccgcttgagaagcaacccgccatacagcaagcctccgtagaaatgcgcgatgcctggctggcgctacagcgtaccaaaattgtcagcccgattgacggctatatctcacgccgcagcgtacagattggtgcccgtatctcctcgacttcggcactgatggccgtggttcctgccaatcatctgtgggtcgatgctaacttcaaagagacgcagttagccaatatgcgcatcggccagcccgctaccgtgatcgcggatatctacggtgatgatgtggtgtatcaaggaaaagtggtcggtctcgacatgggtaccggtagcgcgttttctctgctgcccgcccagaacgctacaggcaactggatcaaagtggttcagcgcctgccggtacgaattgagatcgatccgaagcaggttgccgagcatccgttgcgcatcggcctgtctgcattggtgaatgtcgataccgccaatacagaaggcagtgcgttatcagaaacatcgcgcaccacgccagcctaccaaagtgatgctctgacgctggatctcacccctgttaaccaagacattagcgccattattcaggcgaatgccggttaa

SEQ ID NO: 81890 - protein, 391 aa, Erwinia carotovora subsp. atroseptica SCRI1043
MSESVENQVPQTPQRNKKQQRKRVLSLLTFIFVVLGCAWLVYWFLVLRHHQSTDDAYVAGNQIQIMPQVTGSVTHVNVDNTDFVKQGQVLVELDPTDALQTFERAKTALANSVRQTHQLIINSKQYQANIELRQTELNKAQSDLSRREALGNANAIGREEVQHARDAVATAKAALEVARQQYQANQAMILDTPLEKQPAIQQASVEMRDAWLALQRTKIVSPIDGYISRRSVQIGARISSTSALMAVVPANHLWVDANFKETQLANMRIGQPATVIADIYGDDVVYQGKVVGLDMGTGSAFSLLPAQNATGNWIKVVQRLPVRIEIDPKQVAEHPLRIGLSALVNVDTANTEGSALSETSRTTPAYQSDALTLDLTPVNQDISAIIQANAG

SEQ ID NO: 81891 - DNA, 1050 bp, Yersinia pseudotuberculosis IP 32953
  CDS (1)..(1050): transl_table=11
atgaataaacaacaagggagtggtcgtaagcggcaactggcgttaattgtcgccggggtcatcattattgccgccgcgatttcagggtggctttcagtgcggcagaccacactgaacccgctgtctgaggatgcggagttgggggcgagtgtagtgcatattgccagctcggttcctggccgtatcatttcgatcaatgtcgaggaaaatagcaaagtccggcgtggtgacttactgttttccattgagccagatctctaccgtctgcaagtcgaacaagcgcaggctgagttgaaaatggcagaggctgcccacgatacccaacaacggacagtggtcgcggaacgatccaacgccgcgatcaccaatgagcagattgtacgggcgcaagccaatctcaaattagccactcagacattggcgcggttacaacctttgcgccctaaaggctatgtcaccgcccagcaggtagatgatgcagcaacagcgaaacacgatgcggaagtgagtcttaaacaggcattaaaacagtcagtggccgctgaagccttggtcagcagcacggcgtcttctgaagcgctggtggtagcgcgccgtgcagcccttgccattgccgaacgggaactggctaatacgcaaatacacgcgcctaatgatggtcgggtcgtcgggttgactgtttccgcaggggaatttgtcgccccggatcaggctattttcacccttatcaataccgaacattggcatgcttcggcatttttccgtgaaacagagttgaaacatatcaaggtgggtgattgtgccaccgtgtatgtcatggcagataggcagcgggcgattcaaggacgggtcgaagggattggttggggggttagctccgaggatatgctaaatattccgcgcggcctgccttatgtgccgaagtcattaaactgggtgcgtgttgttcagcgtttcccggtgaggatcagcctggaaaaaccgccggaggacctgatgcgtatcggggcgactgctgtggttatcgtgcgaaatgacgacggttgctga

SEQ ID NO: 81892 - protein, 349 aa, Yersinia pseudotuberculosis IP 32953
MNKQQGSGRKRQLALIVAGVIIIAAAISGWLSVRQTTLNPLSEDAELGASVVHIASSVPGRIISINVEENSKVRRGDLLFSIEPDLYRLQVEQAQAELKMAEAAHDTQQRTVVAERSNAAITNEQIVRAQANLKLATQTLARLQPLRPKGYVTAQQVDDAATAKHDAEVSLKQALKQSVAAEALVSSTASSEALVVARRAALAIAERELANTQIHAPNDGRVVGLTVSAGEFVAPDQAIFTLINTEHWHASAFFRETELKHIKVGDCATVYVMADRQRAIQGRVEGIGWGVSSEDMLNIPRGLPYVPKSLNWVRVVQRFPVRISLEKPPEDLMRIGATAVVIVRNDDGC

SEQ ID NO: 81893 - DNA, 993 bp, Legionella pneumophila subsp. pneumophila str. Philadelphia 1
  CDS (1)..(993): transl_table=11
atgagtgacaaacccaaagctggatttcctgtaattattttattatgcgtgtttctattcattctgatttatcattactcgtatttatttccttttacaaacaatgcatttgttgttgcgaatgttcgtccagttgctgccaatgtaaaaggttatatcaccaatatttatgttaaaaatgaacaggaagtaaaaaaaggccaaccattatttaccgtattcaaagccccctatgaattggcctacaggaaagctgtgagccatgttcaagaggcgaaagcccaattattgttattcaataaacaagttgagaaaacgaaatatctgctgcaagcacaaaaagagctttatgaaaaattccgttttgattatgaacataattattctgcctcgcgcgatcacgcagtttctaaactgaccgtcaatacgatgttaaaagaaaaaaatgcggcactaagcaaattaaaagcattggaaaaagagttggaggtcaaccagcaacaagtcattgtgcaaaaaaagaaaattgactctttaattgcggtgatgaagaatgccaaaatcgatttggatgaaaccacagtttatgccaaacaaaatggggcagttcaggatatgtttgttgcattgggaacccccatcaaaacccgaaagcctgtctttgccatagcggataccgataccttgtttatccaggcaaatttcaacgaaacggatttaagaagagtacagccaggggataaagtttctattttcccgcgaatgtattttggatctaaaatttatcatggagtgattctttcaagaaactgggctgcaagccgcctggaaacccatcgggcaacgcaaatacaaattgttcgcaatagcgaaagcaactggtttttattgcctcagcgcctgccagtacaaattcaaataaccgactatgacccggtgcattacccgttaagtataggcgctagcgcctatgtgtatatccatactcattaa

SEQ ID NO: 81894 - protein, 330 aa, Legionella pneumophila subsp. pneumophila str. Philadelphia 1
MSDKPKAGFPVIILLCVFLFILIYHYSYLFPFTNNAFVVANVRPVAANVKGYITNIYVKNEQEVKKGQPLFTVFKAPYELAYRKAVSHVQEAKAQLLLFNKQVEKTKYLLQAQKELYEKFRFDYEHNYSASRDHAVSKLTVNTMLKEKNAALSKLKALEKELEVNQQQVIVQKKKIDSLIAVMKNAKIDLDETTVYAKQNGAVQDMFVALGTPIKTRKPVFAIADTDTLFIQANFNETDLRRVQPGDKVSIFPRMYFGSKIYHGVILSRNWAASRLETHRATQIQIVRNSESNWFLLPQRLPVQIQITDYDPVHYPLSIGASAYVYIHTH

SEQ ID NO: 81895 - DNA, 1068 bp, Bacteroides fragilis YCH46
  CDS (1)..(1068): transl_table=11
atgtccacccatcagataaagctaaaacaattgagaagactgaagttcaggaacatctttctcaacacagtatgcatcctgctggcattggcaggtatttcatggacagtaaactacttctggaaatacgcccgctacgagataaccaatgatgccgtagtggatcaatacatcgctccgctaaacatccggataccgggctatatcaaagaagtacgttttaccgaacaccagtatgttcatgccggcgacacgttactgatactggacgaccgggaataccggatccggctgaaagacgcggaagcggccttgatggatgccttgggatcaaaggaagtgttaaactccggcatccggacttcaggagtaaatgtagccgtgcaggaagccaacatagccgaaacactggcacacctttcacagcaagaagcggaactgaaccgatatacccggctcctgaaaaagcaggccgtcagccaacaggattatgaactggccaaagcgaacttcgaagcgacccgggcaagatacaacgccctgttgcgacaaaaagaagcggcccaatcgcagtattccgaaaccagcaaacgcagtacaggcgccgaagccaatatcctccggaaggaggccgacctggagatggcccgactaaacctgtcgtataccgttgtcaccgcaccctatgacggatacacgggacgacgtacacttgaaccgggacagttcgtacaaggcggacaaactctttcctacctggtacggggcaatgacaagtgggtaacagccaattataaagagactcaaattgcccatatctatatcgggcaaaaagtccgcatcaaagtagatgctttcagcggacgcacttttcacgggaccgtaaccgccatttccgaagccaccggatcgaaatactccctggtaccaaccgacaattcggcagggaacttcgtcaaagtgcagcaacgcattccggtccgaatcgatctcaatgacgcctcacccgaagagatggaatgcctccgtgcagggatgatggtagaaacggaagcggtccgcccttag

SEQ ID NO: 81896 - protein, 355 aa, Bacteroides fragilis YCH46
MSTHQIKLKQLRRLKFRNIFLNTVCILLALAGISWTVNYFWKYARYEITNDAVVDQYIAPLNIRIPGYIKEVRFTEHQYVHAGDTLLILDDREYRIRLKDAEAALMDALGSKEVLNSGIRTSGVNVAVQEANIAETLAHLSQQEAELNRYTRLLKKQAVSQQDYELAKANFEATRARYNALLRQKEAAQSQYSETSKRSTGAEANILRKEADLEMARLNLSYTVVTAPYDGYTGRRTLEPGQFVQGGQTLSYLVRGNDKWVTANYKETQIAHIYIGQKVRIKVDAFSGRTFHGTVTAISEATGSKYSLVPTDNSAGNFVKVQQRIPVRIDLNDASPEEMECLRAGMMVETEAVRP

SEQ ID NO: 81897 - DNA, 1188 bp, Burkholderia mallei ATCC 23344
  CDS (1)..(1188): transl_table=11
atgcccgacccgaacgatgccgccgagcgcggcaacgacgaacgcagcgagcacgacgaacccggccgcgaacgcgcgcgcgagcgccgcgaagaggccgacgcccacgcgcgcgacgcgcggcccggcgacgcgccttccggcgagcgcaagcggcccggcaagaaaccgctcgtcgtgctcgcgatcatcgtcgtgctgctgctcgtcggcgcgttcgtctggtggttcgcgacgcgcaatcaggtcagcaccgacgacgcctacaccgacggcaacgcgatcacgatcgcgccgaaggtgtccggctacgtcgtcgcgctcgcgatcgacgacaacgtctacgtccatcgcggcgatctgctgctcgtgatcgaccagcgcgactatcaggcgcaagtcgacgcggcgcgcgcgcagctcgggctcgcgcaggcgcagctcgacgccgcgcaggtgcagctcgacatcgcgcacgtgcagttccccgcgcaataccggcaggcgcaggcgcagatcgaggccgcgcaggcgagcttcaggcaggcgctcgccgcgtacgagcggcagcacgcggtcgacgcgcgcgcgacatcgcagcaggcgatcgacgtcgccgacgcgcaacggctcaccgccgacgcgaacgtcgcgaccgcccgcgcgcaggcgcgcaccgcgagcctcgtgccgcagcagatccggcaggctcagaccgcggtcgagcagcgccgccagcaggtgctgcaggcgcaagcgcagctcgaggccgcccagctcgcgctgtcgtactgcgaagtgcgcgcgccgtccgacggctggatcacgcgccgcaacgtgcagctcggctcgttcctgcaggcgggcgcggcgctcttcgcgatcgtcacgccacagttgtgggtgacggcgaatttcaaggaatcgcagctcgagcgcatgcgcgccggcgatcgcgtgagcgtgtcggtcgacgcgtatccgaacctcgagctgcacggccacgtcgacagcatccagctcggcagcggctcgcgcttctccgcgtttccgccggagaacgcgaccggcaatttcgtgaagatcgttcagcgcgtgccggtgaagatcgcgatcgacggcggcctgccgcgcgatccgccgctcggaatcgggctgtcggtcgtgccgaaggtgtatctgaaatga

SEQ ID NO: 81898 - protein, 395 aa, Burkholderia mallei ATCC 23344
MPDPNDAAERGNDERSEHDEPGRERARERREEADAHARDARPGDAPSGERKRPGKKPLVVLAIIVVLLLVGAFVWWFATRNQVSTDDAYTDGNAITIAPKVSGYVVALAIDDNVYVHRGDLLLVIDQRDYQAQVDAARAQLGLAQAQLDAAQVQLDIAHVQFPAQYRQAQAQIEAAQASFRQALAAYERQHAVDARATSQQAIDVADAQRLTADANVATARAQARTASLVPQQIRQAQTAVEQRRQQVLQAQAQLEAAQLALSYCEVRAPSDGWITRRNVQLGSFLQAGAALFAIVTPQLWVTANFKESQLERMRAGDRVSVSVDAYPNLELHGHVDSIQLGSGSRFSAFPPENATGNFVKIVQRVPVKIAIDGGLPRDPPLGIGLSVVPKVYLK

SEQ ID NO: 81899 - DNA, 882 bp, Burkholderia mallei ATCC 23344
  CDS (1)..(882): transl_table=11
atgttcttgcgaaaacttttcggcttcgtcgcgacagccgtcatcctgatcgtcgcgatcctgattgggcgcacgctgtgggtccactacatggacgagccgtggacccgcgacggccgcgtgcgcgcggagatcgtcaacgtcgcgccggacgtgtcgggcgcggtcgtcgagttgccggtgcgcgacaaccagttcgtgaagcaaggcgacctcgtgatgcagatcgatccgtcgcatttccggatcgcggtcgagcaggcgcaggcggccgtcgccgcccgccgcgcggagctgcagatgcgccgcgccgacgccgcgcgccgcgcggatctcgacgcgctcgtcgtgtcgaaggaaagccgcgagaattcggcgcagaccgcgtcgagcgccgaggcgcagtatcagcaggcgctcgccgcgctcgacgccgcgaagctcaatctcgagcgcacgcgcgtggtcgcgcccgtcgacggctacgtgacgaacctgcaagtcttcaggggcgactacgcgagcgccggccaggcgaagctcgcgatcgtcgacagccactcgttctgggtctacggctatttcgaggaaacgaagctgccgcgcgtgaagatcggcgcaaaggccgagatgcggctgatgagcggcggcgtgctgaagggccacgtcgagagcatctcgcgcggcatctacgaccgcgacaatccgcaaagccgcgacctcgtcgccgacgtgaaccccacgttcaactgggtgcggctcgcgcagcgcgtgccggtgcgcatccatatcgacgaggtgccgaaggatctcgtgctgtcagccggcacgacctgcacggtgatcgtcgagccggacggcggcggcaagcgcaagtcgtaa

SEQ ID NO: 81900 - protein, 293 aa, Burkholderia mallei ATCC 23344
MFLRKLFGFVATAVILIVAILIGRTLWVHYMDEPWTRDGRVRAEIVNVAPDVSGAVVELPVRDNQFVKQGDLVMQIDPSHFRIAVEQAQAAVAARRAELQMRRADAARRADLDALVVSKESRENSAQTASSAEAQYQQALAALDAAKLNLERTRVVAPVDGYVTNLQVFRGDYASAGQAKLAIVDSHSFWVYGYFEETKLPRVKIGAKAEMRLMSGGVLKGHVESISRGIYDRDNPQSRDLVADVNPTFNWVRLAQRVPVRIHIDEVPKDLVLSAGTTCTVIVEPDGGGKRKS

SEQ ID NO: 81901 - DNA, 1167 bp, Burkholderia mallei ATCC 23344
  CDS (1)..(1167): transl_table=11
ttgcctgcgtcgcccgaaaccgccgcgacgcttgccgcgcgccgggccacgcgccgccgccgcttcgcatggttcttcggagtgctggcgatcgtcgcgctgggcgcggcgctctactggttcatcgtgggccgcttcagcgaagagacggacgatgcgtacgtggcgggcaacgtcgtgcagatcgccgcgcagatccaggggacggtgaccgacgtgctggtggccgacacgcagcaggtaaaggcggggcaggcgctggtgcggctcgacgacgcggaggcggcggcggcgttcgcgcaggcgcaggcgcagctcgcgcaggcggtgcggcaagtggcgaacacgcggctgtcgatgcagacgtacgagcagacggtgaaggcgcgcgaggcggatctgaagctcgcgcagcaggcgtatcgggcgcgggcgggggcgtcggtggaggtggtggcgccggaggagctggcgcgggcgaagtcgtcgctggcgaacgcgcaggcggcgctggcgggagcgcaggcgcaacgggaggcggcgcgcgcgctgggcagcgagcggccggtcgggcagaacccggcggtgcagcaggcggccgcgcagttcaagctggcgtaccggaacctgaagcgcacgacgatcgtgtcgccggtggacgggacggtcgggcagcggtcggtgcagatcgggcagcaggtggggccgggggtgccgctgatgtcggtggtgcagttgcggcaggtgtgggtggaggcgaacttcaaggaagggcagttgcggcacatgcgggtgggccagccggtgcggctcgaatcggacctgtacggcgcgcgggtgacgtatcacggccgagtggagggcttctcggcgggcacgggcagcgcgttctcgatgctgccgtcgcagaacgcggcggggaactggatcaaggtggtgcagcgcttgccggtggtgatctcgctggagccgtcggagctggcggcgcacccgttgcgggtggggctgtcgatgcgcgcgacggtgcagacgaaggcgcgcggcgggcatctgctggacggcgacgcgccgctgccggcgcagcgcacgcgggtgcacgaaatgcacgcgggcgaggcggaggcggcggccgaggcggtgatccgcgcgaacgacggtgggcagtga

SEQ ID NO: 81902 - protein, 388 aa, Burkholderia mallei ATCC 23344
MPASPETAATLAARRATRRRRFAWFFGVLAIVALGAALYWFIVGRFSEETDDAYVAGNVVQIAAQIQGTVTDVLVADTQQVKAGQALVRLDDAEAAAAFAQAQAQLAQAVRQVANTRLSMQTYEQTVKAREADLKLAQQAYRARAGASVEVVAPEELARAKSSLANAQAALAGAQAQREAARALGSERPVGQNPAVQQAAAQFKLAYRNLKRTTIVSPVDGTVGQRSVQIGQQVGPGVPLMSVVQLRQVWVEANFKEGQLRHMRVGQPVRLESDLYGARVTYHGRVEGFSAGTGSAFSMLPSQNAAGNWIKVVQRLPVVISLEPSELAAHPLRVGLSMRATVQTKARGGHLLDGDAPLPAQRTRVHEMHAGEAEAAAEAVIRANDGGQ

SEQ ID NO: 81903 - DNA, 1230 bp, Burkholderia mallei ATCC 23344
  CDS (1)..(1230): transl_table=11
atggctatcttgcgtacttcccgttcgcggatcgcggccgcggcgttcgcggtcgtcttcatcgcgggcctcggcacgttcggcgcgatccgcgtgaatgccggcgcgccggagaaatcggcggcgccgctgccggaggtcgacgtcgcgaccgtgctgtcgaagacgatcaccgattggcagtcctactcgggccgcctcgaggcggtcgagaaggtcgacgtgcgcccgctcgtgtccggcacgatcgtgtcggtgaatttcaaggacggcgcgctcgtgaagaagggcgacgtgctgttcgtgatcgatccgcgcccgtatcaggccgaggtcgatcgcgcggccgcgcagctcgccggcgcgcaggcccgcaatggctacgcacagagcgactggcagcgcgcgcagcggctgatcggcgacaacgcgatcgccaagcgcgattacgacgagaagcagaacgccgcgcgcgaggcctcggcgaacctgaaggcggccgaggccgcgctcgagacggcgcgcatcaacctcggctacacgcggatcaccgcgcccgtgtcgggccgcgtgtcgcgcgcggagatcacgctcggcaacgtcgtgtcggcgggcgcgtcggccgcaccgctcacgacgctcgtgtcggtgtcgccgatctacgcgtcgttcgacgcggacgagcagacctacctgcaatacatcggcggcgcgaaggacggccgcaaggtgcccgtcgagctcggcctcgcgaacgagagcggctactcgcggcagggcgtgatcgattcggtcgacaaccggctcgatacgtcgtcgggcacgatccgcgtgcgcgcgcgcttcgacaacgcggacggcgcgctcgtgcccggcctctacgcgcgcgtgaaggtgggcggcagcgcgccgcatccggcgctgctcatcgacgacgcggcgatcaacaccgatcaggacaagaagttcgtgttcgtcgtcgatcagcagggccgcgtgtcgtatcgcgaggtgcagctcggcgcgcagcacggcaaccagcgcgtgatcgtgggcggcctggctgcgagcgagcgcatcgtcgtgaacggcacgcagcgcgtgcggccgggcgagcaggtgaagccgcatctcgtgccgatgacgggcggcgacgacgctgccgccgcgacgcccgtcgcgggcggcgtgcagcgtccgcgggccgcgcagggcaacgcgcgcgcgtga

SEQ ID NO: 81904 - protein, 409 aa, Burkholderia mallei ATCC 23344
MAILRTSRSRIAAAAFAVVFIAGLGTFGAIRVNAGAPEKSAAPLPEVDVATVLSKTITDWQSYSGRLEAVEKVDVRPLVSGTIVSVNFKDGALVKKGDVLFVIDPRPYQAEVDRAAAQLAGAQARNGYAQSDWQRAQRLIGDNAIAKRDYDEKQNAAREASANLKAAEAALETARINLGYTRITAPVSGRVSRAEITLGNVVSAGASAAPLTTLVSVSPIYASFDADEQTYLQYIGGAKDGRKVPVELGLANESGYSRQGVIDSVDNRLDTSSGTIRVRARFDNADGALVPGLYARVKVGGSAPHPALLIDDAAINTDQDKKFVFVVDQQGRVSYREVQLGAQHGNQRVIVGGLAASERIVVNGTQRVRPGEQVKPHLVPMTGGDDAAAATPVAGGVQRPRAAQGNARA

SEQ ID NO: 81905 - DNA, 1026 bp, Methylococcus capsulatus str. Bath
  CDS (1)..(1026): transl_table=11
atgcgactgcccatctccccgcggcatctgctgcttctcgccggcttggcgtccctgagtacgggcggcgcagcgtactggctcgaggccatactcccctacgaaaccactgacaacgcttacctcaaggcacacctcatcctgctcagttccaaggaaacaggctacgtgaaagaggtgttgctccaggacaatcagcaggtgaggaaaggggacctcctggcggtgatagacgatcaggaattcaaggcgcgcgtcgccgaagccggcgccgaggtggcggcgaccgcggcgcgcatcgaagccctggaatccgagaaacggacccaggcggccagggtccgcgaagaagacgccaacatcgcctcggccctggccgaccatgaccgttcgcggcgtgacctgcaacggctcgaccgactggccgacgccggcgccgcctcggcccagtcgctggatggcgcggaagccgcctacaaacaggccaaagcactgctggacaagaaccgctcggcgcgggaccaggccgaaatccgcctgatcgccctgaatgcgctgatcgccgaaacccgggcccagctgcagcgggcccaggcccggctggaattggcccggatcgacctggaaaacacccgcatcctcgcccccatcgacgggacggtaggaaatctgagccttcaggtcggccaactcctccagcccggtagcgtcattgcctatctgatcccggcggacggagtgttcgtcgaggccaacttcaaggaaacccagatcgaacacctgcggatcggccagacggcgagcgtcgtcgtggacgcctatcccgaccggccgttcgaggcggtggtggacagcctggcgcccgccagcggatcggaattcagtatcctgccgccggagaatgccaccggcaatttcaccaaaatcgtccgccggcttccggtcaagctggccttcgcccccggtaccgacctcagtctcctcaagcccggcctgtcggtgcaagtcagtatcaaagtgcgctga

SEQ ID NO: 81906 - protein, 341 aa, Methylococcus capsulatus str. Bath
MRLPISPRHLLLLAGLASLSTGGAAYWLEAILPYETTDNAYLKAHLILLSSKETGYVKEVLLQDNQQVRKGDLLAVIDDQEFKARVAEAGAEVAATAARIEALESEKRTQAARVREEDANIASALADHDRSRRDLQRLDRLADAGAASAQSLDGAEAAYKQAKALLDKNRSARDQAEIRLIALNALIAETRAQLQRAQARLELARIDLENTRILAPIDGTVGNLSLQVGQLLQPGSVIAYLIPADGVFVEANFKETQIEHLRIGQTASVVVDAYPDRPFEAVVDSLAPASGSEFSILPPENATGNFTKIVRRLPVKLAFAPGTDLSLLKPGLSVQVSIKVR

SEQ ID NO: 81907 - DNA, 1113 bp, Methylococcus capsulatus str. Bath
  CDS (1)..(1113): transl_table=11
atgacctacgccaccctcccgtggaaaccgggaatcttcgtcctcaccgccattctcgtaatccttgcgctcgcggcctgttccgacagccgcggcggcgcggagcaaacccggccggtcgtcaccttccgggtcgccgcagaaaccggttccgccggcatgagcttcgccggcgagatccgggcccgccacgaaaccaccctgtctttccgggtcgccggaaaactggcttcccgtccggtcgagctgggcgaccgggtccagaaaggccagctgctggccgccctggaccccgccgattacgaactggccgtgcagtcagccaaagcccagctggcggccgccagggcagaattggaattctcccgcgaggaccttcagcgataccgtgaactcctggaacagcgggtcgtcagccctcccgaattcgatcgccgccgtaccgcctataccgccgcgaaagagcgtgtggccgcgctcgaggctcaggcgaccgaggcggccaaccgggtggactatacggcgctgcgcgccgaccggggcggcgtggtgaccgcggtctcggcggaaaccggccaggtgctggccgccggccagccggtgctcacgctggcccgcctcgacgaaccggagatcagcgtcgatgtccccgagcaccgcgtcggcctgctccagccaggccaggaagcagcggtgacgctctgggccgacggacggcggctcaaggcgcgcctccgtgagatcgccgcggcggcggaccctgcgagccgaacctaccgggtacgggccacgctgctcgaaggccaggagaccgtccgtctcggcatgacagcgaccctctggatcgacgccggcggcacggaacgggcgacgatccccctttcggccgtgttcagtccccagcagcagcccgctccgcctcgcgtctggctggtggacgaagcacggctcaccgtcaagtcggtgcccgtccggctgaacgaagtcacgggcgcggaacgcgtttcggtcgaaggcgtggcgcctggccaactggtggtgagtgccggcgtacagcgcctgaccgagggccagaaagtacgtatcatccccgacccggccggccgtccatga

SEQ ID NO: 81908 - protein, 370 aa, Methylococcus capsulatus str. Bath
MTYATLPWKPGIFVLTAILVILALAACSDSRGGAEQTRPVVTFRVAAETGSAGMSFAGEIRARHETTLSFRVAGKLASRPVELGDRVQKGQLLAALDPADYELAVQSAKAQLAAARAELEFSREDLQRYRELLEQRVVSPPEFDRRRTAYTAAKERVAALEAQATEAANRVDYTALRADRGGVVTAVSAETGQVLAAGQPVLTLARLDEPEISVDVPEHRVGLLQPGQEAAVTLWADGRRLKARLREIAAAADPASRTYRVRATLLEGQETVRLGMTATLWIDAGGTERATIPLSAVFSPQQQPAPPRVWLVDEARLTVKSVPVRLNEVTGAERVSVEGVAPGQLVVSAGVQRLTEGQKVRIIPDPAGRP

SEQ ID NO: 81909 - DNA, 1074 bp, Legionella pneumophila str. Paris
  CDS (1)..(1074): transl_table=11
gtgaaagagaagtttgccacatggtctaaaatagtaactaaacatatccggtttttctttagttattctatccctatgttttttaaaaaggccaaaaattacactaatcttcccattattgtcgttggcttggctcttattattggtctttttcatttattttcctatttgatccctttcactgacaatgcgtttgttgttactaatgttactcctgtagctgctgatgtatctggttttattactgaaatctatgtaaaaaatggccaaaaagtaaagaagaacgatcctatatttagcgtttacagggttccttatgagttggcttatcagcaagcaatggctgattacaaggaaggattaaagaaaatagacgtgtttcaaaagcagattgaaagaacggttgctttgattaaagcaacggacgctgagcttgaaaaagcgcaatttgctcttggccttaaaaaaaataagaacgtggccgaagcagtatctgttcttgaattaaaaaatcttggttatgatgtttctactttaagtaataaaagaaatgctctgcaacaggaagtagcggttttgcaagccaaaattgaacaacaaagacatactgttgccagccttaaggcaaaaatggataatgccaaggttaatcttgatttaaccattgtcagagctcctggtgatggagtgatagataatatgtatgtctctccaaatacccctatcgagatccataaaccggtgttttcttttatagatactgcaaattattatatccaggctaattttaatgaaacggacttacgcaatgtacggcaaggtgataaagcatatatcattttacgtatgtattattttgacaaaatatttcatggggttgttgtcaactcgttatgggctgctgaacgacaaagcactgctccaaagagtcaaattcaggttgttacaaatcaaaatgaatggctattgcttcctcagcgatttccattacaaatcaagatattggatcccgatcctgactaccctttaaatcctggcgccagtgcttatgtttatatctcaactaaaagataa

SEQ ID NO: 81910 - protein, 357 aa, Legionella pneumophila str. Paris
MKEKFATWSKIVTKHIRFFFSYSIPMFFKKAKNYTNLPIIVVGLALIIGLFHLFSYLIPFTDNAFVVTNVTPVAADVSGFITEIYVKNGQKVKKNDPIFSVYRVPYELAYQQAMADYKEGLKKIDVFQKQIERTVALIKATDAELEKAQFALGLKKNKNVAEAVSVLELKNLGYDVSTLSNKRNALQQEVAVLQAKIEQQRHTVASLKAKMDNAKVNLDLTIVRAPGDGVIDNMYVSPNTPIEIHKPVFSFIDTANYYIQANFNETDLRNVRQGDKAYIILRMYYFDKIFHGVVVNSLWAAERQSTAPKSQIQVVTNQNEWLLLPQRFPLQIKILDPDPDYPLNPGASAYVYISTKR

SEQ ID NO: 81911 - DNA, 993 bp, Legionella pneumophila str. Paris
  CDS (1)..(993): transl_table=11
atgagtgacaaacctaaagctggatttcctgtaattattttattatgcgtgtttctgttcattctgatttatcattactcgtatttatttccttttacaaacaatgcatttgttgttgcgaatgttcgtccagtcgctgccaatgtaaaaggttatatcaccaatatttatattaaaaatgaacaggaagtaaaaaaaggccaaccattatttaccgtattcaaagccccctatgaattggcctacaggaaagctgtgagcgatgttcaagaggcgaaagcccaattattgttattcaataaacaagttgagaaaacgaaatatctgctgcaagcacaaaaagagctttatgaaaaattccgctttgattatgagcataatcattctgccttgcgtgatcacgcagtttctaagctgaccgtcaatacgatgttaaaagaaaaaaatgcggcactaagcaaattaaaagcattggaaaaagagttggaggtcaaccagcaacaagtcattgtgcaaaaaaagaaaattgactctttaattgcggtgatgaagaatgccaaaatcgatttggatgaaaccacggtttatgccaaacaaaatggggcagttcaggatatgtttgttgcattgggaacccccatcaaaacccgaaaaccagtctttgccatagcggataccgataccttgtttatccaggccaatttcaacgaaacggatttaagaagagtacagccaggggataaagtctctattttcccgagaatgtattttggatctaaaatttatcatggagtgattctttccagaaactgggctgcaagccgcctggaaactcatcgggcgacgcaaatacaaattgttcgcaatagcgaaagcaactggtttttattacctcaacgcctgccagtacaaattcaaataacagattatgacccggtgcattacccgttaagtataggcgctagcgtctatgtgtatatccatactcattaa

SEQ ID NO: 81912 - protein, 330 aa, Legionella pneumophila str. Paris
MSDKPKAGFPVIILLCVFLFILIYHYSYLFPFTNNAFVVANVRPVAANVKGYITNIYIKNEQEVKKGQPLFTVFKAPYELAYRKAVSDVQEAKAQLLLFNKQVEKTKYLLQAQKELYEKFRFDYEHNHSALRDHAVSKLTVNTMLKEKNAALSKLKALEKELEVNQQQVIVQKKKIDSLIAVMKNAKIDLDETTVYAKQNGAVQDMFVALGTPIKTRKPVFAIADTDTLFIQANFNETDLRRVQPGDKVSIFPRMYFGSKIYHGVILSRNWAASRLETHRATQIQIVRNSESNWFLLPQRLPVQIQITDYDPVHYPLSIGASVYVYIHTH

SEQ ID NO: 81913 - DNA, 1038 bp, Legionella pneumophila str. Lens
  CDS (1)..(1038): transl_table=11
atgaaaaaattgatggaatatggtggaaaaataaaagagtacttgtttcgtttaaaaccaaaacgctggtttactcttactaacgtcattatttttatcggttttcttactgcaattatctatgttttttcctatttgatcccttttactgataatgcgtttgtagtaaacaatgtacgtccggttgcagcattaacaagcggatatataaccgagctttatgtaaaaaatggtgatgcagtgcgtaagggacaaaaactatttaccgtatttaaaaagccctatgaatacactgttgaacagctcaatgctgatttagctggagcacaggcaaagttggcagtattaaaggctacgtacgaacgggatttgaagcttagcgagaatgagcaaaaaatatacaaaaagttggcgcaagatgatcaaaaataccttaaagggtatgctataaaatctgtttctctgattaccctgcaaaactcccagcaagaaacaaaagcagctaaagataaatggcaggcttcattaaaacaacttgaaatagatcagcatcaaataacagttcaggagaatgaaataaaatccattcaggcccggttaaaaaatgccaaagtcaatttggatttaacggatgtttatgctcagggtaatggagttattcaaaatttgttttttaccataggaactccagtcaatatcaatcagccattattctcattggttgatcaggataatatttatattcaggccaattttaacgagacggatttgcgtgatgtgcgcaagggctcaaaggtattgatatttccaagaatgtatttaggaagaaaaatatttcatggtgttattgattctgattattggtccgcgaataggcaattggtggatgatcgtactcagctgcaaaatgttatcaatgaaaatcaatggattttattgcctcagcgccttcctgtgattataaaggttactgaccctgaccctaaatacccgcttcgtgttggagctagcgcttatgtctatgtcgaagtttattga

SEQ ID NO: 81914 - protein, 345 aa, Legionella pneumophila str. Lens
MKKLMEYGGKIKEYLFRLKPKRWFTLTNVIIFIGFLTAIIYVFSYLIPFTDNAFVVNNVRPVAALTSGYITELYVKNGDAVRKGQKLFTVFKKPYEYTVEQLNADLAGAQAKLAVLKATYERDLKLSENEQKIYKKLAQDDQKYLKGYAIKSVSLITLQNSQQETKAAKDKWQASLKQLEIDQHQITVQENEIKSIQARLKNAKVNLDLTDVYAQGNGVIQNLFFTIGTPVNINQPLFSLVDQDNIYIQANFNETDLRDVRKGSKVLIFPRMYLGRKIFHGVIDSDYWSANRQLVDDRTQLQNVINENQWILLPQRLPVIIKVTDPDPKYPLRVGASAYVYVEVY

SEQ ID NO: 81915 - DNA, 897 bp, Photobacterium profundum SS9
  CDS (1)..(897): transl_table=11
gtgattttgaacaagattaaaaaactatttgttatagcgcttaatatcctaatcataggaggcgcaatttatctggggtatcagaaatatgaagagtatttcaacaacccatggacacgcgacggtcaagtacgggcaaatataatcaaagtagcgcctcgtgtttcaggacccattgtgaatgtggcggtaaatgataaccaatttgtacgtaaaggtgatttactgttccaaatagatccaagtacttatgcgatttctttatcacaagctgaagtatcactagagcgttcaaaagtaagctcgcgcggtaaaaaaatcgaatacgatcgactactggatattcgcgctaaagataaaggggcggtatctcataaagatcttgtacgtcgacaaattacgtatgaagaatcattgctgcaaattaagtcagcagaagaacaattaaaagccgcgaagttgaacatggggttcactaatgtgcatgcatcggttgatggctacgtatccaatgttgatattcgtaatggcactcaagctgttgccaatcagcctttgattgcgttagtcgatagtaatagcttctgggtatttggctactttcgtgaaaaccagttagagcaaatacaaattggcagtaaagctaaagtaacgctaatggcacatcccgacaaacccattgatgcggttgttgaatcgttaggctggggtatagccccgaaagacggcaccgtagggtataacttactgcccaacgtgaaccctgtttttcagtggatacgattagcacagcgtattcctgttcgtattgcccttaatgaattacctgaaggtgttgcgctacggtttggtttgtctgcatcgattatggtgcagcaagaacaaccagaagagtaa

SEQ ID NO: 81916 - protein, 298 aa, Photobacterium profundum SS9
MILNKIKKLFVIALNILIIGGAIYLGYQKYEEYFNNPWTRDGQVRANIIKVAPRVSGPIVNVAVNDNQFVRKGDLLFQIDPSTYAISLSQAEVSLERSKVSSRGKKIEYDRLLDIRAKDKGAVSHKDLVRRQITYEESLLQIKSAEEQLKAAKLNMGFTNVHASVDGYVSNVDIRNGTQAVANQPLIALVDSNSFWVFGYFRENQLEQIQIGSKAKVTLMAHPDKPIDAVVESLGWGIAPKDGTVGYNLLPNVNPVFQWIRLAQRIPVRIALNELPEGVALRFGLSASIMVQQEQPEE

SEQ ID NO: 81917 - DNA, 1080 bp, Photobacterium profundum SS9
  CDS (1)..(1080): transl_table=11
ttgtaccgtactgtgttaattatggctgtgaatatgaatatgaatatgaatatgaaaacaatgataaaaaaaagcgtagttgcaagtttgctagcgtgcgctgttgcagggttttactattacctagcaccagcgccgggtatggtggcaaccgacaatgcctatgtacacggagaaatatcccaaatcagcgccgaggttgcaggtgtcgtgaccaaggtctatgtcaccgataaccagtatgtacaggcgggtgaactgctggctgaagtcgacaaacgcgactacatcgcccttagggatcaggctaaaagcgccttcgcgatggctgaagcgactgtggataatgttaatgagcgtataaaactgcaaatgatcaatatcaatgaagcggccacccgcatcacttcagccaaatccgatgcagacttccagcataaagagtggcaacgtttttccgatctgctgcgcaaaaagctgatttcaaaatcaagctatgacggccagaagactcagatgcagcaatctagtgccgatcttgatgccaccaaattacagctggcagcagccaagcagcagctaactaccctgaaaaccgagcgggcgcgtatgatcgcccaacgcgatcaaaccgacgctgcattggatctggcgaagttgaatctggaagataccgagcttcgagcaccaatcagcggtatcgtcggcaaccgagtggttcgtgccggacgctatgtcaacaaaggtaatcctctgctggcgatagtgccaatcgacgatatctggatagaggctaattacaaagaaaatcagatcaccaacatctacccaggtcaggaagtgcatatcaacttagatagctttcctaattaccagctcaagggatatgtgatcagtgcttcgcctgccactggcgcacaattcagtctactaccgcccgacaatgccactggcaacttcgtcaaaattgttcagcgagtacccgttaagatctctattcaactacctgatgagcttcgcggcagaatcgttcccggtctgtctgccgaagtcgaagttgataccaacgacaaggcctaa

SEQ ID NO: 81918 - protein, 359 aa, Photobacterium profundum SS9
MYRTVLIMAVNMNMNMNMKTMIKKSVVASLLACAVAGFYYYLAPAPGMVATDNAYVHGEISQISAEVAGVVTKVYVTDNQYVQAGELLAEVDKRDYIALRDQAKSAFAMAEATVDNVNERIKLQMININEAATRITSAKSDADFQHKEWQRFSDLLRKKLISKSSYDGQKTQMQQSSADLDATKLQLAAAKQQLTTLKTERARMIAQRDQTDAALDLAKLNLEDTELRAPISGIVGNRVVRAGRYVNKGNPLLAIVPIDDIWIEANYKENQITNIYPGQEVHINLDSFPNYQLKGYVISASPATGAQFSLLPPDNATGNFVKIVQRVPVKISIQLPDELRGRIVPGLSAEVEVDTNDKA

SEQ ID NO: 81919 - DNA, 1068 bp, Photobacterium profundum SS9
  CDS (1)..(1068): transl_table=11
atgcaaactgctgaattaaaatttcgccgttggatgcaaagcctcatcattatttttatccttttcgctggctacattgttattgcagatcggcatgctcccttaacgacagagagccgcgttcaaggctatgttattcagcttgcaccagaagtcacaggtactgttacagatgtacaagttggtaataatcaagcagtcaaaaaaggggcgcctctttttactattgattcaagtcgatataccttggcggttgaaagagctgaagtcgccctaaaacaggctcatgaacaagaaagtgccttgtacgccaaagtgagctcaggtaaggcaaaagtggccacaactcaggcgtcttatactaatgcgcgcagtgaatatcagcgtgtgaaaaaattagcacgacaaaaactggtatcagcgtcaatgctagataacgcgttagctaataacagtgtggctttatctaaccttcatgcagcgcaacaagacttactttcattacaagtgcaactcggtaatacccctggagaaagtaccctagttcacgcggctgaaaatgccctagagcaagcacaactcgacttatcacacacccaagttattgcccctagtgatggcgttattaccaacttacaacttgaagtcggcagcacagcaagtactaatatgccgttattgacattcattccaaccgattcgttatgggtagccgctgattttcgtgaaaaagccatcgcactaatgaatgagcattcaactgccttagtgacttttgatgcatttcccggcgaaacattcgcattcaacattcaaagccgtgattttggtgtagccgccgcacagcaaagtcctaatggtaaattaacggctgttgaaacaaataacagatgggtacgagatgcccaacgggttcgtgtgaatttatcaacagataaacctttacctaaacaactctttgtaggctcacgagccactgttgttatttaccctagcggtaaccctatctgggcattattggccaaaatacaaatttcgctagtcggcatgttgcactacatctactaa

SEQ ID NO: 81920 - protein, 355 aa, Photobacterium profundum SS9
MQTAELKFRRWMQSLIIIFILFAGYIVIADRHAPLTTESRVQGYVIQLAPEVTGTVTDVQVGNNQAVKKGAPLFTIDSSRYTLAVERAEVALKQAHEQESALYAKVSSGKAKVATTQASYTNARSEYQRVKKLARQKLVSASMLDNALANNSVALSNLHAAQQDLLSLQVQLGNTPGESTLVHAAENALEQAQLDLSHTQVIAPSDGVITNLQLEVGSTASTNMPLLTFIPTDSLWVAADFREKAIALMNEHSTALVTFDAFPGETFAFNIQSRDFGVAAAQQSPNGKLTAVETNNRWVRDAQRVRVNLSTDKPLPKQLFVGSRATVVIYPSGNPIWALLAKIQISLVGMLHYIY

SEQ ID NO: 81921 - DNA, 1173 bp, Photobacterium profundum SS9
  CDS (1)..(1173): transl_table=11
atgtctgacgagaacatgcctaaggtgcaggttgagccaagggaaaggatcgcatctaaatcaggaaagcccaaacgtgtcaaaaaagtgcgtgtcaaaaaagagaaatccccgcccaataaagtaaaacgcttaacaacgtttgtacttgctttatgtcttggtttatttgttttctatattgccgccgaccgtattatcccatctacagatatggcacgtgttcgtggctttgttattcctattacaccattagtctctggacggttagccgaagtcaccgtagagcccaatgagattgttaaccctggcgatattttggtgaaaattgattctgctgattatgaactcgctattcaggaagcagaacaagggttagtcaatgctgggaaaagtgttggcgtacaaactgcgtccattgcttcagcccaagccaaattaactgacgcattagccaatcaagcccacttacgagcacaagccacacgtatattaaccatggaaaaaaaaggcattgtctcgaaatctgatgccgataaaacacgcgcttcacttgccagtgcgaaagcacaagtagaagctgcacaagctggtatagaacaagcaaagaaacagctaggctcaactggtaatgaaaatagtgaagtaaaatcagccttattaaaattacaaaaagcacaacttgatttagatcgcacggtcatcagggcaccagcgattggtggcgtaacaaacttccgtttagatgaagggttttacgcccaagcaggccaaccgttattcacctttgtttcgggtgaagacgtttggattgatgcctattttcgtgaaaacagtattggcaacatgaaagttggcgatagcgtcgacatcgttttggattatgctcctggtcgcgtttttgcaggaaaaatagcaggcattgattggggcattagctggggagaaaatgaacaagcaggtaaactcgccgccgttacgtctcaaacaggttggctacgacagactcaacgattcccggtgacgattcggtttgatgatgaaacagcccgaggttttcgtcgagtaggtggccaagccgacatcattgtatataccgagcaatcttcaattatgaatacgtttggtcgggtatggattcgtataatgagctggttatcttatgtccgttaa

SEQ ID NO: 81922 - protein, 390 aa, Photobacterium profundum SS9
MSDENMPKVQVEPRERIASKSGKPKRVKKVRVKKEKSPPNKVKRLTTFVLALCLGLFVFYIAADRIIPSTDMARVRGFVIPITPLVSGRLAEVTVEPNEIVNPGDILVKIDSADYELAIQEAEQGLVNAGKSVGVQTASIASAQAKLTDALANQAHLRAQATRILTMEKKGIVSKSDADKTRASLASAKAQVEAAQAGIEQAKKQLGSTGNENSEVKSALLKLQKAQLDLDRTVIRAPAIGGVTNFRLDEGFYAQAGQPLFTFVSGEDVWIDAYFRENSIGNMKVGDSVDIVLDYAPGRVFAGKIAGIDWGISWGENEQAGKLAAVTSQTGWLRQTQRFPVTIRFDDETARGFRRVGGQADIIVYTEQSSIMNTFGRVWIRIMSWLSYVR

SEQ ID NO: 81923 - DNA, 1173 bp, Salmonella enterica subsp. enterica serovar Paratypi A str. ATCC
  CDS (1)..(1173): transl_table=11
atgagcgcaaatgcggagatccaaaccccgcagcaaccggctaagaagaaaggcaaacgcaaaacagcgctgctacttcttaccttgctctttgttattattgccgtggcatatggaatttattggtttttagtattgcgtcatattgaagagacagatgatgcttacgtggcagggaaccaggttcaaatcatggcgcaggtgtcaggcagcgtgacgaaagtctgggctgataacaccgactttgtaaaagagggcgatgttctggtcacgctcgatcagactgacgccaaacaagcgtttgaaagagccaaaacggcgctggcctccagcgtgcgccagacgcaccagttgatgattaacagcaagcagttgcaggcgaatatcgacgtgcaaaaaaccgccctggcgcaagcgcaaagcgaccttaaccgtcgtgtgccgctgggtaatgccaatcttattggccgtgaagagctgcaacacgcccgcgatgccgtcgccagcgcgcaggcacagctggatgtcgccattcaacagtacaatgccaaccaggcaatgatactcaacagtaatctggaagatcagcctgcggttcaacaagcggcgaccgaagtgcgtaacgcctggctggcgctggagcgtactcgcatcgtcagtccaatgaccggttatgtttcccgccgcgccgtccagcctggcgcgcagatcagccccaccacgccgctgatggccgtcgtgcctgcaaccgatctgtgggtggacgctaactttaaagagacccaattagcgaatatgcgcattgggcagccagtgacgattattactgacatttatggcgacgacgtaaaatacaccggtaaagtcgtcggtctggatatggggacaggcagcgccttctccctgctgcccgcgcaaaatgcgacgggtaactggattaaagtggttcaacgtctgccggtacgcgtcgaactggacgcccgccagttagaacaacatccgctgcgcattggtttatcgacgctggtcaccgtggataccgctaatcgcgacggtcaggtactggccagccaggtacgaacgacgccggttgccgaaagtaacgcacgcgaaattaatctcgcgccggtcaataaactgatcgacgacatcgtacaggctaacgcgggttaa

SEQ ID NO: 81924 - protein, 390 aa, Salmonella enterica subsp. enterica serovar Paratypi A str. ATCC
MSANAEIQTPQQPAKKKGKRKTALLLLTLLFVIIAVAYGIYWFLVLRHIEETDDAYVAGNQVQIMAQVSGSVTKVWADNTDFVKEGDVLVTLDQTDAKQAFERAKTALASSVRQTHQLMINSKQLQANIDVQKTALAQAQSDLNRRVPLGNANLIGREELQHARDAVASAQAQLDVAIQQYNANQAMILNSNLEDQPAVQQAATEVRNAWLALERTRIVSPMTGYVSRRAVQPGAQISPTTPLMAVVPATDLWVDANFKETQLANMRIGQPVTIITDIYGDDVKYTGKVVGLDMGTGSAFSLLPAQNATGNWIKVVQRLPVRVELDARQLEQHPLRIGLSTLVTVDTANRDGQVLASQVRTTPVAESNAREINLAPVNKLIDDIVQANAG

SEQ ID NO: 81925 - DNA, 1062 bp, Idiomarina loihiensis L2TR
  CDS (1)..(1062): transl_table=11
atgaccgcagacgaaaagtttgcccgttgggttaagcgggcgctggtactattcgtactcgtatttgcctattttctgtgggccgacttgagcctgccgctgactccacaggcaatggtaacccgggtggtgactcaggtcgcaccgcaggtgaatggtactgtagagaaagtcttggttaataataaccagtatgttgaagagggcgagccattatttaaaatcgacccgcgaccttatcaactgcaattacagcaagcagagctggcaatggctcaggcgcaacagtcaaaccagcagtttgatgcccaaattcgaactgcccaggcaaagataaaatcagcacaggcaacagctcaagagcttagccgtgaggcccgtcgcattaaagatctggtggaagatggcagttcgtcgcagcaggcatttgaccgtgcgcagagcagtaagttagaggctctggcaaatgttgaagctgcccagtcacagctacagagcttaaaagtgcagcgaggtgccgaggacgatgcaaacaacttacttattcaacaagctaaaaatgcgatagaaacggcgaagcttaacttaagctacaccaccgtgcgtgcgaaacatgccggacgtgtcggcaatctaaagctcagcgaaggggcttatgcccgtcaaggcacgccgctaatggctctagtctcacccaatgccgacattattgcggattttcgggagaagaatttacgaaacatagaatctggccaacaggctctcgtggtatttgatgccgaacctggcacgctttacgaggctaaagtggaaagcattgatgccggtgttaacgcgggtcagttaagtgccgacggagccttagcagcaccggttaactcaaaccggtgggtacgtgacgcgcagcgacttcgggtgcatttgcgtttaacggagaaaccggattcagagcgtccggccggagcaaaggctacagtgcagatagttcctgaaggaagctttaaagccgctatcgcgaaagcgcaaattcggttgctgggctggttgcactacatttattga

SEQ ID NO: 81926 - protein, 353 aa, Idiomarina loihiensis L2TR
MTADEKFARWVKRALVLFVLVFAYFLWADLSLPLTPQAMVTRVVTQVAPQVNGTVEKVLVNNNQYVEEGEPLFKIDPRPYQLQLQQAELAMAQAQQSNQQFDAQIRTAQAKIKSAQATAQELSREARRIKDLVEDGSSSQQAFDRAQSSKLEALANVEAAQSQLQSLKVQRGAEDDANNLLIQQAKNAIETAKLNLSYTTVRAKHAGRVGNLKLSEGAYARQGTPLMALVSPNADIIADFREKNLRNIESGQQALVVFDAEPGTLYEAKVESIDAGVNAGQLSADGALAAPVNSNRWVRDAQRLRVHLRLTEKPDSERPAGAKATVQIVPEGSFKAAIAKAQIRLLGWLHYIY

SEQ ID NO: 81927 - DNA, 1206 bp, Zymomonas mobilis subsp. mobilis ZM4
  CDS (1)..(1206): transl_table=11
atggcagataacaataccacggttcaggccgccgcagatcagggtgacagcaagctgtcattggataaacaggacgctacccagaataccgcttccgagccggatgaacagaataaatccaatagaaaacgctggttacgctctctagctattttgctgatcgtgatcgcgattatctatggtatctggtatttcttggtcggttcccgtcatgcgtcaactgacaacgcttatactaatgctgaatccgcgcaggtcatggccttggtctcggggccggtcgcgcaggtctttgtttccgatacccaacaggttcaaaaaggggatttgttggttcgtcttaatcctgatgaccaaaagatttctttagcaaaggctgaagctgattttgcagcggcagaaagaaaattcggacagacttcggccagcagtgatgccttgtcccaagctattgttgcgcagcaggctaatgtcgagcaagctgaagccaattacctgtccgcgcagtcaacctatcatcgggcagaaaccgactataaccgtcgtcgttccttagttgaatccggtgccgtgtcacgggatgaaatgacggctatttccaatgctttggaaaaagcacgggcggctttgttgcaaagtcatgctgctgtcgatcaggcccatgccgcaaaagaagaagcaatcggtaattttgaagccaatcaggctttgattaaaaacacaacggtcagcaccaacccgcaagttcgtgccgccaaagccgccttggatcaggcgcgtttagacaatagtcgtcttgaaattcgcgcccctatggcaggcgttgtgacccaaagacaggttcaggtcggtcagcgtgttaatgtcggtaccccgattgcaaccattgtgccgatcgaacaaatttatgtcgatgccaatttcaaagaaacccagcttggcaaggtcaaggttggccagacggcaactgtcaaatctgatctttacggtggtgatgtcgtctatcacggtcatgtcgtcggtttttcaggcggcaccggctctgccttttctcttatccctgcccagaatgcgacgggtaactggatcaaagttgttcagcgtttgcctgtccgtattgcccttgatcccaaggaattgagagcccatccgttgcgcgtgggtttgtcgatggaggctgacattgacctttcttcaaaaaattag

SEQ ID NO: 81928 - protein, 401 aa, Zymomonas mobilis subsp. mobilis ZM4
MADNNTTVQAAADQGDSKLSLDKQDATQNTASEPDEQNKSNRKRWLRSLAILLIVIAIIYGIWYFLVGSRHASTDNAYTNAESAQVMALVSGPVAQVFVSDTQQVQKGDLLVRLNPDDQKISLAKAEADFAAAERKFGQTSASSDALSQAIVAQQANVEQAEANYLSAQSTYHRAETDYNRRRSLVESGAVSRDEMTAISNALEKARAALLQSHAAVDQAHAAKEEAIGNFEANQALIKNTTVSTNPQVRAAKAALDQARLDNSRLEIRAPMAGVVTQRQVQVGQRVNVGTPIATIVPIEQIYVDANFKETQLGKVKVGQTATVKSDLYGGDVVYHGHVVGFSGGTGSAFSLIPAQNATGNWIKVVQRLPVRIALDPKELRAHPLRVGLSMEADIDLSSKN

SEQ ID NO: 81929 - DNA, 1098 bp, Zymomonas mobilis subsp. mobilis ZM4
  CDS (1)..(1098): transl_table=11
atggatcggagatccgtcctacgcgttcttgtaacgctgtttgtcgttttagtggccgtttgggtcagcctgcgaatgtggttctactatgaacgtgaaccatggacacgcgatggtcgcgtgcaggtcgatgttgaaaatgtgacgcccgatgtttccggtttggtcacggatgtccttgtccgtgaaaaccaatatgtgacagcaggaacgccactctttatcgttgatcgggttcgttttcgtttggccttagaagccgccgaggccgaagttgccaatgtcgcttcccgtctcgaacaggctgaacgtgaaaaccggcgtaatatccggcttggcgatttggtctcgaccgaaattctggaacaaggcgcttccaaggtcgatgagctggctgctgaactcgaaagagccaaagccaatctcaatacggctcgcgttaatgtggttcgctcggttgttcgcgcctctgttgatggctggatcacgaatttctcccttcgccccggtaactatgctacgtcaggcaggcctgaattcgcgcttttggatcgccattctttgcgcgttgtcggttattttgaagaaaccaaattaccccgtatccgtgtcggtgataaagtttccatccgcttgatgggtgaaaagaagatcatcgaaggccatgtggattcactggctcgcggtattgctgaccgtgaacttaaccccacttcatctttgatggctaacgtcaacccaacctttacatgggttcgtttgccgcaacgtattcctgttcgtattgctatcgaccatgtgccggaaggtattcgtttggtcgcaggtagaacggcgactgtctccgttcactataactcacatattcggcctattttgccgccttctattacaggtggtgtgcctgaagtgttagaagacagaactgtctctgatagtgtcgtcaagacgcttgaaaataatgcgactgaaactgtcaccaacacttcggaaaccaaggtaacggtagacccaaaaacggcgcaaacgcaggctcccagccgccaggtaaccactgtccaaaagacagtgaaaaaaactgaggagcatgcaaggtga

SEQ ID NO: 81930 - protein, 365 aa, Zymomonas mobilis subsp. mobilis ZM4
MDRRSVLRVLVTLFVVLVAVWVSLRMWFYYEREPWTRDGRVQVDVENVTPDVSGLVTDVLVRENQYVTAGTPLFIVDRVRFRLALEAAEAEVANVASRLEQAERENRRNIRLGDLVSTEILEQGASKVDELAAELERAKANLNTARVNVVRSVVRASVDGWITNFSLRPGNYATSGRPEFALLDRHSLRVVGYFEETKLPRIRVGDKVSIRLMGEKKIIEGHVDSLARGIADRELNPTSSLMANVNPTFTWVRLPQRIPVRIAIDHVPEGIRLVAGRTATVSVHYNSHIRPILPPSITGGVPEVLEDRTVSDSVVKTLENNATETVTNTSETKVTVDPKTAQTQAPSRQVTTVQKTVKKTEEHAR

SEQ ID NO: 81931 - DNA, 786 bp, Francisella tularensis subsp. tularensis Schu 4
  CDS (1)..(786): transl_table=11
ttggggattaatatgtcaaacaaaaatactaaatctataatcagtataataattattttatttgctcttttttcactgtatgcaatgtggcaatattatctttattcaccttggacaagagatggtagaatccgcgcaaaaattatcacaatagcacctgatgtatcaaatatgtacgtcagtgataaccaaaaagttaaaaaaggacagctaattttcacaatagatgaccaaagatatgctgcaactctagaaggtaaagaagcggaattaaaacatgccatgatcgaatggcagcttgcagaaaagcagtatttaagaagaattagactaggcagagatgactcaataagtagagaagagctagatgattatgcaatgcaagaaaaactaagaaaagctgatcttgaaaaagccaaagctgaagctgaattagctaagattaacctagacagaacaaagatatatgctcctgctgatggaactatcaacaacattgacctaagacaaggcaattatgtagtatcttctaaaccagtaatgtctttagtaaaagctggctcattttatgtcaccggatattttgaggaaactaaactaccgcatattaaaataggtgacaaagccaaaataatacttatgagtggtggagagccattatatggacatgtgataagtataggtaaggcagtcactgataataatactgatgtaaataatcaacttttacccaaagtacaagaaacctatgactgggtaagactatccaaaagaattgatagatga

SEQ ID NO: 81932 - protein, 261 aa, Francisella tularensis subsp. tularensis Schu 4
MGINMSNKNTKSIISIIIILFALFSLYAMWQYYLYSPWTRDGRIRAKIITIAPDVSNMYVSDNQKVKKGQLIFTIDDQRYAATLEGKEAELKHAMIEWQLAEKQYLRRIRLGRDDSISREELDDYAMQEKLRKADLEKAKAEAELAKINLDRTKIYAPADGTINNIDLRQGNYVVSSKPVMSLVKAGSFYVTGYFEETKLPHIKIGDKAKIILMSGGEPLYGHVISIGKAVTDNNTDVNNQLLPKVQETYDWVRLSKRIDR

SEQ ID NO: 81933 - DNA, 1023 bp, Francisella tularensis subsp. tularensis Schu 4
  CDS (1)..(1023): transl_table=11
atgtcagaagaaaaattacaacaatcaacaatcacaagaaataaaaaaagctcgagattttcgcctaagaaaattatcattggctctagcattattacaattacagctttaggaatctatggttattataaatataacaagatcttccctagtactgataatgcttatgttaatgctgatataattagtatttcacctaaagttggtggatatatagaaaaagtctatatccacaacaaccaatttgttcacaaagacgataaacttgttcagattgatcctaaagattatcaactaaaagtagctcaagcaaactcaaaaattatccaaactaaagggcaattagctatagctcaagaacaagtaaatgtagctaagtcaaacctaactaaagcacagtcatctttagatactgcaacaagtatggcagatagatatattaaactttacaaagatgatgctggctctttacaagatgcacaaaaatacataaaccaaaagatccaagctcagaaagcaaaagatgaagcttactcatcacttaagcaagccttattacaagttgaaattgccaaagcacaaattggtgcagccaaactaagctatgataatgccaatctaaatctaggttatacaacattgatagctcctgatgatggctatgtatcaaatttaaaactttacaaaggacaactagtatcacctgaacaagcattatttggttttattgataataaaaaatggtggatagacgctaactttaaagaaacagatcttgatagaatcaagccagggcaaaaagttgaaattgagctagatatgtatagccatagttacgctggcaaagttgatagtatcagttatgctactggctcagtattctcattactaccacctgaaaatgctactggaaactgggtaaaagtcactcagcgcttcccagtaaaaataatcctaaaaaatgatcctaaatacccactcagagttggagcaagtgcaacagtaaaagtagatacattatag

SEQ ID NO: 81934 - protein, 340 aa, Francisella tularensis subsp. tularensis Schu 4
MSEEKLQQSTITRNKKSSRFSPKKIIIGSSIITITALGIYGYYKYNKIFPSTDNAYVNADIISISPKVGGYIEKVYIHNNQFVHKDDKLVQIDPKDYQLKVAQANSKIIQTKGQLAIAQEQVNVAKSNLTKAQSSLDTATSMADRYIKLYKDDAGSLQDAQKYINQKIQAQKAKDEAYSSLKQALLQVEIAKAQIGAAKLSYDNANLNLGYTTLIAPDDGYVSNLKLYKGQLVSPEQALFGFIDNKKWWIDANFKETDLDRIKPGQKVEIELDMYSHSYAGKVDSISYATGSVFSLLPPENATGNWVKVTQRFPVKIILKNDPKYPLRVGASATVKVDTL

SEQ ID NO: 81935 - DNA, 966 bp, Francisella tularensis subsp. tularensis Schu 4
  CDS (1)..(966): transl_table=11
atgaaaatatctaagctaatggctaccgtaataattttattcataatcatttttcttatatgtgtttttttattctttgatgctagttttgaaagagatgcttatctatatgctgactttactagagtaaatagtgttgaaaatgggcaagtagagaaaatatatatcaaaaaaggatcatatgtaaaaaaaggagatactctatttgtactagattgtagatatataacaaaagagctgaatatactaaaatctcaagagaaaaaaatagctctagaactcaaagatattgttattaaaataaaacttgctgaaaaacaaagagatctaacaaaagatagcttaattgttgaaaaaagaaattttgagagatatagaatcctaataaaagaaggagctgtatctgcccaacagaaagatctagctgaaaaaagtctaatatctagtgaatctcaatttgttagagcttgtcaaaatgtagataatctaaaaataagacaaaatgatttattatcagatcaaaaaataacacaatcaaagattgatcaaaagcaatattctttaagcagatgctctgtcaaagctacaactaatggatatatttcgaactttatactagaagaaggtgactttattaaaaaaggacaagagctattttctatagttgatactgataaatggtatgttgtagctaatgtcaaagaaagtaatattaaatacttatcagttggtcaaatagtgactatgacaacaagtctaacagggattaaaaaatataaaggcaaaatagttgatattgaaaaaggaattactagaccagagtacaataatttctcagctctctacaatatagaaagaaatatcgactgggttaggttagactacagatttccagtgcttatagaggttttatcgaaagatacaaaagagtttagactaggtggagacgtgcatgtatggttctaa

SEQ ID NO: 81936 - protein, 321 aa, Francisella tularensis subsp. tularensis Schu 4
MKISKLMATVIILFIIIFLICVFLFFDASFERDAYLYADFTRVNSVENGQVEKIYIKKGSYVKKGDTLFVLDCRYITKELNILKSQEKKIALELKDIVIKIKLAEKQRDLTKDSLIVEKRNFERYRILIKEGAVSAQQKDLAEKSLISSESQFVRACQNVDNLKIRQNDLLSDQKITQSKIDQKQYSLSRCSVKATTNGYISNFILEEGDFIKKGQELFSIVDTDKWYVVANVKESNIKYLSVGQIVTMTTSLTGIKKYKGKIVDIEKGITRPEYNNFSALYNIERNIDWVRLDYRFPVLIEVLSKDTKEFRLGGDVHVWF

SEQ ID NO: 81937 - DNA, 1104 bp, Campylobacter jejuni RM1221
  CDS (1)..(1104): transl_table=11
atgaaattatttcaaaaaaatactattttagctttaggtgttgtgcttttactcactgcttgcagcaaagaagaagcaccaaaaatacaaatgccgcctcaacctgtaacaaccatgagtgctaaatctgaagatttaccacttagttttacttaccctgctaaacttgtcagtgattatgatgtcattataaaacctcaagttagtggcgtaatagaaaataaactttttaaagctggagataaagtaaaaaaaggacaaacattatttattatagaacaagataaatttaaagctagtgttgattcggcttacggacaagctttgatggctaaagcaactttcgaaaatgcaagcaaggattttaatcgttctaaagctctttttagtaaaagtgcaatctctcaaaaggaatacgactcttctcttgctacatttaacaattcaaaagctagtctagcaagtgctagagcacagcttgcaaatgcaagaattgatctagatcataccgaaataaaagctccttttgatggtactataggagatgctttagttaatataggagattatgtaagtgcttcaacaactgaactagttagagttacaaatttaaatcctatttacgcagatttctttatttcagatacagataaactaaatttagtccgcaatactcaaagtggaaaatgggatttagacagcattcatgcaaatttaaatcttaatggagaaaccgttcaaggcaaactttattttattgattctgttatagatgctaatagtggaacagtaaaagccaaagctatatttgacaacaacaactcaacacttttaccaggtgcttttgcaacaattacttcagaaggttttatacaaaaaaatggctttaaagtgcctcaaatagctgttaaacaaaatcaaaatgatgtttatgttcttcttgttaaaaatggaaaagtagaaaaatcttctgtacatataagctaccaaaacaatgaatatgccattattgacaaaggattgcaaaatggcgataaaatcattttagataactttaaaaaaattcaagttggtagcgaagttaaagaaattggagcacaataa

SEQ ID NO: 81938 - protein, 367 aa, Campylobacter jejuni RM1221
MKLFQKNTILALGVVLLLTACSKEEAPKIQMPPQPVTTMSAKSEDLPLSFTYPAKLVSDYDVIIKPQVSGVIENKLFKAGDKVKKGQTLFIIEQDKFKASVDSAYGQALMAKATFENASKDFNRSKALFSKSAISQKEYDSSLATFNNSKASLASARAQLANARIDLDHTEIKAPFDGTIGDALVNIGDYVSASTTELVRVTNLNPIYADFFISDTDKLNLVRNTQSGKWDLDSIHANLNLNGETVQGKLYFIDSVIDANSGTVKAKAIFDNNNSTLLPGAFATITSEGFIQKNGFKVPQIAVKQNQNDVYVLLVKNGKVEKSSVHISYQNNEYAIIDKGLQNGDKIILDNFKKIQVGSEVKEIGAQ

SEQ ID NO: 81939 - DNA, 951 bp, Gluconobacter oxydans 621H
  CDS (1)..(951): transl_table=11
gtgcttgccagtgcccatcgcctgatccgcttgaccatcacgctctgcattctcgtggtggcggctctcgtggtcgtcattctgtgggattactacacggcttccccctggacccggaacggacaggtgcgtgcgcaggtcgccaatatcgcgccccgtgtgtcgggacagatcctcgacgtgcgggtgaaggacaaccagttcgtccacaagggggacgtgctctatgtcattgatccgtttgacttcaaggtggcgctcgataccgccaaagcgcgcgttgccgagcgcaaggccgatctggaattccgtgtcgttcaggcccagtggcgcaaggccattcccggcacggccgtctccgtcgaggaaaaacggcagtatgaggccctgtcccagcagatggaggcccagtacgatgcggcgcaggctgcggaacgtcaggccgcgatcaatctggagcgaacggaagtccgcagttccatcgacggcatcgtgaccaacctcatcatgcgccccggtgacttcgcaactgcgggtgtggtcaacatccacatcatcgacaccagctcctactgggtggatggctatttcgaggaaaccaaagtctatgacctcgatgaaggcgatctcgtccgcatggatctgatgggttatcacgatccgctcttcggccatgtcgagagcatcacccgcggtatcgccagcaacaacgcgctggtgaacaaacagggcctgccggaagtggacccggtctatacttgggtgcgtctggcgcagcgtatcccggtccgcgtgaagatcgacaaaatccccgatgacctgacgctcgccgctggtatgacggccaccgtgacggtcgtgtcagaagaaggcaaccgccgtcaccgctccacccacgccgccttccagcatttcggcgacgacatccgtcacctgttcggtcacagatga

SEQ ID NO: 81940 - protein, 316 aa, Gluconobacter oxydans 621H
MLASAHRLIRLTITLCILVVAALVVVILWDYYTASPWTRNGQVRAQVANIAPRVSGQILDVRVKDNQFVHKGDVLYVIDPFDFKVALDTAKARVAERKADLEFRVVQAQWRKAIPGTAVSVEEKRQYEALSQQMEAQYDAAQAAERQAAINLERTEVRSSIDGIVTNLIMRPGDFATAGVVNIHIIDTSSYWVDGYFEETKVYDLDEGDLVRMDLMGYHDPLFGHVESITRGIASNNALVNKQGLPEVDPVYTWVRLAQRIPVRVKIDKIPDDLTLAAGMTATVTVVSEEGNRRHRSTHAAFQHFGDDIRHLFGHR

SEQ ID NO: 81941 - DNA, 1269 bp, Gluconobacter oxydans 621H
  CDS (1)..(1269): transl_table=11
atgttctcttcgtggtgctccgtcctttcccgttgtgggcgcctattttccggactggatggtctgcgggcttgtgggtgtcgccacagccgtcgggctgcgggtcctctttctgctgacggggctcgatgccctgctcagtttccgccttttcacctatgtcgccctgggtgtcatcgccgcactgggcgtgtggaccctggtattcggaccctgatcgtgcagcgcatttcagtctccggcaaaaagccgatcggcattgtcatcgcggttgtctgcgtgggggtggccgtcctgttcggcgtccacgtctcccacgaagacagcacccacccctcctccgacagcggaagcatcgacgcggaaatggtgcatgtcgcctcgaccgtgggcgggcggctcaaagaactggatgtttcggtcaaccagcatgttcacaaaggcgacgtgctgtaccggctggatcccgagccctacgaactgaccgtccggcaggcgcaggccaatctggatctggccagcgcggaagttgaaaaccagacacgtctgctgagcatcaagacgtccaatgccgccaccgccgacgatcaggtcgtccgggcccagaccaaccgtgatcttgcagcgcgtaccgtgcagcggcttcagcctctggcggggaaatcctacatcccctggcaacaatacgatcaggcccgtgtcgccctgcatgatgccgaagtttcgctggcccagtcccgcaaccagtccgctgcggcgaccactgcgatcggggatctgaaaagttcgattgccgcgcgcgatgccagtcaggcggcccttgatcatgcacgttatgaactgcggcagaccacggtaatcgctccggttgacggttacgtcaccagcctgcgggtaaaaccgggcgaagttctcgcgccatcgcaggtcctgttcacgctgattgcagatgatgagtggtacgccacagccaatatccgcgagatcaatctcggcgccgtgcagatcggggactgcgtgacggtccattccatgatcgaccggcgcacgccgcttcggggacatgtcgagagcattggatggggtgtgctctcggcggattccgctggaattgcgcgctccctgccgatcgtgccgcggcagatggactgggtgcatgtggcccagcgcttcccggtccgcatccggctggaaaaggcgaatccccttctgctgcggcttggcgccaccgcgacggtcgagatccggcatggcgctgcctgtccctga

SEQ ID NO: 81942 - protein, 422 aa, Gluconobacter oxydans 621H
MFSSWCSVLSRCGRLFSGLDGLRACGCRHSRRAAGPLSADGARCPAQFPPFHLCRPGCHRRTGRVDPGIRTLIVQRISVSGKKPIGIVIAVVCVGVAVLFGVHVSHEDSTHPSSDSGSIDAEMVHVASTVGGRLKELDVSVNQHVHKGDVLYRLDPEPYELTVRQAQANLDLASAEVENQTRLLSIKTSNAATADDQVVRAQTNRDLAARTVQRLQPLAGKSYIPWQQYDQARVALHDAEVSLAQSRNQSAAATTAIGDLKSSIAARDASQAALDHARYELRQTTVIAPVDGYVTSLRVKPGEVLAPSQVLFTLIADDEWYATANIREINLGAVQIGDCVTVHSMIDRRTPLRGHVESIGWGVLSADSAGIARSLPIVPRQMDWVHVAQRFPVRIRLEKANPLLLRLGATATVEIRHGAACP

SEQ ID NO: 81943 - DNA, 1077 bp, Gluconobacter oxydans 621H
  CDS (1)..(1077): transl_table=11
atgatttacggaaaaccccttctcctggccggatgtgcggtcattgtcctgacgggcctggcctggacggctgaccgcttcttcgtgggtgacggcatccgtcaggaaaccaacgacgcctatgtcacggctgatttcacgaccgtggccccgaaagtctccggtcgtatcgacagggtgcgggcggaagacaacgaatacgtccatgccggggaagaactcgcccatatcgaggacgacgattaccgcgcggctttgggggctgcccatggtgataccgccgcagcgcagggcgatgtggacaatcttcaggctttgctggagcgtcagggctccatcgtcgatgcggcgaaatataccgtgcagtccgacgaggccgcactggtctttgcccggcagaatgcagcgcggtatcgcaatctctcggccggaggggccagcacgattgagcagcagcagggcgcggaagcccggcagcttgaagccgtcgctgctctggcccgtgacaaagcccaaaccagcacggccgaacaacaggtcgctgtcctgaaggcgcagcttgagaaggcacagggcgcacttctgaaggcccagagcgcggagcatcaggccgaactgaacctgtcctactgcacgatcccggcccccgtggatggtgtggtcggcgagcgtggcgtgcgtgttggcgcgtatgtccatccgggcactgggctgctggcggtcgtaccggtccgcaaagcctatgttctagcgaattttcaggaaactcagctgacgaaggttcagaccggccagagtgcgacaatctgggtcgatacgttccccggccatccgctcaaggcccatgtggacagtctggccccggcgacgggtgtggccttcgccgccattcagccggacaatgcaacgggtaacttcaccaaagtcgtgcagcgcgtgccggtcaagctgaccttcgatcccggccagcctctggcagagaaggtccgcgtcggcatgtcggtcgaagcgcggatcgacacgtcctccacgcctgagggcatccactcccatgacgcgcggtatctctggaaatga

SEQ ID NO: 81944 - protein, 358 aa, Gluconobacter oxydans 621H
MIYGKPLLLAGCAVIVLTGLAWTADRFFVGDGIRQETNDAYVTADFTTVAPKVSGRIDRVRAEDNEYVHAGEELAHIEDDDYRAALGAAHGDTAAAQGDVDNLQALLERQGSIVDAAKYTVQSDEAALVFARQNAARYRNLSAGGASTIEQQQGAEARQLEAVAALARDKAQTSTAEQQVAVLKAQLEKAQGALLKAQSAEHQAELNLSYCTIPAPVDGVVGERGVRVGAYVHPGTGLLAVVPVRKAYVLANFQETQLTKVQTGQSATIWVDTFPGHPLKAHVDSLAPATGVAFAAIQPDNATGNFTKVVQRVPVKLTFDPGQPLAEKVRVGMSVEARIDTSSTPEGIHSHDARYLWK

SEQ ID NO: 81945 - DNA, 1287 bp, Xanthomonas oryzae pv. oryzae KACC10331
  CDS (1)..(1287): transl_table=11
gtgcgctgggcggcgaattcacgccggagcccgcgcgcgataccgcacacaccgcgcccacttccgcacaaccgaattcctgagacatcgacgatgagccagacgacttcaacttctcctcaacccgcaccagccgcgcccagcaagcgccgcgctgcgctgcgtatcgtggccattgtggcgatcctggcgatcatcggcctggtggtgtggtacttcctggtcggccgttggcacgaagacaccgacgacgcgtacgtacagggcaaccaggtgcagatcaccccgatggtgggcggcactgtggtgagtatcggcgccgaagacggcatgcgcgtggagcgcggccagttgctggtgcaactggacccggccgacaccgagggcgcggtgcagcaggccgaagccaatcttgccaagaccgtgcgtcaggtgcgcggtctgtatcgcagtgttgaaggtgcacaggccgaattgtccgcacgcgaggtcgcgctgcgcagtgcgcgctcagacttcgcacggcgtaaggatctggcttccaccggcgcgatctccaacgaagaactcgcgcatgcccgcgacgaactggccgtggccgaagcggccgtgagcggctcgcgcgagagctttgagcgtaaccgtgcgttggtggacgacagcgcggtggccaaccagccggacgtgcaggccgccgccgcgcagctgcgtcaggcgtatctgaatcatgcgcgcaccggcgtggtggcgcccgtgtcgggttatgtcgcacggcgcgcggcacaagttggccagcgtgtgcagccgggcagcgtgctgatgctggtggtgccgctggagcaggtgtgggtggaagccaacttcaaggagacccagctcaagcacatgcgtctgggccaggaagtggaactgcattcggatctgtacggcggcggcgtgagctacaccggccgtatccagagcctgggtctgggcaccggcagcgcgttctcgctgttgcctgcgcagaacgccagcggtaactggatcaagatcgtacagcgcgtgccggtacgcattgcagtggattccaagcagctggccagcaatccgctgcggatcgggttgtcgatgaaggtcgaagtcaagctgcacgatcagcagggcagcgtgttgccgaccaagctcgccaacgctgcggtgttctccaccgacgtgtatgcgcagcagctcaaggctgccgacgccgacgtccaacgcatcatccaggacaacctgccgtcgcaggctgccagcaaggcgggctaa

SEQ ID NO: 81946 - protein, 428 aa, Xanthomonas oryzae pv. oryzae KACC10331
MRWAANSRRSPRAIPHTPRPLPHNRIPETSTMSQTTSTSPQPAPAAPSKRRAALRIVAIVAILAIIGLVVWYFLVGRWHEDTDDAYVQGNQVQITPMVGGTVVSIGAEDGMRVERGQLLVQLDPADTEGAVQQAEANLAKTVRQVRGLYRSVEGAQAELSAREVALRSARSDFARRKDLASTGAISNEELAHARDELAVAEAAVSGSRESFERNRALVDDSAVANQPDVQAAAAQLRQAYLNHARTGVVAPVSGYVARRAAQVGQRVQPGSVLMLVVPLEQVWVEANFKETQLKHMRLGQEVELHSDLYGGGVSYTGRIQSLGLGTGSAFSLLPAQNASGNWIKIVQRVPVRIAVDSKQLASNPLRIGLSMKVEVKLHDQQGSVLPTKLANAAVFSTDVYAQQLKAADADVQRIIQDNLPSQAASKAG

SEQ ID NO: 81947 - DNA, 1242 bp, Xanthomonas oryzae pv. oryzae KACC10331
  CDS (1)..(1242): transl_table=11
atgcagggcatgcctcgcccctcacacaggacgcatcctttgagcaatcacgatcatcagtccaatgacggccagtgttcggccacggatgcgcagggcgccggcgcgcgcgacgagcaggagtcgcccaagccctcgccgttgaagaaccccaaggtgaagtggacgctgatcctggtcggggtactggtgctgatcttgctggtggtgtggctggcctgttacctgatcaagggccgctacatgcaagacaccaataacgcctatctgcaggccgattcggtggcagtggcgccgcgcgtcagcggttacgtgaccaaggtgctggtgagcgacaaccagatcgtggaggccggccagccgctgctgcagatcgacgaccgcacctaccaggccaccctgcagcaggccgaagccgccatcgccgcacgccaggccgatatcgtcgctgccaccgccaatgtctccgcgcaggagtcggcgttgttgcaggcacgcacccaggtcactgccgcgactgccaccctcaggttcgcccaggccgaggtgaagcgcttcgcgccattggccgcctcaggcgccgacacccacgagcatcaggaaagcctgcaacatgatctggcccgcgcacgcgctcagtacgacgccgcgcaggcgcaggccaaggccggcgaaagccagatccaggccagccgcgcgcaactggaacaggcacaggccggcgtgaagcaggccaccgccgatgccgatcaagcgcgcgtggcggtggaagacacccgcctgaccagccgcatccacggccgtgtcggcgacaagaccgtgcaggtgggtcagttcctcggcgccggcacccgcaccatgaccatcgtgccgcagcaatcgctgtatcttgtcgccaatttcaaggaaacccaggtcggcctgatgcgtcccggccagccggccgagatcgaggtcgatgcgttgtccggcgtaaaactgcacggcaaggtcgagagcctgtcgccgggcaccggctcgcagttcgccttgctgccgccggaaaacgccaccggcaacttcaccaaggtggtgcagcgcgtgccggtgcgcatccgcgtgttggcgggtgacgaggcgcgcaaggtgttggttccgggcatgtcggtggaagtcaccgtcgacacgcgctcggccaaggacgccaagcagcgcgccgaagaagaatccgaccgcgtgcaggagcaggagcgcgcgcgatga

SEQ ID NO: 81948 - protein, 413 aa, Xanthomonas oryzae pv. oryzae KACC10331
MQGMPRPSHRTHPLSNHDHQSNDGQCSATDAQGAGARDEQESPKPSPLKNPKVKWTLILVGVLVLILLVVWLACYLIKGRYMQDTNNAYLQADSVAVAPRVSGYVTKVLVSDNQIVEAGQPLLQIDDRTYQATLQQAEAAIAARQADIVAATANVSAQESALLQARTQVTAATATLRFAQAEVKRFAPLAASGADTHEHQESLQHDLARARAQYDAAQAQAKAGESQIQASRAQLEQAQAGVKQATADADQARVAVEDTRLTSRIHGRVGDKTVQVGQFLGAGTRTMTIVPQQSLYLVANFKETQVGLMRPGQPAEIEVDALSGVKLHGKVESLSPGTGSQFALLPPENATGNFTKVVQRVPVRIRVLAGDEARKVLVPGMSVEVTVDTRSAKDAKQRAEEESDRVQEQERAR

SEQ ID NO: 81949 - DNA, 1158 bp, Xanthomonas oryzae pv. oryzae KACC10331
  CDS (1)..(1158): transl_table=11
atggatcctgtccgtgctggtgtggcgccgctatctgcgcccaccggtctcgccctctcctcctgttcccagtgtgcgcccatgaatacaccagcggattcttcaccgcctgcctgccggcaacgtcgtcggcgtagccgcattgctggcgtcatcggctttggcgggcttgcgctgatcggcgtggtgctggtgctctatgcatggcgactgccgccgttcgtcagtgcgatcgaacgtaccgaaaatgcgctggtgctcggccagatcacggtgattgcgccgcaggtcagcggctatgtgacccaagtccccgtgcaggattttgcgcacgtgaaacgcggcaagttgctggccaaaatcgacgaccgcatctacgcccagcagctcgaacaggccaatgcgcagatgcaaaccgcgcaagccaatctcgccaactgggagcagcaacggcacagcgccgaggcgacgattgccgagcagcgcgcagcactgagcagcaaccaggcgcaacgcgaccgcacccgttcggcctatgcccgcacgcagcagctggccagccagcaactggtgtccgagcaggaccgcgacactgcatttgccgcacgcgcgcaggccgatgccggcgtggtgcaggcacgcgccgcggtacaggccgccgaagaaaacgcacgcggcgttaccgtcaaccgcgccgcgttggaggcggctgtcgccaacgcgcaagccgccgtgcgactggcgcagatcaacctggacaacacgcgcatcctggccccgcgcgatggtcagctgggcgtgcgccagggcgcctatgtcaccaacggcacgcagctgatgtcgctggtgccggacacgctgtggatcgtggccaatttcaaggaaacccagatggcgaagatccgcatcggccagcgtgccagcttcaccgtggatgcgctggacaacgctcgcctgcacggccgcgtgcaggacatttcgccggcggccggctcggagttcagcgtgctgccggccgataacgccgccggtaacttcgtcaagattgcccagcgcattccgctgcgcatcagcgtcgaccccgaccagccgctggccccgcggctgcggccaggcatgtcggtggtggccgtcgataccgccagcccagtcgactga

SEQ ID NO: 81950 - protein, 385 aa, Xanthomonas oryzae pv. oryzae KACC10331
MDPVRAGVAPLSAPTGLALSSCSQCAPMNTPADSSPPACRQRRRRSRIAGVIGFGGLALIGVVLVLYAWRLPPFVSAIERTENALVLGQITVIAPQVSGYVTQVPVQDFAHVKRGKLLAKIDDRIYAQQLEQANAQMQTAQANLANWEQQRHSAEATIAEQRAALSSNQAQRDRTRSAYARTQQLASQQLVSEQDRDTAFAARAQADAGVVQARAAVQAAEENARGVTVNRAALEAAVANAQAAVRLAQINLDNTRILAPRDGQLGVRQGAYVTNGTQLMSLVPDTLWIVANFKETQMAKIRIGQRASFTVDALDNARLHGRVQDISPAAGSEFSVLPADNAAGNFVKIAQRIPLRISVDPDQPLAPRLRPGMSVVAVDTASPVD

SEQ ID NO: 81951 - DNA, 1011 bp, Vibrio fischeri ES114
  CDS (1)..(1011): transl_table=11
atgaaaaaaagcagacatttcagtattaccttcaccttattttttatctcaagtttaattggatatttgatctactttgcctggcaatattctaataatcacccgagtaccgagaatgcttacgtccgcgccaaaatagtttccattgcgcctcaaataaaaggacgaattatctcagttgaggtgaatgactaccaaaaggtgaataaaggcgatctgctacttaagatagatcctcaaccgtatctgctagcagtaaaaagagcagagtcagcatatcaactcgcagtgcaacaacatcaagtcgcagacagcaaagttacacaagctattgccaacttaaatggtgtgacttctaaccttaaagaaacacaaattgaattcaaaagaactcaagccttagttagtcgcaaattaagctcacaacaagagctagacataatcaaaaacaaattagccattgcacaggcaaaactagaggaagcaagagccaacgtagaagccgcaatagcaaacagaggggacgataatggcgttgatgccgccatagtacaacaagcatctgcagagcttgctcaagctgaactagacctaagttacaccgatatcacagctccaaccgacggtttacttggagaaataaatgtttttgttggttctgttgttaaaaacagtcaaatgctgtttcctttagtggttaaaaacacttactgggttagagctaactttaaagaaacctcattaaccaacattagaatggggcaaacagcagaagtcgttatcgatatgtacccagatatcacctggcaagccaaagtaagcgaactttctcccgccagtggtacttcgttttctctcatgccaccagaaaacgcaactggaaactgggtaaaaatcaaacaacgataccctgtgaagctaatcttagatattccaaaagattctcctcaacttcgcattggtgcaagtgcagaggtcacaatcaatttgtcagatgattcaagaacatga

SEQ ID NO: 81952 - protein, 336 aa, Vibrio fischeri ES114
MKKSRHFSITFTLFFISSLIGYLIYFAWQYSNNHPSTENAYVRAKIVSIAPQIKGRIISVEVNDYQKVNKGDLLLKIDPQPYLLAVKRAESAYQLAVQQHQVADSKVTQAIANLNGVTSNLKETQIEFKRTQALVSRKLSSQQELDIIKNKLAIAQAKLEEARANVEAAIANRGDDNGVDAAIVQQASAELAQAELDLSYTDITAPTDGLLGEINVFVGSVVKNSQMLFPLVVKNTYWVRANFKETSLTNIRMGQTAEVVIDMYPDITWQAKVSELSPASGTSFSLMPPENATGNWVKIKQRYPVKLILDIPKDSPQLRIGASAEVTINLSDDSRT

SEQ ID NO: 81953 - DNA, 1185 bp, Neisseria gonorrhoeae FA 1090
  CDS (1)..(1185): transl_table=11
atgaaatcaggaaattcggaacccaatcttatggaaacgcacacagacgaaacaaaacttcaaaacacgcaagtcaaacgcaaacgccgcctgacggcattgacgctgctgttcgcgctttccgccgcagccgccggatcggcgttttttttatggtggcagcacgaagaggaaacggaagacgcttatgttgccggacgcgtggttcaggttacgccgcaaaagggcggcacggtgcggaaggttttgcacgacgatacggatgccgtgaaaaaaggcgacgtgctggcggtgttggatgacgataatgatgtgctggcttacgagcgggcaaaaaacgagttggttcaggcggtgcgccaaaaccgccggcaaaatgccgccacttcgcaggcgggggcgcaggttgccttgcgccgtgcggatttggcgcgcgcgcaggatgatttacgccgccggtccgctttggcggaatcgggtgcggtgtccgccgaagagctggcacacgcccgtacggcagtgtctcaggcgcaggcggcggttaaggcggctttggcggaagaatcttcggcacgcgcggctttgggcggagatgtttctttgcgcgaacagccggaggttcagacggcaatcggcaggttgaaagatgcgtggctgaaccttcggcggacgcaagtccgcgcgccggcggacggtcaggtggcgaagcgttcggtgcaggtcgggcagcaggtggcggcaggcgcgccgctgatggcggtggtgccgctgtcggatgtgtgggtggatgccaattttaaagagacgcagttgcggcatatgaaaatcggacagcctgccgagctggtgtccgatttgtacggcaaacaaattgtttatcgcggcagggtggcagggttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctga

SEQ ID NO: 81954 - protein, 394 aa, Neisseria gonorrhoeae FA 1090
MKSGNSEPNLMETHTDETKLQNTQVKRKRRLTALTLLFALSAAAAGSAFFLWWQHEEETEDAYVAGRVVQVTPQKGGTVRKVLHDDTDAVKKGDVLAVLDDDNDVLAYERAKNELVQAVRQNRRQNAATSQAGAQVALRRADLARAQDDLRRRSALAESGAVSAEELAHARTAVSQAQAAVKAALAEESSARAALGGDVSLREQPEVQTAIGRLKDAWLNLRRTQVRAPADGQVAKRSVQVGQQVAAGAPLMAVVPLSDVWVDANFKETQLRHMKIGQPAELVSDLYGKQIVYRGRVAGFSAGTGSAFSLIPAQNATGNWIKVVQRVPVRIVLNREDVDRHPLRIGLSMTVKVDTSAAGAPVSKTPGAALPEMESTDWSEVDRTVDEILGQSAP

SEQ ID NO: 81955 - DNA, 1107 bp, Rhodobacter sphaeroides 2.4.1
  CDS (1)..(1107)
atgaacgcccagacctctcccgagaaggcccgctccacgcccgtggtggccgagccgaatccccgcaagacgcgccgcatcctgctgatggcggcccttcccgcggcccttctgggcggcgcgggcgtctggtgggtgaccggcgggcgctacgagaccaccgacaatgcctatctgcatcaggcggtggtcggcgtggcttcggaactttcgggccgcgtgacgcgcgtctccgtgtccgacaaccgccccgtgtcgaagggcgaggtcctgttcgagattgaccccgagccgcaccgcatcgcgctggccaaggccgaggcggcggtggcctcggcgcgtctcgaggtggagcagctgcgcgtggcctatgctcaggctcaggcgcaggagaagctcgcggcggacgacgcggcctatctcgccaatgagctcgagcgccagcaggcgctgtcgcagaagggcgtggcttcgacgacctcgctcgacgatgcgcgccacgaatcgctgcgcgcgaaggagctgctgctggtcgcgcgccagaccaccgcaagcgcgctcgcggcgctcggcggggtcgcggacgggccggtggacgagcatccgaaggtgcgcactgcgcttgccgcgcgcgacgacgccgcctaccagctggcgcggaccgaggtccgcgcgccggccgacggcatcgtctatcaggccgcctccttcaagccgggccagatggtcaccgccggccagtcgctcttctcgctggtcgagacaggcgatgtctggatcgacgcgaacttcaaggagacgcagctggccggcatcgcccccggccagaaggccgaagtcaccttcgacctgcaccccgaccggccctacgaggccacggtcgaggcggtgggcgcgggcacgggctcggaattctcgctgctgccggcgcagaacgccaccggcaactgggtgaaggtgacccagcgcgtgccggtgcggctgcggttcgaagagggggccgacatcgcgggcctcgcctcgggcctgtcggcggaagtgtcggtcgataccggccgcgtccgccacatcccggggctcgcgagtttcgccgccaccgccgactga

SEQ ID NO: 81956 - protein, 368 aa, Rhodobacter sphaeroides 2.4.1
MNAQTSPEKARSTPVVAEPNPRKTRRILLMAALPAALLGGAGVWWVTGGRYETTDNAYLHQAVVGVASELSGRVTRVSVSDNRPVSKGEVLFEIDPEPHRIALAKAEAAVASARLEVEQLRVAYAQAQAQEKLAADDAAYLANELERQQALSQKGVASTTSLDDARHESLRAKELLLVARQTTASALAALGGVADGPVDEHPKVRTALAARDDAAYQLARTEVRAPADGIVYQAASFKPGQMVTAGQSLFSLVETGDVWIDANFKETQLAGIAPGQKAEVTFDLHPDRPYEATVEAVGAGTGSEFSLLPAQNATGNWVKVTQRVPVRLRFEEGADIAGLASGLSAEVSVDTGRVRHIPGLASFAATAD

SEQ ID NO: 81957 - DNA, 1194 bp, Xylella fastidiosa Dixon
  CDS (1)..(1194)
atgaccacgtcatgcagccaaggcaacaagaatagtgcacatcctgctggcgctgacaacacacaaaacgttgagaaacaggggaataccgctccaattcctgtcacagtagtcgcagcaagcagccaaaatgttcctgtgtacgctgccgccccaggcacagtggccgcaatgaataccgtcacgattaacccgcaggtcagtggtcaattgatcagcctacacttccgcgagggtgaatcagtaaaaaaaggccaattgctcgccgaaattgacgcacgcgcacttcaggccagctacgatcaagccgcagcggcgaagcgtcagaaccaagcactgctggcaaccgcacgtgccaactacacccgctccagcacgttggaataccaaccgtacgtcgccaagacagaattagatacacaatataaccaggtcacgcagtatgaagcggcagtcgcagcaaacgaagccgcaatgcgagcagcccaagtacagctgcaatacactaagattgtcgcaccgatcgacggcgtcgccgggatccgcagcatagatgctgggaacgtggtcacaactagcacctccatcgtgacactgacacagatgcatccaatctacgtctcattcaatcttcccgagcgcttgttgcaggaagtacgccaagcccatgcctccggccccgtgatggtggccgcgctggaccgcggagatgcacaccccctgaccgaagatggcacattggatgcgatcaataaccaaatcaacactgacagcggcactttcagcgcacgtgccgtgttctccaaccgcaataacgcactatggcctggccagttcgtcaacgcgcgtctgcaactacgcacgattgccaatggtgtcgtgattccggcgcaggcagtgcaacgcggccccaatggcgactacgtttaccttgtcaagccagatcacacggtcgttacacgggaagtcacccaaggcgtggaaatcggtgacagccatgtacaaatcgccaaaggcttgaatgtcggcgacacagtagtcacagaaggtcaattccggctcaaaccaggcagtaaagtcatcgcgctagcaccaggtgaaactccaccagcaccaaccgaagccgaattgaaggctgctgcggaaaaacgcagcaaaaatagcatgggtggtcctcctcgcggcggcccataa

SEQ ID NO: 81958 - protein, 397 aa, Xylella fastidiosa Dixon
MTTSCSQGNKNSAHPAGADNTQNVEKQGNTAPIPVTVVAASSQNVPVYAAAPGTVAAMNTVTINPQVSGQLISLHFREGESVKKGQLLAEIDARALQASYDQAAAAKRQNQALLATARANYTRSSTLEYQPYVAKTELDTQYNQVTQYEAAVAANEAAMRAAQVQLQYTKIVAPIDGVAGIRSIDAGNVVTTSTSIVTLTQMHPIYVSFNLPERLLQEVRQAHASGPVMVAALDRGDAHPLTEDGTLDAINNQINTDSGTFSARAVFSNRNNALWPGQFVNARLQLRTIANGVVIPAQAVQRGPNGDYVYLVKPDHTVVTREVTQGVEIGDSHVQIAKGLNVGDTVVTEGQFRLKPGSKVIALAPGETPPAPTEAELKAAAEKRSKNSMGGPPRGGP

SEQ ID NO: 81959 - DNA, 1194 bp, Xylella fastidiosa Ann-1
  CDS (1)..(1194)
atgaccacgtcatgcagccaaggcgacaagaatagtgcacatcctgctggcgctgacaacacacaaagcgttgagaaacagaggaataccgctccaattcctgtcacagtagtcgcagcaaggagccaaaatgttcctgtgtacgctgccgccccaggcacagtggccgcaatgaataccgtcacgattaacccgcaggtcagtggtcaattgatcagcctacacttccgcgagggtgaatcagtaaaaaaaggcgaattactcgccgaaattgacgcacgcgcacttcaggccagctacgatcaagccgcagcagcgaagcgtcagaaccaagcactgctggcaaccgcacgtgccaactacacccgctccagcacgttggaataccaaccgtacgtcgccaagacagaattagatacacaacataaccaggtcacgcagtatgaagcggcagtcgcagcaaacgaagccgcaatgcgagcagcccaagtacagctgcaatacactaagattgtcgcaccgatcgacggcgtcgccgggatccgcagcgtagatgctgggaacgtggtcacaactagcacctccatcgtgacactgacacagatgcatccaatctacgtctcattcaatcttcccgagcgcttgttgcaggaagtacgccaagcccatgcctccggccccgtgatggtggccgcgctggaccgcggagatgcacacccactgaccgaagatggcacattggatgcgatcaataaccaaataaacactgatagcggcactttcagcgcacgcgccgtgttctccaaccgcaataacgcactatggcctggccagttcgtcaacgcgcgtctgcaactacgtacgattgccaatggtgtcgtgattccggcgcaggcagtgcaacgcggccccaatggcgactacgtttaccttgtcaagcaagatcacacggtcgttactcaggaagtcacccaaggtgtggaaatcggtgacagccatgtacaaatcgccaaaggcttgaatgtcggcgacacagtagtcacagaaggtcaattccggctcaaaccaggcagtaaagtcatcgcgctagcaccaggtgaaactccaccagcaccaaccgaagccgaattgaaggctgctgcggaaaaacgcagcaaaaatagcatgggtggtcctcctcgcggcggcccataa

SEQ ID NO: 81960 - protein, 397 aa, Xylella fastidiosa Ann-1
MTTSCSQGDKNSAHPAGADNTQSVEKQRNTAPIPVTVVAARSQNVPVYAAAPGTVAAMNTVTINPQVSGQLISLHFREGESVKKGELLAEIDARALQASYDQAAAAKRQNQALLATARANYTRSSTLEYQPYVAKTELDTQHNQVTQYEAAVAANEAAMRAAQVQLQYTKIVAPIDGVAGIRSVDAGNVVTTSTSIVTLTQMHPIYVSFNLPERLLQEVRQAHASGPVMVAALDRGDAHPLTEDGTLDAINNQINTDSGTFSARAVFSNRNNALWPGQFVNARLQLRTIANGVVIPAQAVQRGPNGDYVYLVKQDHTVVTQEVTQGVEIGDSHVQIAKGLNVGDTVVTEGQFRLKPGSKVIALAPGETPPAPTEAELKAAAEKRSKNSMGGPPRGGP

SEQ ID NO: 81961 - DNA, 909 bp, Magnetospirillum magnetotacticum MS-1
  CDS (1)..(909)
atgctcgcgctcctgatcctcgggggcgtcggcgccgtcgcgcaccggacctatgacgcccgccagaagcccgccgaggaaacggcccaggcgcccggccgcggcggccacggtcgtggcggccggtccgccgagatgaaacaggcggtcggcgtcgcgccggtcgtgaccggcgacatgccggtcgtcctccaggggctcggcacggtgacgccgctggcgaccgtctcggtccgctcgcagatcaacggctatctcaccaagatcggcttccgcgaaggccagatggtgaaggagggggacttcctcgcccagatcgacccgcggccctacgaggccctgctcgcccagtaccagggccagctcgcccgcgatcaggcgctgctgcagaattcgaagctcgacctccagcgctaccagacgctgaaccggcaggattcgatctcgaaacagaacgtcgacacccaggccgccctggtgaagcagaacgaaggcacggtcgccgccgaccaagcactggtcgatcagcagaagctcaacctgacctatgcccggatcgtctcgccggtcgagggccgggtcggcctgcggcaagtcgatctcggcaactacatcaccgccggctccaccaacatcgtcgtggtcacgcagctccacccgatctcggtggtgttcaccctgccggaggacgacgtggcccgggtgatgcggcgcgtgcgcgagggcgccaagctcacggtccgcgcctacgaccgcagcgaccagcacgagatcgccaccggcacgctcgacacggtcgacaaccaaatcgacacgaccaccggcacggtgaagctgcgggcgatgttcgagaacggcgacgagagcctgttcccgaaccagttgtcacgcgcgggtccaggcctatag

SEQ ID NO: 81962 - protein, 302 aa, Magnetospirillum magnetotacticum MS-1
MLALLILGGVGAVAHRTYDARQKPAEETAQAPGRGGHGRGGRSAEMKQAVGVAPVVTGDMPVVLQGLGTVTPLATVSVRSQINGYLTKIGFREGQMVKEGDFLAQIDPRPYEALLAQYQGQLARDQALLQNSKLDLQRYQTLNRQDSISKQNVDTQAALVKQNEGTVAADQALVDQQKLNLTYARIVSPVEGRVGLRQVDLGNYITAGSTNIVVVTQLHPISVVFTLPEDDVARVMRRVREGAKLTVRAYDRSDQHEIATGTLDTVDNQIDTTTGTVKLRAMFENGDESLFPNQLSRAGPGL

SEQ ID NO: 81963 - DNA, 1269 bp, Magnetospirillum magnetotacticum MS-1
  CDS (1)..(1269)
atgaccgaacggttcggtcaatgcatgtttgaggatgcggccatgtcgcttcgcgaggatgccggtcgatcggagaccgcctcggacaccactttcgagacggcgcccgaaagcgccggggtggcgcgtgccgagggcgggcgtgtcccggccgtcgcgcagccggctccggctcccgtgccggccgccgactccaagtcccgccggccgctgcggcgcgcggtcctcgggctgatgctctgcgccgccctcggcggcggcgcctatgagggctggcagtggtggacggtcgggcgcttctttgtcggcaccgacgacgcctatgtgcaggccgatatctcgatcctggccgccaaggtctccggctatctggaatccgtccccgtggtgaacgggcaggcggtgaggaagggcgacgtgatcgcccggctcgatgacggcgattaccggctcgccctgaaggcggcgcaggacaaggccgcgacgcaggagagcaccatcgcccgcatcggccggcaggccgaggcggcgcaggcgcaggtgctgcagagtgccgcccaggtcgatgccgcgagggccgatgccgtgcgggccgccgccgactacgcccgcgccacccagatgcaatccgattacgtggcgaagtcgcgcctcgatcaggccaaggccgaccgggatcgcaccgacgcgtcggtgaagtcggcggaggccgccctcgccgccgcccgcgccaatgtcgacgtgctgcgggcgcagcagcgcgaggccgagagcctcgccgccgagctgcgcacggcggtggaccgcgcccggcgcgatgtcgatttcgcggtgatccacgcgcccttcgacggcgtcgtcggcaacaaggcggtggaggccggcgcctatgtctcccccggctcgcggatcgccgccctggtgccgctgacgagcgtgcgggtcgacgcgaatttcaaggagacgcagctcgcccgcgtccgccccggccaggaggtccatatccacgtcgacgcctatcccgatcgggacatcgtcggcacggtggaatcgctctcgcccgcctccggctcggtcttcagcctgctgccgccggacaacgccaccggcaacttcaccaagatcgtccagcgcctgccggtgcgggtccacgtgccggaggatgtcgcccgggagggcctgctgcgccccggcctctcggtggtggtgaaggtcgatacccgcgacggggccgacgccccggtccagaagctcgccgcccggcactga

SEQ ID NO: 81964 - protein, 422 aa, Magnetospirillum magnetotacticum MS-1
MTERFGQCMFEDAAMSLREDAGRSETASDTTFETAPESAGVARAEGGRVPAVAQPAPAPVPAADSKSRRPLRRAVLGLMLCAALGGGAYEGWQWWTVGRFFVGTDDAYVQADISILAAKVSGYLESVPVVNGQAVRKGDVIARLDDGDYRLALKAAQDKAATQESTIARIGRQAEAAQAQVLQSAAQVDAARADAVRAAADYARATQMQSDYVAKSRLDQAKADRDRTDASVKSAEAALAAARANVDVLRAQQREAESLAAELRTAVDRARRDVDFAVIHAPFDGVVGNKAVEAGAYVSPGSRIAALVPLTSVRVDANFKETQLARVRPGQEVHIHVDAYPDRDIVGTVESLSPASGSVFSLLPPDNATGNFTKIVQRLPVRVHVPEDVAREGLLRPGLSVVVKVDTRDGADAPVQKLAARH

SEQ ID NO: 81965 - DNA, 1032 bp, Magnetospirillum magnetotacticum MS-1
  CDS (1)..(1032)
atgaaaaagcccatcgccattgctgccgccttgatcgtcgcctccatcggggggtggagcctgcttcgctggtcccaggactggcgctggcaggaatccaccgacgacgcctatgtggatggcgacattaccgccatctcacccaaagtggcgggacatgtggtcgagcttgccgcccgcgacaaccgaatggtggccaagggtgatgtgctggtccgtatcgatgagcgcgattaccgggcccgtctggacgaggcggcggggcaggtcaaggcccgcctggcccaactggtgcagatcgacgaccgggtcgccgtgcaggaatcggtgatcgcccagtcgggggcctcgatttccgccgcaaaggctgaagtggtgcgcgccaccgccgatttcgaacggtcgcgcaagctggtgcgcgaggattatgtcagccgccagcgcttcgacatatcccaggccgacgcagcccgcgccgcggcggggcttaccggttcgggcgcccaattgcagggcgctcggcggcaattatcggtactggcctccgaacacaatgtggccctggcccagttggagcaggccaaggccgcattgatactggccgagacagagttggaagccaccgtcatccgctctcccgtggatggggtgatcggcaaccgcgcggtgcgggacggccaatatgtgcgtcccggccagatgctgctggccgtggtacctctgggcaatgtctggatcgacgccaatttcaaggaaacccagatcggccgcatgaagcccggcaaccgggcggagatcaaggtcgatgcctttcccggcgcggtgatcaccggtacggtggacagcttcgccccggcttcgggcgccaagttcagcctgttgccgcctgaaaacgccaccggcaatttcaccaaggtggtccagcgcattccggtgcgcatccgggtcgatcccgacagccccctggccggacagttgcggcccggcctgtcggtggtggtcaaggtggatacgcgggacgaggggaaatga

SEQ ID NO: 81966 - protein, 343 aa, Magnetospirillum magnetotacticum MS-1
MKKPIAIAAALIVASIGGWSLLRWSQDWRWQESTDDAYVDGDITAISPKVAGHVVELAARDNRMVAKGDVLVRIDERDYRARLDEAAGQVKARLAQLVQIDDRVAVQESVIAQSGASISAAKAEVVRATADFERSRKLVREDYVSRQRFDISQADAARAAAGLTGSGAQLQGARRQLSVLASEHNVALAQLEQAKAALILAETELEATVIRSPVDGVIGNRAVRDGQYVRPGQMLLAVVPLGNVWIDANFKETQIGRMKPGNRAEIKVDAFPGAVITGTVDSFAPASGAKFSLLPPENATGNFTKVVQRIPVRIRVDPDSPLAGQLRPGLSVVVKVDTRDEGK

SEQ ID NO: 81967 - DNA, 894 bp, Azotobacter vinelandii
  CDS (1)..(894)
atgtcctggaaaagagtcatcagtgtcgtcttcaccctgctggtcgccgccgtcgccgcctacatcgtgcgcacgctgtgggtgcactacatggattcgccctggacccgcgacggccgggtgcgcgccgacgtgatcaacatcgctcccgacgtcgccggcctggtggtcgaggtggcggtgaaggacaaccagcaggtcaagaagggcgacctgctgctgcgcatcgacgacgaacactaccgcctggcggtcaagcaggccgaagccctggtggcctcccgcaaggcccagttgcagatgaatcaggaaaacgcccagcggcgcagcgacctggacgccatggtggtgtcgcgcgaaagccgcatcaacgccagccacatggccagcgccgcccaggccgaataccaggaagcactggcgcagctcgaccggaccaagctcgacctgaagcgcaccgaagtgcacgcgccggtggacggctacgtcaccaacctcaacgtcttcgagggcgacttcgccaaccgtggcgaggcggccatggccctggtcgacagccattccttctacgtctacggctacttcgaggaaacccgcctgccgctgatccgcgtcggcgacaaggccgaactgcgactgatgagcggcgagcgcctgagcggccaggtcgacagcatcgcccgcggcatctacgaccgcgacaacccggaaagccgcgaactggtcgccgacgtcaacccgaccttcaactgggtgcgcctggcccggcggataccggtacgcatccgcatcgaagaggtgccggaaggcgtgaccctggcggccggcctgacctgcacggtgatcgtcacccctcccgccgaccggccgcgcccggtgccggatcgctggtag

SEQ ID NO: 81968 - protein, 297 aa, Azotobacter vinelandii
MSWKRVISVVFTLLVAAVAAYIVRTLWVHYMDSPWTRDGRVRADVINIAPDVAGLVVEVAVKDNQQVKKGDLLLRIDDEHYRLAVKQAEALVASRKAQLQMNQENAQRRSDLDAMVVSRESRINASHMASAAQAEYQEALAQLDRTKLDLKRTEVHAPVDGYVTNLNVFEGDFANRGEAAMALVDSHSFYVYGYFEETRLPLIRVGDKAELRLMSGERLSGQVDSIARGIYDRDNPESRELVADVNPTFNWVRLARRIPVRIRIEEVPEGVTLAAGLTCTVIVTPPADRPRPVPDRW

SEQ ID NO: 81969 - DNA, 1134 bp, Azotobacter vinelandii
  CDS (1)..(1134)
atgactgaagcctcgcagccccccatcgagacgcccgcgccgccgcccgccgcccccgagccggccgatcccagccgtcgcggcgtgcgctggactctcgcgctgatcgtcctcagcctgctctggtatctgtttgccgaccgctacaccccctacacccagcaggcccgggtagaagcgctggtggtcggggtcgcgcccgaagtggccggccgcgtgatcggcgtcgcagtacgcgacaaccagcacgtggaggccggacaactgctcttcgaactggatccggaaccctaccggatcgccgtcgaacgggcgcgcgccgaactggagaacgtgcgccggcaggtcggcgccggcaccgccggcatcgacgccgcgctggccgggctgcgcgccgcgcaggccaacgaggtcaaggcccggcaggacagcgagcgcctggaacggctctaccgcgaggacccgggcaccatctccctgcgccgcctggaggtcgcccgggcgaccctggaacaggccgtcagccaggtcgccgcggcccatgccgaggtccagcgcgcccgtgagcaggagggcggtagcggtgcggacaacgcccaactgcgcagcgccgccgccgccctggagcaggccgagcgcgacctggccaatacccgcgtgcgcgccagctccgccggcctgatcaccgacctgcgcgccgaggtcggccagtacgccggtgccggcaaggcggtgctgaccctgatcgccatcgacgacctgtggatcagtgccgagatgaccgaaaacaacctgggccatctcgaacccggcacgccggtggcgatcgtcctcgacgccctgcccggaaccctgttcgagggccgcgtgcgcagcatcggcttcggcgtcggtgtcggccaggacaatccgcccggcagcctgccgacggtgcagaacgagcgcgactggctgcgcgccgcccagcgtttcccggtgatcgtcgagttcgcgccgggcgagctgagcgatcgccgggcgctgcgcatcggtggccaggccgaggtgatggcctttccccgccgcggcaatccgctcaatccgctcggccgcgccttcctgcgcctgatgagctggctgtcctatgcctactga

SEQ ID NO: 81970 - protein, 377 aa, Azotobacter vinelandii
MTEASQPPIETPAPPPAAPEPADPSRRGVRWTLALIVLSLLWYLFADRYTPYTQQARVEALVVGVAPEVAGRVIGVAVRDNQHVEAGQLLFELDPEPYRIAVERARAELENVRRQVGAGTAGIDAALAGLRAAQANEVKARQDSERLERLYREDPGTISLRRLEVARATLEQAVSQVAAAHAEVQRAREQEGGSGADNAQLRSAAAALEQAERDLANTRVRASSAGLITDLRAEVGQYAGAGKAVLTLIAIDDLWISAEMTENNLGHLEPGTPVAIVLDALPGTLFEGRVRSIGFGVGVGQDNPPGSLPTVQNERDWLRAAQRFPVIVEFAPGELSDRRALRIGGQAEVMAFPRRGNPLNPLGRAFLRLMSWLSYAY

SEQ ID NO: 81971 - DNA, 1065 bp, Azotobacter vinelandii
  CDS (1)..(1065)
atgctgatgacccgtcgaacctcgctgctgctcgtcgcgctggtgctgtgtgcactggcgggcctgctggccttcctcctgctgcgcccggtgcgctggcaggcaaccgacaacgcctatgtgcgcgccgattacaccctggtggcgccgaagatttccgggcacgtcgtcgaactgctggtggacgacaaccagttcgtccaccgcggccagttgctggcgcgcatcgacccgcgcgactacgaatccgaactggcctcggccgaagcgcgggtcgccgccgccgaggccgggctgcggcggatcgccgccgacctggagcagcagggctcgcgcatcgccgccgcgcaggccagggtcgccgcggcgcaggccgaacacgacttcgcccgccaggaactgaagcgctacgagagcctcgccagccagggcgccggcagcctgcaactggcccagcaggcgcgctcgcgcatcggcaccagccgcgccgccctggaggaagccagggcggcactggccagcgaagagcaacaggtggcggtgctgcaggcccgccagggcgaagccggcgccgccctgcaacgcgccggggccgaccgccaccacgccgagctgcgcctctcctacacgcgcatcgaggcgccactcgacggcgtggtgggccgccgctcggtgcgcgtcggcgcctacgtgcagccgggcaacgcactgctcgccgtggtgccgctggacgccgtctacgtggtcgccaactaccaggaaacccagttgaccgaagtgcaacccggccaggcggtggaagtcagcgtcgacacctttcccggcgcgccgctgcgcgcccgtgtggacagtttcgcgccggccaccggcctgagcttcgcgccggtcgtaccgagcaacgccaccggcaacttcaccaagatcgtccagcgcatcccggtgaagatccgcttcgagccggaccagccgcaggtggaaaaactccgcgtgggcatgtcggtggtcacccgcatcgacgtccgctcggcggcaccgcagcccggacaaaggaacgcgtcgcgatga

SEQ ID NO: 81972 - protein, 354 aa, Azotobacter vinelandii
MLMTRRTSLLLVALVLCALAGLLAFLLLRPVRWQATDNAYVRADYTLVAPKISGHVVELLVDDNQFVHRGQLLARIDPRDYESELASAEARVAAAEAGLRRIAADLEQQGSRIAAAQARVAAAQAEHDFARQELKRYESLASQGAGSLQLAQQARSRIGTSRAALEEARAALASEEQQVAVLQARQGEAGAALQRAGADRHHAELRLSYTRIEAPLDGVVGRRSVRVGAYVQPGNALLAVVPLDAVYVVANYQETQLTEVQPGQAVEVSVDTFPGAPLRARVDSFAPATGLSFAPVVPSNATGNFTKIVQRIPVKIRFEPDQPQVEKLRVGMSVVTRIDVRSAAPQPGQRNASR

SEQ ID NO: 81973 - DNA, 1158 bp, Desulfitobacterium hafniense DCB-2
  CDS (1)..(1158)
atggaggattacgattatatgaagttaaggtttcgtttattatcaactgccctaatcatcggcttgaccctgaccgctacggggtgcggttcccaagcagcccaggcggtagttgaagaagaatcctatattcctgttgaagttcagccggctgcggccaagactttagtagagacggtggttttcagtgggaaggtaatctcagatcaagaagtctctatcgttcctaaaatgccgggaaaggttaccaatattaacgtcaaggtaggggatacggtccaggcaggacaagtgctcttcacgatggatacggttgacctgcagaaatctgtcgatacggcggctatagccgtaaaaagtgctgagctgtcttatcagatgaccaaggattccctggattcggccaaggagaatctggaacggcaaagagccctttacgaagccggagctatttccaaagtccagtttgaaggtattgaagatcaggttacctccttggagaataaccttaaagcagttcagctccaggtggagcaggctcaactgggctataaccaggctcatgacgctatatccgatatgaccgtaacggcacccgtcagcggaaccgttgccgctcttaatgtagtggtggggcaaatggcttctcaagccacggcagccgtgacggttacccaattggatgctctttatgtttccttaagtgttcctgagaatattgtcaatacccttaaagtgggacaagaagcaaccgtcatcattaattccgccgggcaaaaggagatcaaaggcgtcttaaccagccttgctccggcagcgaatcaacagctcggcctctatcctgttaaagtgaccattgagaatacagaaaatctggttaagccgggcatgttcgctaaagttgagattcccaccgcaaccaaagagaatgtccttgctgtcaacagtgaagccgttgttttgaaaaacggagaatatgtagtctttgtggttgaagaggagcgcgctgtcgccaagaaggtggtctccggcctggataccggggctgaagtggagatccgcgaaggcctgcaggccggagagcaagtgattgtcaaaggccaaaccttagttgagcaaggaagcaaagtcaaggtggtaggggggagcgaatcttga

SEQ ID NO: 81974 - protein, 385 aa, Desulfitobacterium hafniense DCB-2
MEDYDYMKLRFRLLSTALIIGLTLTATGCGSQAAQAVVEEESYIPVEVQPAAAKTLVETVVFSGKVISDQEVSIVPKMPGKVTNINVKVGDTVQAGQVLFTMDTVDLQKSVDTAAIAVKSAELSYQMTKDSLDSAKENLERQRALYEAGAISKVQFEGIEDQVTSLENNLKAVQLQVEQAQLGYNQAHDAISDMTVTAPVSGTVAALNVVVGQMASQATAAVTVTQLDALYVSLSVPENIVNTLKVGQEATVIINSAGQKEIKGVLTSLAPAANQQLGLYPVKVTIENTENLVKPGMFAKVEIPTATKENVLAVNSEAVVLKNGEYVVFVVEEERAVAKKVVSGLDTGAEVEIREGLQAGEQVIVKGQTLVEQGSKVKVVGGSES

SEQ ID NO: 81975 - DNA, 879 bp, Desulfitobacterium hafniense DCB-2
  CDS (1)..(879)
atggtaaaggtggtggtggctccaaggtcttcgtctgccctgcgcaacaaattggcaccgcaagggccccaaggacgcgaaaccgacggcgccgagccccggtccccggtcaccgtcgtcgccgcaggctcccagcccgtgccggtgttcgtgagcgcgctgggcacggtcaacgcgctcaacaaggtgacggtggcgccgcagatcggcggcgaactgctcagcatcgatttccgcgaaggccaggaagtgaagcagggcgacctgctggcgcggatcgacccgcgcaccgcgcaggccagctacgaccaagccgccgcgtccaagcgccagaaccaggcgcagctggcgaccgcgcgctccaactaccagcgctccaacgcgccggagtaccgccagtacgtgtccaagaccgacctggacacccagcgcaaccaggtcgcccagctcgaaagcgcggtcgccgccaacgatgcggcgatgcgctcggcccaggtgcagctgcaatacacccgcgttaccgcgccgatttccggcatcgccggcctgcgcagcgtcgatgtcggcaacgtgctcaacgccggcaccgcgctggtcaccctgacccaggtgcatcccatccacgtgctgttcaatctgcccgagcgccagttgcagggcgtgcgcgaggcgcagcgcgccgggccggtgatggtcggcgcgctggaccgcaacgacgcccatccgctcaccgccgacggcaagctcgacgtggtcgacaaccagatcagcgccgacagcggcaccttccgcgcccgcgccgtgttcgacaacaccgacaacgcgctttggccgggccagttcgtcaacgtgcgcctgcgcctgcgcacgatcgaatag

SEQ ID NO: 81976 - protein, 292 aa, Desulfitobacterium hafniense DCB-2
MVKVVVAPRSSSALRNKLAPQGPQGRETDGAEPRSPVTVVAAGSQPVPVFVSALGTVNALNKVTVAPQIGGELLSIDFREGQEVKQGDLLARIDPRTAQASYDQAAASKRQNQAQLATARSNYQRSNAPEYRQYVSKTDLDTQRNQVAQLESAVAANDAAMRSAQVQLQYTRVTAPISGIAGLRSVDVGNVLNAGTALVTLTQVHPIHVLFNLPERQLQGVREAQRAGPVMVGALDRNDAHPLTADGKLDVVDNQISADSGTFRARAVFDNTDNALWPGQFVNVRLRLRTIE

SEQ ID NO: 81977 - DNA, 1158 bp, Pseudomonas syringae pv. syringae B728a
  CDS (1)..(1158)
atgaccgaatccaagaccccagataccgaagctccgcgcaactcgccgccaccggcaccgttgacgtccccggtgaccagcaagccgcgctcgacccgcaagcgtgtcgtgtcttccgtgattttcggcgccgtcgccctggccggggtgctggtggtgctgtacgcctggcaactgcccccgtttgccagcccgatcgagagcaccgagaacgcgcaggtcaagggccagaccacgctgatcgggccgcaactgagcggctatgtctacgaggtgccggtgcaggacttccagttcgtcaaggccggtgatttgctggtgcgtctggatgaccgtatctatcgtcagcgcctggatcaggccattgcacaactggctgtgcagaaggcctcgctggccaataatctgcaacaacggcgcagtgccgaagccaccatcggccagcgtcaggccgaactgcagaacagcatcgcccagagccgcaagagcgccgccgatctgcggcgcaatcaggcgctggtgaccgacggttcggtttcgaaaagcgagctggatgtcacgcgtgccgccgatgcgcaggcaaacgccgccgttgccgaagccagggcagtcttgcagatcgcccgtgaggacctgcagaccgtcatcgtcaaccgtggctcactggaagcctcggtcgccaatgcgcaggcggcgatcgagctggcgcgcatagacctggacaacacccgtatcgttgccccgcgggacgggcagttggggcagattggcgtgcgtctgggggcctatgtcaattcgggcgcgcaattgatggcgctggtgcccgagcagcgctggatcgtggcgaacatgaaagaaacccagatggccaacgtgcgcctgggccagccggtgagctttaccgtcgatgcgctcgatggccacgagatgcatggccacgtacaaagaatttcgcccgctgccggctcggaattcagtctgctgcccgccgacaacgccaccggcaacttcgtgaagatttcccagcgtatcccggtacgcatcgtggtcgatgccgatcagcccatgcttgagcacctgcggccagggatgtcggtggtcgtgagcatcgacaccagcgcggacggcgatgtgccgcctgatccggcggtgcgctga

SEQ ID NO: 81978 - protein, 385 aa, Pseudomonas syringae pv. syringae B728a
MTESKTPDTEAPRNSPPPAPLTSPVTSKPRSTRKRVVSSVIFGAVALAGVLVVLYAWQLPPFASPIESTENAQVKGQTTLIGPQLSGYVYEVPVQDFQFVKAGDLLVRLDDRIYRQRLDQAIAQLAVQKASLANNLQQRRSAEATIGQRQAELQNSIAQSRKSAADLRRNQALVTDGSVSKSELDVTRAADAQANAAVAEARAVLQIAREDLQTVIVNRGSLEASVANAQAAIELARIDLDNTRIVAPRDGQLGQIGVRLGAYVNSGAQLMALVPEQRWIVANMKETQMANVRLGQPVSFTVDALDGHEMHGHVQRISPAAGSEFSLLPADNATGNFVKISQRIPVRIVVDADQPMLEHLRPGMSVVVSIDTSADGDVPPDPAVR

SEQ ID NO: 81979 - DNA, 1158 bp, Pseudomonas aeruginosa UCBPP-PA14
  CDS (1)..(1158)
atgcaggcgttgcgcagtggtgggggacgggtcctggtgggcgtgctggcggcgggcctggtcgccttcggcggttgggcatggctcggcggcgacgccggggcgaaggcggcgcccgcgccggccagggtcccggtgaacgtggcacgggtggagcggcgcgacgtcgagcaacaggtcagcggcatcggcacggtgacttcgttgcacaacgtggtgatccgcacccagatcgacggccagttgacccgcctgctggtgagcgaagggcagatggtcgaggcgggcgagttgctggcgaccatcgatgaccgcgccgtcgtcgccgcgctggagcaggcgcaggcctccagggcgagcaaccaggcccagctgaaatccgccgagcaggacctgcaacgctaccgcagcctgtatgccgagcgtgcggtgtcacgccaactgctggaccagcagcaggcgacggtcgaccagttgcgcgcgaccctgaaggccaacgatgccaccatcaacgccgagcgggtgcgcctgtcctacacccggatcacctcgccggtatccggcaaggtcggtatccgcaacgtcgatgtcggcaacctggtgcgggtcggcgacagtctcggcctgttcagcgtgacccagatcgcaccgatctccgtagtcttctccctgcaacaggaacagttgccccagttgcaggcgctgctcggcggcgaggcggcggtgcgcgcctacagccgcgacggcgggagcgcgctgggcgagggccggttgctgaccatcgacaaccagatcgacagttccaccggcaccatccgcgtgcgcgcctccttcgataaccgccaggcccggctctggcccgggcagttcgtcgcggtgagcctgcacaccggggtccggcgcgaccagttggtgctgtcgagcaaggcggtgcgccgcggcctggagggcaatttcgtctaccgggtcgccgccgaccgggtcgaggcggtgccggtgcgggtgctccaggacatcgacggcctcagtgtggtggaaggcctggccagcggtgaccaggtggtggtggacggccactcgcggctgatgcccggcgccctggtcgatatccaggagccgcgcccgagcctggcccaggccacggagcggcggccgtga

SEQ ID NO: 81980 - protein, 385 aa, Pseudomonas aeruginosa UCBPP-PA14
MQALRSGGGRVLVGVLAAGLVAFGGWAWLGGDAGAKAAPAPARVPVNVARVERRDVEQQVSGIGTVTSLHNVVIRTQIDGQLTRLLVSEGQMVEAGELLATIDDRAVVAALEQAQASRASNQAQLKSAEQDLQRYRSLYAERAVSRQLLDQQQATVDQLRATLKANDATINAERVRLSYTRITSPVSGKVGIRNVDVGNLVRVGDSLGLFSVTQIAPISVVFSLQQEQLPQLQALLGGEAAVRAYSRDGGSALGEGRLLTIDNQIDSSTGTIRVRASFDNRQARLWPGQFVAVSLHTGVRRDQLVLSSKAVRRGLEGNFVYRVAADRVEAVPVRVLQDIDGLSVVEGLASGDQVVVDGHSRLMPGALVDIQEPRPSLAQATERRP

SEQ ID NO: 81981 - DNA, 1005 bp, Pseudomonas aeruginosa UCBPP-PA14
  CDS (1)..(1005)
atgaacctgttgcaaggcaaatggccgcgcctggccaccctgctggcggtgctggtggcggcggcactggtgttcctcgcctgggaacgctacacccgcacgccgtggacccgtgacgcgcgggtccgcgccgatgtggtgacgctgtcggcggacgtttccgggctgatcacccggttgccgctgagcgacaaccagcccgtggagaagggcgcgctgctgctcagcatcgacccggcgcgctatgaactggcggtgctgcgcgccgagcgcgcggtgaacgtggcgcgggcggcgctgggcgagtcgcgcgcggcgatcgaggccagccaggcccagttgcgccagcgccgcagcgaggcgcagcggcgctcggcattgcagaagcgctcgatgctatcggtggaagagaacgaaaaggcccagaccgacgtcagcctggcccaggccgagttgctgaggaaccaggccagcctcggcctggcccaggccaacgtggagcttgccgaagccgccttgcagcaggcccgtctcgacctcgaacgtacccaggtacgcgccccggtcagcggctacgtgaccaatctgcagacccgcgaaggcgactacgcccacgccggggtgccattgctggcgctggtggaccgcgattcgttctatgtcagcggatacttcgaggagaccaagttgccgggcatccgcgtcggcagccgggcgcgggtggaactgatgagcggcgagcgcttcgacgggcgcgtgcagagcatcgcccatgccatcaccgaccgggagaatgccgagggctcgcgcctgctggcgaacatcaacccgagctatacctgggtcaagctggcccagcgaattccggtgcgcatcgccatcgatcccgcctatcgccagcgcaacaccttgcgcgccggcgtgaccgcgaccatccgggtgctgcccgcggaggacaccgcgaaagtcgattccgcggcgcccgggactgccgtgcggccttga

SEQ ID NO: 81982 - protein, 334 aa, Pseudomonas aeruginosa UCBPP-PA14
MNLLQGKWPRLATLLAVLVAAALVFLAWERYTRTPWTRDARVRADVVTLSADVSGLITRLPLSDNQPVEKGALLLSIDPARYELAVLRAERAVNVARAALGESRAAIEASQAQLRQRRSEAQRRSALQKRSMLSVEENEKAQTDVSLAQAELLRNQASLGLAQANVELAEAALQQARLDLERTQVRAPVSGYVTNLQTREGDYAHAGVPLLALVDRDSFYVSGYFEETKLPGIRVGSRARVELMSGERFDGRVQSIAHAITDRENAEGSRLLANINPSYTWVKLAQRIPVRIAIDPAYRQRNTLRAGVTATIRVLPAEDTAKVDSAAPGTAVRP

SEQ ID NO: 81983 - DNA, 1404 bp, Psychrobacter sp. 273-4
  CDS (1)..(1404)
atgaacgaagacaaaccgaaccgctttgatgacgcaagtacacctaacaaagcggctaaacccgttgaaaatgctcaagctagtgaatcattatcaaatcaagcagttgtggatacaccatcacagtcacagtcacaagtggcttccaataatgacgcaaataccaatatagcagccattcaacctgaacctactatgcctgaaactcgggttcaaactgacccttctgatgacttacctactaatgccaatgagcctataaatacccctgatactggcactgataaaataggcagcactgaggcaggtgatggcaaagatgccactccgatgccacccactgaatctattcctgcaccggcaggttggtcacctaaaaagaagtcgttttttaatttaggtttactgattgctctgattgttattggcgtggcactcattctctatgcgtggaagctgccaccttttacaccaaccatgcaacaaaccaacaatgcttttgttaaaggacaaacaaccattatcagcccgcaagtgtcaggttatgtgacagaagtggcggtagaagattttgcgaatgttgcagcgggtgatttgttggtaaaaatagatgatcgaatttttcagcagcagctagaacaagcacaggcgaatatcgatattgcgttgaccaatcgctctagtaatgcgcaagatacgggcaccagccaagcacagattcaggcgcgcgaggcagatgtttatagcgctaaagtaagtgttgacagtgcccgcgaggacgttaaccgttatcagggcttagttgccattggcgcagtatcgagagcagatgttgctcatgctgaagctcaattagcaaaagcacaagccggtgtccaacaagcggaagccaatttacaagtggcaaaagaaggtagcaaaaaaatgactgctagccgctcttcattagatgccaatatcaaaaatgctgaagctgccgcgaaacaagcacagattaacttagacaacaccataattcgcgcccctgaatcaggacaattgagccaattaactgtccaaacaggacaatatgtcactgctggtacgcagcttatgtatattgtgccaaaaggcgtatggattattgccaactttaaagagacacaagtggccaatatgacgattggtgaagctgccactattcatgtggatgccttgggtggcacgcagtttagcggacgtgtcagcaatatctcacccgcaacaggcagtgaattcagtgctggcgctgccaatcctgcaacaggtaactatattaaaatcgctcagcgtattccagtccgtattgacttagaccccaaccagccagagcttgcccgcctacgtcctggtatgtccgtgtcggtagatgtggatactaaatag

SEQ ID NO: 81984 - protein, 467 aa, Psychrobacter sp. 273-4
MNEDKPNRFDDASTPNKAAKPVENAQASESLSNQAVVDTPSQSQSQVASNNDANTNIAAIQPEPTMPETRVQTDPSDDLPTNANEPINTPDTGTDKIGSTEAGDGKDATPMPPTESIPAPAGWSPKKKSFFNLGLLIALIVIGVALILYAWKLPPFTPTMQQTNNAFVKGQTTIISPQVSGYVTEVAVEDFANVAAGDLLVKIDDRIFQQQLEQAQANIDIALTNRSSNAQDTGTSQAQIQAREADVYSAKVSVDSAREDVNRYQGLVAIGAVSRADVAHAEAQLAKAQAGVQQAEANLQVAKEGSKKMTASRSSLDANIKNAEAAAKQAQINLDNTIIRAPESGQLSQLTVQTGQYVTAGTQLMYIVPKGVWIIANFKETQVANMTIGEAATIHVDALGGTQFSGRVSNISPATGSEFSAGAANPATGNYIKIAQRIPVRIDLDPNQPELARLRPGMSVSVDVDTK

SEQ ID NO: 81985 - DNA, 1173 bp, Haemophilus influenzae R2846
  CDS (1)..(1173)
atgacgaaaactgcaattgaaactccatcaaataaatctgtatcaaagaaaactaatcgtaaaaaaaatttaagcatttttatttttatcttgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgctgacaatatggataaagtccatgcaggtgatattctagttgaattggatgatacgaatgcgaaacttagtttcgaacaggccaaaagcaatctcgccaatgctgtacgtcaggtagaacaactgggtttcactgtgcagcaattgcaatcagctgtgcacgtcaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcgggctttattgcgtaacgttccattacgtgaacaaccgcaaatacagaatgcgataaactcgcttaaacaggcttggttaaatttgcaacgtacaaaaattagaagtccaattgatggctatgtggcgcgccgtaatgctcaagttgggcaagccgtttcagtgggtggcacgttaatggcggtggtatctaatgaacaaatgtggctagaagctaactttaaagaaactcaattaacgaatatgcgcattggccagccagtgaaaattcattttgatttatacggtaaaaataaagaatttgatggcgtgataaatggtattgaaatggggactggcaatgcattttctcttttgccttcacaaaatgctacgggtaactggattaaagtggtgcaacgcgtacctgtgcgaattaaattagatccacaacaatttacagaaacgccattgagaattggtctttctgcaacggcaaaagtaagaatttcagattcatcaggcgcaatactacgagaaaaaacagaaccgaaaacgttattttctactgatacacttaaatatgatgaaagtgcggtagaaaatttgattgaatctatcattcagcaaaacagccattaa

SEQ ID NO: 81986 - protein, 390 aa, Haemophilus influenzae R2846
MTKTAIETPSNKSVSKKTNRKKNLSIFIFILLIIGIACALYWFFFLKDFEETEDAYVGGNQVMVSSQVAGNVAKINADNMDKVHAGDILVELDDTNAKLSFEQAKSNLANAVRQVEQLGFTVQQLQSAVHVNEISLAQAQGNLARRVQLEKMGAIDKESFQHAKEAVELAKANLNASKNQLAANRALLRNVPLREQPQIQNAINSLKQAWLNLQRTKIRSPIDGYVARRNAQVGQAVSVGGTLMAVVSNEQMWLEANFKETQLTNMRIGQPVKIHFDLYGKNKEFDGVINGIEMGTGNAFSLLPSQNATGNWIKVVQRVPVRIKLDPQQFTETPLRIGLSATAKVRISDSSGAILREKTEPKTLFSTDTLKYDESAVENLIESIIQQNSH

SEQ ID NO: 81987 - DNA, 1233 bp, Ralstonia eutropha JMP134
  CDS (1)..(1233)
atgagtaccctgaatcgacgcacgttgatcgcgattgccatcgtggtcgtcctcggcgccggcgttgccacctccatgctgcagccatggcatggcggcgaggcgcatgccaacacgccgccgccggctccgactattgaagtggcaaacgtggtcggcaagaccattaccgaatgggacgagttctcgggccgtatcgaagccgtggaccgcgtggaaatccgcccgcgcgtttccggcacgattgaaacggtgcatttccgcgaaggctcgatcgtgaagaagggcgatccgctgttcacgatcgatccgcgtccgtacgcggctgaagtggcgcgcgccgaggcagcgctggccgcggctcaggtgcgcgcctcgcacgcgcagaccgagaaggcgcgcgcccagcgcctgctggacgacaacgccatctcgaagcgcgaatttgacgagcgcatcaacgccgccagcgaactgtccgccgacgtgcgcggcgcgcaggcggcgctagaggtggcgaagctgaacctgagctatacgcgcatcgttgcgccggtatcgggcaaggtatcgcgtgcggaaatcacggtaggcaaccttgtcgcagcgggcgccgcatcgccgccgctgacgtcggtggtgtcggtctcaccggtgtatgcaagtttcgatgtcgacgagcagagctacctgcgctataccgcgcccggtgccggcggcggcaagaacggcctgccggtgttcctgggcctggctaacgaggacggcaatccgcacgagggcaagatccactcgatcgacaaccggctcgatacgcgcagcggcaccatccgcgtgcgcgcggtgttcgacaacgaggatggccgcctgttgccgggcctgtatgcgaaggtcaagcttgggggcggttcgccgcacgacgccgtgctgatcaacgaccgcgcgatcggcactgaccagggcaagaagttcgtgctcgtggtcgataaggccaacaagctgacctatcgcgaagtcgacctcgggccgacctttgaagggctgcgcgtgatccgcaagggtttgaagcccggcgagagcatcgtcgtgaacggcctgcagcgtgtgcgccccggcgatacggtggcaccgaagcccgtctcgatggcgttccgcagcgaactggagccacgccccaacgcgcctgaccgcaagcaggcggccgccgaggccgaaggcaagcccgtcagctaa

SEQ ID NO: 81988 - protein, 410 aa, Ralstonia eutropha JMP134
MSTLNRRTLIAIAIVVVLGAGVATSMLQPWHGGEAHANTPPPAPTIEVANVVGKTITEWDEFSGRIEAVDRVEIRPRVSGTIETVHFREGSIVKKGDPLFTIDPRPYAAEVARAEAALAAAQVRASHAQTEKARAQRLLDDNAISKREFDERINAASELSADVRGAQAALEVAKLNLSYTRIVAPVSGKVSRAEITVGNLVAAGAASPPLTSVVSVSPVYASFDVDEQSYLRYTAPGAGGGKNGLPVFLGLANEDGNPHEGKIHSIDNRLDTRSGTIRVRAVFDNEDGRLLPGLYAKVKLGGGSPHDAVLINDRAIGTDQGKKFVLVVDKANKLTYREVDLGPTFEGLRVIRKGLKPGESIVVNGLQRVRPGDTVAPKPVSMAFRSELEPRPNAPDRKQAAAEAEGKPVS

SEQ ID NO: 81989 - DNA, 1128 bp, Ralstonia eutropha JMP134
  CDS (1)..(1128)
atgacaagcaacaccatcaccgaacgcacgggcgagcagcctgttccggccgcgaaacaggcaggatcgcggcccgctacgaagaagctgctcgcgaccggggcgctgcttgtcgcgggtctggccggtgtcggctacggctaccactggtggagctccgcgcgcttcgtgcagagcaccgacgatgcctacgtgggcggcgacgtgaccgtgatcggcgcgaaggttgccggctatatctccgaagttgccgtgaccgacaaccagcctgtgcatgcaggggatgtgctggtgcgcatcgacgaccgcgactatcgtgccgcgctggccaaggccgagggcgcggtggctgcgcagcaggctctgctcgaaaacctcgacgccacgcagcggctgcaggaagccgtcatcggccaggcgcgggccggcttcgcgggcgccaatgccgacaccgttcgtgcgcgccaggaccaggcacgctatgcgagcctggtcgaaaaatcggcggtgtcgatccagagttcgcagaaggccgatgccgactacaagcaggcggccgccaacagcgaaaaggcgcaagcgtcgctgctcgccgcgcagcgccagctcgaggtgatcggcacgcagaagctgcaggcgaaagcggcgctggcgcaggccgtggcggaacgcgacatcgcaaagctcaacctcagctacaccgaactgcgcgcgccggtcgacggcacggtgggcaaccgccgcgcgcgcgtcggcgcctacgccggcagcggtagtcagttgctgtccatcgttccggccagcggcttgtgggtcgatgcaaacttcaaggaaggtcagctcgcgcatatgcgcgagggcatgcctgtcaccatcgaggccgatgtgctgcccggacgcgtcttccatggccgcgtcggcagcctcgcgccggcgactggggcgcagttcagcgtgctgccggccgaaaacgcgaccggtaacttcaccaagatcgtccagcgcgtgccggtacgcatccagctcgacgagaaagatgccacgctcggcaccttgcgcccgggcctgtccgtgatcgcgcaggtcgatacgcatccggatacgcattcaaccaggcaggtgcaatga

SEQ ID NO: 81990 - protein, 375 aa, Ralstonia eutropha JMP134
MTSNTITERTGEQPVPAAKQAGSRPATKKLLATGALLVAGLAGVGYGYHWWSSARFVQSTDDAYVGGDVTVIGAKVAGYISEVAVTDNQPVHAGDVLVRIDDRDYRAALAKAEGAVAAQQALLENLDATQRLQEAVIGQARAGFAGANADTVRARQDQARYASLVEKSAVSIQSSQKADADYKQAAANSEKAQASLLAAQRQLEVIGTQKLQAKAALAQAVAERDIAKLNLSYTELRAPVDGTVGNRRARVGAYAGSGSQLLSIVPASGLWVDANFKEGQLAHMREGMPVTIEADVLPGRVFHGRVGSLAPATGAQFSVLPAENATGNFTKIVQRVPVRIQLDEKDATLGTLRPGLSVIAQVDTHPDTHSTRQVQ

SEQ ID NO: 81991 - DNA, 1251 bp, Methylobacillus flagellatus KT
  CDS (1)..(1251)
atgagggacatcatgtctgcaccactccaacaaaagaaattcgccgccctgctggcggcaaccctggccatctcgggtggcgtcatcttgtggtcgccagcgagccacgaggcccaggccgacactgccgccgtatcaaatatcgctagcgtggacgttgcggttgtcgcgcagcaggacatcaccgactggcaggattattccggccgcctggaagcagtcgagcgcgtggaaatccgccccctggtttccggcacactgaccaagatccacttcaaggacggcgacctggtgaggaaaggcgatctgctgttcaccatagacccgcggccattcgaagcggaggtagcacgcgcccaggcccagttgagcggcgccgaggcgcggttggactacaccagccacgacctggaacgcgcagagcgcctgatcggtgacaacgccattgcccggcgcgacttcgaggaaaagcgcaatgcggcattggaggcgaaagccgcattgctggcagcccaggctgcattgcagaccgcccgcctcaatctggaatatagccgcatcacggccccggtttccggccggatttcccgcgccgaggtgacactgggcaatatcgtttccgcgggcgctagctccacgccgctcactacgctggtatctaccgacaacatctacgcggcgcttgaagtagacgagcaaagctacctgaaattcatccagcccgggcataccagccggctcaaggtattgctgggcctggcgaacgaggacggctacagccgcgaaggccgcatcggatcggtcgataaccgcctcgacaccgcatcgggcaccatccgcgtgcgcgccgtgttcgacaaccacaagggcgagttgctgccggggctgtatgcgcgcgtcaggctgggcagtggcagcacccgtccggcgttactgatagacgagaaagccgtgggcaccgaccaggacaagcgctacgtgctggtggttgatgcgcagaaccaggccaattaccgcgagatacagctaggcgcggcccatggcgaactgcgtgtggtggaaagcgggctgcagcctggcgaacgcatcgtggtcaatggcctgcaacgcgtgcgccccggcagccaggtcagcccgcacttggtcgccatgcctggcagcgattcgccattggcacaggtcagggcagaggaagccatccacaccatccgcagcctccccaatcaacaacaaaagaccgtcaaagcctaa

SEQ ID NO: 81992 - protein, 416 aa, Methylobacillus flagellatus KT
MRDIMSAPLQQKKFAALLAATLAISGGVILWSPASHEAQADTAAVSNIASVDVAVVAQQDITDWQDYSGRLEAVERVEIRPLVSGTLTKIHFKDGDLVRKGDLLFTIDPRPFEAEVARAQAQLSGAEARLDYTSHDLERAERLIGDNAIARRDFEEKRNAALEAKAALLAAQAALQTARLNLEYSRITAPVSGRISRAEVTLGNIVSAGASSTPLTTLVSTDNIYAALEVDEQSYLKFIQPGHTSRLKVLLGLANEDGYSREGRIGSVDNRLDTASGTIRVRAVFDNHKGELLPGLYARVRLGSGSTRPALLIDEKAVGTDQDKRYVLVVDAQNQANYREIQLGAAHGELRVVESGLQPGERIVVNGLQRVRPGSQVSPHLVAMPGSDSPLAQVRAEEAIHTIRSLPNQQQKTVKA

SEQ ID NO: 81993 - DNA, 903 bp, Methylobacillus flagellatus KT
  CDS (1)..(903)
atgaaagacctttacaagcacatcctgcgtatttctctcacactactcgtcgtggtgaccgccgtgatcatggggcacatgctctgggtacgctacatggactcgccatggacacgtgacggcagggtgcgtgccgatgtcgtcaatatcgccagcgacgtctccggcctggtcaccgaagtcgtggtgcacgacaaccagttcgtgaaaaaaggcgacgtattgttccgtatcgacgccgagcgctaccaccatgccctggaagaggcagaagccaagctggagcagcgcaagatcaacctcgccctcaaacgggggcagtccacgcggcgcgccatgctcgacgaccaggtgatttcacgcgaggaccgggaggattccgacctgatcacgctggcagccaaggctgaccttgaccaagcccgtgccgaactcggccatgccagactcaacctcgagcgcaccgaggtgcgggcgcctgtcgacggctgggtatccaacctgctggtgcggccaggagattatgcccaggcgggcgaagccaagctcgcgttgatcgaccagaaatcctactgggtctacggctacttcgaagagcacaagctcgccctcatccatgtgaacgacccggcggaaatccgcatgctgggcaccgacttcgtcctgcacgggcatgtcgaaagcctcgcgcgcggcatcaccgaccgcgacaacccaaccgatgtcaggctgctagccaacgtcaacccaagcttcaactgggtgcgcctggcccagcgcgtgccggtgcgcatccatatcgacgacattcccgaaaacgccgtgctggtcgccggcatgacctgctcagtgatcatacatcccgtcgtaaaagccactaaaacggccatgccccctgcttga

SEQ ID NO: 81994 - protein, 300 aa, Methylobacillus flagellatus KT
MKDLYKHILRISLTLLVVVTAVIMGHMLWVRYMDSPWTRDGRVRADVVNIASDVSGLVTEVVVHDNQFVKKGDVLFRIDAERYHHALEEAEAKLEQRKINLALKRGQSTRRAMLDDQVISREDREDSDLITLAAKADLDQARAELGHARLNLERTEVRAPVDGWVSNLLVRPGDYAQAGEAKLALIDQKSYWVYGYFEEHKLALIHVNDPAEIRMLGTDFVLHGHVESLARGITDRDNPTDVRLLANVNPSFNWVRLAQRVPVRIHIDDIPENAVLVAGMTCSVIIHPVVKATKTAMPPA

SEQ ID NO: 81995 - DNA, 1134 bp, Mesorhizobium sp. BNC1
  CDS (1)..(1134)
atggctaagctgaaattccacaagatcgcagcaatagtggtgctcgtcgcaacggcaggctggattgccaccggccaattttcctcagtgggcagcgccagagaggaggcgaagcccgcaggcgccgagccggatcgccctgtcgttttgaagacggtgcaggtcgcagtgccgccgcgggttgagcacgcgcgcaccatccatgtctcgggacggacagaggcggacaagaacgtaaatctagcggcgcgcgtcgccggaatcgtggaagaattgcctgtcgaggaaggctcccgtgtgaaggagggggacctgatcctgcgcctcgaaaacgaaggcaaggaggcggctgtgacatcggcgcagcagacgcttgcccacagagaggctgaatttgccgcggcggaacggctttccaagagtggcaatctcgccagcctgcagctcgatgtcgcgcgcgccaatctggccgccgcccgctcggccctggagcaggcgaaggccgaactcgaccgcgtctcggtgcgcgcgccattcgatgcggtggtggacaaaattcaagtcgaaaagggcaccgccgccatgcagggcgcggaagtggccactctcctgaagctcgatcccatcgtggccgcgggcgaggtgagcgagcgcgatctcggcacgatcaggccgggtgacaaggccgaggtgcgcctggtcaatggcgagacgctttccggcacgattcgccatgtgagccgcgccgcttccccgcagacgcgtacctatcggatcgaagtcgttgctcccaatccggacaacggcatccccgcaggaatgacggcggaaatcagcatcaagacggagatggtggaaaccgtagcgctgccgcggtccgtcatcacgctcagcaacaacggagaacttggcgtccgcgccgtggatgaggccgcccaggtgcatttctacccgatcgatatcgtggatgatacgcccgaagcgctctatctggccggcataccgcaggaaatgcgcatcattgtcgccggccaggacctcgtgaccgacggagagaaggtgaaggcggaagaggcagacgccgctaccatccgtgagctcgccagcgcggcgcggccacagcaagagcaatga

SEQ ID NO: 81996 - protein, 377 aa, Mesorhizobium sp. BNC1
MAKLKFHKIAAIVVLVATAGWIATGQFSSVGSAREEAKPAGAEPDRPVVLKTVQVAVPPRVEHARTIHVSGRTEADKNVNLAARVAGIVEELPVEEGSRVKEGDLILRLENEGKEAAVTSAQQTLAHREAEFAAAERLSKSGNLASLQLDVARANLAAARSALEQAKAELDRVSVRAPFDAVVDKIQVEKGTAAMQGAEVATLLKLDPIVAAGEVSERDLGTIRPGDKAEVRLVNGETLSGTIRHVSRAASPQTRTYRIEVVAPNPDNGIPAGMTAEISIKTEMVETVALPRSVITLSNNGELGVRAVDEAAQVHFYPIDIVDDTPEALYLAGIPQEMRIIVAGQDLVTDGEKVKAEEADAATIRELASAARPQQEQ

SEQ ID NO: 81997 - DNA, 1152 bp, Mesorhizobium sp. BNC1
  CDS (1)..(1152)
atgaacgctatatccaacccagaggcaaaggcggagccggtcgaggtcgagcagcagaaggcaggaccggtggctttgccgcaacctgccgatctcaagccgaagaagaaaaagaaccgcctgcggatggtgctgatgctcgcggcaccgcttgcgcttgccgttgcgggaacatggtggtgggtgaccagcgggcgatatcaggagacggacgacgcctatctgcagcagcccaagctttcgatcgcctcccagatcgcgggccgcgtggtggaatccaatgtcgcgaacagcatgcacgtggaagccggcgcggtgcttttcaaggtagacccggagccctaccgaatcgcgcttgcgcaggcggaagctgctcttgagggagcgcgcctgcaggtagagcaactgcgcgcctcatacagccaggccgaggctcaggcgcgtgatgcagacagcgaagtcgcctatcttgagacgcagcttaagcgccagcaggatctttcggggaagggtgtggcgtcccagtcatcgctggatcaggcagagcgcaacctgcagaaggcgagggagagcctaagcgctacgcggcaagctgttgcgagcgccctggccgcacttggcggcaatccgaaaatcgagacggacaagcatccgacggtgctttcggctctggcagcccgtgacaaggccgcttatgagctggctcagacgaccgtgagggctccagccgatggcatcatcgcccaggcgtcggatttccgcaatggccagttcgtcagcacaggcacgcctctgttctccctggtggagaccagaagctcctgggtcgaggccaatttcaaggagacgcagcttacccacatgaagccgggccaaaaggccgagatcgtcttcgatacgtatccggaccggccgctggaagccaccgtcgaggatatcagcgcgggaacgggggcggagttctccctgctgcctgcccagaacgctaccggcaattgggtaaaggtgacgcaacgcattcccgttcgcctcaagcttcagatcgaagagcctgaacttctgctgcgcaccggcatgagcgccaccgtgaccgtcgataccggggtttcacacggctttccgggcctgactacggcgcacgcgaccgaatag

SEQ ID NO: 81998 - protein, 383 aa, Mesorhizobium sp. BNC1
MNAISNPEAKAEPVEVEQQKAGPVALPQPADLKPKKKKNRLRMVLMLAAPLALAVAGTWWWVTSGRYQETDDAYLQQPKLSIASQIAGRVVESNVANSMHVEAGAVLFKVDPEPYRIALAQAEAALEGARLQVEQLRASYSQAEAQARDADSEVAYLETQLKRQQDLSGKGVASQSSLDQAERNLQKARESLSATRQAVASALAALGGNPKIETDKHPTVLSALAARDKAAYELAQTTVRAPADGIIAQASDFRNGQFVSTGTPLFSLVETRSSWVEANFKETQLTHMKPGQKAEIVFDTYPDRPLEATVEDISAGTGAEFSLLPAQNATGNWVKVTQRIPVRLKLQIEEPELLLRTGMSATVTVDTGVSHGFPGLTTAHATE

SEQ ID NO: 81999 - DNA, 813 bp, Ralstonia eutropha JMP134
  CDS (1)..(813)
atgaatcgaaagctttccctttttgtccccgtcgctgtcacgctgatcgccgtgggtgcggcggcactgacggcgtggcatctgtggcagtactacaccggcgcaccgtggacgcgagacggccgggtccgtgcggaggtagtacaggttgcacccgacgtatcggggctcgtcgcgcaagtccttgttgccgacaatgcgcacgtgaagcgcggccagctgctgttcgtggtggacgaagcgcgctttcgcgtggccctgaaacaggcgcagggcgcggccaacgccgcacgtgcagcgttggtgcgcgccggcaaggtggacatggccaccgcacaggcgcgcctcgaccaggcagacgctgcagtggaagcggccagcctcgacctggcgcgctgccgcgtggccagcccggtcgacggccacgtcgcggaccatctgccgcgcgccggcgacttcgtgaatcgtggccggcccgcgctctcggtggtcgccagcaggtcgcagtacgtcgaaggctatttcgaggaaaccaagctgcccgcaatccgcgtcggcgccgcggccgacgtacggatcatgggccagagcacggcgctgcgcgggcatgtcgtcagcatcgccccgggcatcgacgaccaggaccgcagcagcgggccgaacctgttgccgaccgtcaacccgacgttcaattgggtacgccttgcccaacgtatcccggtccgcgttgcgctcgacgaggtgccgcccggcatgcatctggtcgccggccagacggccacgatccgggtaagaagcgcgtcgcatgactga

SEQ ID NO: 82000 - protein, 270 aa, Ralstonia eutropha JMP134
MNRKLSLFVPVAVTLIAVGAAALTAWHLWQYYTGAPWTRDGRVRAEVVQVAPDVSGLVAQVLVADNAHVKRGQLLFVVDEARFRVALKQAQGAANAARAALVRAGKVDMATAQARLDQADAAVEAASLDLARCRVASPVDGHVADHLPRAGDFVNRGRPALSVVASRSQYVEGYFEETKLPAIRVGAAADVRIMGQSTALRGHVVSIAPGIDDQDRSSGPNLLPTVNPTFNWVRLAQRIPVRVALDEVPPGMHLVAGQTATIRVRSASHD

SEQ ID NO: 82001 - DNA, 1044 bp, Ralstonia eutropha JMP134
  CDS (1)..(1044)
atggccggcgtacgcagcagcccgaagcgcggcaaactgatcgcgccggtgatcgtcctgctggctgtccttctttccgtctacgcctaccagcgcaccagccgctatccgtcttccgacgacgcctcgctcgacgccgatatcgtccatgtggcatcgcccgtcggcggacgcattgcgaagatccatgtggccgagaaccagctggtcgccaagggcgacgtgttgttcgagatcgatcccgtgccctaccagctggttgttgcgcaggcgcgcgccgatctcgaactggcgcgggccgcgctgggcaccaggcagcgcaccatcgccaccgagcgcgccacggcctcgatcgcttccgagcagaccaagcgcgccgagcagaactacgcgctgactgcccgcaccgtcgaacgcttgcgcccgctcgtcgcggacggctacgtacccgcgcagcagctggaccaggcgcaagtggcccagcgcgacgccggcgtatcgctcaggcaggccaatacgcagcgcgccgctacggcaggcgctgttggcaatgaagacgatgccatcgccaccgtacacgcgcgcgaggccgcgctggccattgcgcagcgcgcacttgacgacaccaaggtccgcgcgccccacgccgggcgcgtgagcggcctgaccgtgctgtcgggcgaggtcgtgatcccgaatcagtccctgttcctgctcgtgcataccggcgagtggttcgcggtcggcaatttccgcgagacgtcgctggccaacatccgcatcggcgactgcgccacggtgtactcgatgatcgaccgcagccaggccttgcgcggcaaagttgacggcatcggcatcggcgtgacggacacggaccgcatcaacctgccccgctcgctgccttatgtgcagccgtcggtgaactgggtgcgcgtggccaagcgcttcccggtgcgaatccgcctggaagacccgcccgaggcactggcccgcgtgggcgcgagcgcaactgtcgagatccggcatggcgcagcctgccgctga

SEQ ID NO: 82002 - protein, 347 aa, Ralstonia eutropha JMP134
MAGVRSSPKRGKLIAPVIVLLAVLLSVYAYQRTSRYPSSDDASLDADIVHVASPVGGRIAKIHVAENQLVAKGDVLFEIDPVPYQLVVAQARADLELARAALGTRQRTIATERATASIASEQTKRAEQNYALTARTVERLRPLVADGYVPAQQLDQAQVAQRDAGVSLRQANTQRAATAGAVGNEDDAIATVHAREAALAIAQRALDDTKVRAPHAGRVSGLTVLSGEVVIPNQSLFLLVHTGEWFAVGNFRETSLANIRIGDCATVYSMIDRSQALRGKVDGIGIGVTDTDRINLPRSLPYVQPSVNWVRVAKRFPVRIRLEDPPEALARVGASATVEIRHGAACR

SEQ ID NO: 82003 - DNA, 1077 bp, Ralstonia eutropha JMP134
  CDS (1)..(1077)
atgtcatccgctacccgcccgccaatcaggaatatccgccttgcagcgatcttcatcgcggtcggcatcgttgcgtgggcctgcgcaaccctcgttccaggctcaagtgcgcagtccaccaatgatgcctatgtaacggcagacttcacgctcgtagccccacgtatcgctggccagatttccgaggtgcttgtggatgacaaccaatgggtcaaggccgggcaggtcctggtccgtatcgatgaccgcgacttcagggcggcgctgcaaagtgcgcaggcagacgttctggcggccaaagccatggtggcgaactatgacgcggagatcgcccggcatccgtccctggtcgagcaggcacgggcgaagctccggtccgacgaagcatcggtcgagtttgcccgcgccaacgcgtcgcgctaccggaatctttcggaagccggagccggcaccgagcaggagcagcaacgtgcgtccagtacgcttgccgagcaggtagcgcagcagtcccgcgaccgcgccgcgctgagcaccaccgaacagaacctcatggtcctgaacacgcagcgcgacaaggccgcgggagccctggcgcgtgccgaagccgcactggaacaggcaaggctcaatctgtcgtatgcggaaatccacgcgccggtggatggcaagatcggcaggcgttcggcgcgtgtcggtgcatacgtgacggcaggcgcttcggtccttgccatcgtgccggtgtcggacgcgtacgtggtggccaatttccaggagaaccagattgccggcatgcggccgggacagagcgcgcgcatcaaggttgacagcctgcctggcgtcgagatccagggccatatccacagcctggcgcccgctacgggagtgagcttcgcgcccattgccccggataacgccacgggcaacttcaccaagatcgtccaacgcgtgccggtcaagatcaccatcgatcgcgggcagaaggccgcatccggattgagcgtgggtctttcggtagaggtggacgtcgccattgcccgtcgtgaagatgtgctgccccagggaggtaacagaggatga

SEQ ID NO: 82004 - protein, 358 aa, Ralstonia eutropha JMP134
MSSATRPPIRNIRLAAIFIAVGIVAWACATLVPGSSAQSTNDAYVTADFTLVAPRIAGQISEVLVDDNQWVKAGQVLVRIDDRDFRAALQSAQADVLAAKAMVANYDAEIARHPSLVEQARAKLRSDEASVEFARANASRYRNLSEAGAGTEQEQQRASSTLAEQVAQQSRDRAALSTTEQNLMVLNTQRDKAAGALARAEAALEQARLNLSYAEIHAPVDGKIGRRSARVGAYVTAGASVLAIVPVSDAYVVANFQENQIAGMRPGQSARIKVDSLPGVEIQGHIHSLAPATGVSFAPIAPDNATGNFTKIVQRVPVKITIDRGQKAASGLSVGLSVEVDVAIARREDVLPQGGNRG

SEQ ID NO: 82005 - DNA, 1212 bp, Burkholderia cepacia R18194
  CDS (1)..(1212)
ttgggtgcggcctgtgcactgctgctggcgttgtcgggctgtcacgacggcaaaggcgcatcgtcggcccaatcccttcccgaagtcggcgttgccaccatcgcgccgcgcacgatccgcctcgcggacgaattcaacggacgcgtcgaagcggtcgatgcggtcgaactgcggccgcgcgtgagcggctatctgcagcgtgtcgcctacaaggaaggcgacctggtcgcgcagggcgcgctgctgttcgagatcgacccgcgcccgtaccggatcgcgctcgatcgcgcgaacgcgcagctgcagcgggcccgcgcggccgcgagcctcgcgaacgtgcagctcaagcgcgtgcagacgctgatcgatgcgcatgcgacgtcgcaggaagaactcgacaacgcgcgcgccacggccgagcaagcgcgtgcggacctgcaggcggccgatgcggccgtcgccgatgcgaagctcaatctcggtttcaccgaagtgcgcgcgccgatcgcgggccgcgtcggccgtgcggtcgccaccgtcggcaacctggcgcgcgcggacgacacgctgctgacgaccgtcgtgtcgcagaaccccgtctacgtgtatttcgactgcgacgaacagagctacctgcgctacaacgcacggcgtgccgatcccaagcatcgcgcgatcggtgccgatccggtgcgcgtgggcctcgcgaacgagacgggcttcccgcatgcgggcaccgtcgacttcctcgacaaccggctcgacccgcaaacgggcacgatccgcgcgcgcgtgcggctgccgaatgcggaccatacgtttacgccgggcctgtatgcgcgcgtgcagctcgtcagcggccgcgaccaggatgctttgctcgtcgacgacaaggccgtgctcaccgaccaggaccgcaagtacgtctatgtgatcggacccggcgacaaggcgctgcgtcgtgacgtaacgatcggtcgcgggctggatggcgagcggatcatcgagaaggggattcaggcgggcgaccgcgtggtcgtcgacggtctgcagcggatctactatccgggcgcgcaggtgaagccgaaggcgctgcccgcgcgcgccgatgccggtggtgccggcaatggcgcaggcaacggcacgggtaacggcccgggtaacggcacgcaggccgtcgccgatgccggcgcgccgccggctgcgcagtaa

SEQ ID NO: 82006 - protein, 403 aa, Burkholderia cepacia R18194
MGAACALLLALSGCHDGKGASSAQSLPEVGVATIAPRTIRLADEFNGRVEAVDAVELRPRVSGYLQRVAYKEGDLVAQGALLFEIDPRPYRIALDRANAQLQRARAAASLANVQLKRVQTLIDAHATSQEELDNARATAEQARADLQAADAAVADAKLNLGFTEVRAPIAGRVGRAVATVGNLARADDTLLTTVVSQNPVYVYFDCDEQSYLRYNARRADPKHRAIGADPVRVGLANETGFPHAGTVDFLDNRLDPQTGTIRARVRLPNADHTFTPGLYARVQLVSGRDQDALLVDDKAVLTDQDRKYVYVIGPGDKALRRDVTIGRGLDGERIIEKGIQAGDRVVVDGLQRIYYPGAQVKPKALPARADAGGAGNGAGNGTGNGPGNGTQAVADAGAPPAAQ

SEQ ID NO: 82007 - DNA, 1002 bp, Burkholderia cepacia R18194
  CDS (1)..(1002)
atggtggccacactggtgctgctcggtgttgttgtgtggcgtctcgatcaggcgctgacgaccgacgatgcctatgtctatgccgacacgatcaacgtcgtaccggaagtgaccggcaagatcgtcgagatgccagtgcgcgataaccagccggtgaagcggggagacttattgttccggatcgatccgcgaccgtaccaggatgcgctcaatcaggcgcgtgcaaggttggtcacgctcgaaaggcagattggactcacgcagcgtacggtcaatgcgcagcagtacaacgccgattccgttaaggcagcggttgagcgctcgcgcgcccaggccgtgcaggcggcggatacgctgcatcgcatggagccgctgcttgcgccgggctatatgtcggcggaagatgtcgatcgggcgcgcaccgcggagcgggcggcgcaggcggagttgaacgcagcgatgctgcaggcgcagcaggcgtccgcggcggtgagcggcgtggacgcattggtcgcgcagcgtgccgaagtcgaagcgcagatcgcgattgcggagctgaacctcgagttcaccgaagtccgcgcaccgttcgacggtcgggtggcctcactgcgcacgacagtcgggcaattcgcgtcggcgctcaagccagtctttactctgatcgatatacgtcactggtacgtgatcgcgaatttccgcgaaaccgatctgaaaggcgtgcgagcagggacatcggcgaccgtttatctcctaagcgacaccggcaagcatttcgacggcgaggtcgattcgatcagctacggcgtgctgcccgacgacggtggcgtggtccaggaaggtttgccgcgtgtggcgcgaagcatcaactgggtgcacgtgtcgcagcgtttccctgtcaagatcgcggttcgaaatccgaacccggaaacgttccgcattggcacgtcggcggtggccacactgaggcgcgatgcctccgcccgcggcgcggctcagtga

SEQ ID NO: 82008 - protein, 333 aa, Burkholderia cepacia R18194
MVATLVLLGVVVWRLDQALTTDDAYVYADTINVVPEVTGKIVEMPVRDNQPVKRGDLLFRIDPRPYQDALNQARARLVTLERQIGLTQRTVNAQQYNADSVKAAVERSRAQAVQAADTLHRMEPLLAPGYMSAEDVDRARTAERAAQAELNAAMLQAQQASAAVSGVDALVAQRAEVEAQIAIAELNLEFTEVRAPFDGRVASLRTTVGQFASALKPVFTLIDIRHWYVIANFRETDLKGVRAGTSATVYLLSDTGKHFDGEVDSISYGVLPDDGGVVQEGLPRVARSINWVHVSQRFPVKIAVRNPNPETFRIGTSAVATLRRDASARGAAQ

SEQ ID NO: 82009 - DNA, 1224 bp, Burkholderia cepacia R1808
  CDS (1)..(1224)
atgagcgaccctcaacaaaacgcggccggcgcccagccgcagaacaacggcaagcgcaaacggatgatgacgctgctgatcgcggtgatcgtgatcgcggccatcgcgtacggtctgtactacttcctcgtcgcgcgtttccatgaggaaaccgacgacgcatacgtgaacggcaacgtcgtgcagatcacgccgcaggtcaccgggacggtgatcgccgtgaaggccgacgatacgcagacgatcaaggccggcgacccgctcgtcgtgctcgatccggccgattcgcagatcgcgcttcagcaggccgaggccaatctcgcgcagacggtgcgtcaggtgcgcggcctgttcgtcaacgacgatcagtaccgtgcgcaagtcgcgctgcgccagtccgacctgtcgaaggcgcaggacgacctgcgccgccggctggccgtcgcgcagacgggcgccgtgtcgcaggaagaaatctcgcatgcgcgcgacgcggtacgcgccgcgcaggcatcggtcgacgccgcgcagcaggaactcgcgtcgaaccgcgcgctgaccgccaacacgacgatcgcgtcgcatccgaacgtgatggccgcggccgcgaaggttcgcgacgcctacctcgccaacgcgcgcaacgtactgcccgcgccggtcaccggctatgtcgcgaagcgctcggtgcaggtcggccagcgcgtgtcgccgggcacgccgctgatgtcggtcgtgccgctgaacgcggtgtgggtcgatgccaacttcaaggaagtgcagctcaggcacatgcgcatcggccagccggtcgagttgacggccgacatctacggctcgtcggcggtctatcacggcaaggtcgtcggcttctcggccggcacgggctcggcgttctcgctgctgccggcgcagaacgcgaccggcaactggatcaaggtcgtgcaacgcctgccggtgcgtatcgagatcgatccgaaggacctcgacaagcatccgctgcgcatcgggctgtcgatgcaggtcgacgtcgacatcaaggacgagcgcggcgatcagctcgccaacgcacacaacaccgtctacgagaccgacgtattcgcgaagtacggcgacgaagccgacgcggaaatcgcccgcatcatcgccgcgaacgccggcggcaacgcgccggcatcggccgcggctgcggcgaagacgggcaccgccgcgaagatgatgtaa

SEQ ID NO: 82010 - protein, 407 aa, Burkholderia cepacia R1808
MSDPQQNAAGAQPQNNGKRKRMMTLLIAVIVIAAIAYGLYYFLVARFHEETDDAYVNGNVVQITPQVTGTVIAVKADDTQTIKAGDPLVVLDPADSQIALQQAEANLAQTVRQVRGLFVNDDQYRAQVALRQSDLSKAQDDLRRRLAVAQTGAVSQEEISHARDAVRAAQASVDAAQQELASNRALTANTTIASHPNVMAAAAKVRDAYLANARNVLPAPVTGYVAKRSVQVGQRVSPGTPLMSVVPLNAVWVDANFKEVQLRHMRIGQPVELTADIYGSSAVYHGKVVGFSAGTGSAFSLLPAQNATGNWIKVVQRLPVRIEIDPKDLDKHPLRIGLSMQVDVDIKDERGDQLANAHNTVYETDVFAKYGDEADAEIARIIAANAGGNAPASAAAAAKTGTAAKMM

SEQ ID NO: 82011 - DNA, 1044 bp, Burkholderia cepacia R1808
  CDS (1)..(1044)
atgacgccgcccccgtcccccaccccgcccgttgcatcgtctgcgcctgcgccgtcgcgtgcgcgcgcgccggcgatcgtcgcgatcgcggtgctcgcgctgctgctcgtcgggtcgttgctgtacgcgttcgatacgcgcgacctgggcaccgacgatgcgtacgtgaccggccacctgcatgtgatctcgccgcgcgtggccggcacggtcgagcgtgtgctcgtcgacgacaaccagttcgtccacgcgggcgaggcgctcgtgcagatcgatcggcgcgacttcgacgtgcgcgtcgccgcgcagcgcgcgcgcgtcgcgcagacgcgcgccgatgcgagccgcgccgtcgcgctgatcgcgcaggccgacgcggcgctcgttgccgcgcgcgccgatgccgagaaggccgagctcgattacgcgcgggccagcgagctggcccacgagacgccgcgcggtttgtcgaagcaggagttcgacgcggccgatgccgcgcgcaagtccgcgcgggcgcgcgtcgcggcggccgacgcgcaacggcgcagcgccctcgccgcgtcgcaggccgccgatgccgcggctgcccagaacgacgccgaactgcgcgacgcgcagcttcagctcggctatacgaccgtcgtcgcgccgtcggacggctacgtcggcaagaagaccgtcgagaccggcgagcacgtcgcgcccggccaggcgctgctcacgctggtcgaaccgcatccgtggatcgtcgccaatttccgcgagacgcagctgcgcaacgtgcgcaccggcgacgccgtgcagttgcgcttcgacgcgctgccgcagcgcaccttcagcggccgcatcgacagcctgtcgccggcgaccggcgcgcagttcgcgctgctgccgcccgacaacgcgaccggcaatttcacgaaggtcacgcaacgcgtgccggtgaagatcctgctcgacggcccggcggcgacggagccgcgcatccggcccgggctgtcggtcgtcgtcacgctgcagcgcagccctgacgcacgatga

SEQ ID NO: 82012 - protein, 347 aa, Burkholderia cepacia R1808
MTPPPSPTPPVASSAPAPSRARAPAIVAIAVLALLLVGSLLYAFDTRDLGTDDAYVTGHLHVISPRVAGTVERVLVDDNQFVHAGEALVQIDRRDFDVRVAAQRARVAQTRADASRAVALIAQADAALVAARADAEKAELDYARASELAHETPRGLSKQEFDAADAARKSARARVAAADAQRRSALAASQAADAAAAQNDAELRDAQLQLGYTTVVAPSDGYVGKKTVETGEHVAPGQALLTLVEPHPWIVANFRETQLRNVRTGDAVQLRFDALPQRTFSGRIDSLSPATGAQFALLPPDNATGNFTKVTQRVPVKILLDGPAATEPRIRPGLSVVVTLQRSPDAR

SEQ ID NO: 82013 - DNA, 939 bp, Burkholderia cepacia R1808
  CDS (1)..(939)
atgaaaaaaacctggtactcggcaggacagatcctgctcacgctgatcgtcgtcgtcgtggccgccctcgtgttgtggcgcatcatcaattactacatgttctcgccgtggacccgcgacgggcacgtgcgcgccgacgtgatccaggtcgcgccggacgtggccggcctcatcacgtcggtgcaggtcgccgacaaccaggaggtcaagcgcggccaggtgctgttcgtgatcgatcaggcgcgctacacgctcgcgcaacgcctcgccgaagcgaccctcgcgcagcgccgcgcgacgctcacccaggcgaagcgcgaatatgcgcgcaacctgcaactcggcaatctggtggcgagcgaacaggtcgaggaaagccgcacgcgcgtcgagcagggcgaagccgccgtcgccgatgcgcaggtgtcgctcgacaccgcgaaactgaatctccagcgcaccacgatcgtgagcccggtcgacggctatctgaacgaccgcgcgccgcgcaccggcgaatacgtggcggccggccgtgcggtgctgtcggtcgtcgatcgaaactcgttccgcgtggacggctatttcgaggaaaccaagctgcgcggcatccatatcggcgagccggtcgacatcgtcgtgatgggcgaaccgcatccgctgcgcggccacgtgcagagcatcgtcgccgcgatcgaggatcgcgaccgcacgcagggcgcgaacctgctgccgaacgtgaacccggcattcagctgggtgcggctcgcgcagcgcgtgccggtgcgcgtcgtgctcgacgaggtgccggacgatttccggatgatcgccggccgcaccgcgaccgtcgcggtgcgctcgcatgacgcgcgccgtgacgacaagacgcggccggcatcggcgcccgccgcggccagcgcgactggagcatcgcaatga

SEQ ID NO: 82014 - protein, 312 aa, Burkholderia cepacia R1808
MKKTWYSAGQILLTLIVVVVAALVLWRIINYYMFSPWTRDGHVRADVIQVAPDVAGLITSVQVADNQEVKRGQVLFVIDQARYTLAQRLAEATLAQRRATLTQAKREYARNLQLGNLVASEQVEESRTRVEQGEAAVADAQVSLDTAKLNLQRTTIVSPVDGYLNDRAPRTGEYVAAGRAVLSVVDRNSFRVDGYFEETKLRGIHIGEPVDIVVMGEPHPLRGHVQSIVAAIEDRDRTQGANLLPNVNPAFSWVRLAQRVPVRVVLDEVPDDFRMIAGRTATVAVRSHDARRDDKTRPASAPAAASATGASQ

SEQ ID NO: 82015 - DNA, 879 bp, Burkholderia cepacia R1808
  CDS (1)..(879)
atgattatcagaaaactcttcggcttcgtcgcgaccgccgtcatccttctcgtcgcgatcctgatcgggcgctcgctgtgggtgcactacatggatgatccgtggacgcgcgacgggcgcgtgcgcgcggagatcgtcaacgtcgcgccggacgtgtcgggtgcgatcgtcgagctgccggtgcacgacaaccagctcgtcaagaagggcgatctgatcatgcagatcgacccgtcgcactatcagatcgcggtcgagcaggcgcaggcggccgtggccgcccgccgcgcggaactgcagatgcgccgcgacgacgcggcccgccgtgccgacctcgacgcgctcgtcgtgtcgaaggaaaaccgcgagaacgcggcgcacagcgcatcgagcgccgatgcgcagtatcagcaggcgatcgccgcactcgacgcggccaaactgaacctcgaacgcacgcgcgtgatcgcgccggtcgacggctacatcacgaacctgcagaccttcaaggggaactatgcggtggccggccaggcgaagctcgcgatcgtcgacagccactcgttctgggtgtacggctacttcgaggaaaccaagctgccgcgcgtcaaggtcggcgcgccggccgagatgcggctgatgagcggcggcgtgatgaagggccatgtcgagagcatctcgcgcggcatctacgatcgcgacaacccgcaaagccgcgacctcgtcgccgacgtgaacccgaccttcaactgggtgcgcctcgcgcaacgcgtgccggtgcgcatcaagatcgacgaagtgccggccgacgtggtgctgtcggccggtacgacctgcacggtcgtgatcaacccggagcagcagaagaagaaatcctga

SEQ ID NO: 82016 - protein, 292 aa, Burkholderia cepacia R1808
MIIRKLFGFVATAVILLVAILIGRSLWVHYMDDPWTRDGRVRAEIVNVAPDVSGAIVELPVHDNQLVKKGDLIMQIDPSHYQIAVEQAQAAVAARRAELQMRRDDAARRADLDALVVSKENRENAAHSASSADAQYQQAIAALDAAKLNLERTRVIAPVDGYITNLQTFKGNYAVAGQAKLAIVDSHSFWVYGYFEETKLPRVKVGAPAEMRLMSGGVMKGHVESISRGIYDRDNPQSRDLVADVNPTFNWVRLAQRVPVRIKIDEVPADVVLSAGTTCTVVINPEQQKKKS

SEQ ID NO: 82017 - DNA, 1092 bp, Burkholderia cepacia R1808
  CDS (1)..(1092)
atggaaacgacccaaaccgctgcgtcgcgcgacgcggctacagccgaccggcccgcgaagcagcaacgccgcgtgccgtggatgcggatcgcggtcgcggcggtggtcgtcgcggtcgcggccgcgacgctcgactggctgttcgtgctgcgcttcgaggaaagcaccgacgacgcctatgtcggcggcgacgtgacggtgctcgcgccgaaggtcaacggtttcgtcgacaagatcctcgtgaccgacaaccagcgcgtgaaagccggcgacgtgctcgtgcagctcgacgcgcgcgactacgacgcgaagctggcgcaggccagcgccgaagtcgacggcgcgcgctccgcggtcgccgaactcgaagcgaagcagcagcttcagtacgcggtgatcggccagcatgcggcggaccgtcacgcgtcggcggccgagctcgcgcgcgccgcgtcggatcgcgagcgctaccgcgagctcgtgaagtccgacgcggtgtcgaaccagatcgtcgagcgcgcggatgccgactattcgaaggcggacgccgccgtcgcccgcagcgacgccgcgctgctcgccgcgcagcggcagctcgacgtgctcggcgcacagctcgccgatgcgcgggcgcgcgtgaacacggcactggccgcccagcgcgtcgcggcgctgaacgtcgaatacacgacgatccgctcgccggtcgacggctacgtcggcaaccgcacgggccgcgtcgggatgctcgcgaacgtcggcgcgccgttgctgacgatcgtgcccgcgaccggcctgtggatcgacgcgaacttcaaggaagaccagttgcgcaggatgcgcgcgggcgagcgcgtcgacgtcgcgctcgacgcgtcgagcacgcgcctgcatggccgcgtcgacagcctcgcgccggcgaccggcgcgacgttcagcgtgctgccgcccgaaaacgcgacgggcaacttcacgaagatcgtccagcgcgtgccggtgcgcgtgcatctcgacccgcagccggggctcgagcgcgtgctgcgtcccggcctctcggcggtcgtgaccgtgcatctcgaccgcgcgaactga

SEQ ID NO: 82018 - protein, 363 aa, Burkholderia cepacia R1808
METTQTAASRDAATADRPAKQQRRVPWMRIAVAAVVVAVAAATLDWLFVLRFEESTDDAYVGGDVTVLAPKVNGFVDKILVTDNQRVKAGDVLVQLDARDYDAKLAQASAEVDGARSAVAELEAKQQLQYAVIGQHAADRHASAAELARAASDRERYRELVKSDAVSNQIVERADADYSKADAAVARSDAALLAAQRQLDVLGAQLADARARVNTALAAQRVAALNVEYTTIRSPVDGYVGNRTGRVGMLANVGAPLLTIVPATGLWIDANFKEDQLRRMRAGERVDVALDASSTRLHGRVDSLAPATGATFSVLPPENATGNFTKIVQRVPVRVHLDPQPGLERVLRPGLSAVVTVHLDRAN

SEQ ID NO: 82019 - DNA, 1245 bp, Rubrivivax gelatinosus PM1
  CDS (1)..(1245)
atgcgtgactccgttgcctcccctgttccgttccgacatgccgccgcgctgctgatcgccgtgtcgctggccgccggcgtgctgacggcctgcggcgagcgcgccgaggcgcagggcggcccgccgccggccccgccggtctcggtggccccggcggtgcagaagccgatcgccgacagcgaggagttcaccggccgcctcgaggcgctggagaccgtcgacatccggccgcgcatcggcggcacgatcgaccgagtgcacttcgtcgatggcgccaccgtcaagaagggcgcgctgctgttcaccatcgatccccgcccctaccaggccgaggtggcgcgtgccgaatcgcagctcgccgccgcgcagtcgcgcgccgagctggccaaggccgagctggcccgcgcgcagaagctgctggacgccaaggccgtgtcgcgccaggagttcgaccagctcggctccggcgaacgcacctcgcaggccgacatccgcgccgccgaggcggccctgcgcgtggcacgcctcaacgtggagtacaccgccgtgcgcgcgccgatcgccgggcgcctgtcgcgcgccaacatcaccgccggcaacctggtcgacgacaagacggtgctgaccacgctggtggccacgcacaaggtctacgcctacttcgacggcagcgagcagaccttcctgcgtctgcgcaaggccaacgacgcccagctgaacgtgaagatgggcctggccaacgagagcggcttcccgcacaccggcaaggtcgacttcatcgacaaccgcctcaacacccagaccggcgcgatccgcatccgcgcggtgttcgacaacgcagacggccagttcacgccgggcctgttcgcccggctgcaggtggcgggcagcacctcctacgacgcggtgctgacgcccgagcgtgcgatcggcaccgaccagagcaagaagttcgtgttcgtggtcggcgccaacaacgtcgccgagttccgcgaagtcaagctcggcgcgctgatcgacggcatgcgcgtggtcaccagcggcctgaagccgggcgagctggtggtggtcagcggcctgcagcgggtgcgcccgggcgcgccgctggcgccggagaagctcgatgtcgacgcccgcggcatgccggtcgagaagccggtcgcgccgccgccgggcgccggcggcaagaaggacgagaagaaggccgcgctgagcgcgccggtcgcggctgcgcgcgccgcctga

SEQ ID NO: 82020 - protein, 414 aa, Rubrivivax gelatinosus PM1
MRDSVASPVPFRHAAALLIAVSLAAGVLTACGERAEAQGGPPPAPPVSVAPAVQKPIADSEEFTGRLEALETVDIRPRIGGTIDRVHFVDGATVKKGALLFTIDPRPYQAEVARAESQLAAAQSRAELAKAELARAQKLLDAKAVSRQEFDQLGSGERTSQADIRAAEAALRVARLNVEYTAVRAPIAGRLSRANITAGNLVDDKTVLTTLVATHKVYAYFDGSEQTFLRLRKANDAQLNVKMGLANESGFPHTGKVDFIDNRLNTQTGAIRIRAVFDNADGQFTPGLFARLQVAGSTSYDAVLTPERAIGTDQSKKFVFVVGANNVAEFREVKLGALIDGMRVVTSGLKPGELVVVSGLQRVRPGAPLAPEKLDVDARGMPVEKPVAPPPGAGGKKDEKKAALSAPVAAARAA

SEQ ID NO: 82021 - DNA, 1152 bp, Rubrivivax gelatinosus PM1
  CDS (1)..(1152)
atggtgctggtcgccgcaggggccgccctcgcctggacgctggcgcagcgcccgccggccggcgccccgcgtgctgcggctgcgaccgccggcaccgccgtcacggtgaccacggtgccggcacgccgcgaggatttcgcgctggagctgggggcgaccggcacggtcagcgcgctgaaccgcgtggagatccatccgcagatcagcgccgccatcgagcgggtgcacatccgcgaagggcagacggtccgtgccggcgaactgctgttcacgcttgacagccgggctgccgaggtgcgggtggcccaggcccaggcgcagttgcagcgcgatctggccacgctggccgacgccgagcggcaactggcccgcagccgcgatctgctgcgccaggatttcgtgtcgcagagcgccgtcgacaccaacctcagccaggtcgaggcgcagcaggcggtggtggtggccgaccgcgcggcgatccaggcagcgcgtgtggacctcggctacgcgcgcatcgtggccccgagcgccggccgcgtgggcgcgatcgcggtctatgccggcagctatgtgacgccggcgtcgccagcgctggtgacgatcacccagctcgacccgatcgcggtgagctttccggtgccgcagcggcacatcggcgcgttgctggacagcctgaagtcgggcaccggccgcgtcaccgcgcgcctgccgggcgcgcaggcgccgctcaccggcacgctgcagttcgtcgacagcgccgtcgacgcgaactcgggcacggtgcaggtcaaggcgcagttcgccaacccgcagcagcagctgtggcccggtgcctatgccgacgtgaagctcgcggtcggcagcctgccgggcgcgatcctggtgccgcaggccgcaatcatccagggcgccaaggccaagtcggtctacgtggtcggtgcggacgacaaggcacagctccgcgaggtggaggtcatcgcctcggccggcgacgtggcggccgtcagcggcgtgcaggcaggcgagcgcgtcatcgtcgacggcaagcagaacctgcggcccggtgcggcggtggtcgaacaggccccggcggcggccgcagcgagccggccggcgcggcgcgtggccgccgcgtcggagcctcggccatga

SEQ ID NO: 82022 - protein, 383 aa, Rubrivivax gelatinosus PM1
MVLVAAGAALAWTLAQRPPAGAPRAAAATAGTAVTVTTVPARREDFALELGATGTVSALNRVEIHPQISAAIERVHIREGQTVRAGELLFTLDSRAAEVRVAQAQAQLQRDLATLADAERQLARSRDLLRQDFVSQSAVDTNLSQVEAQQAVVVADRAAIQAARVDLGYARIVAPSAGRVGAIAVYAGSYVTPASPALVTITQLDPIAVSFPVPQRHIGALLDSLKSGTGRVTARLPGAQAPLTGTLQFVDSAVDANSGTVQVKAQFANPQQQLWPGAYADVKLAVGSLPGAILVPQAAIIQGAKAKSVYVVGADDKAQLREVEVIASAGDVAAVSGVQAGERVIVDGKQNLRPGAAVVEQAPAAAAASRPARRVAAASEPRP

SEQ ID NO: 82023 - DNA, 888 bp, Pseudomonas fluorescens PfO-1
  CDS (1)..(888)
atgaaaaaaccgtttctgaccctcggtcgcgtcgtcctgacgctgctgatcgtgactttcgccgtcgtcgtggtctggcgcatggtgatgtattacatgttcgcgccctggacccgcgacggccacattcgcgccgacatcgtgcagatcgccccggacgtgtccgggctgatccagcaggtcgaagtgaaggacaaccagttggtgaagcgcggccaggtgctgttcagcatcgaccaggaccgtttcaaactggcgctgcgccaggccagggcggcggtcgccgatcgcgaagaaaccctggctcaggcgcagcgtgaagccaagcgtaaccgtggtctgggcaatctggtgccggccgaacagctggaagaaagcctgtcgaaagtggcccgcgcgcaatcggccctggccgaagcgctggtggcggtggacagcgctcagctcaacctcgatcgctcggtgatccgcagcccggtggacggctacgtcaacgaccgtgcgccacgctcgcaggaattcgtcaccgccgggcgtccggtgttgtcggtggtcgacagcaattcgttccacatcgacggctatttcgaagagaccaaactcgacggcatccatgtcgggcagtcggtggatatccgcgtgatcggcgaccgcgctcgcctgcgcgggcacgtcgaaagcatcgtcgccggcatcgaagaccgtgaccgttcgagcggcagcaacctgctgcccaacgtcaatccggcgttcagctgggtacgtctggcgcaacggattccggtgcgcattgccttcgacgatgtgccggatgacttccgcatgatcgccgggcgtaccgccactgtgtcgatcatcgacgatcaaccgcaggagcccgccaaatga

SEQ ID NO: 82024 - protein, 295 aa, Pseudomonas fluorescens PfO-1
MKKPFLTLGRVVLTLLIVTFAVVVVWRMVMYYMFAPWTRDGHIRADIVQIAPDVSGLIQQVEVKDNQLVKRGQVLFSIDQDRFKLALRQARAAVADREETLAQAQREAKRNRGLGNLVPAEQLEESLSKVARAQSALAEALVAVDSAQLNLDRSVIRSPVDGYVNDRAPRSQEFVTAGRPVLSVVDSNSFHIDGYFEETKLDGIHVGQSVDIRVIGDRARLRGHVESIVAGIEDRDRSSGSNLLPNVNPAFSWVRLAQRIPVRIAFDDVPDDFRMIAGRTATVSIIDDQPQEPAK

SEQ ID NO: 82025 - DNA, 1203 bp, Pseudomonas fluorescens PfO-1
  CDS (1)..(1203)
atggccactgccgaaaacacacaagctcaagacaacgcccaggacactggcaatccgcgcaaacgcaaggtgatgctgctggtgctggccgttgtggttgccctcgccggtgtcggcgtctgggcgtatcacgaattcatcgggcgctggagcgaaagcaccgacgacgcctacgtcaacggcaacgtggtggaaatcaccccgctggtgaccggcaccgtggtcagcatcggtgctgacgatggcgatctggtgcatgaaggccaggtgctgatcaacttcgacccgaatgacgccgaagtcggcctgcaaagtgccaaggccaatctggcccgcaccgtgcgtcaggtgcgcggcctgtacagcaacgtcgacggcatgaaggcccaggtcaatgcgcaacaggccgaagtgcagaaagcccaggacaacttcaaccgccggaaaaacctcgcggccggcggggcgatttcccaggaagaactgtcccacgcccgcgatgacctgacctcggcgcagaacgccctggccaacgccaaacagcaactgaaaaccaccagcgcgctggtcgatgacaccgtggtgtcctcgcacccggacgtgatggccgccgccgcgcaactgcgtcaggcctacctgaccaacgctcgcagcaccttgattgcgccggtcaccggttatgtcgccaaacgcaccgtgcaacttggccagcgtgtgcagccgggcaccgcgctgatggcggtgattccgctggatcagctgtggatcgacgccaacttcaaggaaacccagctgcgtgacatgcgcattggccaaccggtggagatcgagtcggacatctacggcagtgacgtcaagttcaacggcaccgtcgacagcctcggcgcgggcaccggcagcgcgttcgccctgttgccggcgcagaacgccaccggtaactggatcaagatcgtgcagcgtgtgccggtacggattcacgtcaacgccgaagagctggccaaacacccgcttcgcgtcggcctgtcgaccaatgtcgaggtcaatctgcacgaccagagcggcccggtactggcccagcaaccgccgcaaaaggcctcgttcagcaccaacgtctacgatcgccaactggccgaagccgacgcgatgatcacccagttgatccacgacaacagcgcggcggtcagcaagactgcgcaacgctga

SEQ ID NO: 82026 - protein, 400 aa, Pseudomonas fluorescens PfO-1
MATAENTQAQDNAQDTGNPRKRKVMLLVLAVVVALAGVGVWAYHEFIGRWSESTDDAYVNGNVVEITPLVTGTVVSIGADDGDLVHEGQVLINFDPNDAEVGLQSAKANLARTVRQVRGLYSNVDGMKAQVNAQQAEVQKAQDNFNRRKNLAAGGAISQEELSHARDDLTSAQNALANAKQQLKTTSALVDDTVVSSHPDVMAAAAQLRQAYLTNARSTLIAPVTGYVAKRTVQLGQRVQPGTALMAVIPLDQLWIDANFKETQLRDMRIGQPVEIESDIYGSDVKFNGTVDSLGAGTGSAFALLPAQNATGNWIKIVQRVPVRIHVNAEELAKHPLRVGLSTNVEVNLHDQSGPVLAQQPPQKASFSTNVYDRQLAEADAMITQLIHDNSAAVSKTAQR

SEQ ID NO: 82027 - DNA, 951 bp, Pseudomonas fluorescens PfO-1
  CDS (1)..(951)
ttggcggtggtgctgctggcaatcgtgcttggctggttcgcctgggaacattacacccgggccccgtggacgcgggatgcgcgggtgagggcggatgtggtgacgctgtcggcggatgtttcgggtcgcatcgtcacgctcgccgtgcaggacaaccagcatgtcgacaaggggcagttgctgctggagatcgacccggctcgctacagcctggccgtcgagcatgcgaaacgctcggtggaggtctcgaaggccacgcttgggcagtcacaagcagccattgtcgccagcgaggcattgctcaaacaacgccagagcgaagaacgtcggcgacgaacgctcaagcaagggttcgcgatttccggggaggaatgggagaagtccagtaccgacgtggccgtggcccaggcggatctgttgcgcaatcaggcgaatctcggtctggccgaagccaacgtgcaactggcgattgctgcattgacccaggctgaactggatctgcaacgtacccgagtcgaagcgccggtcagcggatatgtcaccaatttgttgacccgtcagggggattacgcggtggccggcagtgccttgctggcgctggtggacagcagctccttttatgtcagcggctatttcgaagaaaccaagttgccaagaatcgaggagggtgaccgggtgcggatcgaattgatgagcggggaaaaattcggcggcaccgtgcagagcatcgccttcgccattgctgaccgggaaaacgcgccgggcagtcgattgctggccaacatcaaccccagctacacctgggtaaaactggcgcaacgagtaccggtgcggatcggtatcgatcccgattattcaggcaaggaccgactgagagccggcaccacagcgacagttacggtgctggaaaaccctgaaagacaggcgcaaaaaagccccgcgaccgaatga

SEQ ID NO: 82028 - protein, 316 aa, Pseudomonas fluorescens PfO-1
MAVVLLAIVLGWFAWEHYTRAPWTRDARVRADVVTLSADVSGRIVTLAVQDNQHVDKGQLLLEIDPARYSLAVEHAKRSVEVSKATLGQSQAAIVASEALLKQRQSEERRRRTLKQGFAISGEEWEKSSTDVAVAQADLLRNQANLGLAEANVQLAIAALTQAELDLQRTRVEAPVSGYVTNLLTRQGDYAVAGSALLALVDSSSFYVSGYFEETKLPRIEEGDRVRIELMSGEKFGGTVQSIAFAIADRENAPGSRLLANINPSYTWVKLAQRVPVRIGIDPDYSGKDRLRAGTTATVTVLENPERQAQKSPATE

SEQ ID NO: 82029 - DNA, 864 bp, Pseudomonas fluorescens PfO-1
  CDS (1)..(864)
atgaaaaagtttttcagcctgctcgcgaccctgctggtgctggccctggcgctgtggatcggccgcacgttgtgggagcactacatgaacaccccgtggacccgcgacggccgggtgcgcgccgacatcatcaatgttgccgccgacgtcaccggtgaagtggtcgacgtgccggtccgcgacaaccagttggtgaagaaaggtgatctgctgatgcagatcgaccccgagcactaccgcctggcggtgaaacaggcgcagtcgctggtcgcttcgcgcaaggccacgtgggagatgcgcaaggtcaacgcccatcgccgcgccgacctcgataacctggtgatctccaaggaaaaccgcgacgacgccagcaacatcgccgactccgcactggccgattaccaacaggcccaggcgcaactggaagcggccgaactcaacctcaaacgcaccgaagtgcgcgcggcggtggacggctacgtgaccaacctcaacgtccatcgcggcgattacgctcgtattggcgaagcgaaaatggccgtggtcgacatgaactcgttctgggtctatggcttcttcgaagaaaccaaactgcctcacgtgcgggtcggcgataaagcggatatgcaactgatgagcggcgaagtcctcaagggccatgtggaaagtatttcccgtggtatctacgaccgtgacaacccggaaagccgcgagctgattgccgatgtgaacccgaccttcaattgggtgcgcctggcgcaacgggtgccggtgcggattcacatcgatgaagtgccggagggtgtgttgctggcggcggggattacctgcaccgttgttgtgaagcaggacgttgtcgagtaa

SEQ ID NO: 82030 - protein, 287 aa, Pseudomonas fluorescens PfO-1
MKKFFSLLATLLVLALALWIGRTLWEHYMNTPWTRDGRVRADIINVAADVTGEVVDVPVRDNQLVKKGDLLMQIDPEHYRLAVKQAQSLVASRKATWEMRKVNAHRRADLDNLVISKENRDDASNIADSALADYQQAQAQLEAAELNLKRTEVRAAVDGYVTNLNVHRGDYARIGEAKMAVVDMNSFWVYGFFEETKLPHVRVGDKADMQLMSGEVLKGHVESISRGIYDRDNPESRELIADVNPTFNWVRLAQRVPVRIHIDEVPEGVLLAAGITCTVVVKQDVVE

SEQ ID NO: 82031 - DNA, 1143 bp, Pseudomonas fluorescens PfO-1
  CDS (1)..(1143)
atgaccgaaccgaccaccacaaccaccaatgccatcgccgccacccctgaaggcgtggcgccgccgtcatcaccgaataccgagccgcggtcgttgcgggtgcggatcatctcgtcgctgggctttgccggggtcgccatcgtcggtgtgctgatcgtgctctatgcctggcagttgccgccgttcagcagcgcggtggagaccactgaaaacgccctggtgcgcgggcaggtgacgatcatcggcccgcagctcagtggctatgtgtttgaggtgccggtacaggactttcagtttgtgaaggagggcgatttgctggtacgtctcgatgaccgcatctatcagcaacgcctcgaccagtcgctggcacaactggcggtgcagaaggcttcgctggccaacgtggtgcagcagcgcaacagcgccgaagccacgataaaactgcggcaggcggtggtggccgacagcgaagcgcagttgcgcaaaagcgaggctgacttgcgacgcaacaaagcgctggtcaatgacggctccgtgtccaaacgcgagatggacgtagcgctggccgccaacgcgcaaagcattgcagcggtggcgcaggccaaggccaatctggaaatcgcccggcaggatctgcaaacggtgatcgtcaatcgcggttcgctggaggcggcggtggccagtgccgaggcggcggtgcagttggcgcggatcgacttgtccaacacccggatcatcgccccgcgtgacggacagctcgggcagatcggcgtgcgcctcggcgcctacgtcaactctggggcgcagttgatggcgctggtgccgaaccagaaatgggtaatcgccaacctcaaggagacccagatggacaacgtgcgcgtggggcagccggcgagcttcaccgtcgatgccttgaaccaccgtaaattcaccggccacgttcagcacatctctccgggcaccggttccgagttcgcgttgttgcaggccgacaacgccaccggcaacttcgtgaagatcgcccagcgtgtgccggtgcgcattaccatcgatccggatcagcaggagagcgagcgtttgcggccggggatgtcggtggtggtcagcattgatacggcggcgggcgacacccagaaacactga

SEQ ID NO: 82032 - protein, 380 aa, Pseudomonas fluorescens PfO-1
MTEPTTTTTNAIAATPEGVAPPSSPNTEPRSLRVRIISSLGFAGVAIVGVLIVLYAWQLPPFSSAVETTENALVRGQVTIIGPQLSGYVFEVPVQDFQFVKEGDLLVRLDDRIYQQRLDQSLAQLAVQKASLANVVQQRNSAEATIKLRQAVVADSEAQLRKSEADLRRNKALVNDGSVSKREMDVALAANAQSIAAVAQAKANLEIARQDLQTVIVNRGSLEAAVASAEAAVQLARIDLSNTRIIAPRDGQLGQIGVRLGAYVNSGAQLMALVPNQKWVIANLKETQMDNVRVGQPASFTVDALNHRKFTGHVQHISPGTGSEFALLQADNATGNFVKIAQRVPVRITIDPDQQESERLRPGMSVVVSIDTAAGDTQKH

SEQ ID NO: 82033 - DNA, 1065 bp, Rhodospirillum rubrum
  CDS (1)..(1065)
atgtcaaaggtcaaacattttttccctgccgggctcgcgctgtccatcggcctcatcggtgccctgctcgttctctatgcgtggcacctgccgcccttccgcagcgccgtcgaaacgaccgacaacgcctatgtgcgcgctcaggtcaccatgatcagtccgcaaagcgccggctatgtgaccgcggtcaccgtccatgatttccagacggtcaaggccggcacgccgctgtttcagatcgatgaccggatctatgcgcaaaagctgaagcaggcccaggcgaccttagaaatgaaacgcgccgccctggagaattccgagcagagcgagcgggcggcgcaggcgcggatccgctccagcgaggccgagatcgccagcgccatcgccgccctggatgtcgcccggtccaccgcccgccgcaccgaggctttgctggcgcgcggcgtctcgacgcaaagctccgccgatcaggcccgctccaccctggcccaggccgaagccctggtacacaaaagccaagccgcccttgacgtttcccgcgaggatctgcgctcgatccgcgttaatcgggactcgcttcaggccgatatcgccaatgcccaggcggcggtcgaactggcgacgattgatttgcacaacaccagcatcgtcgcgccaatcgatggcacgctgggcgagatcggggtgcggttggggcagtatgtttcggccggaacccagctcgccgccctggtgcccgcaagacgctgggtcatcgccaatttcaaggaaacccagttggccggcatccagatcggtcaggcggtgagctttcgcgtcgatgccctgcaggggacggccctggccgggcatgtcgaagccttttcgcccgccacgggctcagagtttaccgtgctgaaatccgacaacgccacgggcaacttcaccaaggtcacccagcggcttcccgttcgcatcgccatcgatcccgatcaggcgcaggccgccctgttggcgccgggaatgtcggtggtggtgcgcatcgataccgccccatccgagagggacggaaagcacccgtcttaa

SEQ ID NO: 82034 - protein, 354 aa, Rhodospirillum rubrum
MSKVKHFFPAGLALSIGLIGALLVLYAWHLPPFRSAVETTDNAYVRAQVTMISPQSAGYVTAVTVHDFQTVKAGTPLFQIDDRIYAQKLKQAQATLEMKRAALENSEQSERAAQARIRSSEAEIASAIAALDVARSTARRTEALLARGVSTQSSADQARSTLAQAEALVHKSQAALDVSREDLRSIRVNRDSLQADIANAQAAVELATIDLHNTSIVAPIDGTLGEIGVRLGQYVSAGTQLAALVPARRWVIANFKETQLAGIQIGQAVSFRVDALQGTALAGHVEAFSPATGSEFTVLKSDNATGNFTKVTQRLPVRIAIDPDQAQAALLAPGMSVVVRIDTAPSERDGKHPS

SEQ ID NO: 82035 - DNA, 903 bp, Rhodospirillum rubrum
  CDS (1)..(903)
atgaccttgaagcctgttctctccctgctcggccgctatgccctgacgctttgcctcgtcgccggcgccaccctcatcgcgtgggaagcctggagccgctccgagcggactccctggacacgcgacgggcgggtgagcgccgatgtcgtgcggatcgccccggaagtctccggcaccgtcagcgccgtacccattcgggataatcaatatgtccatcgcggggacattctctatgggatcgaccccgagcggctgcggctcgcggtggcggtggcggaggccgacctcgaagcaaagcgccaggatatgctcgttcgtcaagcgacggcgcggcggcacggtcaactccgcgatgttgtatcacaagaagccgtccagcaagcgggcggagcggcggcggtggccagcgccgcctatcaggccgcgctggccaccctcgatctggccaaactcgacctcgcccgcgcgaccgtgcgctcgccggtcgatggctatgtgatcaatctgcggctgcggcccggcgactacacgacagccggcgtgacgacggtcgccgtcctcgacgccgcccgattctggatcaccggctattttgaggagaccaagatcggacaaatccgcgtcggcagtccggcgcggatcaggctgatgggctttgatcggccggtgtcgggccatgtcgaaagcatcggtcacggtatcgagaacggcaacgacgcgcccggccctctcggcctgcccactgtggcggcgaccttttcctgggtgcgtctcgcccagcgcatcccggtccgcatccacgtcgatcaggtgcctcttgatgtcgcactggcggcaggcatgacggcgaccatcgagatcatcccggcggccggcgagccggccgtggggaaccggcgctga

SEQ ID NO: 82036 - protein, 300 aa, Rhodospirillum rubrum
MTLKPVLSLLGRYALTLCLVAGATLIAWEAWSRSERTPWTRDGRVSADVVRIAPEVSGTVSAVPIRDNQYVHRGDILYGIDPERLRLAVAVAEADLEAKRQDMLVRQATARRHGQLRDVVSQEAVQQAGGAAAVASAAYQAALATLDLAKLDLARATVRSPVDGYVINLRLRPGDYTTAGVTTVAVLDAARFWITGYFEETKIGQIRVGSPARIRLMGFDRPVSGHVESIGHGIENGNDAPGPLGLPTVAATFSWVRLAQRIPVRIHVDQVPLDVALAAGMTATIEIIPAAGEPAVGNRR

SEQ ID NO: 82037 - DNA, 1146 bp, Rhodospirillum rubrum
  CDS (1)..(1146)
atgtccgccgccgccctgacgttcatcgccctgggcgccgcctatgggatttactggtggacgacggcccgcttcgacatgtccaccgacaacgcctatgtcgcgggcaatatcatccaggtctcgccccagatcgccggcacggtgacggcggtccatgccgacgatacggatttcgtcgaagccggacagatgctggtcaccatcgacccgaccgacgcccgtctggcccttgatcaggcggaagcgactttggccgaaacggtgcgccaggttcgcgccctgttcagccaggatggcgttctggcggcaacggtcctggcccaggaaaccaccctggcccggctgcgcgaggatttcgcccgccgtcaaagactggccaacaccggcgccgtttcggccgaagaggtcaaacacgcccgtgacgcggtgacgcaggcctcggcgcacttggccggcgcccgcaagcagcaggaagccaaccgcgtgctgatcgacatgaccggcctaaccagccatccccgcgtcgcccgggccgcggcccaagtgcgcgaagcctatgtggcgtggcggcgcaccgtggttccggcgccggtgtcgggtcaggtcgcccgccgcgccgttcaggtcggccaacgaaccacccccggcacgcccttgatggcgatcattccgctcgacgaggtttgggtcgacgcgaatttcaaggaaggccaattgggagcgatgcgcctcggccaacccgtcctgctcaccgccgacatctatggcgacgacattgtctatcgcggcacggtggccggactggcggcgggaaccggggcggccttttcgctgctgccggcccagaacgccaccggcaactggatcaaggtggtccagcgcgttccggttcgcatcgcccttgatccccgggatctggcccagcgtccgctgcgggtcgggctttcgatggaggcccacgtctcgatcagggatcaaagcggtccgcagatggcgacgggccggcaaaaggacatcgtcgcccggaccgacgtcttcgccgacctcgaccacgacgccgaggcgctgatcaaggacctgatcgcccggaacatgcggacggagccggacctcgcgccggcgccgataaccgccgaccggtga

SEQ ID NO: 82038 - protein, 381 aa, Rhodospirillum rubrum
MSAAALTFIALGAAYGIYWWTTARFDMSTDNAYVAGNIIQVSPQIAGTVTAVHADDTDFVEAGQMLVTIDPTDARLALDQAEATLAETVRQVRALFSQDGVLAATVLAQETTLARLREDFARRQRLANTGAVSAEEVKHARDAVTQASAHLAGARKQQEANRVLIDMTGLTSHPRVARAAAQVREAYVAWRRTVVPAPVSGQVARRAVQVGQRTTPGTPLMAIIPLDEVWVDANFKEGQLGAMRLGQPVLLTADIYGDDIVYRGTVAGLAAGTGAAFSLLPAQNATGNWIKVVQRVPVRIALDPRDLAQRPLRVGLSMEAHVSIRDQSGPQMATGRQKDIVARTDVFADLDHDAEALIKDLIARNMRTEPDLAPAPITADR

SEQ ID NO: 82039 - DNA, 1173 bp, Rhodospirillum rubrum
  CDS (1)..(1173)
atgtccaccgccccctcgggaccccgttcaaccgtgtctgccgaaccgacgctgccccccgcgtccccccgttcctggggtcgccgcctgctgcttggcgtccttgtcgttggcgcggtggcggcggccggggtgttcggctggcgctggtggaccgagggacggtttcttgaaaccaccgacaacgcctatatccagggcgacatcaccgccatcgcccccaaggtctcgggctatgtggacgaggtcgccgtcggcgacaacgaggtggttagcgccggtcagctgctggtgcgcttagatagcgccgattaccgggttcaggtggatcaggcccgtgccaacgccgagggcaaggccgccgaactggcctcgatcatcgccaatatcgatcttcaacagacggcgatcgcccaggcccggggcgcgatggacgccgcccaggcgcggttcgatcgcgccgccaaggatctggcccgctatcaggatctggtgggccgtggcgccaccagtcgccagagcctggacagcgcccgcgaacaggcgacctctggcgcggccgagctgcgcagcgccgccgccgcccttgacggcgcccagaagcgtctggccgtgctcagcgccgatcgcgacgcggcggcggccgaagtgcgctcggcccaggcgcaacgcgccctggccgagatcaatctcgccaatacggaaatccgcgcgccgatcgccggggtggtcggcaatcgcggggtgcgggccggtcagtatgtggctcccggatcggcgctgatggcgatcgtgccgcttgagggcctgtggatcgcggcgaacttcaaggaaacccaattgggcgccatggcgccgggacagacggtgaaggtggagatcgacgcctattccggtcgccacggccagggccgggtggtcagtttcgccccggcctcgggggcgcagttcagcctgctgccgcccgagaacgccacgggcaatttcaccaaggtcgtccaacgcgttccggtgcggatcgagatgcttgccgatgatccgctgtcggcgctgatgcgcccggggctgtcggtcgaggtctcggtcgatacccgtggcgggcgcgatgtcgcgctgggtctggtcggcaccgccctggccggttcggccgggtcttcccccacccaccgctaa

SEQ ID NO: 82040 - protein, 390 aa, Rhodospirillum rubrum
MSTAPSGPRSTVSAEPTLPPASPRSWGRRLLLGVLVVGAVAAAGVFGWRWWTEGRFLETTDNAYIQGDITAIAPKVSGYVDEVAVGDNEVVSAGQLLVRLDSADYRVQVDQARANAEGKAAELASIIANIDLQQTAIAQARGAMDAAQARFDRAAKDLARYQDLVGRGATSRQSLDSAREQATSGAAELRSAAAALDGAQKRLAVLSADRDAAAAEVRSAQAQRALAEINLANTEIRAPIAGVVGNRGVRAGQYVAPGSALMAIVPLEGLWIAANFKETQLGAMAPGQTVKVEIDAYSGRHGQGRVVSFAPASGAQFSLLPPENATGNFTKVVQRVPVRIEMLADDPLSALMRPGLSVEVSVDTRGGRDVALGLVGTALAGSAGSSPTHR

SEQ ID NO: 82041 - DNA, 1044 bp, Ralstonia metallidurans CH34
  CDS (1)..(1044)
atggccggcgttcaaaaggggccgctgcgcggccgggtcattaccctggccatcgtgctggtggccgtgttgctttccgtctatgcctatgagcgcaccgtgcaccatccgtcgtcggacgatgccacgctcgacgccgatgtcgttcatgtggcctcgccggtaggcggacgcatcgcccgcatcgccgtcaccgagaaccagcacgtagccaagggcgacgtgctattcgaaatcgaccctgtgccttacaagctggcggtggaccaggcgcgggcagacctcgaactcgcgcaggcgggcctcggcacgcggcggcgcacgatcgtcagcgaacgcgcggccgcgtcgatcgcctccgagcagaccacgcgcgcggcgcaaaactacgccttgacggcacgcacggtggaacgcctgcgcccgctggccgccgatggctacgtgccaaagcagcagctcgaccaggcccaggtggcgcagcatgacgcggcggtctcgctcaagcaggcgaacgtccagcactcggcatccacgcaagccatcggcaacgacgacgacgccatcgccgcggtccacgcccgggaagccgcgctcgcaatcgcccagcgcgcgttgcaggacaccgtagtccatgccccgcaggaaggccgcgtcaccgggctctccgtgctggccggtgaagtcgtgattccaaaccagtcgctgttcctgctcgttcataccggcgaatggtttgccgtggcgaacttccgggagacatcgctagccgatattcatatcggcgactgcgccacggtctactcgatgatcgaccggcgcaaggcgatacgcggcaccgtgaccggcatcggcgcgggcatcaccgatacggaacggctcaacctgccgcgctcgctgccctacgtgcaggcctcggtgaactgggtacgcgtcgccaagcgtttcccggttcgcatccggctcgaagatccgcccgagacgctggcccgcgccggcgccagcgcaaacgtcgagatccggcatggcgcagcctgccgctga

SEQ ID NO: 82042 - protein, 347 aa, Ralstonia metallidurans CH34
MAGVQKGPLRGRVITLAIVLVAVLLSVYAYERTVHHPSSDDATLDADVVHVASPVGGRIARIAVTENQHVAKGDVLFEIDPVPYKLAVDQARADLELAQAGLGTRRRTIVSERAAASIASEQTTRAAQNYALTARTVERLRPLAADGYVPKQQLDQAQVAQHDAAVSLKQANVQHSASTQAIGNDDDAIAAVHAREAALAIAQRALQDTVVHAPQEGRVTGLSVLAGEVVIPNQSLFLLVHTGEWFAVANFRETSLADIHIGDCATVYSMIDRRKAIRGTVTGIGAGITDTERLNLPRSLPYVQASVNWVRVAKRFPVRIRLEDPPETLARAGASANVEIRHGAACR

SEQ ID NO: 82043 - DNA, 1275 bp, Ralstonia metallidurans CH34
  CDS (1)..(1275)
atgatgaccacgaccaacccgaaccccactgacaatcccaaggccgcgtccggcgcgccgagaacccgcaagcgtctgctggccctgcttgggctgggcgctctggtggcagcggcaggctacggcgcgtactactacagcgtggcacgctttcacgaagacaccgatgacgcctacgtcaacggcaatctggtgcaactcacccctcaggtgagcgggacggttgtcgcagtcaatgccgacgacacggagatcgtcagggcgggcgatgcgatcgtcacgcttgatcccgcagacgctcgcatcgctctggccaacgccgaggcggcgctcgggcagaccgttcgccaggtaagtgcgttatatgtcaacaacaacacgctggctgcaactgttcaacagcggcaggtggacctttcccgggcgcgagatgatctgcggcgtcgaaccgaagcctcggaaagtggcgcggttgccgcggaggacgtcgcgcacgcaagggacaccgtgaaggctgccgaagccgcgctggaaacggcgaagcaacagctcgcctcgaaccatgcgttgaccgaccaggctagcgtggccgatcaccccagtgttcaagcagccgccacacgcgtgcgggatgcctatctcgccaatgcgcgaaacacgctgcccgctcccgtgaccggctatgtcgcccgtcgatccgtgcaagtcggtcaacgtgtcgcgcctggcaatccactcatggccatcgtgcctctcgatggagtctgggtagatgccaacttcaaggaggttcagctcaagcacattcgaattggccagccagtagaactccacgccgatctgtacggcggcaaggtgacctatcacggcaaggtcgtcggcttctccgcgggcaccggtagcgcgttctccgcgctaccagcgcagaacgcgactggcaactggataaaggtcgtccagcgactgcccgtgcggatcgcactggatccggtggaactgcgcgcgcacccactgcaggttggcctgtctatgcaggtcgatgtggagaccagggagcgcggcggagagctttcccccgccaagggcacaagcacaccaattcgcaccgcctatcgcaccgatgtgttcgaacgctacggtgcggaagccgacagcgagatcgatcggatcatcgcccggaacagcaatagcaacagcgacaactccacgcgaaacgaaacgaccaggaatgcgcggccggtggccagtccttcggcactcgccagggcctcgtga

SEQ ID NO: 82044 - protein, 424 aa, Ralstonia metallidurans CH34
MMTTTNPNPTDNPKAASGAPRTRKRLLALLGLGALVAAAGYGAYYYSVARFHEDTDDAYVNGNLVQLTPQVSGTVVAVNADDTEIVRAGDAIVTLDPADARIALANAEAALGQTVRQVSALYVNNNTLAATVQQRQVDLSRARDDLRRRTEASESGAVAAEDVAHARDTVKAAEAALETAKQQLASNHALTDQASVADHPSVQAAATRVRDAYLANARNTLPAPVTGYVARRSVQVGQRVAPGNPLMAIVPLDGVWVDANFKEVQLKHIRIGQPVELHADLYGGKVTYHGKVVGFSAGTGSAFSALPAQNATGNWIKVVQRLPVRIALDPVELRAHPLQVGLSMQVDVETRERGGELSPAKGTSTPIRTAYRTDVFERYGAEADSEIDRIIARNSNSNSDNSTRNETTRNARPVASPSALARAS

SEQ ID NO: 82045 - DNA, 954 bp, Ralstonia metallidurans CH34
  CDS (1)..(954)
atgctgacgctggccgtcaccgccgttggcgcggtcgtcgtcaaacacctgtgggactactacaccgtggcgccgtggacgcgcgacggtcacattcgcgccgaggtggtgcaggtggcgcccgatgtctccgggctggtcacgcggatcgcggtcaaggacaaccagcatgtgaaggcaggcgacgtcctgttcgagatcgaccacgagcgctatgcgctggcgctgcgtcaggcggaagccacggcggcggcggtgcgcgccaatctggcccaggcacgccgcgaggcgaagcgcagccagacgctttccgaggtggtttccaaggaaatcgtcgaagaggggctggccaaggtgcagcagggcgaggcccagctggcacaggccgaggccgcgatcggcgtggcgaagctgaatctggagcgcacccacgtggtgagcccggtggaaggctacgtcaacgaccgcctgccgcgtctgggggattacgtcgtgaccggcaagccggtgctgtcgatggtcgattcgaactcgttccacgtggaaggctacttcgaggaaaccaagctgaagggtatccatatcggcagccccgtcgatatccgcgtcatgggcgagaagcgcgtgctgcacggccatgtgcagagcatcgcagccggtatcgaagaccgtgatcgcaccaatggctcgaacctgctgccgaacgtgaatccgacgttcaactgggtgcgtctggcgcagcgcgtgccggtgcgcatccagttcgaccagatgcccgaggatgtgcgcctggtggcaggacgcacggccaccgtatcggtgaaggccgatgacgagaagaacatcggggaaacgggagacaagccgaccgcgccggcggccggccgtagtgcctcgcaggacaaggttgcgctggccggcaagcgcgcgccctcaaccggagcagtgcagtga

SEQ ID NO: 82046 - protein, 317 aa, Ralstonia metallidurans CH34
MLTLAVTAVGAVVVKHLWDYYTVAPWTRDGHIRAEVVQVAPDVSGLVTRIAVKDNQHVKAGDVLFEIDHERYALALRQAEATAAAVRANLAQARREAKRSQTLSEVVSKEIVEEGLAKVQQGEAQLAQAEAAIGVAKLNLERTHVVSPVEGYVNDRLPRLGDYVVTGKPVLSMVDSNSFHVEGYFEETKLKGIHIGSPVDIRVMGEKRVLHGHVQSIAAGIEDRDRTNGSNLLPNVNPTFNWVRLAQRVPVRIQFDQMPEDVRLVAGRTATVSVKADDEKNIGETGDKPTAPAAGRSASQDKVALAGKRAPSTGAVQ

SEQ ID NO: 82047 - DNA, 894 bp, Ralstonia metallidurans CH34
  CDS (1)..(894)
atgcgccagaaccgccacatgaaactcaatctccaatccctgctccgcatcctggcaacctgtctgttggctacggctgccattgccctgggttatagcctttgggcccactacatgtactcgccctggacccgcgacggacgggtacgtgccgaagtgatcaacattgccgcggatgtctccgggctggtggcccgtgtggccgtgcgcgacaaccaggagatacgcaagggcgacctgctcttcgtcatcgatcaggaacgattccgccaggcacttgcacaggccgaggcacaggcccaggcgcgaaaggcggaactcgacatgcgacatcagcaagccatgcgccggcgcgatctggacagttcggtgatctccgtcgaaagccgcgaagatgtcagcgctcaggagaagcaggccctggccaactaccaggccagcctggcggcggtggacacagccaggctgaacctgcaacgcagcgaagtacgctcgccggcggacggctacgtgaccaacctcaacctgtatgccggcgactatgtaagcgcaggcaccgcgcgaatggcggtgatcgacaagcattcctattgggtctatgggtactttgaagaaaccaagctggccaacgtgcaggtcggcgcgaaagtggaggtccgtctgatgtccggtggagcctcgttgcgaggacacgtggagagcctagcgcgaggcatcgccgaccgggacaaccccaccggcgcaaacctgctcgccgatgtgaatccggtgttcacctggatccggctggcgcagcgcgtgccggtgcgaatacacctcgacgaagagcctgccggactgccgctcgcgatgggaacaacgtgcacggtcacggtgcagccgggcaacccgtag

SEQ ID NO: 82048 - protein, 297 aa, Ralstonia metallidurans CH34
MRQNRHMKLNLQSLLRILATCLLATAAIALGYSLWAHYMYSPWTRDGRVRAEVINIAADVSGLVARVAVRDNQEIRKGDLLFVIDQERFRQALAQAEAQAQARKAELDMRHQQAMRRRDLDSSVISVESREDVSAQEKQALANYQASLAAVDTARLNLQRSEVRSPADGYVTNLNLYAGDYVSAGTARMAVIDKHSYWVYGYFEETKLANVQVGAKVEVRLMSGGASLRGHVESLARGIADRDNPTGANLLADVNPVFTWIRLAQRVPVRIHLDEEPAGLPLAMGTTCTVTVQPGNP

SEQ ID NO: 82049 - DNA, 1050 bp, Ralstonia metallidurans CH34
  CDS (1)..(1050)
atgcggtgggttgtcatcgcgatcgtgctcagtctggtctggtatctgctggccgaccgcttcacgccttatacccagcaggcgcgtgtgcaggcgttcgtgattccagtggcttcagaagtgtctggccgcgtcacccaggtgccggttcacaacaaccagaatgtggaggtcggcaccgtgctgttcgaggtcgacccacagcagtaccggatcgcgctggaccgcgcccgcgccgatttcgaatccacgcgccggcagatcggcgcgaacacggcgggcatcgattccgcgcgcgaatcgctgcgagcggcgcaggccaacgagctcaaggcgcgacaggacagcgagcggcttgagcgtctgtatcgggaagaccccggcacggtttccgtgcggcggctggaggtggcgcgcgccacgcacacgcaggccgtcagccaggtcggcgcggcccgcgccgaggtcgaacgggccaaggagcagcagggcggcagcgaagagaacaacgccaagctgcgcagcgccgctgcggcggttgaaaaggcggagctcgatctgtccaatgccaagatccgggcgcgtaccggcgggctggtcaccgacctgcaaacggaagtcggccgttttgccggcgccggcagcccggtcatgacgctgatcgcgatccaggatatctggattaccgccgacctcaccgaaaacaacctgggccacgtagagccgggcacgcccgtggccatcgtactcgacgcgctgccgggcaaggtgctcgaaggcaaggtgcgcagcattggctacggcgtgagcaccggccagagcccgccaccaggcagcctgccgacggtgcagaacagccgcgactggctgcggcccgcgcaacgctttccggtgatcgtcgatatcgatccggggcaactctcttcgctgcgcggcgtgcgcgtgggcggccaggccgaagtgatggcgttcccgacctcaggcaacccgctcaatccgttgggccggctgtacatccgcctgatgagctggctgtcctatgtctactga

SEQ ID NO: 82050 - protein, 349 aa, Ralstonia metallidurans CH34
MRWVVIAIVLSLVWYLLADRFTPYTQQARVQAFVIPVASEVSGRVTQVPVHNNQNVEVGTVLFEVDPQQYRIALDRARADFESTRRQIGANTAGIDSARESLRAAQANELKARQDSERLERLYREDPGTVSVRRLEVARATHTQAVSQVGAARAEVERAKEQQGGSEENNAKLRSAAAAVEKAELDLSNAKIRARTGGLVTDLQTEVGRFAGAGSPVMTLIAIQDIWITADLTENNLGHVEPGTPVAIVLDALPGKVLEGKVRSIGYGVSTGQSPPPGSLPTVQNSRDWLRPAQRFPVIVDIDPGQLSSLRGVRVGGQAEVMAFPTSGNPLNPLGRLYIRLMSWLSYVY

SEQ ID NO: 82051 - DNA, 1176 bp, Burkholderia fungorum LB400
  CDS (1)..(1176)
atgctctccagtcaaaaacggctcactgccgcgctcggtgcgctggcagttgtcggcgcagttgcaggcattggcttcactcatgggaccacgtcaggtccgctgagtgcagctcaggctgccgacgcgccgccgccagctactcaggtcgacgtcgcggtcgtcctttcgcagaccatcacggactggcaaagctactccgggcgtctcgaagccatcgaccatgtcgaagtacgcccgctcgttgccggcaccatcattgccgtccacttcaaggacggcgcgctggtcaggaaaggcgacccgcttttcacgatcgacccccgcccctatcaggccgaagtcgaccgcgccgcagcacaggttgcagcggccagggctcgcgctatttacacgtcgaccgatgccgcgcgcgctgaccgactgctcgccgacaatgccatcgcaaagcgcgactacgacgaaaagcagaatgcctcgcgcgaagctgccgcaggagtgaaggctgccgaagccgcgctggaagcagcacaggtcaatctcggctacaccaggattaccgcctcggtgacgggccgcgtatcgcgcgccgaactgaccgtcggcaacgtcgtatcgaccggcgcgaacgcgcctctgcttaccacgctggtttcggtgtcgccgatttacgcctcgttcgatgtcgatgaacagacgtatctgcaataccttggccgcgaccgcaatacgaaggtgccggtgtcgctgggtcttgcaaatgaagacggctactcgcgcaagggggcggttacgtcggttgataaccggctcgacacgtcgtccggcaccatccgtgtgcgtgccactatcgacaacgcagacggcgcgctcgttccgggtctctacgcacgcgtcaaggttggcggcggcgagccccatccggccattctgattgacgacgcggccgttggcactgaccaggcgaagaagttcgtgctggtcgtggacggcgcgaacaaggtcgtctatcgcgaagtccagcttggcggtctgcacgacaacctccgcgtcgtgacctcgggtctgaaggcgggtgagcgcatcgtcgtgaacggcatgatgcacgcaaagccgagtgacaccgtcagcccgcacatggtcagcatgacagacgctgccaaatccgcagcgtaa

SEQ ID NO: 82052 - protein, 391 aa, Burkholderia fungorum LB400
MLSSQKRLTAALGALAVVGAVAGIGFTHGTTSGPLSAAQAADAPPPATQVDVAVVLSQTITDWQSYSGRLEAIDHVEVRPLVAGTIIAVHFKDGALVRKGDPLFTIDPRPYQAEVDRAAAQVAAARARAIYTSTDAARADRLLADNAIAKRDYDEKQNASREAAAGVKAAEAALEAAQVNLGYTRITASVTGRVSRAELTVGNVVSTGANAPLLTTLVSVSPIYASFDVDEQTYLQYLGRDRNTKVPVSLGLANEDGYSRKGAVTSVDNRLDTSSGTIRVRATIDNADGALVPGLYARVKVGGGEPHPAILIDDAAVGTDQAKKFVLVVDGANKVVYREVQLGGLHDNLRVVTSGLKAGERIVVNGMMHAKPSDTVSPHMVSMTDAAKSAA

SEQ ID NO: 82053 - DNA, 1086 bp, Magnetococcus sp. MC-1
  CDS (1)..(1086)
atgaatctctatgtcaaatatctcgtgctgtccgttgctatgtgggtgggtctatcatccgtggccgcagcttcgtctttggcaaccgtcacggttaccaaaacgcagagccccaaactgctcccaataccaggcaatgtggaggccattaaccaagccaccatgaccgcaaaaacggcgggtaccatcgtggagttaaactttgacgtaaacgattatgttaaaaaagaccaggttctgctcagctttaagggtaagcgcaatcaggcgggcctctctcaagcccaagccggggtcagtgaagccgaagcccgtgtggtcgaagcgcgtaatgagtataaccggcttaaatcgctgtttgatcaaaagatggtgacggcctcgcaaatggatcaagcgcagggttcgctgcaagcggcccgcgcacgcttgaacgccgccaaagcagggctcaccagtgccagtgaaggggtggatgacacggtgctgcgtgcgccctattccggttatgtgacgcaacgctttgtgcaactgggcgaaaatgccagcgtggggcagcggttgtttacgggaatttcgttggatgagctgcgggtaataaccaacattccgcaaaaatatgcggatgtggtgcgggtcacccgctcggcgctggtggaaatctcatcctccttggcgcagcaggtaaggcgcatacccgttaaggatgtggtggtgttccccgtagcggaccccgcgagccgtacggtgggggtgcgtatcaagctgcccgaaggcatacaaggtatctatccggggatgctggttaaagtgttttttgtcatcggtcagcaggaaaaactgatcattccagaatccaccgtggtacggcgcagcgaattaaccgccgtctatgtcatgaacccagggcaaccagcacccatgttgcgcatggtgcgcctcggccaggtagatgaggctcaacaggtcgaggtggtctctggcttattggagggagatctggtggtcaagcagcctgcgctggctacccaggtggcgttgagtcactaccaatccatgcgtaaaaaggatgcgatccatgagtga

SEQ ID NO: 82054 - protein, 361 aa, Magnetococcus sp. MC-1
MNLYVKYLVLSVAMWVGLSSVAAASSLATVTVTKTQSPKLLPIPGNVEAINQATMTAKTAGTIVELNFDVNDYVKKDQVLLSFKGKRNQAGLSQAQAGVSEAEARVVEARNEYNRLKSLFDQKMVTASQMDQAQGSLQAARARLNAAKAGLTSASEGVDDTVLRAPYSGYVTQRFVQLGENASVGQRLFTGISLDELRVITNIPQKYADVVRVTRSALVEISSSLAQQVRRIPVKDVVVFPVADPASRTVGVRIKLPEGIQGIYPGMLVKVFFVIGQQEKLIIPESTVVRRSELTAVYVMNPGQPAPMLRMVRLGQVDEAQQVEVVSGLLEGDLVVKQPALATQVALSHYQSMRKKDAIHE

SEQ ID NO: 82055 - DNA, 1152 bp, Geobacter metallireducens GS-15
  CDS (1)..(1152)
atgcagggggcagcttattctctcattgtcacacttgccgcctgcgccaagaaagagcagaaacctgctgccaagccgccggtcccggtagcgatcgccacggtcgagcgaaagaccgtcccggtccagatcaaggccatcggcaacgtggagccctacgctaccgtggccgtcaaggctcaggtgaacggcgaggtgctgaaggtccatttcaccgagggacaggacgtgaaacggggtgacctccttttcgccattgacccgcgcacctatcaggcagcagtgaagaaagccgaagccaatctttcccgtaacctcgtccaggcacggaacgcccggcaggacgcggagcgctacgcccaactggtgaaggagggcatcgtgacttcggagcagtacgagcagtaccggaccagggccgaggcctttgccgccgatgtgtccgccgaccgggccgccgtcgagaacgcgaaggtggagctttcctactgcttcatccgctcccccttgaccggccgcaccgggaatctggcggtccatgcggggaacatcgtaaaggccaatgagaacccccccctggtcaccatcaaccagattacgccggtctacgtggcgttttccatccccgaaaaggacctcgccgaggtcaagcgccgcatggctgcaggaaagctggcggtggaggcgaccattcccaacgatgccggtcccgctgagcaggggatgatctccttcctcgacaacacggttgacgtggccaccggcaccatcaaactcaaggggaccttcgagaacagggcacgtcgcctctggcccgggcagttcgccaacgtggttgtgaccctcgcggccaggcccaatgcgattgtggtcccggcccaggcgattcagaccggccagagcggtccctatgtctttgtggtaaaggctgactcttcggtagaaatccggccggtgacgccgggcattgcctacgaaggggtcaccattatcgagcaggggctcgcgcccggtgaaagggttgtgaccgacggccagatgaggctcacgcccaaggccagggtgacggaaaaaccgggaccggggaccagggaccaagggccggcaaacccccggcaagcttctggccagcccaagggccagcaaccatga

SEQ ID NO: 82056 - protein, 383 aa, Geobacter metallireducens GS-15
MQGAAYSLIVTLAACAKKEQKPAAKPPVPVAIATVERKTVPVQIKAIGNVEPYATVAVKAQVNGEVLKVHFTEGQDVKRGDLLFAIDPRTYQAAVKKAEANLSRNLVQARNARQDAERYAQLVKEGIVTSEQYEQYRTRAEAFAADVSADRAAVENAKVELSYCFIRSPLTGRTGNLAVHAGNIVKANENPPLVTINQITPVYVAFSIPEKDLAEVKRRMAAGKLAVEATIPNDAGPAEQGMISFLDNTVDVATGTIKLKGTFENRARRLWPGQFANVVVTLAARPNAIVVPAQAIQTGQSGPYVFVVKADSSVEIRPVTPGIAYEGVTIIEQGLAPGERVVTDGQMRLTPKARVTEKPGPGTRDQGPANPRQASGQPKGQQP

SEQ ID NO: 82057 - DNA, 1125 bp, Geobacter metallireducens GS-15
  CDS (1)..(1125)
atggcagtggaagaatcgaaggaaaatcaaggggcgggagaaaccgccagaaccgcaacggatacggccggcccagcgggcaagcagcggggagggaagcggacgcgggcaggaatcattctcctcgcggtgatcgccatcgggctgttcatgggaacgcactggttcttacggagcaagaccctcatcaccaccgacaacgcctttgttgaggcccacatccacgcgatatcgccgcgggtttcgggcaccgtgaccgctgtcccggtgatggacaaccagtttgtgaaaaagggggagaccctggtggagctggaccctacggactatgaggttcgggtccggtcggcggccgccgaccttgacatggcgcgcaatgaaacctcgggggactacgcccaggtggaagcggcccgggcagcggtttcccacgcccgggcgcggctggaccaggcggagctggacctcaggcgcggaagtgtcctctttaccaaggaggtgataccgcgtgagcagctggatcgcctcgaaacggcacgacgggtgactgctgcccagcttcgggaggcagaggaaggggtacgcaaggcccaggcagagttgggtcttgccggcaccggcggcaaagaggccagggtggcccagcgggaggcgaaactacgggaagcctccctcagcctctcctacacgcgcatcgttgcccccgtcgacggctacgtgacccgcaagtccgttgagacgggatccacggtccaggcagggcagcccctcatggccgtggtggcccttaacgacacgtgggtgacggccaattacaaggaaagccagcttgcccacatgaaaccgggccagaaggtgacgttcaccgtggacgcctacccctcccgcacctttaccggccgggtcgacagcatcatggccggcaccggcgccgccttctcgctcctcccgtccgagaacgccaccggcaactacgtgaaggtggtgcagcgagtgccggtgaagatcgtggtggatacggggagcgacccccggcatctgctccgggtgggaatgagcgtgatccccaccgtgaacaccgggcgcaaactgggggaaatcctcagggatttccggcccttctag

SEQ ID NO: 82058 - protein, 374 aa, Geobacter metallireducens GS-15
MAVEESKENQGAGETARTATDTAGPAGKQRGGKRTRAGIILLAVIAIGLFMGTHWFLRSKTLITTDNAFVEAHIHAISPRVSGTVTAVPVMDNQFVKKGETLVELDPTDYEVRVRSAAADLDMARNETSGDYAQVEAARAAVSHARARLDQAELDLRRGSVLFTKEVIPREQLDRLETARRVTAAQLREAEEGVRKAQAELGLAGTGGKEARVAQREAKLREASLSLSYTRIVAPVDGYVTRKSVETGSTVQAGQPLMAVVALNDTWVTANYKESQLAHMKPGQKVTFTVDAYPSRTFTGRVDSIMAGTGAAFSLLPSENATGNYVKVVQRVPVKIVVDTGSDPRHLLRVGMSVIPTVNTGRKLGEILRDFRPF

SEQ ID NO: 82059 - DNA, 1071 bp, Novosphingobium aromaticivorans DSM 12444
  CDS (1)..(1071)
atggctgaagccgatccttttcccatccaggaatccagtgccgcccgtgccgttggcgagcacgaacgacgcacccgcagcaagcgcctgcgcaccgtactgatggccctcggcccgattctcgcgatcggtggtggcctttggtactggttcggtcggcccggcgtggtcgaaaccgacaacgcctacatcaagcaggacatcgtttcggttgccggcgaagtcacggggctcgtcacctcggtcaaggtgaaggagaaccagcacgtcaaggcaggcgacgtgctgttcaccatcgatccctcaagtttcaccgtggcgacgcgccaggccgatgcgcagatcgcatccgcgcaggcccgcgtgatcgctctcaacgccgacgtcaccgccaaggccgcggatcttgccggcgcgcgcgacgaccttgcgctcgcccaggccaactatgcccgtgaaaaggcgctgatggatcgcggcttcaacacccgcgcccgcatggacgctgccgaacatgccgtcgccaccgcgcgcgaccgcatcgtctcgatccaggcggaagtggaacaggcccgtgccgaactggcgcagggctcgcaggtgcccggcgtcaacccggagattgccgccgcccaggccaatcgcgcaaaggccgcgctcgatgtcgaacgcacggtcgttcgcgccccggccgacgggatcgtcacgcaggtcacccgcctccagatcggccagatggtgttcccgggcgtgccgatgctgtccatcgtgcgcgatggcggtgcgcggatcgaggcgaacttcaaggaaaccgacctcaatcacatgcgccccggccagcgcgcggatatcgagatcgacgcctatcccggcctcaagctcaagggccgcgtcgaatccatcggcgcgggcaccggctcggaattctcggtcctcccggcccagaacgccaccggcaactgggtcaaggtgatccagcgcgtgcccgtgcgcatcgcgatcgaggacaagtcgccgcgcccactgatcgccgggctcagctccgacgtcacggtccatgtcggcaagtaa

SEQ ID NO: 82060 - protein, 356 aa, Novosphingobium aromaticivorans DSM 12444
MAEADPFPIQESSAARAVGEHERRTRSKRLRTVLMALGPILAIGGGLWYWFGRPGVVETDNAYIKQDIVSVAGEVTGLVTSVKVKENQHVKAGDVLFTIDPSSFTVATRQADAQIASAQARVIALNADVTAKAADLAGARDDLALAQANYAREKALMDRGFNTRARMDAAEHAVATARDRIVSIQAEVEQARAELAQGSQVPGVNPEIAAAQANRAKAALDVERTVVRAPADGIVTQVTRLQIGQMVFPGVPMLSIVRDGGARIEANFKETDLNHMRPGQRADIEIDAYPGLKLKGRVESIGAGTGSEFSVLPAQNATGNWVKVIQRVPVRIAIEDKSPRPLIAGLSSDVTVHVGK

SEQ ID NO: 82061 - DNA, 978 bp, Novosphingobium aromaticivorans DSM 12444
  CDS (1)..(978)
atgaccgaccagacccgcatttccccgcccgtgcgcaaggcgctgcgccttgccgtgaccgctgctttcgtcgtcggagccatcctcgccgttcgcgcgcttgtcggctattaccaggccgatccctggacccgcgacggcagggtgcgggccgacatcgtgcaggtgtcgcccgatgtcggggggatcgtggtcgcggttcgcgtcacgcatgaccagcaggtgcacaagggcgacgttctgttcgagatcgacccttcgcgcttcgacctggcggtggcgcgcgcgcaggcccagttgcggcaggcgcaggccgaagttgcgcaggcgcgggcggccatcggccatgccggcgtgacgctgaccgaggctcggcgcgaggcggcgcgcaaccggggcctgggcgatcttgtcgcgggcgagctgaccgagcagagcgagacccgcgtgggcgagggccaggcgaagatggccgaggcgggcgccgctctcgcggctgcggaagcaagggtcgaggccgcgcgcaatgcgctgaaccttgccagactggatcgcgcgcggacgaaggtcgttgccccggtcgatggcgagatgtcggacgtggtgctgcgtcccggcgactacgtgagcgcgggtgccccggtccttgccctgatcgacagcgcgagccttcgggtcgaaggctacttcgaggaaaccaagttgccgcgcatccatgccgggcagcgcgcgacgatccacctgatgggcgaagatactgtccttactggccgggtggtttccatcgcgggggcgatcgcggatcaggatcgcggcaaggagccgcgcctcgtgcccgcgatcaacccgacgttcagttgggtccgtctgccccagcgcgtacccgttcgtgtccggctggaccggccgccggcgggcattgcgctgattgccgggcgcaccgcctcggtctcgctcgaccaggaacacacgtcgtga

SEQ ID NO: 82062 - protein, 325 aa, Novosphingobium aromaticivorans DSM 12444
MTDQTRISPPVRKALRLAVTAAFVVGAILAVRALVGYYQADPWTRDGRVRADIVQVSPDVGGIVVAVRVTHDQQVHKGDVLFEIDPSRFDLAVARAQAQLRQAQAEVAQARAAIGHAGVTLTEARREAARNRGLGDLVAGELTEQSETRVGEGQAKMAEAGAALAAAEARVEAARNALNLARLDRARTKVVAPVDGEMSDVVLRPGDYVSAGAPVLALIDSASLRVEGYFEETKLPRIHAGQRATIHLMGEDTVLTGRVVSIAGAIADQDRGKEPRLVPAINPTFSWVRLPQRVPVRVRLDRPPAGIALIAGRTASVSLDQEHTS

SEQ ID NO: 82063 - DNA, 1146 bp, Novosphingobium aromaticivorans DSM 12444
  CDS (1)..(1146)
atggccgccacccccgattctcttcccgccaacgccgatgcccccgccgagaacgaagggcgcaagaagacggtgggacgcatcgcactgggcgtgctcgcgctcggcgcagcctatggcgcctatgcgctctaccactacgagaccgtcggccagtacatgcaggaaaccaatgacgcttatgtgaaggcagatggcgtcaccgtaagctcgaagctggcaggctatgtccggaccgtcgccgtggccgacaaccagtcggtcaacgacggcgcgctcctcgtacagatcgatcctaccgattacgacacgcgcctcgcacagagcaccgcacaagtcgaagttgcccgtgcgaccgaaacagcaacgcttgccgccatcaacgaagcgcaatcggcggtcggacaggcgcgggccgcgctccaggcctcgcaacgcgagcttgcctacctcaacggcgaagtcgcccggatgcgcccgctggtcgccagcggcgccgaaccccggcaggcattcgaccagcttgtcgccaaccgcgacaaggctgctgccgacgtttcggccaagcaggccgcgctttcggccgcaagcgaccgcgtcgccagcacccgggcgcaggcggggcaatccgccgcacaggtcaaggccgcgcaagcccagcgccaggccgccagcaccgatcttgctaccacccgcatcgtcgctcccgtttccggcaaaatcggcaattcgacggtccgcgtcgggcaattcgtgcaaccgggccagcgcctgatgacgatcgttcccacacaggccatctatgtcgaggccaacttcaaggaaacgcagatcggcctgatgcgcgcgggacagccggtgacggtgcacgtggatgccctgcccgacgtcgatttccacggtacggtcgaaagcatcacccccggcacgggcgcgaacttctcgttgatcccgccgcagaacgcgaccggcaacttcaccaagatcgtccagcgcgtaccggtgcgcatccgcatcaacgccggccccgaatcgcgcaaggtgctggtgccgggcctgtcgcttacggtcgaggtggatacccgctcggcgaagtcggccatcgacgcgatccgcgatgaacaggaccgggtctcggccaagtga

SEQ ID NO: 82064 - protein, 381 aa, Novosphingobium aromaticivorans DSM 12444
MAATPDSLPANADAPAENEGRKKTVGRIALGVLALGAAYGAYALYHYETVGQYMQETNDAYVKADGVTVSSKLAGYVRTVAVADNQSVNDGALLVQIDPTDYDTRLAQSTAQVEVARATETATLAAINEAQSAVGQARAALQASQRELAYLNGEVARMRPLVASGAEPRQAFDQLVANRDKAAADVSAKQAALSAASDRVASTRAQAGQSAAQVKAAQAQRQAASTDLATTRIVAPVSGKIGNSTVRVGQFVQPGQRLMTIVPTQAIYVEANFKETQIGLMRAGQPVTVHVDALPDVDFHGTVESITPGTGANFSLIPPQNATGNFTKIVQRVPVRIRINAGPESRKVLVPGLSLTVEVDTRSAKSAIDAIRDEQDRVSAK

SEQ ID NO: 82065 - DNA, 1074 bp, Cytophaga hutchinsonii
  CDS (1)..(1074)
atgaaaataaaatttatcgtttatacacttgttatactctctattggttcactgatattttaccgcatcagacaaaacaaagaatctgaatcagcgaataaaccggatgcttcaaaaaacaaaaccgtccaggttgatggaatcattttaaaaccacaatctttttctgataacctcatggtttcaggttctattgaagcaaatgaacaggtacagataagaagtcaggttacaggtgtaattacacacatctattttcaggaaggcaacaaagtttctaagggacaagcgctggtaaagatagatgatgcagagctgcaggcgcagctttcagaattgttaacccgcgaagatctggcagcagaaaatgaaaagcgtgcaaagttattattgcagaaagaaggtatcagtaaagaagaatacgacatcagtttatctgcgctgaagtctttacaggcacaggaaaatattatccggacacaaatttcaaaaaccattattaaagcgcctttcaacggtaccattggcttacggaatgtttctataggcgaattcctttcaaccagcctgatcatagccaatctggtaaataccaatccggtgaaaattacctttgccgttccggaaaaatattcttccaatatgaaaatcaatacaaaagttgaattcacttttgccggctcttctaaaacatatgctgctaccgtatatgcgatcgaaccacagattgacgcggccacacgtacgcttcagcttcgtgcccgcgcttctaacgaagacggagcattgctccctgggtcctttgccaacgttaaactaccgttaacaatcataccggatgcacttcttgtacctactgaatctgttattccgattcaggatggtaaaaaagttttcatagttgaaaacgggcaagcaaaagaagttaaaattgaaacatcttccagaacagataaagacctgctggttttgtccgggctaaaagcgggcgataccgttcttactaccggagtaatgtcaatgaaagccggaatgtccgttcaggtaaaacttacaaacgctgataccaaataa

SEQ ID NO: 82066 - protein, 357 aa, Cytophaga hutchinsonii
MKIKFIVYTLVILSIGSLIFYRIRQNKESESANKPDASKNKTVQVDGIILKPQSFSDNLMVSGSIEANEQVQIRSQVTGVITHIYFQEGNKVSKGQALVKIDDAELQAQLSELLTREDLAAENEKRAKLLLQKEGISKEEYDISLSALKSLQAQENIIRTQISKTIIKAPFNGTIGLRNVSIGEFLSTSLIIANLVNTNPVKITFAVPEKYSSNMKINTKVEFTFAGSSKTYAATVYAIEPQIDAATRTLQLRARASNEDGALLPGSFANVKLPLTIIPDALLVPTESVIPIQDGKKVFIVENGQAKEVKIETSSRTDKDLLVLSGLKAGDTVLTTGVMSMKAGMSVQVKLTNADTK

SEQ ID NO: 82067 - DNA, 1350 bp, Polaromonas sp. JS666
  CDS (1)..(1350)
ttgcaaccggccgccggcaacccccggcgcaagaaagcgctgaccgcgctggccagcgtggtggtggtcgccggcctgggctgggccgcctacgagtacctcgtggccagccattacgagtcgaccgacaacgcttacgtgcaaggcaacgtgatccagatcacgccgcagatcggcggcaccgtcatggccatcatggccgacgacaccgacttcgtgaaagccggtcagacgctggtgcaactggacccggcagacgccagaatcgcgctggagcaggccgaagccgcgctggcccaggcggtgcgccaggtgcgcacgctctacgccaacaacggcacgctggccgcccagatcgcgctgcgtgatgccgacgtggccagggcccgcagcgatattgcccgcgccaccgatgacctcaaccgccgccagtcgctcaccggcaacggggcggtgtcgaaagaagaactcaaccatgcgcagacgcagctggccaacgccaaaagcgcgctggccgcagcgcaggccggcgtggtggccgcgcgcgagcagctcaccagcaaccaggccttgaccgaggggaccagcatcgagcagcaccccagcgtgcaggtggcggccgccaaggtgcgcgaggcctacctcgccacacagcgcgccggtctgcaggctccggtggatggctacgtggccaagcgcacggtgcagctgggccagcgcgtggcggccggcacgcccatgatgtcgatcattccgctcaaccaggtctgggttgatgccaacttcaaggaagtgcaactgcgcaatatccgcatcggccagccggtgacgctggtggccgacctgtatggcaaaaaaatccaatacaaaggcacggtagcggggctgggtgtcggcacgggcgcggccttttcgctgctgccggcgcaaaacgccaccggcaactggatcaaggtggtgcagcgcgtgccggtgcgcattgcgctcgacgccaggcaactggccgacaacccgctgcgggtgggcttgtcgatggatgcggaagtcgacgtcagccacaaggacggcaaaacgctggccgatgcgccgcgcgacgcggcccaggcgcacacgcagacttatggcaagcaggacgatgccgccaacgtgtatgtgcggcgcgtgattgccgccaacagcggcaaggcactcaaaccggccaaagccgccgccatcggctcgccggcccaaccgccgggcggccccaccacagcggatcagaccggcagcgaagggcagggccttgcgatggcgcagacgcagaccctgtcgattgccggcagccgcgcggcaccacagcaggcgcactaa

SEQ ID NO: 82068 - protein, 449 aa, Polaromonas sp. JS666
MQPAAGNPRRKKALTALASVVVVAGLGWAAYEYLVASHYESTDNAYVQGNVIQITPQIGGTVMAIMADDTDFVKAGQTLVQLDPADARIALEQAEAALAQAVRQVRTLYANNGTLAAQIALRDADVARARSDIARATDDLNRRQSLTGNGAVSKEELNHAQTQLANAKSALAAAQAGVVAAREQLTSNQALTEGTSIEQHPSVQVAAAKVREAYLATQRAGLQAPVDGYVAKRTVQLGQRVAAGTPMMSIIPLNQVWVDANFKEVQLRNIRIGQPVTLVADLYGKKIQYKGTVAGLGVGTGAAFSLLPAQNATGNWIKVVQRVPVRIALDARQLADNPLRVGLSMDAEVDVSHKDGKTLADAPRDAAQAHTQTYGKQDDAANVYVRRVIAANSGKALKPAKAAAIGSPAQPPGGPTTADQTGSEGQGLAMAQTQTLSIAGSRAAPQQAH

SEQ ID NO: 82069 - DNA, 1272 bp, uncultured bacterium
  CDS (1)..(1272): transl_table=11
atgcgcgggaatccagtttacaggccgaccgcaagcgcgccatggcgatgctgttcctcgcgcttggcggcggatatgaaccaggtcaggagtaacagcatcatgcctgcagcacccaatcataattcagccaggcgcagccgcgccctgctcgtcctgacgctggctttcctcctgctcgggctgggttacggcgcgtactggtggattcacggccgccaccatgaaagcaccgacgacgcctatgtcgccggcaacctgattcgtgtcgcgccgcgcattgccggcaccgtgctggcagtctatgccgacgataccgacctggtgcagcgcggccagctcctggcgcgcctggacgatgccgatgcccgtgtcgcgctggccgctgccgaagcccacctggcagaaacggtgcgtcaggtgcggcagatgttcagtgccgtggaccaggcgcgtgccacggtgggcatcaagcaggagagcctgcgccaggccgaggccgatgcggcgcggcgcggcggcgcggcggcagcggacgacgccgtgtcgcgcgaggaacgggatcacaccatgtcggcgctgaaacgcgcccagtccgaattgcacctcgccagcagccagcttgaaggcgcgctggcgcaggtggcgcataccgacatcgaacaccatcccgcggtgctgcaggcggaagcgcaggtgcgcgaggcgttcctcaatctcgggcgctgcgaggttcatgctgcagaaagcggctacgtggccaaacgcgcggtgcaggtgggacagcaggcggcgccgggaacgaccctgatggtgattgtgccgttgcgccaggtgtgggtggaagccaacttcaaggaagaccagctcaagcgcatgcgcatcggccagccggtggtgctggaatccgacctgtatggcagcggggtgaagctgcacggcaaggtggcggggctggccgccggcaccggcagcgtgttttccctcctgccgccgcagaacgcgagcggcaactggatcaagatcgtgcagcgcctgccggtgcgcattgcgctggatcccgccgagctggccaaacacccgctgcgcatcggcctgtcgatgaaagcgcaggtggaaaccggggatgcctccggcgagtccctcgccagcacccccccccatggcccgctttatgaaacggcggtctatggtgacgaagagaagcaagccgggcagcgcatccgcgagatcgtcgccgccaatctggggcggacgaaaccagcgccgtga

SEQ ID NO: 82070 - protein, 423 aa, uncultured bacterium
MRGNPVYRPTASAPWRCCSSRLAADMNQVRSNSIMPAAPNHNSARRSRALLVLTLAFLLLGLGYGAYWWIHGRHHESTDDAYVAGNLIRVAPRIAGTVLAVYADDTDLVQRGQLLARLDDADARVALAAAEAHLAETVRQVRQMFSAVDQARATVGIKQESLRQAEADAARRGGAAAADDAVSREERDHTMSALKRAQSELHLASSQLEGALAQVAHTDIEHHPAVLQAEAQVREAFLNLGRCEVHAAESGYVAKRAVQVGQQAAPGTTLMVIVPLRQVWVEANFKEDQLKRMRIGQPVVLESDLYGSGVKLHGKVAGLAAGTGSVFSLLPPQNASGNWIKIVQRLPVRIALDPAELAKHPLRIGLSMKAQVETGDASGESLASTPPHGPLYETAVYGDEEKQAGQRIREIVAANLGRTKPAP

SEQ ID NO: 82071 - DNA, 1173 bp, uncultured bacterium
  CDS (1)..(1173): transl_table=11
atgactgaccagcaaaataaggaagacgtgagccttgccgcgactacaccggattccaccacaaatgcggaggcacaacagcccccgcaagatgccccccgcacggtaaaaaagggtgggcttgcgatagtaataaccatcgtgctcagcttgttgtggtacttgctcgctgatcgctataccccctacaccacccaggcccgcattgacggttatgttattggtgtcgccccgcaagtctctggcaccgtcaccaaggtgtgggtgaacaacaaccaacatgtgaaagaggggcagccgctctttacgatcgataattcgcaataccagattgccgtgaataaagcgcgttctgacctggacaacgctgttcgccaagtaggtgcaggtagtgcagtagtagatgctgcaaaggccaatttgttggctgctcatgcgaatgaacgcaaggcacggcaggatgcagagcggttggagcggttatacaaagaggattccggtacgatttctgtacgccttctggaagtcgcacgtgcgagcctcgatcaagccaaggcgcaagtgaccgccgctgaagccgacatccagggtgccatagaacaaatgggcggtgaagactcaacggccaataccatcctcaataccgcccgtaccgcagtcgctaaagccgagttagaccttgctaacaccgaagtgaaagcatcctcgaacggcgtgattactgacctcaagaccgatgtcggtcacttcgcaggtgctgggcagccggtgctgacactgatcggtattcacgatatctggatcaatgctgagtacaccgagaataatctggggcgactgaaagtaggcacaccggtagagattctgtttgacgtactacccggccaaatctttcatggggagatccgtagtatcggtctgggaataagcgctggccgaccccaagcggcagggaccttaccaagtatccagaacgaccgcgattggctgcggcaatcacaacgctttcctgtcgtcatcgggtttgatagcacgcaagacccaacgttgcagtcacagttgcgggttggtggacaggcctcggtcatcgcctacagcgagggttcgtggatgaccaagctgctcggcaaaacctggattcgcatcgcaagtttcttgtcgtatgcatattaa

SEQ ID NO: 82072 - protein, 390 aa, uncultured bacterium
MTDQQNKEDVSLAATTPDSTTNAEAQQPPQDAPRTVKKGGLAIVITIVLSLLWYLLADRYTPYTTQARIDGYVIGVAPQVSGTVTKVWVNNNQHVKEGQPLFTIDNSQYQIAVNKARSDLDNAVRQVGAGSAVVDAAKANLLAAHANERKARQDAERLERLYKEDSGTISVRLLEVARASLDQAKAQVTAAEADIQGAIEQMGGEDSTANTILNTARTAVAKAELDLANTEVKASSNGVITDLKTDVGHFAGAGQPVLTLIGIHDIWINAEYTENNLGRLKVGTPVEILFDVLPGQIFHGEIRSIGLGISAGRPQAAGTLPSIQNDRDWLRQSQRFPVVIGFDSTQDPTLQSQLRVGGQASVIAYSEGSWMTKLLGKTWIRIASFLSYAY

SEQ ID NO: 82073 - DNA, 1062 bp, Pseudomonas putida
  CDS (1)..(1062): transl_table=11
atgaccaacaaccgcaaaacccttttcatcggctcggtgctggccgtggccgtcctggctggcatcgtcggcccctggatgtttggcagtgatcaccgccagagcaccaatgacgcctatgtgagcgccgactacaccgtggtcgcgcccaaagtcgccggttttatcaagcaagtgctggtggaagacaatcagcaggtcacggctggccagttgttggcgaccatcgatgcgcgtgactaccaggctgcgctggatgctgcgcaggcgcagttgctggtagcccaggcacaaagcgccgatgcccgcgccacgcttgaacgccaggacgcgctgattgcccaggccgaagcggcagtgaaggcggcccaggctgaggtggcgttcgccgaccatgaagtcaaccgctacagccgccttgccgagcagggcgcgggtaccgtgcagaacgcccagcaggcgcgcagcgcggtcgaccaagcccgtgctcgcctggccaacgctcaagctgcgcgggtggcggcgcgcaagcaggtggacatcctcaaagctcaagtggccagcgccgatggccagctcaagcgtgccgaagcaggcctggaaaaggcccagctcgatctgtcctacacccgcatcacagcaccggtggacggtatggtcggcgaacgcgccctgcgggtgggggcctacgtcaacccgggcgctcgcctgctgtcggtggtgccgttgcagcaggcctatgtggtcggcaacttccaggaaacccagctgacccacgtacagccgggccagccggtgcgcatcagcgtcgacaccttctccggcgaaaccctgcaaggccatgtgcaaagcattgccccggctaccggcgtaaccttcgccgcagtcaagccagacaacgccaccggcaacttcaccaaggtggtgcaacgcattccggtcaagatcgttctcgatgatggccagccactgctcacccgcctgcgtgtgggcatgtcggtcgaagccaccatcgacacgcgtggcgacaagctggacggcaaagaggtaagcgcgcgatga

SEQ ID NO: 82074 - protein, 353 aa, Pseudomonas putida
MTNNRKTLFIGSVLAVAVLAGIVGPWMFGSDHRQSTNDAYVSADYTVVAPKVAGFIKQVLVEDNQQVTAGQLLATIDARDYQAALDAAQAQLLVAQAQSADARATLERQDALIAQAEAAVKAAQAEVAFADHEVNRYSRLAEQGAGTVQNAQQARSAVDQARARLANAQAARVAARKQVDILKAQVASADGQLKRAEAGLEKAQLDLSYTRITAPVDGMVGERALRVGAYVNPGARLLSVVPLQQAYVVGNFQETQLTHVQPGQPVRISVDTFSGETLQGHVQSIAPATGVTFAAVKPDNATGNFTKVVQRIPVKIVLDDGQPLLTRLRVGMSVEATIDTRGDKLDGKEVSAR

SEQ ID NO: 82075 - DNA, 1104 bp, Campylobacter jejuni
  CDS (1)..(1104): transl_table=11
atgaaattatttcaaaaaaatactattttagctttaggtgttgtgcttttactcgctgcttgcagcaaagaagaagcaccaaaaatacaaatgccgcctcaacctgtaacaaccatgagtgctaaatctgaagatttaccacttagttttacttaccctgctaaacttgtcagtgattatgatgtcattataaaacctcaagttagcggcgtaatagtaaataaactttttaaagctggagataaggtaaaaaaaggacaaacattatttattatagaacaagataaatttaaagctagtgttgattcagcttacggacaagctttaatggctaaggcaactttcgaaaatgcaagcaaggattttaatcgttctaaagctctttttagcaaaagtgcaatctctcaaaaagaatacgactcttctcttgctacatttaacaattcaaaagctagtctagcaagtgctagagcacagcttgcaaatgcaagaattgatctagatcataccgagataaaagctccttttgatggtactataggagatgctttagttaatataggagattatgtaagtgcttcaacaactgaactagttagagttacaaatttaaatcctatttacgcagatttctttatttcagatacagataaactaaatttagtccgcaatactcaaagtggaaaatgggatttagacagcattcatgcaaatttaaatcttaatggagaaaccgttcaaggcaaactttattttattgattcggttatagatgctaatagtggaacagtaaaagccaaagccgtatttgataacaataactcaacacttttaccgggtgcttttgcaacaattacttcagaaggttttatacaaaaaaatggctttaaagtgcctcaaataggtgttaaacaagatcaaaatgatgtttatgttcttcttgttaaaaatggaaaagtagaaaaatcttctgtacatataagctaccaaaacaatgaatacgccattattgacaaaggattgcaaaatggcgataaaatcattttagataactttaaaaaaattcaagttggtagcgaagttaaagaaattggagcacaataa

SEQ ID NO: 82076 - protein, 367 aa, Campylobacter jejuni
MKLFQKNTILALGVVLLLAACSKEEAPKIQMPPQPVTTMSAKSEDLPLSFTYPAKLVSDYDVIIKPQVSGVIVNKLFKAGDKVKKGQTLFIIEQDKFKASVDSAYGQALMAKATFENASKDFNRSKALFSKSAISQKEYDSSLATFNNSKASLASARAQLANARIDLDHTEIKAPFDGTIGDALVNIGDYVSASTTELVRVTNLNPIYADFFISDTDKLNLVRNTQSGKWDLDSIHANLNLNGETVQGKLYFIDSVIDANSGTVKAKAVFDNNNSTLLPGAFATITSEGFIQKNGFKVPQIGVKQDQNDVYVLLVKNGKVEKSSVHISYQNNEYAIIDKGLQNGDKIILDNFKKIQVGSEVKEIGAQ

SEQ ID NO: 82077 - DNA, 1176 bp, Erwinia chrysanthemi
  CDS (1)..(1176): transl_table=11
atgagtgccaacgtggaaaagcagactccaccaactatgccatcgaaatccaaaaaatcgcgtaaaggaattctcacgctgctgatgattgtgtttttctttattggctgtgtgtggtttgcctactggtatttggtgttgcggcaccatcaggaaaccgacgacgcctatgtcgccggcaaccagattcaaattatgtcgcaggttaacggcagcgtcgcccgcgtcaacgtcgacaacaccgacttcgttaaaaaaggcgacgtgctggtggagcttgacccaaccgacgccgagcaagcctttgaacgctcgaaaaccacgttggccaatagcgtgcgccaggttcatcagcagatgatcaacgtccgtcagtaccaagccaacatcgacctgcagcagattgcgctggacaaagctatcagcgacttgaaccgccgtgaagtgctggggcgagccaatgctatcggccgggaagacctgcaacacgcgcgcgaccaggtcgccagcgccagagcgtcgctggaagcggccaaacagcagtatgccgccactcaggcgctggtgctgaatacctcattagagcagcaacccgccattgcccaggctgctactgacctgcgcaacgcctggctggcgctcaaacgtacccatatcgtcagcccggtggatggctatgtctcccgccgcagcgtgcagttaggcgcgcgcgtcaccccgtcgtccgccctgatggcggtggtaccggccgctccgctgtgggtcgacgccaactttaaggaaacccaactggccaacatgcgcatcggccagccggcgaccatcattagcgacctgtatggcgacagcgtggtgtacaaaggcaaggtggtaggcctggacatgggaaccggcagcgcgttctcgctgttgccggcccagaacgccaccggtaactggatcaaggtcgtcgagcgcctgccggtacgtatcgaactggatccgaagcaactgaccgattatccgttgcgcatcggcttgtcgacgctggttaaagtggataccgccaataccgacggcaagatgctgtccgatgcatcccgtgcaacaccggcataccagagtgatgcgctggatctggatctgtcgcccgtcaaccagatgatcgaccagatcatcggcgccaacgctggctaa

SEQ ID NO: 82078 - protein, 391 aa, Erwinia chrysanthemi
MSANVEKQTPPTMPSKSKKSRKGILTLLMIVFFFIGCVWFAYWYLVLRHHQETDDAYVAGNQIQIMSQVNGSVARVNVDNTDFVKKGDVLVELDPTDAEQAFERSKTTLANSVRQVHQQMINVRQYQANIDLQQIALDKAISDLNRREVLGRANAIGREDLQHARDQVASARASLEAAKQQYAATQALVLNTSLEQQPAIAQAATDLRNAWLALKRTHIVSPVDGYVSRRSVQLGARVTPSSALMAVVPAAPLWVDANFKETQLANMRIGQPATIISDLYGDSVVYKGKVVGLDMGTGSAFSLLPAQNATGNWIKVVERLPVRIELDPKQLTDYPLRIGLSTLVKVDTANTDGKMLSDASRATPAYQSDALDLDLSPVNQMIDQIIGANAG

SEQ ID NO: 82079 - DNA, 1173 bp, Escherichia coli
  CDS (1)..(1173): transl_table=11
atgagcgcaaatgcggagactcaaaccccgcagcaaccggtaaagaagagcggcaaacgtaagcgtctgctcctccttctcaccttgctctttataattattgccgtagcgatagggatttattggtttttggtactgcgtcacttcgaagaaaccgatgacgcatacgtggcagggaatcaaattcaaattatgtctcaggtgtctggcagcgtgacgaaagtctgggccgataacaccgattttgtaaaagaaggcgacgtgctggtcactctcgacccgacagatgctcgccaggcgtttgaaaaagccaaaactgcactggcttccagcgttcgccaaacccaccagctgatgattaacagcaagcagttgcaggcgaatattgaggtgcagaaaatcgccctcgcgaaagcacaaagcgactacaaccgccgtgtgccgctgggcaatgccaacctgattggtcgcgaagagctgcaacacgcccgcgacgccgtcaccagtgcccaggcgcaactggacgtcgcgattcaacaatacaatgccaatcaggcgatgattctggggactaaactggaagatcagccagccgtgcaacaggctgccaccgaagtacgtaacgcctggctggcgctggagcgtactcgtattatcagtccgatgaccggttatgtctcccgccgcgcggtacagcctggggcgcaaattagcccaacgacgccgctgatggcggtcgttccagccaccaatatgtgggtggatgccaactttaaagagacgcagattgccaatatgcgtatcggtcagccggtcactatcaccacggatatttacggcgatgatgtgaaatacaccggtaaagtggttggtctggatatgggcacaggtagcgcgttctcactgcttccagcgcaaaatgcgaccggtaactggatcaaagtcgttcagcgtctgcctgtgcgtatcgaactggaccagaaacagctggagcaatatccgctgcgtatcggtttgtccacgctggtgagcgtcaataccactaaccgtgacggtcaggtactggcaaataaagtacgttccactccggtagcggtaagcaccgcgcgtgaaatcagcctggcacctgtcaataaactgatcgacgatatcgtaaaagctaacgctggctaa

SEQ ID NO: 82080 - protein, 390 aa, Escherichia coli
MSANAETQTPQQPVKKSGKRKRLLLLLTLLFIIIAVAIGIYWFLVLRHFEETDDAYVAGNQIQIMSQVSGSVTKVWADNTDFVKEGDVLVTLDPTDARQAFEKAKTALASSVRQTHQLMINSKQLQANIEVQKIALAKAQSDYNRRVPLGNANLIGREELQHARDAVTSAQAQLDVAIQQYNANQAMILGTKLEDQPAVQQAATEVRNAWLALERTRIISPMTGYVSRRAVQPGAQISPTTPLMAVVPATNMWVDANFKETQIANMRIGQPVTITTDIYGDDVKYTGKVVGLDMGTGSAFSLLPAQNATGNWIKVVQRLPVRIELDQKQLEQYPLRIGLSTLVSVNTTNRDGQVLANKVRSTPVAVSTAREISLAPVNKLIDDIVKANAG

SEQ ID NO: 82081 - DNA, 1173 bp, Haemophilus influenzae
  CDS (1)..(1173): transl_table=11
atgacgcaaattgcaactgaaaacccatcaactaaatctgtatcaaataaaactgaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagtttcgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcagtggtatctaatgaacaaatgtggctagaagctaacttcaaagaaacccaattaacgaatatgcgcattggtcagccagtaaaaatccattttgatttatacggtaaaaataaagaatttgatggcgtgataaatggtattgaaatggggactggcaatgcattttctcttttgccttcacaaaatgctacgggtaactggattaaagtggtgcaacgcgtacctgtgcgaattaaattagatccacaacaatttacagaaacgccattgagaattggtctttctgcaacggcaaaagtaagaatttcagattcatcaggcgcaatgctacgagaaaaaacagaaccgaaaacgttattttctactgatacacttaaatatgatgaaagtgcggtagaaaatttgattgaatctatcattcagcaaaacagccattaa

SEQ ID NO: 82082 - protein, 390 aa, Haemophilus influenzae
MTQIATENPSTKSVSNKTDRKKGLSIFILLLLIIGIACALYWFFFLKDFEETEDAYVGGNQVMVSSQVAGNVAKINADNMDKVHAGDILVELDDTNAKLSFEQAKSNLANAVRQVEQLGFTVQQLQSAVHANEISLAQAQGNLARRVQLEKMGAIDKESFQHAKEAVELAKANLNASKNQLAANQALLRNVPLREQPQIQNAINSLKQAWLNLQRTKIRSPIDGYVARRNVQVGQAVSVGGALMAVVSNEQMWLEANFKETQLTNMRIGQPVKIHFDLYGKNKEFDGVINGIEMGTGNAFSLLPSQNATGNWIKVVQRVPVRIKLDPQQFTETPLRIGLSATAKVRISDSSGAMLREKTEPKTLFSTDTLKYDESAVENLIESIIQQNSH

SEQ ID NO: 82083 - DNA, 1164 bp, Escherichia coli
  CDS (1)..(1164): transl_table=11
gtggaacagattaattcaaataaaaaacattctaacagaagaaaatacttttctttattggcggtagttttatttattgcgttttcaggtgcctatgcctattggtcaatggaattagaagacatgattagtacagatgacgcctatgtcacggggaatgcagatccaatttctgcacaagtctcaggtagtgtcactgtcgttaatcataaagatacgaactacgttcgacaaggtgacattttagtttcactggataaaactgatgccactatcgcactcaataaagctaaaaataatctggcaaatattgttcggcaaacgaataaactatacttacaggataaacaatacagtgccgaagtcgcttcagcacgtattcagtatcaacaatctttagaagattataaccgtcgagtgccgttagcgaagcagggggttatttcaaaagaaacgctggagcataccaaagatacgttaataagtagcaaagcggcattgaatgccgctatccaggcttataaagcgaataaagctttagtaatgaacacaccattaaaccgtcagccacaagtcgttgaagcggcggatgcaactaaagaagcctggttggcgcttaaacgtacggatattaagagtccggttaccggctatattgcccagagaagtgttcaggtcggcgaaacagtgagccccggacaatcgttaatggctgtcgtaccggcacgtcaaatgtgggttaatgccaactttaaagaaacacaactcacggatgtacggattggtcaatcggtcaatattatcagcgatctttatggtgaaaatgttgtgtttcatggtcgggtgacagggatcaatatgggaaccggcaatgcgttctccttattacctgcacaaaatgcgacagggaactggatcaaaatcgttcagcgtgtaccggttgaagtttctcttgatccaaaagaactcatggaacaccccttgcgtattggtttatcgatgacagcaactattgatacgaagaacgaagacattgccgagatgcctgagctggcttcaaccgtgacctccatgccggcttataccagtaaggctttagttatcgataccagtccgatagaaaaagaaattagcaacattatttcgcataatggacaactttaa

SEQ ID NO: 82084 - protein, 387 aa, Escherichia coli
MEQINSNKKHSNRRKYFSLLAVVLFIAFSGAYAYWSMELEDMISTDDAYVTGNADPISAQVSGSVTVVNHKDTNYVRQGDILVSLDKTDATIALNKAKNNLANIVRQTNKLYLQDKQYSAEVASARIQYQQSLEDYNRRVPLAKQGVISKETLEHTKDTLISSKAALNAAIQAYKANKALVMNTPLNRQPQVVEAADATKEAWLALKRTDIKSPVTGYIAQRSVQVGETVSPGQSLMAVVPARQMWVNANFKETQLTDVRIGQSVNIISDLYGENVVFHGRVTGINMGTGNAFSLLPAQNATGNWIKIVQRVPVEVSLDPKELMEHPLRIGLSMTATIDTKNEDIAEMPELASTVTSMPAYTSKALVIDTSPIEKEISNIISHNGQL

SEQ ID NO: 82085 - DNA, 1032 bp, Escherichia coli
  CDS (1)..(1032)
atggaaagtacgccgaaaaaagctcctcgcagtaaattccctgctctgttagtggttgcgttggcgctggttgcccttgttttcgttatctggcgcgtagacagtgcgccatcaactaatgacgcttacgcgtcagcagataccattgatgtggtaccggaagtcagcggccgcattgtagaactggcggtcaccgacaaccaggcagtcaaacagggcgatttgctgttccgcatcgacccgcgcccgtacgaagccaatctggcgaaagctgaagcctccctcgcggcgctggataagcaaattatgctcacccagcgtagcgttgacgcgcaacagtttggtgccgactcggttaatgccacggtagaaaaagcccgtgccgccgcgaaacaggccacagatacattacgccgcaccgagccattactgaaagaaggttttgtctcagcggaagatgttgaccgtgcaagaacggcgcagcgcgccgcagaagcggatcttaatgccgtattgttacaggcgcagtcagccgccagcgccgtcagcggcgtggatgcattagttgcccagcgtgcggcggtcgaagcggatattgccctgaccaaactgcatctggaaatggcgaccgttcgcgcgccgtttgatggccgggtcatttccctcaaaacctccgtcgggcaatttgcttctgccatgcgccctatttttaccctaatcgacactcgtcactggtatgtgatcgccaacttccgcgaaaccgatctgaaaaatattcgctcaggtacacccgcaacgattcgcctgatgagtgacagcggcaaaaccttcgagggtaaagtggattcgattggctacggcgtgctaccggatgacggcggcctggtgctgggcggcctgccgaaagtgtctcgttctattaactgggtccgcgttgcccagcgttttccggtcaaaatcatggtcgataaacctgacccggaaatgttccgcatcggcgcttcggcagtcgctaatcttgagccgcaataa

SEQ ID NO: 82086 - protein, 343 aa, Escherichia coli
MESTPKKAPRSKFPALLVVALALVALVFVIWRVDSAPSTNDAYASADTIDVVPEVSGRIVELAVTDNQAVKQGDLLFRIDPRPYEANLAKAEASLAALDKQIMLTQRSVDAQQFGADSVNATVEKARAAAKQATDTLRRTEPLLKEGFVSAEDVDRARTAQRAAEADLNAVLLQAQSAASAVSGVDALVAQRAAVEADIALTKLHLEMATVRAPFDGRVISLKTSVGQFASAMRPIFTLIDTRHWYVIANFRETDLKNIRSGTPATIRLMSDSGKTFEGKVDSIGYGVLPDDGGLVLGGLPKVSRSINWVRVAQRFPVKIMVDKPDPEMFRIGASAVANLEPQ

SEQ ID NO: 82087 - DNA, 28 bp, Primer
atgaaaacactaataagaaaattctccc

SEQ ID NO: 82088 - DNA, 23 bp, Primer
ttaaccaaactcacgcaggcgat

SEQ ID NO: 82089 - protein, 386 aa, consensus
  MISC_FEATURE (1)..(386): consensus for the disclosure of xaa see table XV
GXXXXXXXXXXXXVXXGXXLXXXDXXXXXXXXXXAXXXXXXXXXXXXXXXXXXXXXXXXXXXXXXXXXXXXXXXXXXXXXXXXXXXXXXRXXXLXXXXXXXXXXXXXXXXXXXXXXXXXXXXXXXXXXXXXXXXXXXXXXXXXXXXXXXXXXXXXXXXXXXXXXXXXXXAXXXLXXXXXXXPXXGXXXXXXXXXXXGXXXXXXXXXXXXXXXXXXXXXXXXXXXXXXEXXXXXXXXGXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXQRXXVXXXXXXXXXXXXXXXXXXXXXXXXXXXXXXXXXXXXXXXXXXXXXG

SEQ ID NO: 82090 - protein, 41 aa, consensus
  MISC_FEATURE (1)..(41): consensus for the disclosure of xaa see table XV
XXXXXXXXXXXXXXXXXXXXXXXXXXXXXXXXXXXXXXXXX

SEQ ID NO: 82091 - protein, 65 aa, consensus
  MISC_FEATURE (1)..(65): consensus for the disclosure of xaa see table XV
XXXXXXXXXXXXXXXXXXXXXXXXXXXXXXXXXXXXXXXXXXXXXXXXXXXXXXXXXXXXXXXXX

SEQ ID NO: 82092 - DNA, 1647 bp, Escherichia coli
  CDS (1)..(1647)
atgaatggcgcacagtgggtggtacatgcgttgcgggcacagggtgtgaacaccgttttcggttatccgggtggcgcaattatgccggtttacgatgcattgtatgacggcggcgtggagcacttgctatgccgacatgagcagggtgcggcaatggcggctatcggttatgctcgtgctaccggcaaaactggcgtatgtatcgccacgtctggtccgggcgcaaccaacctgataaccgggcttgcggacgcactgttagattccatccctgttgttgccatcaccggtcaagtgtccgcaccgtttatcggcactgacgcatttcaggaagtggatgtcctgggattgtcgttagcctgtaccaagcatagctttctggtgcagtcgctggaagagttgccgcgcatcatggctgaagcattcgacgttgcctgctcaggtcgtcctggtccggttctggtcgatatcccaaaagatatccagttagccagcggtgacctggaaccgtggttcaccaccgttgaaaacgaagtgactttcccacatgccgaagttgagcaagcgcgccagatgctggcaaaagcgcaaaaaccgatgctgtacgttggcggtggcgtgggtatggcgcaggcagttccggctttgcgtgaatttctcgctgccacaaaaatgcctgccacctgtacgctgaaagggctgggcgcagtagaagcagattatccgtactatctgggcatgctggggatgcacggcaccaaagcggcaaacttcgcggtgcaggagtgtgacctgctgatcgccgtgggcgcacgttttgatgaccgggtgaccggcaaactgaacaccttcgcgccacacgccagtgttatccatatggatatcgacccggcagaaatgaacaagctgcgtcaggcacatgtggcattacaaggtgatttaaatgctctgttaccagcattacagcagccgttaaatcaatatgactggcagcaacactgcgcgcagctgcgtgatgaacattcctggcgttacgaccatcccggtgacgctatctacgcgccgttgttgttaaaacaactgtcggatcgtaaacctgcggattgcgtcgtgaccacagatgtggggcagcaccagatgtgggctgcgcagcacatcgcccacactcgcccggaaaatttcatcacctccagcggtttaggtaccatgggttttggtttaccggcggcggttggcgcacaagtcgcgcgaccgaacgataccgttgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgttttttcaggaacgatacagcgaaaccacccttactgataaccccgatttcctcatgttagccagcgccttcggcatccatggccaacacatcacccggaaagaccaggttgaagcggcactcgacaccatgctgaacagtgatgggccatacctgcttcatgtctcaatcgacgaacttgagaacgtctggccgctggtgccgcctggcgccagtaattcagaaatgttggagaaattatcatga

SEQ ID NO: 82093 - protein, 548 aa, Escherichia coli
MNGAQWVVHALRAQGVNTVFGYPGGAIMPVYDALYDGGVEHLLCRHEQGAAMAAIGYARATGKTGVCIATSGPGATNLITGLADALLDSIPVVAITGQVSAPFIGTDAFQEVDVLGLSLACTKHSFLVQSLEELPRIMAEAFDVACSGRPGPVLVDIPKDIQLASGDLEPWFTTVENEVTFPHAEVEQARQMLAKAQKPMLYVGGGVGMAQAVPALREFLAATKMPATCTLKGLGAVEADYPYYLGMLGMHGTKAANFAVQECDLLIAVGARFDDRVTGKLNTFAPHASVIHMDIDPAEMNKLRQAHVALQGDLNALLPALQQPLNQYDWQQHCAQLRDEHSWRYDHPGDAIYAPLLLKQLSDRKPADCVVTTDVGQHQMWAAQHIAHTRPENFITSSGLGTMGFGLPAAVGAQVARPNDTVVCISGDGSFMMNVQELGTVKRKQLPLKIVLLDNQRLGMVRQWQQLFFQERYSETTLTDNPDFLMLASAFGIHGQHITRKDQVEAALDTMLNSDGPYLLHVSIDELENVWPLVPPGASNSEMLEKLS

SEQ ID NO: 82094 - DNA, 1659 bp, Archaeoglobus fulgidus DSM 4304
  CDS (1)..(1659): transl_table=11
atgcgtgctgctgatgccattgtcaaggctttggagatggaaggtatagaggtcgtgtttggaatacccggaggtgcgattattgaggtctacgatgcgctctacgattcgggaataaggcacataacaacgaggcacgagcagggtgcgacccacgcggcagacggctacgcaagggcgagcggcaaagtgggggttgccttcgccacctccggacccggagcgacgaacaccgttaccggcatagctacagcctacatggactcctcaccgctcgttgtcttcaccggccaggttccgaccagcatgatcggaaacgatgcgtttcaggaggccgacataaccggaatcacgatgcccataaccaagcacaactacctggttacggacaccaaagaccttctgggcacgataaaggaggctttccacatagcctcaaccggcagacccggtccggttctcgttgacctgcccaaggacatcacaaccgcagacatagacttcaactaccccaagaaggtcagcctcccgggatacaagccgaagctggaggggcatccgaggcagatagcgaaggcggccgagctgataatgaaggcggagagaccggttatacttgccggtggtggggtcataatctcaaacgcctcaaaggagcttgtcgagcttgcagaaacaatcccggccttcgttgttacaacgctgatgggaaaaggctcaattccagaaacacacccgctgtcactcggattcgccggaatgcacggaacgaagtacgcaaactacgctttgagtgagagcgacttgattatcgcggtcggctgcaggttcagcgacagaacaaccggaaacgtcgcgatgttcgcaccagaggcaaagataatccacatcgacatcgatcctgcagaaataggaaaaaacgtcagagttgacgtccctatagtcggagatgcgaggaaagtccttgcaaagcttaagaaggccgtggagtacaagcaaagaaaagaatgggaggacaaggtgaacgactggaagaagagatatccgctgaagtacaaaaaggaggggttcaagccgcagtacgtgattgagcgcgcctgcgagattatgccggacgctattatcacgacagaggttggacagaatcagatgtgggctgctcagtttttcaaaaccaagtacccaaggcagttcataacaagcggtggattgggaacgatgggtttcggcttccctgcagcgatgggcgcacaggtcgcgtttccagaaaagacagttatagacatcgcaggggatgggagcttcttcatgaacatccaggagcttgcaacatgcgtcaagtacgagattcccgtgaaagttctggttctgaataacggctacctcggaatggtcaggcagtggcaggagctgttctacagagagaggtactctgcaacctgcattggctgcgagaaaacgggatttgaagccatagcaaggggtttcggtgcgataggcatgaccgtcgagaagccttcggaagtcgatgatgcactcaaggaggcaaaggaagtcgacgcgccggtggtcatagacttcagagttgactaccaggcaaacgtcttcccgatggtcccgccgggagcggcgttaaacgagattatcgatgaggagtga

SEQ ID NO: 82095 - protein, 552 aa, Archaeoglobus fulgidus DSM 4304
MRAADAIVKALEMEGIEVVFGIPGGAIIEVYDALYDSGIRHITTRHEQGATHAADGYARASGKVGVAFATSGPGATNTVTGIATAYMDSSPLVVFTGQVPTSMIGNDAFQEADITGITMPITKHNYLVTDTKDLLGTIKEAFHIASTGRPGPVLVDLPKDITTADIDFNYPKKVSLPGYKPKLEGHPRQIAKAAELIMKAERPVILAGGGVIISNASKELVELAETIPAFVVTTLMGKGSIPETHPLSLGFAGMHGTKYANYALSESDLIIAVGCRFSDRTTGNVAMFAPEAKIIHIDIDPAEIGKNVRVDVPIVGDARKVLAKLKKAVEYKQRKEWEDKVNDWKKRYPLKYKKEGFKPQYVIERACEIMPDAIITTEVGQNQMWAAQFFKTKYPRQFITSGGLGTMGFGFPAAMGAQVAFPEKTVIDIAGDGSFFMNIQELATCVKYEIPVKVLVLNNGYLGMVRQWQELFYRERYSATCIGCEKTGFEAIARGFGAIGMTVEKPSEVDDALKEAKEVDAPVVIDFRVDYQANVFPMVPPGAALNEIIDEE

SEQ ID NO: 82096 - DNA, 1728 bp, Archaeoglobus fulgidus DSM 4304
  CDS (1)..(1728): transl_table=11
atggcgcagatttctggaggagagttgcttgtgaggtgtttgataaaggagaatgtcaggtacatctttggagttccgggagggcagcttctcaccttcctcgatgcgataaaaagggttggggagaagcacggaatgaagttcgtaaactgcaggcacgaacaggctgcggcgagcatggcagatgcttacgcaagagttagcggtgagattggggtttgcgttggcacgataggcccgggtggggctgatttggttccgggagtttatcctgcctttgcggacagcgttcccatgctcgtaatcacagctcaaaaccagacgtggaagagctaccctgaccacggctcaatgcaggctttagaccagtaccacctcttcaagccaataacgaagtggaatgcggtggtttcacactgggagaggattccagaactcgttcagagggccataagaattgccctttcgggcaggccggggcctgtgcaccttgatttcccatctgacgtgctctacaacggtcaggaggagagctttgcgaaggtttacgggcctgagcgctacagaccgatgaagccccctgtggggcatcctgagctggtggagaaggctgctgaaatgctctacaacgctgagagaccgctcattcacgcagggacaggggttctgagggctaaggcttggaatgagcttagagagcttgccgagtatcttggagctgttgtaacaaccacaatgggcgggaggggagcaattccggaagaccacccgctctgcatcctccctgcaagtccggcagcaatcacagcccagaacgaggctgatgttattctggttgttggaagcaagatgggcgacttggatttctggggaaagccaccagcatggggtgaccctgagcagcagaagaccattcagatagacatcgacccagagatgattgccctaaaccgcccagttgatgttgcaattgttggagatgctaaggagactctgaaggcgttgattgaggcggtgaagaagaagggggagaagagggagccggttgacaggctcaaggaatacaggaaaatgcagcaggattggcttgaggggtttttgaagctggctgaaagcggtgagaagcccattcacccgctgagggtgattaaggaggtcagggagttttatcccagaaacgccatctcctgcgttgatggaggcaacacggcagtttgggcttcatatctcaacagaatttacgagcccaacaccttcctgtgggcggctgactctggccaccttggcacgggactgccatacgccatcggagcgaagcttgccaaccccgacaggcccgtttacctgatagcgggggatggtgccttcggcctgacaatggaggaacttgagacggcaagcagggaaggggtgaaaattacagctgtggtcatgaacgacggctgctgggggatgattaaaggctcgcagaaggcggcctttggcgggaggttcataggtgttgacttcaaggatgtcagatacgataaagtggctgagtcgatgggatggtacgggcagagggttgaggagcccgaggacattgccacagcactcgacaaggctgaaagctcagacaaaccagctttactggacgtgaaaatctcgcaggaggccaatctctccccgccagacttgattactctctcaatcgtgtggcttgagggctgcaatcctccaccagtatga

SEQ ID NO: 82097 - protein, 575 aa, Archaeoglobus fulgidus DSM 4304
MAQISGGELLVRCLIKENVRYIFGVPGGQLLTFLDAIKRVGEKHGMKFVNCRHEQAAASMADAYARVSGEIGVCVGTIGPGGADLVPGVYPAFADSVPMLVITAQNQTWKSYPDHGSMQALDQYHLFKPITKWNAVVSHWERIPELVQRAIRIALSGRPGPVHLDFPSDVLYNGQEESFAKVYGPERYRPMKPPVGHPELVEKAAEMLYNAERPLIHAGTGVLRAKAWNELRELAEYLGAVVTTTMGGRGAIPEDHPLCILPASPAAITAQNEADVILVVGSKMGDLDFWGKPPAWGDPEQQKTIQIDIDPEMIALNRPVDVAIVGDAKETLKALIEAVKKKGEKREPVDRLKEYRKMQQDWLEGFLKLAESGEKPIHPLRVIKEVREFYPRNAISCVDGGNTAVWASYLNRIYEPNTFLWAADSGHLGTGLPYAIGAKLANPDRPVYLIAGDGAFGLTMEELETASREGVKITAVVMNDGCWGMIKGSQKAAFGGRFIGVDFKDVRYDKVAESMGWYGQRVEEPEDIATALDKAESSDKPALLDVKISQEANLSPPDLITLSIVWLEGCNPPPV

SEQ ID NO: 82098 - DNA, 1782 bp, Mesorhizobium loti MAFF303099
  CDS (1)..(1782): transl_table=11
atgagcaacggacaaagtgaacggcgcgagatgacaggcgccgaaatggtggtgcaggcgctgaaggacaatggcgtcaagcatgtcttcggctacccgggcggcgcggttctcccgatctatgacgagatcttccagcaggacgacgtcgagcacattctcgtgcggcacgagcaaggtgccgggcatgcggccgagggctatgcgcgctcgaccggcaaggccggcgtcatgctggtgacgtcaggccccggcgcgaccaatgcggtgacgccgctgcaggatgcgctgatggattcgatcccgctggtctgcctgacgggccaggtgccgacctccttgatcggctccgacgcgttccaggaatgcgacacggtcggtattacgcgcccctgcaccaagcacaactggctggtgaaggacgtcaacgagctcgccgcgaccatccatgaggctttccacgtcgcgaccacgggccgtccggggccggttgtggtcgacatccccaaggacgtgcagttcgccaagggtttctacgtcccgccgcagatcgcgccgcgcaccagctaccagcccaaggttcagggcgacctggagaagatcaaggccgcggtcgagctgatggccagcgccaagaagccgatcatctattcgggcggcggcgtgatcaattccggtccggaagcgagccatctgctgcgcgaactggtcgaccttaccggtttcccgatcacctcgacgctgatggggctcggcgcctatccggcgtcgggcaagaactgggtcggcatgctcggcatgcacggcacctacgaggccaacatggccatgcatgattgcgacgtgatgatctgcatcggcgcgcgcttcgacgaccgcatcaccggccggctcaatgcgttctcgccgaactcgaagaagatccacatcgacatcgacccgtcctcgatcaacaagaacgtgcacaccgaggtgccgatcatcggcgatgtcggccgggtgctggaggatatggtgcggctgtggcgggcaaccgccaaggccgacaagaaggcgctctatccctggtgggagcagatcgcaaaatggcgtgggcgcgattcactcgcctacaagatgaaccacgacgtgatcatgccgcaatacgccatccagcggctctacgaactgaccaaggacaaggacacctacatcaccaccgaagtcggccaacaccagatgtgggcggcgcagcactatcatttcgaaaagccgaaccgctggatgacctcaggcggtctgggcacgatgggctatggcctgccggcggcactcggcgtgcagatcgcgcatcccgatgcgctggtcatcgacattgccggcgacgcctcggtgcagatgacgatgcaggagatgagtgccgcggtgcagtacaaggcgccgatcaagatcttcatcctcaacaaccagtatatgggcatggtgcggcaatggcagcagctcttgcacggcaaccggctgtcgcattcctacaccgaggcgatgcctgactttgtcaagctggcggaggcctatggcggccatggcatacgctgcgagaagccggacgagctggacgacgccatcaaggagatgatctcggtccggaaacccgtgctgttcgactgccgcgtggcgaacctcgccaactgcttcccgatgatcccgtccggcaaggcgcataacgagatgctgttgccggacgaggccaccgacgaggccgtggccaacgccatcgacgccaagggcagggaactggtttaa

SEQ ID NO: 82099 - protein, 593 aa, Mesorhizobium loti MAFF303099
MSNGQSERREMTGAEMVVQALKDNGVKHVFGYPGGAVLPIYDEIFQQDDVEHILVRHEQGAGHAAEGYARSTGKAGVMLVTSGPGATNAVTPLQDALMDSIPLVCLTGQVPTSLIGSDAFQECDTVGITRPCTKHNWLVKDVNELAATIHEAFHVATTGRPGPVVVDIPKDVQFAKGFYVPPQIAPRTSYQPKVQGDLEKIKAAVELMASAKKPIIYSGGGVINSGPEASHLLRELVDLTGFPITSTLMGLGAYPASGKNWVGMLGMHGTYEANMAMHDCDVMICIGARFDDRITGRLNAFSPNSKKIHIDIDPSSINKNVHTEVPIIGDVGRVLEDMVRLWRATAKADKKALYPWWEQIAKWRGRDSLAYKMNHDVIMPQYAIQRLYELTKDKDTYITTEVGQHQMWAAQHYHFEKPNRWMTSGGLGTMGYGLPAALGVQIAHPDALVIDIAGDASVQMTMQEMSAAVQYKAPIKIFILNNQYMGMVRQWQQLLHGNRLSHSYTEAMPDFVKLAEAYGGHGIRCEKPDELDDAIKEMISVRKPVLFDCRVANLANCFPMIPSGKAHNEMLLPDEATDEAVANAIDAKGRELV

SEQ ID NO: 82100 - DNA, 1647 bp, Mesorhizobium loti MAFF303099
  CDS (1)..(1647): transl_table=11
atgaccaaaggttcggatctgttcgtcgcggccctcgagaatgaaggggtcgaccggatcttcggcattccgggcgaggagaatctcgacatcgtcgaatccatccgtcgctcgtcgatccagttgatcttgacccgccacgagcaggcggccgccttcatggccgccacctatggcaggctcaccggcaaggcaggcgtgtgcatcaccacgcttggccccggcgcgctcaatctgacgaccggcgcggcctatgcgctgctcggcgcgatgccgatgatcatgatcaccggtcagaagggcatattgtcatcgcggcaggcgcgtttccagatcgtcgacatcgtcgcggcgatgaagccgctgaccaagctgtcgcgccagatcgtctcgccgaagatgatcccctcgctggtgcgcgaagccttccgcgttgcccaggaagagcggcccggccccgtccatctggaactgccggaggacattgcggcggccgaatgcgagccggtggcgctggtgccgacacacccggtcgaactgccgttggccagcccgggcgcgctcgatcgcgccgcccgcatgatcatggaggccaaacatccgctgctgatgttcggcgcggcggcgtcgcggccgcgcgtgacccccgatgtcgcccagttcgtgctgcgcacgcaaataccctatttcaccacgcagatgggcaagggcacggtgcctggcggcaccgaactctacatgggaacagcggcgctgtcggagcgcgactatgtgcacgaggccatcgaacaggccgatctgatcataacgatcggccacgacacggtggagaaaccgcccttcatcatgggcgccaatgggccgaaggtcatccatgtcggctaccactcggccgatgtcgagcaggtctatttcccgcaggccgagatcgtcggcgatctcggcccgtcgctggcgctgctggcggaccgtatcgaaggcaagatccccaacgcgcaggccttgctgccgctcagggaaaacattctgagccggatcgccgcgcgcgccaccgaagaccgctttacgccgcagcgcatcgtgcatgacgtgcgcgctgtgatgccggcggacgggatccttgccctcgacaacggcatgtacaagatctggttcgcgcgcaactaccgcacgcgcatggcaaacacgctgctactcgacaatgcgctggccacgatgggcgccggcctgccgtcggcgatgatggcgtcgctgctctttcccacgcgccgcgtgatggccatttgcggcgacggtgggttcatgatgaacagccaggaactggagaccgccgtcaggctgaagctcaacctcgtcatcctgctgctggaagaccatgcctatggcatgatccgctggaagcaggcggtcgacgaattcccggatttcggcatgaccttcggcaatccggatttcgtcaaatacgccgaggcttatggcgccaagggaaccagggttacggagatcgccgatttgcggccggcgctggaacgggccttcaccggcggcggcgtacatctcgtcgtcgtgcccatcgactattccgaaaacaccagggtgcttgtcgacgaattacgcgagcggctgccggcgccgcgtacgccctga

SEQ ID NO: 82101 - protein, 548 aa, Mesorhizobium loti MAFF303099
MTKGSDLFVAALENEGVDRIFGIPGEENLDIVESIRRSSIQLILTRHEQAAAFMAATYGRLTGKAGVCITTLGPGALNLTTGAAYALLGAMPMIMITGQKGILSSRQARFQIVDIVAAMKPLTKLSRQIVSPKMIPSLVREAFRVAQEERPGPVHLELPEDIAAAECEPVALVPTHPVELPLASPGALDRAARMIMEAKHPLLMFGAAASRPRVTPDVAQFVLRTQIPYFTTQMGKGTVPGGTELYMGTAALSERDYVHEAIEQADLIITIGHDTVEKPPFIMGANGPKVIHVGYHSADVEQVYFPQAEIVGDLGPSLALLADRIEGKIPNAQALLPLRENILSRIAARATEDRFTPQRIVHDVRAVMPADGILALDNGMYKIWFARNYRTRMANTLLLDNALATMGAGLPSAMMASLLFPTRRVMAICGDGGFMMNSQELETAVRLKLNLVILLLEDHAYGMIRWKQAVDEFPDFGMTFGNPDFVKYAEAYGAKGTRVTEIADLRPALERAFTGGGVHLVVVPIDYSENTRVLVDELRERLPAPRTP

SEQ ID NO: 82102 - DNA, 1689 bp, Pyrococcus abyssi GE5
  CDS (1)..(1689): transl_table=11
atgtcgggtgcaagggccctcgtgaaagccctggagaaggaaggcgtgaagcatacgtttggaataataggcggaagcataatgcccgtattcgacgagctactcgagagtagcataaggcacataacaacaaggcacgagcaaggtgcagcacatgcagctgatggttacgctagggtctcgggaaaaccaggggttgcgataacaacttcgggaccaggagctactaatctcgtcactggaatagccaacgcctacatggattcatctccaatagtagctatcacaggtcaagttcccacgcacatgattggaaagatggcattccaggagacagatataataagcataacaaagccaatcacgaagtggaattatcagataaggaatcctagggaagttccaaaggccgtaaagatggctttcactatagcaaccctcggtagaccagggccgacgttactcgactttccaaaggatgctcaaactggagaggacgaaatcaactttgatgtggatgtttctagactagtaactccctggagacctccaaagttagatgcctgtcctgaagaggtaaagaaagcagttgatatgatactctccgctgaaaggcctgtgttcatagtgggaggaggagttgtatggagcggtgctaccgaggaagtcctagcgatagcagagtacctaatgataccaataatgtccaccttcatggggaaaggagcagtacccgagaatcatccactctacattgggaaccttggaatgcatggaaagattgcagccaacaagctcctcccccagacggaccttataatagctgtcggcatgaggtggagcgatagaactgtaagcgaatttgagaactttgctccagaggctaagatcatccacatcgacatagatccaaaggaagttggaaagaacgtaaaagtagacctgggaatagtgggagatgccaagagggttctgaggagcatatacagcgaaattactaggggggtcaagaaaagggaggattggccctggttaaagaaggtgagggaattccaggagaagtacaaagaagagcttattcccctcgatggaaattatctcagaccccccgagatcttaaaggaactcagaaagattttacctgaagatgcgatagtcgcaacggaagttgggcaaaaccaaatgtgggtagcactgtacttcccaatattaaagccgaggacatttctcacttctggcggattaggaactatgggctttggattcccagctgctattggagcaaaagttgcgaagcctgacaaggtggtcatcgacatagcaggtgatggaagctttatgatgtccgagagagagttagcaacagcggtaaacgagaaccttccggtaatagtagtgatcctaaacaattcatcccttggaatggttgcccagtggcagaggatgttcttcaacagaagatacgttgctacctacttcaagaagaatcctgacttcgtgaagcttgcagaggcttatggagcccaaggcttcagagctgaaaccatggaagaacttctgaaagccgtgaaggagggtatgaattctgaagttccaaccgtcattgacgtcccgattcaccctgaggatgatgttctccccatggttcctcctggggagcacatttccaaggttgtaacaaggtattga

SEQ ID NO: 82103 - protein, 562 aa, Pyrococcus abyssi GE5
MSGARALVKALEKEGVKHTFGIIGGSIMPVFDELLESSIRHITTRHEQGAAHAADGYARVSGKPGVAITTSGPGATNLVTGIANAYMDSSPIVAITGQVPTHMIGKMAFQETDIISITKPITKWNYQIRNPREVPKAVKMAFTIATLGRPGPTLLDFPKDAQTGEDEINFDVDVSRLVTPWRPPKLDACPEEVKKAVDMILSAERPVFIVGGGVVWSGATEEVLAIAEYLMIPIMSTFMGKGAVPENHPLYIGNLGMHGKIAANKLLPQTDLIIAVGMRWSDRTVSEFENFAPEAKIIHIDIDPKEVGKNVKVDLGIVGDAKRVLRSIYSEITRGVKKREDWPWLKKVREFQEKYKEELIPLDGNYLRPPEILKELRKILPEDAIVATEVGQNQMWVALYFPILKPRTFLTSGGLGTMGFGFPAAIGAKVAKPDKVVIDIAGDGSFMMSERELATAVNENLPVIVVILNNSSLGMVAQWQRMFFNRRYVATYFKKNPDFVKLAEAYGAQGFRAETMEELLKAVKEGMNSEVPTVIDVPIHPEDDVLPMVPPGEHISKVVTRY

SEQ ID NO: 82104 - DNA, 1758 bp, Aquifex aeolicus VF5
  CDS (1)..(1758): transl_table=11
atgccggcaaagaaaggagctgacatagttattgaaacacttaaggctgaaggcgttgaggttgtttttgggcttcccggcggagcgataatggaagtttacgacgccctttacaggctcggagggataaaacacatactcgcaaggcacgaacagggcgccggtcacatggcggaagggtacgcaaaggcaaccggaaaagtaggggttgtaatggtaacatcaggaccgggagccacaaacctcgtcacacccatagcggacgcatatatggactccgttccgcttgtcgcaataacgggacaggtacccacccaccttatcggaaacgatgcctttcaagaagttgatatcgtaggaataacgagacccataaccaagcataactttttagttaagagcatagaggagcttcccctcatcttaagggaggccttttacatagcgagaacaggaagacccggacccgttctcgtggaccttcccaaagacgtcactcagcaaatagcggacgtaaaaataccctctgacgaagaggtaaaggcagcccttcccggatacaagccccacgttgagggaaatccccagcagataaagaaggcagcagagctcataatgtccgcaaaaagacctgttctttacgttggcgggggagctgtaaactcggaagctcaggaggaactaattgaactcgctgaattaatgcagatacccgtaaccaccaccacccagggtaaaggtgcattccccgaaacacaccctctttccctcaggatgctcggaatgcacggaacatattacgcaaatatggcggtttacaactcggacctcctcatagctgtaggtgcgagatttgacgacagggttacgggtaagatagatgaattcgcaccgggagcaaagataattcacatagacatagacccagcttctatttccaagaacataaccgttgacgttcccatagtcggggacgtgaagatagtcctcaggaagctcataaacgaaataaagaaaaggggagcaaagatactctatccagaagagaggaagaagtggctggagcaaatagaaaagtggaaaaaactccatccactgacttacagaaattctgacaaggttataaagcctcagtacgttatagaacagctctgggaagccacgaacggggaagccataatcgttccaggcgttggacagcaccagatgtgggctgcgatgttctacaagttcaaatatccgagacagtttataaattcgggcggacttggaactatgggatttggactgcccgcgggaataggggcaaagataggaagaccggacagagaagtttgggtagtggacggagacggctccttcgttatgaccatgcaggaagtaatcaccgcagttcagtataaagttcccgttaaggtagctattattaacaacgcgtacctcgggatggtaaggcagtggcaggaactcttctacgacaagaggtactccgaagttgacctctcagtccagccggatttcgtaaagctcgcagaagcgatgggcgcggttggtatgagggctaaaaagcctaaggaagtaagagaagttatagaagaggcaagaaagatagacgacagacccgtaattatagacttctgggtagacagggaggaaaacgttctcccaatggttccagcaggaaagtcttacaaggacatgatactcgaagacggaaaaggaaagcacgaagcggaaaccatgtacctcgtaggttaa

SEQ ID NO: 82105 - protein, 585 aa, Aquifex aeolicus VF5
MPAKKGADIVIETLKAEGVEVVFGLPGGAIMEVYDALYRLGGIKHILARHEQGAGHMAEGYAKATGKVGVVMVTSGPGATNLVTPIADAYMDSVPLVAITGQVPTHLIGNDAFQEVDIVGITRPITKHNFLVKSIEELPLILREAFYIARTGRPGPVLVDLPKDVTQQIADVKIPSDEEVKAALPGYKPHVEGNPQQIKKAAELIMSAKRPVLYVGGGAVNSEAQEELIELAELMQIPVTTTTQGKGAFPETHPLSLRMLGMHGTYYANMAVYNSDLLIAVGARFDDRVTGKIDEFAPGAKIIHIDIDPASISKNITVDVPIVGDVKIVLRKLINEIKKRGAKILYPEERKKWLEQIEKWKKLHPLTYRNSDKVIKPQYVIEQLWEATNGEAIIVPGVGQHQMWAAMFYKFKYPRQFINSGGLGTMGFGLPAGIGAKIGRPDREVWVVDGDGSFVMTMQEVITAVQYKVPVKVAIINNAYLGMVRQWQELFYDKRYSEVDLSVQPDFVKLAEAMGAVGMRAKKPKEVREVIEEARKIDDRPVIIDFWVDREENVLPMVPAGKSYKDMILEDGKGKHEAETMYLVG

SEQ ID NO: 82106 - DNA, 1755 bp, Thermotoga maritima MSB8
  CDS (1)..(1755): transl_table=11
gtggttcacgtgaagatgaaaggttcaaagatgttattcgaagcccttctgaaagagggagtcgatacgattttcggtatccctggtggtgccatcatcaacgtatacgatgaactctgcaattacgaagataagataaacttctatcttttcagacacgaacagggagccacacacgcggcagacggttacgcgagggtcacgggaaagcccggagtggtcatcgtcacttccgggccaggtgccacgaacacggtcacaggcatagccaccgcctacatggattcgattccgatcgtggtgatcaccggtcaggttcccacctctttcataggaacagacgcctttcaggaagtggatgtcacgggaatcaccatgcccatcaccaagcacaaccacctcgttacgagtatagaagaacttccttacgcgataaaagaaatgttctacgttgccacaacgggaaggccgggacctgtccttctggacttcccaaaggatatacaaactgccgagggggaattcaactatcctgatacggtggaaattccgggatacaaacccacggtgaaaggccatcccaaacagataaagaaggcggttgaactcttgaaagaatcgaagcgccccgttgtcattgtgggtggtggagcgaatctttccggtgccatggatcttgtgaatcagttcatcgacaaattcaaggttcccgctgtcagcacgctcatgggacgcggtgtgaatccttccgacgagaagctttactacgaaggaatcggaatgcacggtacttactatgggaactacgccgtggccaacgcagatctcatcatcgccctcggtgtgagattcagcgacagaatcctcggaaatcccaggacattcgcgaagaacgccagaatagtccatgttgatatagatcccgccgaaatcggaaagaacgttcgggtagacgtgcccatagtcggcgatctgaagagtgtccttgaggaattcctgaagtacgaaatcgagacggacttctcggactggatcgaagagctccaggagataaagaaaaagtacccgctcacctacaagagggatgggaagctcataaaaccccagtacgttgtggaaaaggtgaacgaggtctttccagacgacacggtggtcgttgcggatgtggggcagaaccagatgtgggttgctcagttctacaagttcaaacaccagaggtctttcctgtgttccggaggactcggaacgatgggatacgcccttcccgctggaataggagccaagataggagccccagacaaggaggttgtagtctttgccggagacggcggtttccagatgaacatacaggagctcatgacgataaaaaggtacaaccttcctgtgaagatcatcgtgatggacaacaaagcgctgggaatggtgagacagtggcagcagctctttttcaactgcagatactctgccaccattctgtctgacaacccggatttcgcgaagatagcggaagctgttggtataaaagcaatgagaatagaaaagcccgatcaggtcgatgaagcgatcgagaaactcgcaaaatccaaagagccgatgctcattcacgccgtcgttgatcccgccgagaacgttcttccgatggtaccaccgggaggagacgtgggaacaccgctcattgaagccccatacgacgaaaccttcgtggaaagagttctgaaggtcatcgaagagagcaggagaggtgatgaaagatga

SEQ ID NO: 82107 - protein, 584 aa, Thermotoga maritima MSB8
MVHVKMKGSKMLFEALLKEGVDTIFGIPGGAIINVYDELCNYEDKINFYLFRHEQGATHAADGYARVTGKPGVVIVTSGPGATNTVTGIATAYMDSIPIVVITGQVPTSFIGTDAFQEVDVTGITMPITKHNHLVTSIEELPYAIKEMFYVATTGRPGPVLLDFPKDIQTAEGEFNYPDTVEIPGYKPTVKGHPKQIKKAVELLKESKRPVVIVGGGANLSGAMDLVNQFIDKFKVPAVSTLMGRGVNPSDEKLYYEGIGMHGTYYGNYAVANADLIIALGVRFSDRILGNPRTFAKNARIVHVDIDPAEIGKNVRVDVPIVGDLKSVLEEFLKYEIETDFSDWIEELQEIKKKYPLTYKRDGKLIKPQYVVEKVNEVFPDDTVVVADVGQNQMWVAQFYKFKHQRSFLCSGGLGTMGYALPAGIGAKIGAPDKEVVVFAGDGGFQMNIQELMTIKRYNLPVKIIVMDNKALGMVRQWQQLFFNCRYSATILSDNPDFAKIAEAVGIKAMRIEKPDQVDEAIEKLAKSKEPMLIHAVVDPAENVLPMVPPGGDVGTPLIEAPYDETFVERVLKVIEESRRGDER

SEQ ID NO: 82108 - DNA, 1725 bp, Pasteurella multocida subsp. multocida str. Pm70
  CDS (1)..(1725): transl_table=11
atgaaaaagttatctggcgcagaaatggttgtgcagtctttgcgagatgaaggcgttgagtttttatttggttatcctggcggatcggttttagatatttatgatgcgattcataccttggggggcattgaacatattcttgtccgacatgaacaagccgctgtgcacatggcagatggttatgccagagcgaccggtaaagtgggttgtgttcttgtgacatccggacccggtgcaactaataccatcactggtattgcaacagcgtatatggattccgtgcctttgattattttatctggacaggtgatgtcaggattaattggcagtgatgcttttcaagaatgcgatatggtgggtatctctcgtccagtcgtcaaacacagttttttagtgaaatctgcggctgaaattcctgaaaccattaaaaaagctttttatattgcgtcaacaggcagaccgggacctgtggtgatcgatttgccaaaggatgtggttaatcctgcacataaatttacttatcattatccagaaagagttgaattacgttcttataatccaacaatacaagggcataaagggcaaattaaaaaagcattaaaagccttattagtcgcgaaaaagccggtgttatttgttggtggtggtgtcatcactgcgaattgtagcgacaaattaacgcaatttgcacaaaccttaaatttgccggtcacttcctccttaatgggattaggtgcctatccaagctcagataagcaattcttagggatgttaggcatgcatggtacttacgaagcgaataatgcaatgcatcatagtgatctcattcttggtattggtgtgcgttttgatgatagaacgactaataacttggcaaaatattgtccacatgcaaaagtgattcatattgatattgatccaacgtctatttctaaaaatgtattggcatctattccaattgtgggcagtgcagaaaaagtcattaatgaatttttagccttattagaggatgacaatttattaaaatcgcaaactgccttggatgaatggtggcagcaaattgatgaatggaaagcagtaaaatgtctctcttttacacgagatgattccgtcattaaaccacagcaagtgatggaagtggtttatcgattaacacaaggtgaggcttatgtcgcctcagatgttggacaacatcaaatgtttgcggcattacattatccgtttaaccaacctcggcgttggattaactctggtggcttagggaccatgggctttggactaccagccgcacttggggtaaagctcgcttatcctgactcaacagtggtgtgtgtgacgggggatggcagtattcaaatgaatattcaagagctttctactgcacagcaatatgatattccaattgtgattatcagtttgaataaccgctttttaggcatggtgaaacagtggcaagatctgatttattctggacgccattcacagtcttatatgaattctttacctgattttgtgaagcttgctgaggcttatggacatgtgggtatccaaattaatacgccagatgaattagaggaaaaactcactcaagcattttcgatgaaagataaattagtatttgtcgatattaatgttgatgcgacggaacatgtttatccgatgcaagtacgtggtggtgcaatgaatgaaatgattttaacaaaaccggagaaggcgaatgcgtag

SEQ ID NO: 82109 - protein, 574 aa, Pasteurella multocida subsp. multocida str. Pm70
MKKLSGAEMVVQSLRDEGVEFLFGYPGGSVLDIYDAIHTLGGIEHILVRHEQAAVHMADGYARATGKVGCVLVTSGPGATNTITGIATAYMDSVPLIILSGQVMSGLIGSDAFQECDMVGISRPVVKHSFLVKSAAEIPETIKKAFYIASTGRPGPVVIDLPKDVVNPAHKFTYHYPERVELRSYNPTIQGHKGQIKKALKALLVAKKPVLFVGGGVITANCSDKLTQFAQTLNLPVTSSLMGLGAYPSSDKQFLGMLGMHGTYEANNAMHHSDLILGIGVRFDDRTTNNLAKYCPHAKVIHIDIDPTSISKNVLASIPIVGSAEKVINEFLALLEDDNLLKSQTALDEWWQQIDEWKAVKCLSFTRDDSVIKPQQVMEVVYRLTQGEAYVASDVGQHQMFAALHYPFNQPRRWINSGGLGTMGFGLPAALGVKLAYPDSTVVCVTGDGSIQMNIQELSTAQQYDIPIVIISLNNRFLGMVKQWQDLIYSGRHSQSYMNSLPDFVKLAEAYGHVGIQINTPDELEEKLTQAFSMKDKLVFVDINVDATEHVYPMQVRGGAMNEMILTKPEKANA

SEQ ID NO: 82110 - DNA, 1650 bp, Pasteurella multocida subsp. multocida str. Pm70
  CDS (1)..(1650): transl_table=11
atgaatggggcaagattagtaaccgagagtttgaaaacacatggcgtaaccaccgtttttggctatcccggtggggcgattatgccagtttatgatgcgctgtatgatgcgggcatagaacatttattgtgtcgtaatgagcaaggtgcagcgatggcagccattggctatgcgcgttcaagtggcaaagttggcgtgtgtatcgccacttctggtccgggtgcagcaaacttgatcaccggcttaggggatgccttaatggattcgattccagttgttgcgatcactgggcaagtggcttctcccttgatcggtacggatgcgttccaagaagcggatgtgctcggtttatctcttgcttgtaccaaacacagctttttagtgcaaagcatcgaagaattgccagacgtgattgctaaagcctttgaaattgctgccagtgggcgtccgggtccagttttgatcgatattccaaaagatatccaaattgccccaaccgatgtcacgccgttcacttattctgtggcaaaacccaccgcactttcacaagcgcatttaacagatgcacttacgttactcaaacaagcaaaacgccccgtgctgtatgtcgggggcggtgtaggtatggcgcaagccgtaccagcgttgcgtgagtttcttgcagtaacgcaaatgccaagtgtgtccaccctaaaaggtttaggttcagttcacccggataatccttattatatgggcatgattggtatgcacggcaccaaagccgcaaactatgcggtgcaagaatgtgatttattattggcatttggtgcacgctttgatgatcgtgtaacaggtaagctggatacgtttgccccccatgccaaagtgatccatgctgatattgatatggctgaaattgggaaattacgccgtccagatgtggcattgtgtggggatattgttcaggctttcaatgccctaagcatcccgttgaacattgctgagtggcaagcacatatcaaacaactcaagcaaacacacgatttttgttactcgacaaaccaaggggatactttcattaatccgttatggttgctgaattcattatcaaagaagaaaccacaaagtgcggtgattaccaccgatgttggacagcatcaaatgtggtcagcccagcatatgcaacattatgctcctgaaaactacattacctcagccggttacggcaccatgggctttggtttgccagcagcaattggcgcgaaaaaagcccgtcctgacgatgaggtgatcttaatttctggcgatggctctatcatgatgaatattcaagaattaggcaccttcaaacgcggaaaaacaccggtgaaaattgtgttgttagacaatcaacgtttaggcatggttcgtcagtggcaagagctgttcttcaacgccagatttagtaatacgattttagatgacaaccccgatttcgtgatgcttgccgctgcgttcggtattcaaggcgaacgcatcaccaaaggagaagaagtggaaggtgcactcgatcgtttattagcgagcaaagaagcctatttcttacatgtgtgtatttcaagtaatgaaaacgtttggccattggtaccaccgaatgcctgcaaccttgatatggttgaacaaatgtaa

SEQ ID NO: 82111 - protein, 549 aa, Pasteurella multocida subsp. multocida str. Pm70
MNGARLVTESLKTHGVTTVFGYPGGAIMPVYDALYDAGIEHLLCRNEQGAAMAAIGYARSSGKVGVCIATSGPGAANLITGLGDALMDSIPVVAITGQVASPLIGTDAFQEADVLGLSLACTKHSFLVQSIEELPDVIAKAFEIAASGRPGPVLIDIPKDIQIAPTDVTPFTYSVAKPTALSQAHLTDALTLLKQAKRPVLYVGGGVGMAQAVPALREFLAVTQMPSVSTLKGLGSVHPDNPYYMGMIGMHGTKAANYAVQECDLLLAFGARFDDRVTGKLDTFAPHAKVIHADIDMAEIGKLRRPDVALCGDIVQAFNALSIPLNIAEWQAHIKQLKQTHDFCYSTNQGDTFINPLWLLNSLSKKKPQSAVITTDVGQHQMWSAQHMQHYAPENYITSAGYGTMGFGLPAAIGAKKARPDDEVILISGDGSIMMNIQELGTFKRGKTPVKIVLLDNQRLGMVRQWQELFFNARFSNTILDDNPDFVMLAAAFGIQGERITKGEEVEGALDRLLASKEAYFLHVCISSNENVWPLVPPNACNLDMVEQM

SEQ ID NO: 82112 - DNA, 1659 bp, Pseudomonas aeruginosa PAO1
  CDS (1)..(1659): transl_table=11
atgtccgactcccttccccagcgcaacggcgggcagatcctggtagaggcattgcggcgcaatgccgtcgataccgtctactgcatccccggggaaagctacctgccggtgctcgacgcgctgtacgacaccgacggcatccgcaccgtcgtcacccgccacgagggtgccgcctcgaacatggccgatgcctacggcaagctgaccggccgaccaggcatctgcttcgtcacccgcggccccggtgccacccatgcggcgaatggcgtgcacacggcgcagcaggactcgacgccgatgatcctgttcgtcggccaggtggaaagcgccttcaagggccgcgaggcgttccaggaagtcgactacgtgcagatgttctcgggcctggccaagtgggccgtggaaatcgaccgtatcgaacgcatcccggagatcgtcggccgcgccttcagcgtcgccacctcgggccgaccgggcccggtcgtggtcgccctgcccgaggaaatcctcttcggttccgcgcaggtcgccgatgcgccggagccaagggtgcttccggggcggccgggcgccacggcgatggcggaactgcgcgaactgctggcgaacgccaggcgccccctgctggtacttggcggcagcggctgggacagcgccgccaggaaacggctaggcgccttcgtcgaggccaatggcctgccggtggccacctcgttccgtcgtcaggacctgttcgacaaccgtgacccgcactacgccggacaactgggcttcggcgcggcgccggcgctattggagcggctgcgccaggccgacctgctgctggtggtcggggcgcgcctgggcgaaacgccgagcgccggctacagcctggtgcgtagtccggcccccgcgcagacgctgatccacgtgcatccggacagcgcggaactgaaccgcgtctacctggcgcgattgccgatccaggccaccccgtgtgccttcgccgaggccctggccgacctcgcgccgttgccctcgagcacctggcaggactggcgcgaagccgcccatgccgattacctggcctactcgaccccggccgcgagcgaccccgccgtccagggcgtcgacctggcgtccgtggtcgcgtacctcagcgaaaacctgccggacgacgcggtgatcgccaacggtgccggcaactatgccgtctgggtgcatcgcttctaccgctatcgccaggcccgcacgcagttggcgccgaccaacggcgccatgggctacggcctgcccgccgcgatcgccgccagcctgcgcgatccgcagcgcagcgtggtgtgcttcgccggcgacggctgtttcatgatgtatccgcaggagctggcgaccgccgcgcagttcggcgcgacgccggtggtgatcgtggtcaacaacggcatgctcggcaccatccgcatgcatcaggagcgcgaatatcccgggcgggtatccgccacccgcctggacaaccccgacttcgtcgccctggcgcgagccttcggcgcccacgccgaacgagtggaatgcagcgccgacttccccgccgcattccgccgcgcccgcgaaagcggacgcccggcgctgctggagctgctgaccgacccacgccagatcacgccgcaggcgcgcctcgcctga

SEQ ID NO: 82113 - protein, 552 aa, Pseudomonas aeruginosa PAO1
MSDSLPQRNGGQILVEALRRNAVDTVYCIPGESYLPVLDALYDTDGIRTVVTRHEGAASNMADAYGKLTGRPGICFVTRGPGATHAANGVHTAQQDSTPMILFVGQVESAFKGREAFQEVDYVQMFSGLAKWAVEIDRIERIPEIVGRAFSVATSGRPGPVVVALPEEILFGSAQVADAPEPRVLPGRPGATAMAELRELLANARRPLLVLGGSGWDSAARKRLGAFVEANGLPVATSFRRQDLFDNRDPHYAGQLGFGAAPALLERLRQADLLLVVGARLGETPSAGYSLVRSPAPAQTLIHVHPDSAELNRVYLARLPIQATPCAFAEALADLAPLPSSTWQDWREAAHADYLAYSTPAASDPAVQGVDLASVVAYLSENLPDDAVIANGAGNYAVWVHRFYRYRQARTQLAPTNGAMGYGLPAAIAASLRDPQRSVVCFAGDGCFMMYPQELATAAQFGATPVVIVVNNGMLGTIRMHQEREYPGRVSATRLDNPDFVALARAFGAHAERVECSADFPAAFRRARESGRPALLELLTDPRQITPQARLA

SEQ ID NO: 82114 - DNA, 1644 bp, Pseudomonas aeruginosa PAO1
  CDS (1)..(1644): transl_table=11
atggccaaggcagccgatgtggttgtgcaatgcctggaaaacgagggcgtgcagtacgtcttcggaattcccggcgaggagaatctcgacctgctggagtccctgcgcaagtcgcagatccggctggtgctcacccgccacgaacaatcggccggcttcatggccgccacctatgggcgcctcaccggcaagaccggggtcagcctgtcgaccctcggcccaggcgccaccaacctggtgaccgccggcgcctacgcctacctgggcggcatgccgatgctgatgatcaccgggcagaagccgatcaagaagtccaagcagggccgcttccagatcctcgacgtggtcggcatgatgcagccgctgaccaagtacacccaccaactggcctccgccgacaacattccctcgcgggtccgcgaggcgttccgcctggccgaggaagagaagcccggcgcggtgcacctggagctgccggaggacatcgccgccgagcagaccgacagcctgcccatcccgccgagcctgagccgccggccgctggcggaatacaaggcgatctgcgccgcggtggagaagctgcgcgccgcgcgcagcccgatcctggtgatcggcgccggggccaaccgcaagatgaccgccaaggtcctcaagcaactgatcgacaagaccggcattcccttcgtcaccacccagatgggcaagggcgtggtcgacgagcgtcacccgcgcttcctcggcaacgccgcgctgtccgccggcgacttcgtgcatcgcgcggtggaggcggccgacctgatcgtcaacgtcggccacgacgtgatcgagaagccgccgttcttcatggttcgcggcggtaccgaggtgatccacgtgaacttccgttccgccgaggtggacccggtgtatttcccgcagatcgaagtggtgggcgacatcgccaacgccatctggcagatcggcgaggcgctggacgataccgcgcactgggacttcacccgcctgctggcgatccgcgaggccaacgaggcgcaggtcgccgaaggcgccgacgacccgcgcttcccgctctacccgcagcgcctggtggccgacgtgcgccgggcgttgccgtcgcagggaatcgtcgccctggacaacggcatgtacaagatctggttcgcccgcaactacaaggcacacatgcccaacaccgtgctgctggacaacgccctcgccaccatgggcgccggcctgccctcggcgatggccgcgcacctggtctacccggaccggccgatcgtcgcggtgtgcggcgatggcggcttcatgatgaacagccaggaactggaaaccgcggtgcggctgaagatgaacctgacggtgatcatcctgcgcgacaacggctacgggatgatccgctggaagcaatcgaacatgggcttcgccgacttcgggctggactacggcaacccggacttcgtgcactacgccgaggcctacggcgcccacggccaccgggtcgacagcgccgagggcttcctgccgctgctggagcgctgcctgggcacgcccggggtgcatgtgatcgattgcccggtggattactcggagaacgaccgcatcctcaacgtcgagttgcgcgaacgcgccctggcggtctga

SEQ ID NO: 82115 - protein, 547 aa, Pseudomonas aeruginosa PAO1
MAKAADVVVQCLENEGVQYVFGIPGEENLDLLESLRKSQIRLVLTRHEQSAGFMAATYGRLTGKTGVSLSTLGPGATNLVTAGAYAYLGGMPMLMITGQKPIKKSKQGRFQILDVVGMMQPLTKYTHQLASADNIPSRVREAFRLAEEEKPGAVHLELPEDIAAEQTDSLPIPPSLSRRPLAEYKAICAAVEKLRAARSPILVIGAGANRKMTAKVLKQLIDKTGIPFVTTQMGKGVVDERHPRFLGNAALSAGDFVHRAVEAADLIVNVGHDVIEKPPFFMVRGGTEVIHVNFRSAEVDPVYFPQIEVVGDIANAIWQIGEALDDTAHWDFTRLLAIREANEAQVAEGADDPRFPLYPQRLVADVRRALPSQGIVALDNGMYKIWFARNYKAHMPNTVLLDNALATMGAGLPSAMAAHLVYPDRPIVAVCGDGGFMMNSQELETAVRLKMNLTVIILRDNGYGMIRWKQSNMGFADFGLDYGNPDFVHYAEAYGAHGHRVDSAEGFLPLLERCLGTPGVHVIDCPVDYSENDRILNVELRERALAV

SEQ ID NO: 82116 - DNA, 1623 bp, Lactococcus lactis subsp. lactis Il1403
  CDS (1)..(1623): transl_table=11
atgctccccttgtatgatgcgattcataattttgaaggaattcaacatattttagcccgtcatgagcaaggagcaacgcatgaagccgaaggttacgctaaatcgtctggtaaagttggtgtcgtcgttgttacgtctggaccgggagcgactaatgcagtaaccggaattgctgacgcttatcttgattcagtcccattgttagttttcacaggtcaagttggccctctgtcaattggtaaagatgcttttcaagaagcagatactgttggaattacagccccaattacaaaatataattatcaaattagggaaactgcagatattccaagaattgttacagaagcctattatttggcaaggacaggacgtcctggaccagtagaaattgatttaccaaaagatgtttccacccttgaagtcactgaaattaatgacccaagcttgaatcttcctcattatcacgaaagtgaaaaagcgactgatgaacaattgcaagaattactgacagaactttctgtcagtaaaaaaccagtcattattgctggcggaggaattaattattctggctcagttgatattttcagagcatttgtcgaaaaatatcaaattccagttgtttctacattgcttggcttaggaacattaccaatcagccacgaattgcaactaggaatggcaggaatgcacggttcatacgctgcaaatatggctttagttgaagctgactatattattaatttgggatcacgttttgacgatagagttgtatccaatcctgcaaaagttgctaaaaatgctgtcgttgctcatattgatattgacgctgctgaacttggcaaaattgtaaaaaccgatattccaatcctttctgatttgaaagcggctttaagcagacttttgcaattaaataaggtcaggactgactttaatgattggattaaaactgtcactaaaaataaagagaaagcaccatttacttatgagccccaaaaccatgatatccgtccacaggaaacaattaaattaattggagaatacactcaaggagatgcaatcattgtgaccgatgttgggcaacatcaaatgtgggtggcgcaatattatccttataaaaatgcaaggcaacttattacttctgggggaatgggaacgatgggctttggcattcctgcagcaatcggtgcaaagctggcacagccaaataaaaatgtcattgtttttgttggcgatggtggctttcaaatgactaatcaagaattagcattacttaatggctacggtattgcaatcaaagttgttctgattaataatcattcattgggaatggtacgtcaatggcaagaatcattctatgaagagcgacgttcacaatcggtttttgatgttgaacccaattttcaattgttagccgaagcttatggcatcaaacatgttaagttagataatccaaaaactttggctgatgatttaaaaattattacagaagatgagccaatgcttattgaagttctaatttcaaaatctgaacatgttttaccaatgataccagctgggttacacagtgacgaaatgattggacttcattttactgatgagaatgaggaggtagataatgcgtag

SEQ ID NO: 82117 - protein, 540 aa, Lactococcus lactis subsp. lactis Il1403
MLPLYDAIHNFEGIQHILARHEQGATHEAEGYAKSSGKVGVVVVTSGPGATNAVTGIADAYLDSVPLLVFTGQVGPLSIGKDAFQEADTVGITAPITKYNYQIRETADIPRIVTEAYYLARTGRPGPVEIDLPKDVSTLEVTEINDPSLNLPHYHESEKATDEQLQELLTELSVSKKPVIIAGGGINYSGSVDIFRAFVEKYQIPVVSTLLGLGTLPISHELQLGMAGMHGSYAANMALVEADYIINLGSRFDDRVVSNPAKVAKNAVVAHIDIDAAELGKIVKTDIPILSDLKAALSRLLQLNKVRTDFNDWIKTVTKNKEKAPFTYEPQNHDIRPQETIKLIGEYTQGDAIIVTDVGQHQMWVAQYYPYKNARQLITSGGMGTMGFGIPAAIGAKLAQPNKNVIVFVGDGGFQMTNQELALLNGYGIAIKVVLINNHSLGMVRQWQESFYEERRSQSVFDVEPNFQLLAEAYGIKHVKLDNPKTLADDLKIITEDEPMLIEVLISKSEHVLPMIPAGLHSDEMIGLHFTDENEEVDNA

SEQ ID NO: 82118 - DNA, 1734 bp, Methanothermobacter thermautotrophicus str. Delta H
  CDS (1)..(1734): transl_table=11
gtgtttccaatgaaaggtggccaggcaataatcagatcacttctggatcagggagcagacaccgtattcggataccccggtggacagttactgccactctatgatatgctctatgattctgaacttaaacacatcctcgtaagacatgaacagtgcgcagcacacgctgcagacggatatgcaagggcctcaggaagggtgggggtctgcatagctacctccggtcccggggcaacaaaccttgtaacaggcattgcaacggcctacatggactcagcccccatcgtggccattgcaggtcaggtcccaacacacctcattggaaatgatgcattccaggaggtggacatgatagggataaccatgcccatcaccaagcacagtttccagccatcagacgccagcgagatacctgcaattgtcagggcaagcttccacatagcaaagacaggacggccaggaccggttgttatagacctccccaaggatatacaggaacaggagatcatggaggaggttgatgacctggagctcccagggtacaggcccaatgtaaagggccaccccctccagataaagagggccgctgaactcataaggaggtcagaaaaacccgtcatacttgctggtggaggagttataatatcaggggcgtccagggagataaaggaattatcagatctcataaaggccccggtgacaacaacactccttggtaagggttcctttcctgaggaccacccttcagccatgggtatgctcggcatgcacggccgcaaggtggcgaacctgacagtggacgaatgcgactgcctcatagccgttggatgcagattctcagaccgtacaacagggaacgttgcagaattcgcccccaacgccaggataatacacgtcgacatcgaccccgctgagataggtaagaacgttggggttgatgtccccatcgttggagatgcaagaaacgtcctcagggaactcatagcaaaactcaaaaaatatgaaaagagggacagccaatggcttgaaagcgtccagaaattccgtgccgattgcatgccaaggatgagctatgatgaggtgcccctgaagccccagcaggttataaaggagataagccaggtccttgatgacgagacggtcgttacaacggatgtgggacagaaccagatgtggatggcccacttctacacatcccgtgcccccagaaagttcatatcatcaggaggccttggaacaatgggcttcggttttccagccgccataggtgccaaggtggcactgcctgatagtgacgttgttgcagtgtgcggtgacggcggattcctcatggtctgccaggaccttgcaaccataagggaatacgacatcccggtggtgatatgtatcatggacaacaggcaccttggaatggtggcgcagtggcagcgcctcttctatgatgagagaatgtcccatacacacctgggcgaagttccggactttgtgaagctggctgaatcatttggagtggaggctgagaggatagaggaacccggtgaaacctctgaagccctttcaagggcaataaggtctggtgaacctgccctccttgatatagtgatagatcctgatgagatactccccatggtcccccccggctgtggtctcaccgagatagtgggggagtaccgggttgaaagggaggacccccaggaaattaaatactccccagggaaggcggatggtgattga

SEQ ID NO: 82119 - protein, 577 aa, Methanothermobacter thermautotrophicus str. Delta H
MFPMKGGQAIIRSLLDQGADTVFGYPGGQLLPLYDMLYDSELKHILVRHEQCAAHAADGYARASGRVGVCIATSGPGATNLVTGIATAYMDSAPIVAIAGQVPTHLIGNDAFQEVDMIGITMPITKHSFQPSDASEIPAIVRASFHIAKTGRPGPVVIDLPKDIQEQEIMEEVDDLELPGYRPNVKGHPLQIKRAAELIRRSEKPVILAGGGVIISGASREIKELSDLIKAPVTTTLLGKGSFPEDHPSAMGMLGMHGRKVANLTVDECDCLIAVGCRFSDRTTGNVAEFAPNARIIHVDIDPAEIGKNVGVDVPIVGDARNVLRELIAKLKKYEKRDSQWLESVQKFRADCMPRMSYDEVPLKPQQVIKEISQVLDDETVVTTDVGQNQMWMAHFYTSRAPRKFISSGGLGTMGFGFPAAIGAKVALPDSDVVAVCGDGGFLMVCQDLATIREYDIPVVICIMDNRHLGMVAQWQRLFYDERMSHTHLGEVPDFVKLAESFGVEAERIEEPGETSEALSRAIRSGEPALLDIVIDPDEILPMVPPGCGLTEIVGEYRVEREDPQEIKYSPGKADGD

SEQ ID NO: 82120 - DNA, 1575 bp, Methanothermobacter thermautotrophicus str. Delta H
  CDS (1)..(1575): transl_table=11
atgaagatgtgtgcggaggtccttgcagggatcctggaggaagctggtttcacccatatcttcgggcacccgggtgaacagatactgccactctatgaggccctcagaaaatccgggcttgaacatgttctcatgagacacgaacagggagccgtccacgccgcagatggctacgccagggcctctggaggaccgggggtctgtgttgccaccggaggacctggcgcccttaatcttgtgatgggtgtggctgcagccagcacagattccgtacccctcattgccatgaccggtgacctgccacggggtgggggccccggcaggttccaggaggttgaccttgaggcggttttcagagcccttacaaggatgagcatgaccccggggagtggtgatgaggcctccatgatgctggctgactccataagctccctcaggagggggcttaccggtgtcatacacataaacctgccaagggacgtccttgaagaggatgcatgcccccctgtggggccatctgaagtgtttagggagcttccagacatgagcagagcgctggaacttctgggatccgcgagaaggccccttatacttgcaggtggtggtgtaatctgggggaacgccgttggtgagttcagggaattcatagagaatgccaggatcccggtggtgaccacctacagtgcaaggggtgttatacccgaggaccatccactctgcctgggaatgaccggtacccgggggaccccggcagctaaccatgctgcagggaactgcgacgttctcctggtcctcggggcgaggctctcagagaggaccctggcagccacaggaaatccccgcgtaatacacgtcaacactgacccctctgtactgaggggtgatgttgtgctggagatggatgtgggggatttcctgagggaactgcctgaattaaaaggaccggaggggtggtttaaggaacttgcagcctaccggagggataacccgcccatcagtgagttacagccccccggtgggggtgcatttgtaacatcatctgctgtgaggggtatccttgatgcagcccccgatgccaccatagtcaacgatgccggtagccacaccacctgggtgaccctccaccggcgggttctccgtgagagatccctcatattctccggtggcttcgggcccatgggttacggtctcccggcggccatcggtgcaaagcttgcagacccatccagggatgtcatcatgatagcgggtgacggcggatttcagatgactatccaggaacttggcaccgttgctgagctggagctgcccatcaccatgtgcatcctgaataaccagaagctcgatgttataaggcagtggcaggagatgaactacggcaccagttactctgttgaactgaagaaccctgatttcattagacttgcagatgcctacggtataggtgcggagaggatcctcaggttggaagatgtctcaggtgccgtggagagggcccttgagtcaggtgaaccccgcctcctggagttcatggttgaaggggaggacataccacttcccggggtcaggccctga

SEQ ID NO: 82121 - protein, 524 aa, Methanothermobacter thermautotrophicus str. Delta H
MKMCAEVLAGILEEAGFTHIFGHPGEQILPLYEALRKSGLEHVLMRHEQGAVHAADGYARASGGPGVCVATGGPGALNLVMGVAAASTDSVPLIAMTGDLPRGGGPGRFQEVDLEAVFRALTRMSMTPGSGDEASMMLADSISSLRRGLTGVIHINLPRDVLEEDACPPVGPSEVFRELPDMSRALELLGSARRPLILAGGGVIWGNAVGEFREFIENARIPVVTTYSARGVIPEDHPLCLGMTGTRGTPAANHAAGNCDVLLVLGARLSERTLAATGNPRVIHVNTDPSVLRGDVVLEMDVGDFLRELPELKGPEGWFKELAAYRRDNPPISELQPPGGGAFVTSSAVRGILDAAPDATIVNDAGSHTTWVTLHRRVLRERSLIFSGGFGPMGYGLPAAIGAKLADPSRDVIMIAGDGGFQMTIQELGTVAELELPITMCILNNQKLDVIRQWQEMNYGTSYSVELKNPDFIRLADAYGIGAERILRLEDVSGAVERALESGEPRLLEFMVEGEDIPLPGVRP

SEQ ID NO: 82122 - DNA, 1728 bp, Neisseria meningitidis Z2491
  CDS (1)..(1728): transl_table=11
atgcagctatcaggcgcgcaaatcatagtgcagagtctcaaagccgaaggtgtcgagtacgttttcggttatcccggcggtgcggttatcgaaatctacgatgcccttttccaactcaataaattcaagcacattctgacccgtcacgagcaggcggcagtacacgcggcagatgcgtatgcgcgcgtcagcggtaaggtgggcgtggcattggttacatccggcccgggcgttaccaatgcactgaccggtattgctactgcctatacggattcgattccgatggtggtcatcagcgggcaggtaggcaattccctgattggtacggatgcgttccaagaagttgatacggtgggtattacccgtccgtgcgtcaaacacaatttcctggttacggacatcaatgagttggcggaaaccattaaaaaggcgttccaaattgccgcaagcggccgaccggggcccgtggtggttgatgtcccgaaagatgttacgcaggcgatggcgaaattcagctatcctcaggaagacatttttatccgttcgtatcaaccggttgttcaagggcatatcggtcagattaaaaaggccgtgcagatgttggcatctgccaaacgtccggtcgtctattttggcggcggcgtggtgttgggtaatgcttctgaagagctgacccgatttgtccgaatgacgggtgctccgtgcacgggtacgctgatgggcttgggcgcttatccttccggcgaccgccaattcctcggtatgctcggtatgcacggtacttacgaggcaaaccttgccatgcagaatgcggatgtcgttcttgccgtaggtgcgcgttttgacgaccgtgtggtttccgtaccgtccaaatttttcgagaaggcgaagaaggttatccatatcgatgtcgatccttccagcatcgccaaacgcgtgaaggcggacattccgattgtcggcgacgtgaaaaacgttttgtccgagatggttgcgctgtggcaaaaacaagagtccgtgccgtctgaagatgctttgggcaaatggtggaaaaccatagaggaatggcgttcccgcgattgcttgtggtttgacaacggcagcgaaattatcaagccacaatatgtgattcagaagcttgccgagattaccggcaattcggcaatcatcacatcggatgtagggcagcatcaaatgtttgcggctcaatattatcccttcgaacgtccgcgccaatggctcaactccggcggtttgggtacgatgggcgttggtctgccttatgcgattggtgcaaaacttgccgccccggatcaagacgtattctgtattaccggcgacggctcgatccagatgaacatccaagagctgtccacctgtttccaatatcggattccggttaacgtcattacgctgaacaacggttatctcggtatggtacgccagtggcaggaaatatattacggcggacgagagtcggaaacctatttcgattctttgcccgatttcgtcaaacttgccgaggcatacggccatatcggtatccgcgtggacaagaagtctgatgtggaaggtgcgttgttggaagcattgaaccaaaaagacaggctggtgtttatcgacttcctgaccgaccagaaacagaatgtgatgcccatggtcggcaacggcaaaggtttggacgaaatggtacttccgccgcatatgcgtgcggacggaaaggcgtaa

SEQ ID NO: 82123 - protein, 575 aa, Neisseria meningitidis Z2491
MQLSGAQIIVQSLKAEGVEYVFGYPGGAVIEIYDALFQLNKFKHILTRHEQAAVHAADAYARVSGKVGVALVTSGPGVTNALTGIATAYTDSIPMVVISGQVGNSLIGTDAFQEVDTVGITRPCVKHNFLVTDINELAETIKKAFQIAASGRPGPVVVDVPKDVTQAMAKFSYPQEDIFIRSYQPVVQGHIGQIKKAVQMLASAKRPVVYFGGGVVLGNASEELTRFVRMTGAPCTGTLMGLGAYPSGDRQFLGMLGMHGTYEANLAMQNADVVLAVGARFDDRVVSVPSKFFEKAKKVIHIDVDPSSIAKRVKADIPIVGDVKNVLSEMVALWQKQESVPSEDALGKWWKTIEEWRSRDCLWFDNGSEIIKPQYVIQKLAEITGNSAIITSDVGQHQMFAAQYYPFERPRQWLNSGGLGTMGVGLPYAIGAKLAAPDQDVFCITGDGSIQMNIQELSTCFQYRIPVNVITLNNGYLGMVRQWQEIYYGGRESETYFDSLPDFVKLAEAYGHIGIRVDKKSDVEGALLEALNQKDRLVFIDFLTDQKQNVMPMVGNGKGLDEMVLPPHMRADGKA

SEQ ID NO: 82124 - DNA, 1779 bp, Deinococcus radiodurans R1
  CDS (1)..(1779): transl_table=11
gtggagcagacaggcaagcaggggcagaaccgtggggagatgaccggcgccaaagcgctgtgggcgactctggcggggcacggcatcacgacggtgttcggctatcccggcggggcgatcatgccggtgtacgacgcgctgaccttttacccggaagtgcgccacatcctcgcccggcacgagcaaggcgccattcacgccgccgagggctgggccaaagcgaccggtgaaatcggcgtgtgcatggcgacatctggccccggcgcgaccaacctcgtcaccgggctggccgacgcgatgctcgacagcgtgccgctgctggcgatcaccggcaacgtggcgcagcacctgatgggcaccgacgcctttcaggaagccgatatcaccggcatcaccatgccaatcaccaagcacaactacgtggtgcgcgacgtggacgagctgccgcgcgtgatcgccgaggccatccgcatcgcccgctcggggcgtccggggccagtgctggtggacattcccaaagacgtgcagctcgcggccttcgcgggcgacattcccaccccgcacacccgcccacaggcgcccgaggccagtgccgagagcatcgcgtcggccagagaactgctgagaaatgccaaaaaacccgtgctggtcatgggcggcggctcgctcgacgcctcggcggaactcactgcgctcgcccacgcctggggcctgccggtcatcaccacgctgatgggcctgggcgcgtacccggcgtccgatcccctctggctggggatgccggggatgcacggctcggtggcggccaaccgcgccatttccgagtgtgacgtgctgctcgccgtcgggatgcgcttcgacgaccgggtgacgggccgggtcagcggatttgcaccgcacgcgcagattattcacgtcgaactcgacgccgccgagatcggcaagatcgtgcggacccacctgccgatccgcagcgacgcgaaaactgccgcccggcaactcgccgagggcgccgagaaactcgaactcggcgagtggctttcccagatcgaggagtggaaaggacgggcggtgcccccgcagcagtggggcgcggcctacgcggtgggacaggtcacggcccggctgcggcctgacgacattctcagcagcgacgtgggccagcaccagatgctcgccgcgcagctcgcccgcttcgaaaagccccggcgctggctgaactccggcgggctgggcaccatgggcttcggctttccggcggccatcggcgcggcgctcgccgaacccggcgtcgtcagcatggtggtggcgggcgacggcggcttccagatgaccgcgcaggaactcgccacgctgaagatgtacgacatccgcaacgtcaaaatctgcatcatcaacaactcgtacctcggcatggtgcggcagtggcaggagctgtttcacggcaagcgctactccgaggtgtggctgggcgactccaaccccgatttcgtcaagctggcgggcgcctacgacgtgccggcctaccgcgcgagcagcgccgaggaactgcccgccgccatcgacgcctggctgagcgaccccaagtcctccctgctggaagtggtcgtaccgcacgaacacggcgtgttcccgatggtcccggcgggcgcggcgctgcacgagatgatggaaaccgagccggtccgcaccgacatcagcgcggaggccaccgaggtcaacgaagccacctggcaggaaatgaccgagcaggaagccgaggagatgaatcagggatga

SEQ ID NO: 82125 - protein, 592 aa, Deinococcus radiodurans R1
MEQTGKQGQNRGEMTGAKALWATLAGHGITTVFGYPGGAIMPVYDALTFYPEVRHILARHEQGAIHAAEGWAKATGEIGVCMATSGPGATNLVTGLADAMLDSVPLLAITGNVAQHLMGTDAFQEADITGITMPITKHNYVVRDVDELPRVIAEAIRIARSGRPGPVLVDIPKDVQLAAFAGDIPTPHTRPQAPEASAESIASARELLRNAKKPVLVMGGGSLDASAELTALAHAWGLPVITTLMGLGAYPASDPLWLGMPGMHGSVAANRAISECDVLLAVGMRFDDRVTGRVSGFAPHAQIIHVELDAAEIGKIVRTHLPIRSDAKTAARQLAEGAEKLELGEWLSQIEEWKGRAVPPQQWGAAYAVGQVTARLRPDDILSSDVGQHQMLAAQLARFEKPRRWLNSGGLGTMGFGFPAAIGAALAEPGVVSMVVAGDGGFQMTAQELATLKMYDIRNVKICIINNSYLGMVRQWQELFHGKRYSEVWLGDSNPDFVKLAGAYDVPAYRASSAEELPAAIDAWLSDPKSSLLEVVVPHEHGVFPMVPAGAALHEMMETEPVRTDISAEATEVNEATWQEMTEQEAEEMNQG

SEQ ID NO: 82126 - DNA, 1752 bp, Xylella fastidiosa 9a5c
  CDS (1)..(1752): transl_table=11
atgaacagatccgcacacagcgcaacccgcaatggtgcgagctggttgacgcatgctctggaagcagaaggagttgatacactcttcggctatccgggtggcacgatcatgccgttttatgacgccctggtcgattctcgcctcacacatattctggtccgccatgaacagggtgcagctttagctgcaaatggctatgcccgcgctagcggacgtgtcggtgtatgcgtagcgacgtcaggtccaggtgcctccaatctgatcactggcattgccgacgcgatgctagattcagtccccatggtctgcttgactggccaagtcgctagctcgttgctggggaccgatgcatttcaggaattggacgtatttggcctaaccatgccgatcgtcaaacatagcttcttggtgcgttcgatacaggatctgccaagcatggtgcaggacgcattccgtatcgcacgagaaggccgccccggcccggtcctgatcgatttacctaaagatgtccaaatgactgatgcttcgcacctacaggaccatgtgtcggccgccgtgatggcaccgccgcaagcagaagcagcgatgatcatcgaagctgcagcagcaatcgcctctgctgagaaaccagtgatctatggcggcggcggcatcgccctcgccgatgcagttaacgtcttccgtaccttcgttgataccactagtatcccgaccacgttgacactacgcggtttgggggcgctgccacacgctcatccccattacttgggcatgctgggcatgcatggcacccgcgcggccaacatggcaatccaggagtgcgatctactactcgtcattggtgcccgtttcgacgaccgtgcaaccgggaaggtgaacgaattcgctccgttcgctcgaattgtccaccttgatgcagacgcttacgaaatcaataagctacgtaatgccgacatcgcggtaccaggcaacttagccacaacactcactgcccttagcgccttgctgtcacccagtacagcccacccacacataagctcatccagatatgaatggcaggagcgctgcataggcaaccgcgaacgttttggcgtgcgttacgatgcgccaggcaatgatatctacgcaccggccctacttaaacgcctgagcgaaatggcacccgttgataccatcattgcttgcgatgttggccagcatcaaatgtgggtggcgcaacactgtaaattcgaagatccacgtaatcacctgaccagcggtgggctaggcaccatggggttcggcttgcctgcggcaatgggtgcacagtttgcctatccggaacgcactgtagtactggtttctggcgatggcagtttcatgatgaatgtacaagaactgaccacaatcgcacggtgcaagctacctttgaagattgtactgcttgataacaactcgctaggcatggttcggcaatggcaagaactgttctttgcggagcgatacagtgaaattgacctgtctgacaatcccgatttcactgcattggtacaggtatttggaattcctgcaaaacgcatcacggttcgcagcgacgtcgaacaaggcttagcctatttactagcacaaccaggcccagcattactgcacgtgcagattgatgcacgcgccaacgtatggccccttgtgccaccgaacaccgccaacagcaccatgctggaaagcaatccggcccacgttaagaaggaagcgccccatgcaataccggcttga

SEQ ID NO: 82127 - protein, 583 aa, Xylella fastidiosa 9a5c
MNRSAHSATRNGASWLTHALEAEGVDTLFGYPGGTIMPFYDALVDSRLTHILVRHEQGAALAANGYARASGRVGVCVATSGPGASNLITGIADAMLDSVPMVCLTGQVASSLLGTDAFQELDVFGLTMPIVKHSFLVRSIQDLPSMVQDAFRIAREGRPGPVLIDLPKDVQMTDASHLQDHVSAAVMAPPQAEAAMIIEAAAAIASAEKPVIYGGGGIALADAVNVFRTFVDTTSIPTTLTLRGLGALPHAHPHYLGMLGMHGTRAANMAIQECDLLLVIGARFDDRATGKVNEFAPFARIVHLDADAYEINKLRNADIAVPGNLATTLTALSALLSPSTAHPHISSSRYEWQERCIGNRERFGVRYDAPGNDIYAPALLKRLSEMAPVDTIIACDVGQHQMWVAQHCKFEDPRNHLTSGGLGTMGFGLPAAMGAQFAYPERTVVLVSGDGSFMMNVQELTTIARCKLPLKIVLLDNNSLGMVRQWQELFFAERYSEIDLSDNPDFTALVQVFGIPAKRITVRSDVEQGLAYLLAQPGPALLHVQIDARANVWPLVPPNTANSTMLESNPAHVKKEAPHAIPA

SEQ ID NO: 82128 - DNA, 1650 bp, Sulfolobus solfataricus P2
  CDS (1)..(1650): transl_table=11
atgccatcagttgcagaagtaataataagagtattagaagataatggaattcaaagaatatatggaattcctggagattccattgaccctttagttgacgcgataagaaaatctaaagtaaaatacgtacaagtaagacatgaagaaggtgcagctttagctgcctcggtcgaagcgaaaataactggtaagccttcagcatgtatgggtacttctggtcctggatcaatccatttattaaatggattatacgatgcaaaaatggatcatgctccagtaatagcgctaactggacaagtagagtcagatatgataggtcacgattattttcaagaagttaacctaactaagttatttgatgatgtggcagtatataatcaaattttaattaacccagaaaacgcggaatatataataaggagggctataagagaggctatttccaaaaggggagtagctcacataaatttaccagtagatattctcagaaagtcctcagaatataagggtagcaagaatactgaagtaggtaaagttaaatattcgatagatttttctagagctaaggaattaatcaaagaaagtgagaaaccagttttactaattggaggagggactagaggcctaggtaaagagataaataggtttgctgaaaaaataggagcaccaataatatatacattaaatggtaaggggattttaccagatttagatcctaaagttatgggcggaataggtcttttaggaactaagccttccatagaggcgatggataaggctgatttattaataatgttaggcgcatcatttccttacgttaattttctaaataagagtgccaaagtgatacaggttgatatagataattctaatataggtaagaggttagatgttaatctctcttatccgattccagttgctgagttcctaaatatagatatcgaagagaaatcagataaatactatgaagagttaaaaggaaagaaggaagattggctagattctataagtaagcaggagaatagtttagataaaccaatgaaacctcagagagtagcttatatagtttcccagaagtgcaagaaagacgcagtaatagttactgatactggaaatgtaactatgtggactgctagacactttagagcttcaggagagcaaacctttatattttctgcttggctaggttcaatgggcattggagtcccaggaagtgtaggagcttcttttgctgtagaaaataaaagacaagttatttcttttgtaggagatggaggttttactatgactatgatggaaatgataactgctaagaaatatgatcttccagttaaaataatcgtttataataattctaaattaggaatgataaaatttgaacaagaagtaatggggtacccagaatggggagtcgatttatataacccagatttcacaaagatagctgaatctattggatttaaaggatttagattagaagagccaaaagaggctgaggaaataatagaagattttctaaacactaaaggacaggcacttttagatgcaatagtagatccaaatgagagaccaatgccacctaaactaacttttaagcaagctggagaatacgttctttcaatatttagagagaaattagagggtatttaa

SEQ ID NO: 82129 - protein, 549 aa, Sulfolobus solfataricus P2
MPSVAEVIIRVLEDNGIQRIYGIPGDSIDPLVDAIRKSKVKYVQVRHEEGAALAASVEAKITGKPSACMGTSGPGSIHLLNGLYDAKMDHAPVIALTGQVESDMIGHDYFQEVNLTKLFDDVAVYNQILINPENAEYIIRRAIREAISKRGVAHINLPVDILRKSSEYKGSKNTEVGKVKYSIDFSRAKELIKESEKPVLLIGGGTRGLGKEINRFAEKIGAPIIYTLNGKGILPDLDPKVMGGIGLLGTKPSIEAMDKADLLIMLGASFPYVNFLNKSAKVIQVDIDNSNIGKRLDVNLSYPIPVAEFLNIDIEEKSDKYYEELKGKKEDWLDSISKQENSLDKPMKPQRVAYIVSQKCKKDAVIVTDTGNVTMWTARHFRASGEQTFIFSAWLGSMGIGVPGSVGASFAVENKRQVISFVGDGGFTMTMMEMITAKKYDLPVKIIVYNNSKLGMIKFEQEVMGYPEWGVDLYNPDFTKIAESIGFKGFRLEEPKEAEEIIEDFLNTKGQALLDAIVDPNERPMPPKLTFKQAGEYVLSIFREKLEGI

SEQ ID NO: 82130 - DNA, 1665 bp, Clostridium acetobutylicum ATCC 824
  CDS (1)..(1665): transl_table=11
gtgaaatataacggttccagaattatacttgaatgtttgaaagaacaaggtgtagatactatttttggatatccgggaggagcagtcttaaatatttttgatgctttatattcattttcagaaataagatgtgtactaacatctcatgagcagggggcatcacatgcagcagatggatatgcaagggctacaggaaaagttggggtttgccttgcgacctctggaccaggggctacaaatcttgtaactggaattgcaacagcgtatatggattcagtacctatggtagctataacggggcaagtagctacatcattaataggtaaagattcttttcaagaagttgatataacagatataactatgccaataactaagcataattttatagtaagaaaagttgaagatttagctgatactataaggaaagcattttatatagcacaaagtggtagaccaggtcctgtattaatagatattcctaaagacgtaacgggaaatgaatgtgagtacgaacctaggaagccagaaaaaattgaaaaaagctctgtaagggatgcggaggtagaaggggctattgaacttctattagaaagtaagaggcctgttataattgttggtggcggttgcaatatatcggaagcatcaaaagagcttaaaattcttcaagaaaagcttaaatgtcctgtttgttcaactatgatgggacttggggcatttagtggcaaggacgatatgtttactggtatggttggaatgcatggaacaaaggcatcaaataaatctatatgcgaaagtgatttagttatagctattggatgtagatttagtgatagagttacaagtaatgcagatacctttgctaaaaatgcaaaaatacttcatattgatattgatgaagcagaggtttctaaaaatattaaagcagatagttttattattggggatgtagaagaggttctaaaaaaagtaaatgagaagcttactgcaagagaaggtaatgagtggacagaatatgctctaggtcttctgaaaaaagataaatctaaggtacttaggataaataaatgtgactctgtaaatcctgtatatgtaataaaaaagttatatgaacttacagatggagaagcaataataacaacagaagtgggacaaaaccagatatgggcaactcaaggatatatttatacaaagcctagaagttttataacttcaggtggacttggcacaatgggatacggatttggagcggcaataggggctagcgttgggaaagataaaatgacatttgatattgctggtgatggaagctttagaatgaacataaatgagcttgcaacagttgttagatataagttgccagtaaaaataattgtattaaacaataatgttcttggcatggtaagacagtggcagaatttattttacaagaaaagatattcaagtactactcttgagagagacactgactttgtaaaaatagctgaaggatacggtgcccttggtttaagagttgatacaaatgcaggagtagagtcagctcttaaaaaggcaatagattatgatggaccagtagtaattgactttaccgttggagaggatgaaatggcaacgcctatagttccccctggggctgatattgaaaatatggttgtacttgattaa

SEQ ID NO: 82131 - protein, 554 aa, Clostridium acetobutylicum ATCC 824
MKYNGSRIILECLKEQGVDTIFGYPGGAVLNIFDALYSFSEIRCVLTSHEQGASHAADGYARATGKVGVCLATSGPGATNLVTGIATAYMDSVPMVAITGQVATSLIGKDSFQEVDITDITMPITKHNFIVRKVEDLADTIRKAFYIAQSGRPGPVLIDIPKDVTGNECEYEPRKPEKIEKSSVRDAEVEGAIELLLESKRPVIIVGGGCNISEASKELKILQEKLKCPVCSTMMGLGAFSGKDDMFTGMVGMHGTKASNKSICESDLVIAIGCRFSDRVTSNADTFAKNAKILHIDIDEAEVSKNIKADSFIIGDVEEVLKKVNEKLTAREGNEWTEYALGLLKKDKSKVLRINKCDSVNPVYVIKKLYELTDGEAIITTEVGQNQIWATQGYIYTKPRSFITSGGLGTMGYGFGAAIGASVGKDKMTFDIAGDGSFRMNINELATVVRYKLPVKIIVLNNNVLGMVRQWQNLFYKKRYSSTTLERDTDFVKIAEGYGALGLRVDTNAGVESALKKAIDYDGPVVIDFTVGEDEMATPIVPPGADIENMVVLD

SEQ ID NO: 82132 - DNA, 1692 bp, Clostridium acetobutylicum ATCC 824
  CDS (1)..(1692): transl_table=11
atgaatgaaaatttaaagcaagacaaggattctgaaatttcaaaaaccgaagatgaagagagtagtatgaatacagctgagttggttgtaaagtgcttagaaaatgaaaatgtagagtatatattcggtataccaggtgaggaaaatttggcactcataaaagcgcttactaaatcacctataaaattcataactacacgtcatgaacaaggggcggctttcatggcagatgtatatggaagattgactggaagaccaggagtatgtctttctacattgggacctggtgctacaaatttaatgactggtgttgctgatgctaatcttgatggagctccgcttattgcgataacaggacaggttggaactgatagaatgcatatagagtcgcatcagcaccttgatttagtagctatgttcgcacctgttactaagtggaataaacaaatagtaagaccagatactgcacctgaaatagttagaaaagcttttaaaacagctgtagatgagaaaccaggagcatgccatatagatcttcctcaaaatatcgcagatatgcctgtacaaggaaaaccgttaagacatacagttacggataagagctttgctgcttacagtagtatagaaaaggctgctatagctatatcaagagctaaaagcccactaatactttcaggaaatggagcaatacgttcaaaggcaagtaaggcagttttagatatggctgaaagattaaacattccagttgcaaatacctttatgggaaaaggaataattccttttaatcatcctctttcattatggagtatgggtcttgcacaaaaagattatattaatagaattttcgaaaagacagaccttgtcattgctataggatatgatatagtagaatattcacccaaaaaatggaactcaaagggagaaattaggataatacatataggcgagaaaaaagccgaagttaataatagttatcttcctgaggttgaggtaataggtgatatttcagattcgattcaagaaataataagacgttcagatagaatagagacaccaaaacaagcacttaaaataaaagaagatatgcataaaaattatgaggaatatagtgatgatcagagctttccaatgaaaccacagaaggtactatacgacttacgaagagttatgggcgaggatgatatagtaatatctgatgtaggagctcataaaatgtggatagctaggaattatcattgttataagcctaatacatgcataatttcaaatggttttgcatcaatgggaattgctattccaggagctttagcggcaaagcttgtaaatccagataaaaaggtagttgcagttacaggagatggtggcttcatgatgaattcacaagagcttgaaactgcacttagaataggaaccccattcgtaacattaatatttaatgatagtaattatggacttataaagtggaagcaggaagaaagatacggagaatcagcgtatataaactttacaaatccagattttaaaatgtacgcagagagtatgggactaaaaggatatagaattactaaagctgaagagctcatacctacattagaagaggcgtttagtcagaaggttccatcagtaattgattgtgcagttgattatagcgaaaatcttaaattgtcccataaattagaggaactaaaatag

SEQ ID NO: 82133 - protein, 563 aa, Clostridium acetobutylicum ATCC 824
MNENLKQDKDSEISKTEDEESSMNTAELVVKCLENENVEYIFGIPGEENLALIKALTKSPIKFITTRHEQGAAFMADVYGRLTGRPGVCLSTLGPGATNLMTGVADANLDGAPLIAITGQVGTDRMHIESHQHLDLVAMFAPVTKWNKQIVRPDTAPEIVRKAFKTAVDEKPGACHIDLPQNIADMPVQGKPLRHTVTDKSFAAYSSIEKAAIAISRAKSPLILSGNGAIRSKASKAVLDMAERLNIPVANTFMGKGIIPFNHPLSLWSMGLAQKDYINRIFEKTDLVIAIGYDIVEYSPKKWNSKGEIRIIHIGEKKAEVNNSYLPEVEVIGDISDSIQEIIRRSDRIETPKQALKIKEDMHKNYEEYSDDQSFPMKPQKVLYDLRRVMGEDDIVISDVGAHKMWIARNYHCYKPNTCIISNGFASMGIAIPGALAAKLVNPDKKVVAVTGDGGFMMNSQELETALRIGTPFVTLIFNDSNYGLIKWKQEERYGESAYINFTNPDFKMYAESMGLKGYRITKAEELIPTLEEAFSQKVPSVIDCAVDYSENLKLSHKLEELK

SEQ ID NO: 82134 - DNA, 1857 bp, Agrobacterium tumefaciens str. C58
  CDS (1)..(1857): transl_table=11
atgtcttcaaacaggccctcgggctcctcgatatccaaagccaaagcgggatggaaacaggcaatgacggataaggacaatacggaaaacagcaatcgcatgacaggtgcggagatcgttctgcaggcgctgaaggacaacggcgtcgagcacatcttcggttatcccggcggtgccgttcttccgatttatgacgagattttccagcaggaagacattcagcacatcctcgtgcgtcatgagcagggtgccggccacgcggccgaagggtatgcccgttccaccggcaaggtcggcgtcatgctcgttacctccggtcccggcgccaccaatgcggtgacgccgctgcaggatgcgctgatggattccattccgctcgtctgcctgtccggccaggttccgacatcgctgatcggttccgacgcatttcaggaatgcgataccgtcggcatcacgcgcccctgcaccaagcacaactggctggtcaaggacgtcaacgaactggctggcatcatccatgaagccttccgcatcgcgcagactggccgtccgggtcccgtcgttgtcgatattccgaaggatattcagttcgccaccggcacctatacgccgccttccgccgccatccagcagaagagctacaagccgaaggttcagggcgacctcaacgccattcatgctgccatcgaactgatgtcgaaagcgaagaagccggttttttacaccggcggcggcgtcatcaattctggtccggaggcaacccgtctgctgcgtgaactggtcgagctcaccaatttcccgatcacctcgacgctgatgggtctcggcgcctatccggcttccggcaagaactggctcggcatgctgggcatgcacggttcctacgaagccaatatgacgatgcatgattgcgatgtcatggtctgcatcggcgcgcgtttcgatgaccgtattaccggtcgcatcaatgcgttttcgccgaattccaagaagatccatatcgatatcgatccgtcctcgatcaacaagaccgtgcgtgtcgacgtgcctgttatcggcgatgtcgggcatgttctggaagacatggttcgcctgtggcgcgctttgccgaagaaaccggaaaaagcgcagacggccgactggtggtcgcagattgagcgctggcgcgcccgcaattccttcgcctacaagaactccaaagatgtcatcatgccgcaatatgcattgcagcggctttatgaggcgtcgaagggacgcgacacttacatcacgacagaagtcggccagcaccagatgtgggcggcgcagttcttcggtttcgaggagccgaaccactggatgacctcgggcggtctcggcaccatgggttatggcctgccggcggctatcggcgtgcaggtcgcgcatcccgaagcgcttgtcatcgacattgccggtgacgcatcgatccagatgtgtatccaggaaatgtcctgcgccatccagtacggcctgccggtgaagattttcatcctcaacaaccagtatatgggcatggtgcggcaatggcagcagttgctgcacggcaaccgtctgtccaactcctataccgaagccatgcctgatttcgtcaagctggcggaggcctatggcgctgtcggcatgtattgcgacgacccgaaggaactggacgacaagatcgccgagatgattgcggtcaacaagccggtcatcttcgattgccgcgttgccaatctcgccaattgcttcccgatgatcccatctggtaaagcccataacgagatgctgttgccggatgaggcgacggatgaagctgttgccaacgccatcgatgccaagggccgtcagctagtctga

SEQ ID NO: 82135 - protein, 618 aa, Agrobacterium tumefaciens str. C58
MSSNRPSGSSISKAKAGWKQAMTDKDNTENSNRMTGAEIVLQALKDNGVEHIFGYPGGAVLPIYDEIFQQEDIQHILVRHEQGAGHAAEGYARSTGKVGVMLVTSGPGATNAVTPLQDALMDSIPLVCLSGQVPTSLIGSDAFQECDTVGITRPCTKHNWLVKDVNELAGIIHEAFRIAQTGRPGPVVVDIPKDIQFATGTYTPPSAAIQQKSYKPKVQGDLNAIHAAIELMSKAKKPVFYTGGGVINSGPEATRLLRELVELTNFPITSTLMGLGAYPASGKNWLGMLGMHGSYEANMTMHDCDVMVCIGARFDDRITGRINAFSPNSKKIHIDIDPSSINKTVRVDVPVIGDVGHVLEDMVRLWRALPKKPEKAQTADWWSQIERWRARNSFAYKNSKDVIMPQYALQRLYEASKGRDTYITTEVGQHQMWAAQFFGFEEPNHWMTSGGLGTMGYGLPAAIGVQVAHPEALVIDIAGDASIQMCIQEMSCAIQYGLPVKIFILNNQYMGMVRQWQQLLHGNRLSNSYTEAMPDFVKLAEAYGAVGMYCDDPKELDDKIAEMIAVNKPVIFDCRVANLANCFPMIPSGKAHNEMLLPDEATDEAVANAIDAKGRQLV

SEQ ID NO: 82136 - DNA, 1719 bp, Sulfolobus tokodaii str. 7
  CDS (1)..(1719): transl_table=11
atgccaacaggggctagaataacaatagatgctctaaaaagagaaggagtaaaagtaatattcggaatacctggcctatccaatatgcaactttatgacgcatttattgaagacttacaaaatggagaactaagacacgtattaatgagacatgaacaagctgccgctcatgcagctgatgggtatgcaagagcttcaggaataccgggagtatgtacagcaacatccggtcctggtgcaacaaacttagttactggcctaataacagcatactgggattcctcgccagttatagcaataactggacaagtacctagaaattccattggaaaaatggcattccaggaagccgatgccatgggtatatttgaacatattacaaaatacgttgtagaagtaaagaaattagaagaaattccaatttggataaagaatgcattctatatagcaacaacaggtagaccaggacctgtagttgttgacatacctagagatattttctatgaaaaagttgaggaagtaaaatggccagaaaaacccatggtaaaaggttacaaagagtttcctacaataattgatagacagaagttaaagaaagctgcagaaatactggtaaatgctgagagacctataattttagtaggaactggtgttgtatggtctaacgcaacacaagaggttcttgaacttgccgagtatttgcatattccaatagtatcaacattccctggtaagtccgctataccacatgaccacccactatatttcggtgccatgggatactatggaagagcagaagcttcaatggctgccttagaatcagatgctatgttagttattggagctaggtttagtgatagaacctttacttcatacgatgaaatgattgagacaagaaagaaattcataatgattaacatagatccctcagatggagaaagagcaataaaagttgatgtaaatcttgtaggtaatgcaaaaattctacttagggaattgatgaaagcaatatacgaagtaggtaaaaagaatgatcatagcgcctggataaaaagagtaaaagaatataaggaatattactcacaattctattattatgacgaaccaaataaactaaaaccatggaagatattaaagacaataaggaatacgatacctagagatgctatagtaactactggtgtgggacaacatcaaatgtgggcagaagtattctgggaagtattagaacctagaacgtttttatcttcgactggtatgggaacaatgggatttggtttaccagctgcaatgggagctaaattagctaaaccagataaggttgtagtggatctggatggtgatgggtctttcttaatgactggaaataatctcgctactgctgtggatgagcatattccaattatatcagtagtgtttgataataggacattaggtctagtaaggcaagttcaagatttgttctttggaaacagaattgtaggagtagactacggaccctcgccagatttcgtaaaattagcagaggcatttggagctctaggatttaacgctacttcttatgaagaaatagaaaaatcacttaaaacagctatgaaagaaaatattcctgcagtaataagaattccggtcgataaagaagaattagcattacccacattacctcctggaggaagattaaagcaggtgattgtacgtgacccaagaaaaagtagttag

SEQ ID NO: 82137 - protein, 572 aa, Sulfolobus tokodaii str. 7
MPTGARITIDALKREGVKVIFGIPGLSNMQLYDAFIEDLQNGELRHVLMRHEQAAAHAADGYARASGIPGVCTATSGPGATNLVTGLITAYWDSSPVIAITGQVPRNSIGKMAFQEADAMGIFEHITKYVVEVKKLEEIPIWIKNAFYIATTGRPGPVVVDIPRDIFYEKVEEVKWPEKPMVKGYKEFPTIIDRQKLKKAAEILVNAERPIILVGTGVVWSNATQEVLELAEYLHIPIVSTFPGKSAIPHDHPLYFGAMGYYGRAEASMAALESDAMLVIGARFSDRTFTSYDEMIETRKKFIMINIDPSDGERAIKVDVNLVGNAKILLRELMKAIYEVGKKNDHSAWIKRVKEYKEYYSQFYYYDEPNKLKPWKILKTIRNTIPRDAIVTTGVGQHQMWAEVFWEVLEPRTFLSSTGMGTMGFGLPAAMGAKLAKPDKVVVDLDGDGSFLMTGNNLATAVDEHIPIISVVFDNRTLGLVRQVQDLFFGNRIVGVDYGPSPDFVKLAEAFGALGFNATSYEEIEKSLKTAMKENIPAVIRIPVDKEELALPTLPPGGRLKQVIVRDPRKSS

SEQ ID NO: 82138 - DNA, 1779 bp, Sinorhizobium meliloti 1021
  CDS (1)..(1779): transl_table=11
atgagcggaactgagaaccagatgacgggcgcggagatcgttctccaggctttgaaagacaatggcgtcgaacacatcttcggctatcccggcggtgccgtgctcccgatctacgacgagattttccagcaggaggatatccagcacatcctcgtccgccacgagcagggcgccggccacatggccgaaggttatgcccgctccaccggcaaggtcggcgtcatgctggtgacttccggcccgggagcgaccaatgcggtcacgccgctgcaggacgcgctgatggactcgatcccgctcgtctgcatctcggggcaggtaccgacgtcgctgatcggttcggacgccttccaggaatgcgacacgatcggcatcacgcggccctgtaccaagcacaactggctggtcagggacgtcaacgagctcgcccgcgtcatccatgaggctttccgcgtcgctcagtccggccgtccgggtccggtcgtcgtcgacattccgaaggacgtccagttcgcaaccggcacctatacgccgccttcggccgttccgacgcagaagagctaccagccgaagacccaaggggacctgaagaagatcgaggaggcggtcgcgctcatgaaaacggcgcgccagccggtcatctattcgggcggcggcgtcatcaattccgggccgcaagccgcgcatttcctgcgcgagctggtcgagctcaccggcttcccgatcacgtcgaccctgatgggcctcggcgcctatcctgcctccggcaaaaactggctcggcatgctcgggatgcacgggacctacgaagccaacctggcgatgcatgattgcgacgtcatgatctgcatcggcgcgcgcttcgacgaccggatcaccggccggctcaatgccttctcgcccaactccaagaagatccacatcgacatcgacccgtcctcgatcaataagaacgtccgcgtcgacgttccgatcatcggcgatgtcgccgctgttctcgaggacatgattcgcctgtggcgggctgcggccaagacggtcgaccagacgcggcttggcgactggtggaagtcgatctccaagtggcgggcgcgcaactctctggcctatacgccgagtgccgacgtcatcatgccgcaatatgcgatccagcggctatacgagctcaccaaggaccgcgacacctacatcaccaccgaggtcggccagcaccagatgtgggccgcgcagttcttcggcttcgaagagccgaaccgctggatgacctcgggcggcctcgggaccatgggctacggattcccggccgcggtcggcgtccaggtcgcgcatccggagagcctcgtcatcgacatcgccggcgacgcctcgatccagatgtgcatccaggagatgtcgtgtgcggttcagtacggcctgccggtcaagatcttcatcctgaacaaccaatatatgggcatggtccggcagtggcagcaactcctgcacggcaaccgcctgtcgcattcctacaccgaggcgatgcctgacttcgtcaagctcgccgaggcctatggcggcgtcggcatccgttgcgaaaagccgggagagctcgacgatgcgatccggcagatgatcgacactccggctccggtcatcttcgactgccgcgtcgccaatctcgccaactgcttcccgatgatcccttcgggcaaggcgcataacgaaatgctgctccccgacgaggccacggacgaggtggtcgccaacgccatcgatgccaagggccgccagctcgtttga

SEQ ID NO: 82139 - protein, 592 aa, Sinorhizobium meliloti 1021
MSGTENQMTGAEIVLQALKDNGVEHIFGYPGGAVLPIYDEIFQQEDIQHILVRHEQGAGHMAEGYARSTGKVGVMLVTSGPGATNAVTPLQDALMDSIPLVCISGQVPTSLIGSDAFQECDTIGITRPCTKHNWLVRDVNELARVIHEAFRVAQSGRPGPVVVDIPKDVQFATGTYTPPSAVPTQKSYQPKTQGDLKKIEEAVALMKTARQPVIYSGGGVINSGPQAAHFLRELVELTGFPITSTLMGLGAYPASGKNWLGMLGMHGTYEANLAMHDCDVMICIGARFDDRITGRLNAFSPNSKKIHIDIDPSSINKNVRVDVPIIGDVAAVLEDMIRLWRAAAKTVDQTRLGDWWKSISKWRARNSLAYTPSADVIMPQYAIQRLYELTKDRDTYITTEVGQHQMWAAQFFGFEEPNRWMTSGGLGTMGYGFPAAVGVQVAHPESLVIDIAGDASIQMCIQEMSCAVQYGLPVKIFILNNQYMGMVRQWQQLLHGNRLSHSYTEAMPDFVKLAEAYGGVGIRCEKPGELDDAIRQMIDTPAPVIFDCRVANLANCFPMIPSGKAHNEMLLPDEATDEVVANAIDAKGRQLV

SEQ ID NO: 82140 - DNA, 1725 bp, Bacillus subtilis subsp. subtilis str. 168
  CDS (1)..(1725): transl_table=11
atggggactaatgtacaggtggattcagcatctgccgaatgtacacagacgatgagcggagcattaatgctgattgaatcattaaaaaaagagaaagtagaaatgatcttcggttatccgggcggggctgtgcttccgatttacgataagctatacaattcagggttggtacatatccttccccgtcacgaacaaggagcaattcatgcagcggagggatacgcaagggtctccggaaaaccgggtgtcgtcattgccacgtcagggccgggagcgacaaaccttgttacaggccttgctgatgccatgattgattcattgccgttagtcgtctttacagggcaggtagcaacctctgtaatcgggagcgatgcatttcaggaagcagacattttagggattacgatgccagtaacaaaacacagctaccaggttcgccagccggaagatctgccgcgcatcattaaagaagcgttccatattgcaacaactggaagacccggacctgtattgattgatattccgaaagatgtagcaacaattgaaggagaattcagctacgatcatgagatgaatctcccgggataccagccgacaacagagccgaattatttgcagatccgcaagcttgtggaagccgtgagcagtgcgaaaaaaccggtgatcctggcgggtgcgggcgtactgcacggaaaagcgtcagaagaattaaaaaattatgctgaacagcagcaaatccctgtggcacacacccttttggggctcggaggcttcccggctgaccatccgcttttcctagggatggcgggaatgcacggtacttatacagccaatatggcccttcatgaatgtgatctattaatcagtatcggcgcccgttttgatgaccgtgtcacaggaaacctgaaacactttgccagaaacgcaaagatagcccacatcgatattgatccagctgaaatcggaaaaatcatgaaaacacagattcctgtagtcggagacagcaaaattgtcctgcaggagctgatcaaacaagacggcaaacaaagcgattcaagcgaatggaaaaaacagctcgcagaatggaaagaagagtatccgctctggtatgtagataatgaagaagaaggttttaaacctcagaaattgattgaatatattcatcaatttacaaaaggagaggccattgtcgcaacggatgtaggccagcatcaaatgtggtcagcgcaattttatccgttccaaaaagcagataaatgggtcacgtcaggcggacttggaacgatgggattcggtcttccggcggcgatcggcgcacagctggccgaaaaagatgctactgttgtcgcggttgtcggagacggcggattccaaatgacgcttcaagaactcgatgttattcgcgaattaaatcttccggtcaaggtagtgattttaaataacgcttgtctcggaatggtcagacagtggcaggaaattttctatgaagaacgttattcagaatctaaattcgcttctcagcctgacttcgtcaaattgtccgaagcatacggcattaaaggcatcagaatttcatcagaagcggaagcaaaggaaaagctggaagaggcattaacatcaagagaacctgttgtcattgacgtgcgggttgccagcgaagaaaaagtattcccgatggtggctccggggaaagggctgcatgaaatggtgggggtgaaaccttga

SEQ ID NO: 82141 - protein, 574 aa, Bacillus subtilis subsp. subtilis str. 168
MGTNVQVDSASAECTQTMSGALMLIESLKKEKVEMIFGYPGGAVLPIYDKLYNSGLVHILPRHEQGAIHAAEGYARVSGKPGVVIATSGPGATNLVTGLADAMIDSLPLVVFTGQVATSVIGSDAFQEADILGITMPVTKHSYQVRQPEDLPRIIKEAFHIATTGRPGPVLIDIPKDVATIEGEFSYDHEMNLPGYQPTTEPNYLQIRKLVEAVSSAKKPVILAGAGVLHGKASEELKNYAEQQQIPVAHTLLGLGGFPADHPLFLGMAGMHGTYTANMALHECDLLISIGARFDDRVTGNLKHFARNAKIAHIDIDPAEIGKIMKTQIPVVGDSKIVLQELIKQDGKQSDSSEWKKQLAEWKEEYPLWYVDNEEEGFKPQKLIEYIHQFTKGEAIVATDVGQHQMWSAQFYPFQKADKWVTSGGLGTMGFGLPAAIGAQLAEKDATVVAVVGDGGFQMTLQELDVIRELNLPVKVVILNNACLGMVRQWQEIFYEERYSESKFASQPDFVKLSEAYGIKGIRISSEAEAKEKLEEALTSREPVVIDVRVASEEKVFPMVAPGKGLHEMVGVKP

SEQ ID NO: 82142 - DNA, 1782 bp, Escherichia coli K12
  CDS (1)..(1782): transl_table=11
atggcaaaaatgagagccgttgacgcggcaatgtatgtgctggagaaagaaggtatcactaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgcattaccggccaggcaccgcgcgcccgtctgcataaagaagattttcaggccgtagatattgaagcaattgctaaaccggtcagcaaaatggcggttacagttcgtgaagcggcgctggtgcctcgcgtgctgcaacaggcatttcacctgatgcgttctggtcgtccgggtccggtactggtggatttaccgttcgacgttcaggttgcggaaatcgagtttgatcctgacatgtacgaaccgctgccggtctacaaacctgctgccagccgtatgcagatcgaaaaagctgtagaaatgttaatccaggccgaacgtccggtgattgttgccgggggcggggtaattaatgctgacgcagctgcactgttacaacagtttgctgaactgaccagcgttccggtgatcccaacgctaatgggctggggctgtatcccggacgatcatgaactgatggccgggatggtgggtctgcaaaccgcgcatcgttacggtaacgcaacgctgctggcgtctgacatggtgtttggtatcggtaaccgttttgctaaccgtcataccggctcggtagagaaatacaccgaagggcgcaaaatcgttcatattgatattgagccgacgcaaattggtcgcgtgctgtgtccggatctcggtattgtctctgatgctaaagcggcgctgacactgctggttgaagtggcgcaggagatgcaaaaagcgggtcgtctgccgtgtcgtaaagaatgggtcgccgactgccagcagcgtaaacgcactttgctgcgcaaaacccacttcgacaacgtgccggtgaaaccgcagcgcgtgtatgaagagatgaacaaagcctttggtcgcgatgtttgttatgtcaccaccattggtctgtcacaaatcgctgcggcacaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagctgttggcgcgcagttcaacattccgtacatccatgtgctggtcaacaacgcttatctggggctgattcgtcagtcacaacgcgcttttgacatggactactgcgtgcaactcgctttcgagaatatcaactccagtgaagtgaatggctacggtgttgaccacgtaaaagtagcggaaggtttaggttgtaaagctattcgggtcttcaaaccggaagatattgcgccagcctttgaacaggcgaaagccttaatggcgcaatatcgggtaccggtagtcgtggaagttattctcgagcgtgtgaccaatatttcgatgggcagcgaactggataacgtcatggaatttgaagatatcgccgataacgcagcggacgcaccgactgaaacctgcttcatgcactatgaataa

SEQ ID NO: 82143 - protein, 593 aa, Escherichia coli K12
MAKMRAVDAAMYVLEKEGITTAFGVPGAAINPFYSAMRKHGGIRHILARHVEGASHMAEGYTRATAGNIGVCLGTSGPAGTDMITALYSASADSIPILCITGQAPRARLHKEDFQAVDIEAIAKPVSKMAVTVREAALVPRVLQQAFHLMRSGRPGPVLVDLPFDVQVAEIEFDPDMYEPLPVYKPAASRMQIEKAVEMLIQAERPVIVAGGGVINADAAALLQQFAELTSVPVIPTLMGWGCIPDDHELMAGMVGLQTAHRYGNATLLASDMVFGIGNRFANRHTGSVEKYTEGRKIVHIDIEPTQIGRVLCPDLGIVSDAKAALTLLVEVAQEMQKAGRLPCRKEWVADCQQRKRTLLRKTHFDNVPVKPQRVYEEMNKAFGRDVCYVTTIGLSQIAAAQMLHVFKDRHWINCGQAGPLGWTIPAALGVCAADPKRNVVAISGDFDFQFLIEELAVGAQFNIPYIHVLVNNAYLGLIRQSQRAFDMDYCVQLAFENINSSEVNGYGVDHVKVAEGLGCKAIRVFKPEDIAPAFEQAKALMAQYRVPVVVEVILERVTNISMGSELDNVMEFEDIADNAADAPTETCFMHYE

SEQ ID NO: 82144 - DNA, 1749 bp, Caulobacter crescentus CB15
  CDS (1)..(1749): transl_table=11
atgaccggcgccgagatcgtggtccgcggcctcgtggaccaaggagtcgaggtgctgttcggctatccgggcggcgcggtcctgccgatctatgacgcgctgttccacgagccgcgcctgcagcacattctggtccgccacgagcagggcgcggcgcacgcggcagaaggctatgcgcgctcgtcgggcaagccgggcgtggtcctggtcacctcgggccccggcgcgaccaacgccatcaccggcatcatggacgccctgatggactcgatcccgatggtcgtcatcaccggccaggttccgacgcacctgatcggcaccgacgctttccaggaagccgatacagtcggcatgacccgctcgtgcaccaagcacaactatctggtcaaagacgtccgcgacctgccgcagatcatccacgaggcgttcaagatcgccaccaccggccgccctggccccgtactgatcgacatccccaaggacgtccagttcgccaagggcgagtacttcggtcccggcgaggtcgcctcgacccacgcctatgcgccgcgcaccaagggcgacgccggccgcatcgccgaggcggccaggatgatcgcccaagcgcgccgaccgatcttctacaccggcggcggcgtcatcaacgccggccccaaggccagcgcggcgctgcgcgagttcgccgccctgacgggcgcgccggtcacctcgacgctgatgggcctgggcgccttcccggcggcggatccggcgtggctgggcatgctgggcatgcacggcacgttcgaggccaacaacgccatgcacgactgcgacgtgatgatctgcgtcggcgcgcggttcgatgaccgggtcacgggccgcctcgacgccttctcgccgggcagcaagaagatccacatcgacatcgacccgtcctcgatcaacaaaaacgtccgcgtggacctgcccatcgtcggcgacgccggttcggtactggaagacctgatcgccgcctggaaggccgcgaacctacagccgaacaaggccgccctgaccgactggtgggcccagatcgaccagtggcgcgcccgtcagtgcctgtcctatcgccgctcggactcggtcatcaagccgcagtacgccatcgagcgcctgtacgagctgaccaaggacaaggacgtctacatcaccaccgaagtcggccagcaccagatgtgggccgcgcagttcttccgcttcgaggagccgaaccgctggatgacatccgggggcctcggcaccatgggctacgggctgcccgccgccctcggtgtgcaactggcgcacccgaacagcctggtcgtcgacatcgccggcgaagcctcgatccagatgtgcatccaggagctgtcgacggcgatccagttcgatctgccggtcaagatcttcatcctgaacaacgagtggatgggcatggtccgccagtggcaacagctgctgcacggcgagcgctatagccactcctattccgacagcctgcccgacttcgtgaagctggccgaggcctatggcgcggtcggcatccgttgcgacaaccccgccgagctggacgccaagatcctggagatggtcaacagcgacaagccggtgatcttcgactgccgcgtcgagaagcacgagaactgcctgccgatgatcccgtcaggcaaggcgcacaacgagatgatcatgggcgaggtcgaggacatcggcaacgtcatcggcgaggacggcgcggggctggtctaa

SEQ ID NO: 82145 - protein, 582 aa, Caulobacter crescentus CB15
MTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 82146 - DNA, 1866 bp, Synechocystis sp. PCC 6803
  CDS (1)..(1866): transl_table=11
gtggttgcatcaattcctaatcccaaaacaaatttcctgaaaactgttcctagccaacggcaaaccggggcttatatcctgatggatagcctgaaacgccatggggtcaaacacatttttggctatcccggcggggcaattttgcccatctatgatgaactgtaccgctttgaagcggcgggggaaattgagcatattttggtgcgccatgaacaaggagcttcccatgcggcggatgggtatgccagagccacaggtaaagtgggagtttgtttcggtacatctggaccaggggcgactaacttggtgaccggcattgccaatgcccatttggactcggtgcccatggtggtgattactggacaggtgggccgtgccatgattggtagcgatgctttccaggaaattgacatttttggcatcaccttaccgatcgttaagcactcctatgtggtacgtagtgcggcggatatggctcgcattgttactgaggctttccatcttgctagcaccggtcgtcccgggccggttttgatcgatattcccaaggatgtgggcttagaagaatgtgagtacattcccctcgaccccggtgacgttaatctaccgggttatcgccccacggttaaaggtaatccccgacaaattaatgcggcattgcaattgttggagcaggccagaaatcccttgctctacgtagggggaggggcgatcgccgccaatgcccatgcccaggtgcaggaatttgcggaaaggttccagttgccggtaacaaccaccctgatgggaattggggcttttgacgaaaaccatcccctttcggtgggtatgttgggtatgcatggcaccgcctatgccaactttgccgtcagcgaatgtgatttgttgattgcggtgggggcccgtttcgacgaccgggtaactggcaaactagacgaatttgctagccgcgccaaagtaattcacattgacatcgacccggcggaggtgggaaaaaacagggctcccgatgtgcccattgtgggggatgtacgccatgttttagaacagcttttgcagcgggcccgggaattggattaccccacccatccccataccacccaggcatggttaaatcgcattgatcattggcggaccgattaccccctccaggtgccccactatgaggatactattgccccccaggaggtagtacacgaaattggtcgccaggcccccgatgcctactacaccaccgatgtgggacaacaccaaatgtgggcggcccagtttttgaacaatggcccccgccgatggatttccagtgctggcttgggtacgatgggctttggtttacctgccgccatgggagccaaagtgggagtgggggacgaagcggtcatttgcatcagtggagatgccagcttccaaatgaatcttcaggaactgggaaccctagcccagtacgacatccaggttaaaactattattctcaataacggttggcaggggatggtgcgtcagtggcaacaaactttctacgaagaacgttattctgcttctaacatgtcccagggcatgccagacattaatctcctctgtgaagcctatggcatcaagggtattactgtgcgcaagcgggaagatttggccccggcgatcgccgaaatgctagcccacaatggtcctgtggtgatggatgtggtggtcaaaaaagatgaaaactgttaccctatgattgcccccggcatgagtaatgcccaaatgctaggtttaccggaagtgccggtacgggacaatggtccccggatggtggagtgcaaccattgccaaacccaaaatttcatcacccatcgtttctgttctggttgtggagccaaactctaa

SEQ ID NO: 82147 - protein, 621 aa, Synechocystis sp. PCC 6803
MVASIPNPKTNFLKTVPSQRQTGAYILMDSLKRHGVKHIFGYPGGAILPIYDELYRFEAAGEIEHILVRHEQGASHAADGYARATGKVGVCFGTSGPGATNLVTGIANAHLDSVPMVVITGQVGRAMIGSDAFQEIDIFGITLPIVKHSYVVRSAADMARIVTEAFHLASTGRPGPVLIDIPKDVGLEECEYIPLDPGDVNLPGYRPTVKGNPRQINAALQLLEQARNPLLYVGGGAIAANAHAQVQEFAERFQLPVTTTLMGIGAFDENHPLSVGMLGMHGTAYANFAVSECDLLIAVGARFDDRVTGKLDEFASRAKVIHIDIDPAEVGKNRAPDVPIVGDVRHVLEQLLQRARELDYPTHPHTTQAWLNRIDHWRTDYPLQVPHYEDTIAPQEVVHEIGRQAPDAYYTTDVGQHQMWAAQFLNNGPRRWISSAGLGTMGFGLPAAMGAKVGVGDEAVICISGDASFQMNLQELGTLAQYDIQVKTIILNNGWQGMVRQWQQTFYEERYSASNMSQGMPDINLLCEAYGIKGITVRKREDLAPAIAEMLAHNGPVVMDVVVKKDENCYPMIAPGMSNAQMLGLPEVPVRDNGPRMVECNHCQTQNFITHRFCSGCGAKL

SEQ ID NO: 82148 - DNA, 1653 bp, Synechocystis sp. PCC 6803
  CDS (1)..(1653): transl_table=11
atggggcaaatgaacaccgcagacctattggttcaatgtctggaaaatgaggacgttgaatacatttttggcgtacccggagaggaaaacctccacatcctcgaagcgctgaaaaactcgcccatccgctttattaccacccgccacgaacagggagcagcctttatggccgacgtttacggccgtttaacgggcaaagcgggggtttgtctttccaccctggggcctggagccaccaacctgatgaccggggtagcggatgctaacttggacggagcgcccctggtggccatcactggacaggtgggcacagatcggatgcacatcgaatcccaccaatacctggacttggtggccatgttcgacccggtgactaaatggaccaggcaaattgtccgccccagcattaccccggaagtggttcgtaaagcgttcaaattggctcagagcgaaaaaccaggggccacccacattgatttaccagaaaatattgccgctatgccggtggatgggaaacccctacggcgggacagtcgggaaaaggtttatgcagcttttcgtactttgggcacagcggccaacgccatttccaaggccaaaaaccccattattctggccggcaatggcaccatccgagccgaagccagcgaagccctgacggaatttgccaccagtttgaatattcccgtggccaacaccttcatgggtaaaggcaccatgccctacacccatcccctttccctttggacagtgggcttacaacaacgggatcacattacctgtgcctttgaaaaaagcgatttggtcattgcggtgggctatgacttaattgaatattctccgaaaaaatggaatcccactggagatttgcccatcattcacattggcgctactccggcggaaattgatagcagttatattccccaggtggaggtggtgggggacattaccgattccctgatggatttgctcaaacggtgcgatcgccaaggtaaacccactccctacggggcttctctccgggcggaaattcgggccgagtatgaatgttatgccaatgacacaggttttcccgttaagccacaaaaaattatttatgacctgcgccaagtgatgggccccgatgatgtggtgatttccgatgtgggggcccataaaatgtggatggcccgccattaccactgtgacagccccaacacctgtttaatttccaatggttttgcggccatgggcattgccattccaggggcgatcgccgctaagctggtttatcctgagcgcaacattgttgcagtgacgggggacggcggttttatgatgaactgtcaggagttggaaacggccatgcgggtgggcactccctttgtcacgttgatttttaacgacaacggttacggcctaattgagtggaaacagatcaaccaatttggcgaatccagctttattaaatttggcaatccagactttgttaagtttgctgaaagtatgggtctcaaaggttatcgggtggaagcggcggcggatttaattcctatcctcaaagaagctttagctcaacctgtgcccacagtgattgattgtcctgtggattatcgggagaatattcgtttctcgcaaaaagcaggggaattggcctgtgaaatttgggaataa

SEQ ID NO: 82149 - protein, 550 aa, Synechocystis sp. PCC 6803
MGQMNTADLLVQCLENEDVEYIFGVPGEENLHILEALKNSPIRFITTRHEQGAAFMADVYGRLTGKAGVCLSTLGPGATNLMTGVADANLDGAPLVAITGQVGTDRMHIESHQYLDLVAMFDPVTKWTRQIVRPSITPEVVRKAFKLAQSEKPGATHIDLPENIAAMPVDGKPLRRDSREKVYAAFRTLGTAANAISKAKNPIILAGNGTIRAEASEALTEFATSLNIPVANTFMGKGTMPYTHPLSLWTVGLQQRDHITCAFEKSDLVIAVGYDLIEYSPKKWNPTGDLPIIHIGATPAEIDSSYIPQVEVVGDITDSLMDLLKRCDRQGKPTPYGASLRAEIRAEYECYANDTGFPVKPQKIIYDLRQVMGPDDVVISDVGAHKMWMARHYHCDSPNTCLISNGFAAMGIAIPGAIAAKLVYPERNIVAVTGDGGFMMNCQELETAMRVGTPFVTLIFNDNGYGLIEWKQINQFGESSFIKFGNPDFVKFAESMGLKGYRVEAAADLIPILKEALAQPVPTVIDCPVDYRENIRFSQKAGELACEIWE

SEQ ID NO: 82150 - DNA, 1782 bp, Salmonella typhimurium LT2
  CDS (1)..(1782): transl_table=11
atggcaaaaatgagagccgtggatgcggcaatgtatgtgctggaaaaagaaggtatcaccacagcattcggcgttcctggggctgcaatcaaccccttctattctgcaatgcgtaagcatggaggcattcgccatatactggcgcgtcatgtggaaggcgcttcgcatatggctgagggctacacacgtgcggcggcaggtaatattggggtctgcctgggcacttccggcccggcgggaaccgacatgatcaccgcgctctattccgcttctgccgactccatcccgattttatgcattaccggccaggcgccacgagcgcgtctgcacaaggaagatttccaggcagtcgatattgaagcgattgcaaaaccagtcagcaagatggcagtgacggttcgtgaggcggcgctggtgccgcgcgtattacaacaggcttttcatctgatgcgctcaggccgcccaggtcctgtgctggttgatttaccgtttgatgtccaggttgcggagatcgaattcgatccggatatgtatgagccgttgccggtatataagccagccgccagccgcgtacagattgaaaaggcgctggagatgctgattcagtccgagcgtccggtaattgtcgcgggcggcggggttattaacgccgacgccgcgccactgctgcagcagtttgccgaactgaccaacgtaccggtgatccctaccctgatgggctggggctgtatcccggacgatcaccccttaatggcggggatggtcggcctgcaaacggcgcaccgctacggcaacgccactctgctggcatccgatatggtttttggcatcggtaaccgcttcgccaaccgtcatacggggtccgttgagaaatatactcaggggcgaaaaatcatccatatcgatattgaaccgacgcaaattggtcgcgtgttgtgcccggatctaggcatcgtttcggacgccaaagcggcgctaacgttgctgatcgatgtcgcgcaggagatgcaaaaggcggggcgtttgccatgccggaagacctgggtggacgaatgccagcagcgtaaacggactttgctgcgtaaaacccactttgacaacgtgccagtgaagccgcagcgcgtctatgaagagatgaacaaagcctttggtcgcgatgtgtgctatgtcaccaccattggattgtcgcaaatcgcggcagcgcagatgctgcatgtgtttaaagacagacactggatcaactgcggccaggcggggcctcttggctggacaatcccggcggcattaggggtttgtgctgccgatccgcaacgcaatgtggtggcgatttccggcgatttcgacttccagttcctgattgaagagttagccgtcggcgcgcagtttaacattccgtatatccatgtgctggttaacaacgcttatcttggtctgattcgccagtcgcaacgcgcatttgacatggactactgcgtacagcttgcctttgaaaatatcaactccagcgaagtgaatggctatggcgttgaccatgtaaaagtggcggaagggttaggctgtaaagcaattcgtgtctttaaaccggaagatattgcgcctgcatttgaacaagccaaagcgctaatggcgcaatatcgcgttccggtggtggtggaagtcattctggaacgcgtaaccaatatttccatgggcagcgaactggataacgtaaccgagtttgaagaggttgcggatagtgcgaaagatgcgccaacagaaacctgttttatgaaatatgagtaa

SEQ ID NO: 82151 - protein, 593 aa, Salmonella typhimurium LT2
MAKMRAVDAAMYVLEKEGITTAFGVPGAAINPFYSAMRKHGGIRHILARHVEGASHMAEGYTRAAAGNIGVCLGTSGPAGTDMITALYSASADSIPILCITGQAPRARLHKEDFQAVDIEAIAKPVSKMAVTVREAALVPRVLQQAFHLMRSGRPGPVLVDLPFDVQVAEIEFDPDMYEPLPVYKPAASRVQIEKALEMLIQSERPVIVAGGGVINADAAPLLQQFAELTNVPVIPTLMGWGCIPDDHPLMAGMVGLQTAHRYGNATLLASDMVFGIGNRFANRHTGSVEKYTQGRKIIHIDIEPTQIGRVLCPDLGIVSDAKAALTLLIDVAQEMQKAGRLPCRKTWVDECQQRKRTLLRKTHFDNVPVKPQRVYEEMNKAFGRDVCYVTTIGLSQIAAAQMLHVFKDRHWINCGQAGPLGWTIPAALGVCAADPQRNVVAISGDFDFQFLIEELAVGAQFNIPYIHVLVNNAYLGLIRQSQRAFDMDYCVQLAFENINSSEVNGYGVDHVKVAEGLGCKAIRVFKPEDIAPAFEQAKALMAQYRVPVVVEVILERVTNISMGSELDNVTEFEEVADSAKDAPTETCFMKYE

SEQ ID NO: 82152 - DNA, 1689 bp, Salmonella typhimurium LT2
  CDS (1)..(1689): transl_table=11
atggcaagttcgggcacaacatctacacctcagcgctttacgggcgcggaatttattgttcattttctggagcgccaggggattcgtatcgtcaccggcattcccggcggttcgatcctccccgtttacgacgcgttaagccaaagtacgcaaatccgtcatattctggcgcgccacgaacaaggcgcggggtttattgcgcaggggatggcgcggacggagggtaaacctgctgtttgtatggcctgtagcgggccgggcgcgaccaatctggtcacggccattgccgatgcgcgcctggattctattccgttaatctgtattaccgggcaggttccggcgtccatgatcggtactgacgcgtttcaggaagtggatacctacggtatctctatccccatcaccaagcacaactatctggtcagaaatatcaatgagttgcctcaggtgatgagcgatgcttttcgtctggcgcagtcggggcgtcccggcccggtgtggatagacgttcctaaagatgtgcagacggcgacaattgagctggatgcgttgccgtcgccggcggaaaaatcacccccgccggagtttagcgcggagagtatccgcgaggccgccgcaatgattaacgcggcgaagcgtccggtgctgtatctgggcggcggcgtgatcaatgcgccgacacgcgtgcgcgaactggcggaaaaagcgcaactgccgacgacaatgaccttaatggcgctgggaatgctgcctaaggcgcatccgctgtcgttaggaatgctggggatgcacggcgcgcgcagtaccaattttattctgcaagaggccgatttactgattgttctgggcgcgcgttttgatgaccgggcgattggcaaaacggagcagttttgtccgaacgccaaaatcatccatgtggatatcgatcgcgccgagttaggcaaaattaagcagccgcatgtggctattcaggcggatgtcgatgatgtactggcacagttaattccccatatcgaggcacagccgcgggaagcatggcatcagttggtggcggacttgcagcaagaattcccttgcagtattccccaggaaaataacccgcttagtcactatgggctgattaacgcggtcgccgcctgtgtggacgacaacgcgattattaccactgacgtaggtcagcatcagatgtggaccgcgcaggcttatccgctcaaccgtccgcgtcagtggctgacttccggcgggctgggcaccatggggtttggtctgcccgcggcgattggcgcggcgctggcgaatccgggcaacaaggtgctgtgtttttccggcgacggtagtttgatgatgaatattcaggagatggctaccgccagtgaaaaccagttggatgtgaaaatcatcctgatgaataacgacgcgctgggactggtacatcagcaacagagtctgttctataaacagggcgtttttgcggcgacctatccgggaagcatcaactttatgcagattgccgccgggtttggtctggacacctgtgatttgaataacgaagccgatccgcaggcggcgttgcaggctatcattcgtcgtcctggaccggcgttgatccatgtgcgcattgatgcagaagaaaaagtgtatccgatggtgccgccgggcgcggcaaatacagagatggtgggggaataa

SEQ ID NO: 82153 - protein, 562 aa, Salmonella typhimurium LT2
MASSGTTSTPQRFTGAEFIVHFLERQGIRIVTGIPGGSILPVYDALSQSTQIRHILARHEQGAGFIAQGMARTEGKPAVCMACSGPGATNLVTAIADARLDSIPLICITGQVPASMIGTDAFQEVDTYGISIPITKHNYLVRNINELPQVMSDAFRLAQSGRPGPVWIDVPKDVQTATIELDALPSPAEKSPPPEFSAESIREAAAMINAAKRPVLYLGGGVINAPTRVRELAEKAQLPTTMTLMALGMLPKAHPLSLGMLGMHGARSTNFILQEADLLIVLGARFDDRAIGKTEQFCPNAKIIHVDIDRAELGKIKQPHVAIQADVDDVLAQLIPHIEAQPREAWHQLVADLQQEFPCSIPQENNPLSHYGLINAVAACVDDNAIITTDVGQHQMWTAQAYPLNRPRQWLTSGGLGTMGFGLPAAIGAALANPGNKVLCFSGDGSLMMNIQEMATASENQLDVKIILMNNDALGLVHQQQSLFYKQGVFAATYPGSINFMQIAAGFGLDTCDLNNEADPQAALQAIIRRPGPALIHVRIDAEEKVYPMVPPGAANTEMVGE

SEQ ID NO: 82154 - DNA, 1647 bp, Salmonella typhimurium LT2
  CDS (1)..(1647): transl_table=11
atgaacggggcacagtgggtggtacatgctttgcgagcgcagggggtgaaaaccgtatttggttatcctggcggcgcaattatgccggtttacgacgcgttgtatgacggtggtgtggagcatttgttgtgccgacacgagcagggtgcggcaatggcggcaatcggttatgcccgttctaccggcaaaaccggtgtttgtatcgccacttccggccctggcgccactaacctgatcactggcctggcggatgcgttgttagattcggtccccgtcgtcgcgatcacgggtcaggtttccgccccgttcatcggcaccgatgcgttccaggaggtggatgtgttagggctgtcgctggcctgtaccaaacacagcttcctggtgcagtcgctggaagagttgccgcgcatcatggcggaggcttttgaagtcgccaacgctggccgtcctggcccggttctggtggatatcccgaaagatatccagttggccagcggtgagctggaaccctggtttactaccgttgctaacgaagcgactttcccgcaggctgatgtggaacaggcgcgccagatgctggaacaggcgaaaaaacccatgctgtacgtcggcggtggtgttggtatggcgcaggcagttccggcgctgcgtaaatttatcgcggtaacgcaaatgccagttacctgcacgctgaaagggctgggggctgttgaagctgattatccgtactatctgggcatgctgggaatgcacggtactaaagcggctaatttcgcggtgcaagagtgtgatttactgatcgcagtgggtgcacgttttgatgaccgggtgaccggtaagctgaatacgtttgcgccgaacgccagcgtaatccatatggatatcgacccggcggaaatgaacaaactgcgtcaggcacacgtcgcgttgcagggcgatttaaattcgctgttgccggcattacagcaaccgctgaagatcgacgcatggcgtcagtcctgtgcagagctgcgcgcagaacacgcctggcgctatgaccatcctggcgagactatctatgcgccgttgttgttgaagcaattgtcggaacgcaaacccgcagacagcgtggtgacgacggatgtggggcagcatcagatgtggtcagcccagcatatgacttacacccgcccggagaacttcatcacctccagcggtctggggacgatgggattcggcttaccggcggccgttggcgcgcaggtagcgcgaccgaatgataccgttatctgtatctccggtgacggctccttcatgatgaatgttcaggagttgggcaccgtaaaacgcaagcagttaccgttgaagatagtcttactcgacaaccagcggttagggatggttcgacaatggcagcaactgtttttccaggagcgatatagcgaaaccaccctgaccgataaccccgatttcctcatgctggccagcgccttcggcattccaggccagcacattactcgtaaagaccaggttgaagcggcactcgacacgatgttggcaagcgaagggccgtacctgcttcacgtctcaatcgacgaacttgaaaatgtctggccgttggtgccgcctggcgccagtaactctgaaatgctggagaaattatcatga

SEQ ID NO: 82155 - protein, 548 aa, Salmonella typhimurium LT2
MNGAQWVVHALRAQGVKTVFGYPGGAIMPVYDALYDGGVEHLLCRHEQGAAMAAIGYARSTGKTGVCIATSGPGATNLITGLADALLDSVPVVAITGQVSAPFIGTDAFQEVDVLGLSLACTKHSFLVQSLEELPRIMAEAFEVANAGRPGPVLVDIPKDIQLASGELEPWFTTVANEATFPQADVEQARQMLEQAKKPMLYVGGGVGMAQAVPALRKFIAVTQMPVTCTLKGLGAVEADYPYYLGMLGMHGTKAANFAVQECDLLIAVGARFDDRVTGKLNTFAPNASVIHMDIDPAEMNKLRQAHVALQGDLNSLLPALQQPLKIDAWRQSCAELRAEHAWRYDHPGETIYAPLLLKQLSERKPADSVVTTDVGQHQMWSAQHMTYTRPENFITSSGLGTMGFGLPAAVGAQVARPNDTVICISGDGSFMMNVQELGTVKRKQLPLKIVLLDNQRLGMVRQWQQLFFQERYSETTLTDNPDFLMLASAFGIPGQHITRKDQVEAALDTMLASEGPYLLHVSIDELENVWPLVPPGASNSEMLEKLS

SEQ ID NO: 82156 - DNA, 1722 bp, Listeria monocytogenes EGD-e
  CDS (1)..(1722): transl_table=11
gtgattgatacgacgaagacaaatgaaaaagcgacaaaaaagcaaaataaaagtggagcggaacttttaattgacgccttgaaaaaacaacaagttgacatgatttttggttatccaggtggcgctgtgttacctctctatgatgctttttatgactgcgatatcccgcatattctaacacgacacgagcaaggagcgattcatgctgcggaaggttatgctcgcgttactgggaaacctggtgttgtggttgtaacgagtggccctggtgcaaccaacgtactaactggtatcgcggatgcaatgagtgactcgattccattagtaatttttaccggacaagttcatacgcctggtatcggaaaagatgctttccaagaagccgatatgattgggctaacgattccaattactaaatacaattaccaagtgcgtgatgttcgtgacttaccaaaaatcgtcaatgaagcttttcatattgcaagtactggtcgtaaaggccctgttgtcgtggatattccaaaagacatggggattatccaaacagagtctgtccggccagatacgattgatctgccgggttatcaaccgacttattcaccgaacccacttcaacttgaaaaactaatgcaatctctttccgccgcaagtaagccactaatacttgccggagctggcgtcaatcatgcgagagctacagctgaattactagaattcgctgaacgctatcaaattcctatcgtgaatacactgcttggtctaggaagtttcccgcaaagccatgatttattccttggtatgggtggtatgcacggttcttatgcagcaaatatggcgctaacggattgcgacttgctgattaattttggctccagattcgacgaccggcttgcaagcgcgccgaaagaatttgccacgaaagcaaccattgctcatatcgatattgatcccgcggaaatcggcaaaattatcgaaacgcaaattccaatcgtggcggatatcaacgaaacgctcacgcaactactacaaatggaacttccggttcatccggatacatcccattggtacaaattaaatatgacgcgcaaaaaccgtcatccttttaattttgatagaacgaaaaaagcggaaattaaaccacagcgtgtcattgagctaattggtgaaattacgcaaggtgaagcgcttgtttctaccgatgttggacagcatcaaatgtgggcggcgcagttttatccattccaattcgatcatcaaattattacaagtggtggtcttggcacaatgggctttggattccccgcagccgttggggcacaactcgctttcccagataaaacggtagtcgcaattgttggcgatggcggtttccaaatgaccaaccaagaactcgcgattttaaacgattatcaaatcaatgtaaaaacggtcattatcaataatggttcgcttgggatggttcgtcagtggcaagaaaaattccacggtgaaagatattcccattcgattttcacgagccaaccagattttgtcaaactatctgaagcttacggtgtcaaaggtgttcgcctaacaaatccggaaacactagaaaaagatttaagaaaagcgttcgctcacccagggccaatcgtaattgatgtccatgtagcaaaagacgaactagtacttccaatggttccaagcggcaaaccaaatcaccaaatggaaggggtggaataa

SEQ ID NO: 82157 - protein, 573 aa, Listeria monocytogenes EGD-e
MIDTTKTNEKATKKQNKSGAELLIDALKKQQVDMIFGYPGGAVLPLYDAFYDCDIPHILTRHEQGAIHAAEGYARVTGKPGVVVVTSGPGATNVLTGIADAMSDSIPLVIFTGQVHTPGIGKDAFQEADMIGLTIPITKYNYQVRDVRDLPKIVNEAFHIASTGRKGPVVVDIPKDMGIIQTESVRPDTIDLPGYQPTYSPNPLQLEKLMQSLSAASKPLILAGAGVNHARATAELLEFAERYQIPIVNTLLGLGSFPQSHDLFLGMGGMHGSYAANMALTDCDLLINFGSRFDDRLASAPKEFATKATIAHIDIDPAEIGKIIETQIPIVADINETLTQLLQMELPVHPDTSHWYKLNMTRKNRHPFNFDRTKKAEIKPQRVIELIGEITQGEALVSTDVGQHQMWAAQFYPFQFDHQIITSGGLGTMGFGFPAAVGAQLAFPDKTVVAIVGDGGFQMTNQELAILNDYQINVKTVIINNGSLGMVRQWQEKFHGERYSHSIFTSQPDFVKLSEAYGVKGVRLTNPETLEKDLRKAFAHPGPIVIDVHVAKDELVLPMVPSGKPNHQMEGVE

SEQ ID NO: 82158 - DNA, 1644 bp, Nostoc sp. PCC 7120
  CDS (1)..(1644): transl_table=11
atgaatacagcagaactgttagtacagtgtttagaaaatgaaggggtacaatatgtttttggacttccaggcgaagaaaacttacacgttttagaagcgcttaaacattcctctattcaatttattacaacccgtcatgaacaaggtgcagctttcatggcagatgtttacggacggttgacaggaaaagccggcgtatgtctttccaccttggggccgggggcgacaaatctcatgactggggtggctgatgccaacctggatggtgcgcctttggtggcgattactggacaagtgggaaccgatagaatgcacatcgaatcccatcaatatctagatttagtggcgatgtttgctcctgtaactaagtggaataaacagattgtccgaccgagtattacacccgaagtagtgcgtaaagccttcaagcgatcgcaaagcgaaaaaccaggggcagttcacatagatttaccagaaaatattgccgctatgcccgtagagggcaaacctttgcagaaagacaatatcgagaaaacatacgcatctttcgccagtattcgtgccgccgccgccgctatttctcaagctgttaatcccttaatcttagtgggaaatggtgcaattagggctaaagctagtgatgccgtcacccaatttgctacccaaatgaatatccctgttgctaatactttcatgggtaaaggtgtgattccttacactcatcccttagccttatggtcagtaggattgcaacaaagagatttcattacctgcggttttgataatacagatttagtaattgctattggttatgatttgatcgaattttcacccaaaaaatggaacccagaaggcaaaattcctattgtccatattggtgcagattcggcggaaattgacagtagctatatccctaatgtatccgttattggtgatatttctgattctctagtagaaatattaaaagtagcagatagacaaggcaaacctaatccttatgctatcagcttaagaggcaatattcgggaagattacgaacaatatgccaatgatgatggttatccgattaagccacaaaagttgatctatgacttacggcaagtaatggggcccgatgatatcgtaatttccgatgtcggcgctcataaaatgtggatagcccgtcattatcattgccacagccctaatacctgtattatttctaatggctttgccgcaatgggtattgctattcctggtgctttggctgcaaaactcgtttatcctaaccgtaaagttgtcgccgctactggtgacggtggctttatgatgaattgccaagaattagaaacagccctacgagttggtacaccattcgtcaccttaattttcaatgatggcggctacggtttaattgaatggaaacaagaaaatcaatttggtaaaggacaatcatcttttgtacatttcggcaatccagattttgtcaaattagccgaaagtatgggcttaaaaggttacagagttgaatcagctttagatttaattcccgtactcaaagaagccttagcgcaagatgtaccagctgtgattgattgtcctgtagattaccgagaaaatcgccgctttacacaaaaagctggtgagttaagttgttctgtttag

SEQ ID NO: 82159 - protein, 547 aa, Nostoc sp. PCC 7120
MNTAELLVQCLENEGVQYVFGLPGEENLHVLEALKHSSIQFITTRHEQGAAFMADVYGRLTGKAGVCLSTLGPGATNLMTGVADANLDGAPLVAITGQVGTDRMHIESHQYLDLVAMFAPVTKWNKQIVRPSITPEVVRKAFKRSQSEKPGAVHIDLPENIAAMPVEGKPLQKDNIEKTYASFASIRAAAAAISQAVNPLILVGNGAIRAKASDAVTQFATQMNIPVANTFMGKGVIPYTHPLALWSVGLQQRDFITCGFDNTDLVIAIGYDLIEFSPKKWNPEGKIPIVHIGADSAEIDSSYIPNVSVIGDISDSLVEILKVADRQGKPNPYAISLRGNIREDYEQYANDDGYPIKPQKLIYDLRQVMGPDDIVISDVGAHKMWIARHYHCHSPNTCIISNGFAAMGIAIPGALAAKLVYPNRKVVAATGDGGFMMNCQELETALRVGTPFVTLIFNDGGYGLIEWKQENQFGKGQSSFVHFGNPDFVKLAESMGLKGYRVESALDLIPVLKEALAQDVPAVIDCPVDYRENRRFTQKAGELSCSV

SEQ ID NO: 82160 - DNA, 1899 bp, Nostoc sp. PCC 7120
  CDS (1)..(1899): transl_table=11
gtgactgtgagcttgccttccccgactagtccctcacaaacagagaaacatactcagtctgttaattcgccatcggtggttgtgacaccacaacgggtaactggtggcttcgcgctacttgatagcctgctgcgccacggcgttgagtatatctttggttatcctggtggggcgattctgccgatttatgatgatctgtataaggtggaagcaactggcagccttaaacatattctagtgagacacgaacaaggagcagctcatgctgctgatggttatgctcgtgcaaccggaaaagtaggtgtatgctttggtacttctgggcctggggcaactaacttggtaacaggtatcgctacagcctacatggattcaattccaatggtgattgttactgggcaagtaccccggaaaatgatcggtacagatgcgttccaagaaaccgatatctacggtattactctacccattgttaagcactcctatgtagtgcgtgacccccaagacatggcgcgaattgtggcagaagcattccacatagccagcacaggccgtccagggccagtgttgattgatgtgccgaaagatgtggcttttgaacaatttgattatgtacctgtagaaccaggttcaattaaattacgcggatatcgccccacggtgaagggaaatccacgccaaattaacgccgcgattgaattgatccgcgaaagccgtcgtcctttactatacgttggtggtggggcgatcgcatctggcgctcatgcagaaattcaagaactcgccgagttatttaatatccccgtcactaccaccctaatgggtatcggggcttttgatgaacaccatcctttatccttggggatgttggggatgcacggcacagcttacgctaactttgctgtgactgattgtgatttattgatttgcgtgggtgctaggtttgatgaccgtgttactggcaaattagatgagtttgcttctcgtgccaaagtcattcacatcgatattgaccccgccgaagttggtaaaaaccgcattcctgaagtccccattgttggcgatgtgcggaaagtcttacttgatttattacgtcgttgcaaacaaacaagtgccaaaactacccccaaccaaaaccaagaatggcttaacttaattaaccgttggcgggaggattaccccctagtagttccccagcatccagacagcattcccccacaagaagtgattgtggaagtcggtagtcaagccccccacgccttctacaccactgatgttggtcaacatcaaatgtgggcagcccaattcctcaaaaatggcccccggcgttggatttctagcgcaggcttgggaactatgggttttggtttacctgccgcaattggcgctaaagtagctttcccagatgaacaagtaatctgtattagcggtgatgccagtttccaaatgtgtctgcaagagcttggtactgctgcacaatataagataaatgtcaagactgtaattctaaataacggctggcaagggatggtacgccaatggcaacaagcattccacggcgagcgctactcctgctcaaatatggaagtagggatgccagatgtagagttattggcacaagcctacggcattaagggtattgtagtcactcacagagagcaattgaaagatgcgatcgctcaaatgttagcctacgatggcccagttattttagatgttcgcgtcacaaaagacgagaattgctatcctatggtagctcctggtaagagtaatgctcaaatgattggtttaccgaagcaaccaccaaagaccagtgtcgaaccagtttattgcagccattgtggcacgtcaaatttaccaaatcacaatttctgttctgaatgtgggactaagttgtaa

SEQ ID NO: 82161 - protein, 632 aa, Nostoc sp. PCC 7120
MTVSLPSPTSPSQTEKHTQSVNSPSVVVTPQRVTGGFALLDSLLRHGVEYIFGYPGGAILPIYDDLYKVEATGSLKHILVRHEQGAAHAADGYARATGKVGVCFGTSGPGATNLVTGIATAYMDSIPMVIVTGQVPRKMIGTDAFQETDIYGITLPIVKHSYVVRDPQDMARIVAEAFHIASTGRPGPVLIDVPKDVAFEQFDYVPVEPGSIKLRGYRPTVKGNPRQINAAIELIRESRRPLLYVGGGAIASGAHAEIQELAELFNIPVTTTLMGIGAFDEHHPLSLGMLGMHGTAYANFAVTDCDLLICVGARFDDRVTGKLDEFASRAKVIHIDIDPAEVGKNRIPEVPIVGDVRKVLLDLLRRCKQTSAKTTPNQNQEWLNLINRWREDYPLVVPQHPDSIPPQEVIVEVGSQAPHAFYTTDVGQHQMWAAQFLKNGPRRWISSAGLGTMGFGLPAAIGAKVAFPDEQVICISGDASFQMCLQELGTAAQYKINVKTVILNNGWQGMVRQWQQAFHGERYSCSNMEVGMPDVELLAQAYGIKGIVVTHREQLKDAIAQMLAYDGPVILDVRVTKDENCYPMVAPGKSNAQMIGLPKQPPKTSVEPVYCSHCGTSNLPNHNFCSECGTKL

SEQ ID NO: 82162 - DNA, 1758 bp, Ralstonia solanacearum GMI1000
  CDS (1)..(1758): transl_table=11
atgaatatgccaagcgcggaattttcccacgccaatagcggttcacctgccgaaatgatggggtctgacatcctcgtcaatgcgctcgcggcagaaggcgtcgagttcgtctggggttacccgggcggcgcggtgctctatatctacgacgcgttctacaagcagaacaagatcgaacacatcctggtgcgccacgagcaggcggcggtccatgcggccgacggctatgcgcgcgccacgggcaaggtcggggtcgccctggtgacgtccggcccgggcgtgaccaatgccgtgaccggcatcgccaccgcctacctggattcgatcccgatggtgatcatcaccggcaacgtgccgacgcacgccatcggccaggacgccttccaggaatgcgacaccgtcggcatcacgcgcccgatcgtcaagcacaacttcctggtcaaggacgtgcgcaacctcgcttcgaccatcaagaaggcgttctacatcgcctcgaccggccgtccgggtccggtggtggtggacatcccgaaggatgtctcgcgcgagctgtgcaagtacgagtatccgaagaccatcgagatgcgctcgtacaacccggtcaacaagggccactccggccagatccgcaaggccgtgagcctgctgctgcaggccgagcgtccgtacatctacaccggcggcggggtggtgctggccaatgccagcgaagagctgcgccagctggcggccctcaccggctacccggtgacgaacacgctgatgggtctgggcgccttccccggcgccagcaagcagttcctcggcatgctgggcatgcatggcacgtacgaagccaacatggccatgcagcactgcgacgtgctgatcgccgtcggcgcgcgcttcgatgaccgcgtgatcggcagcccggcgcacttcgcctcgcagccgcgcaagatcatccacatcgacatcgatccgtcgtccatttccaagcgggtcaaggtggacatccccatcgtcggcaacgtcaaggacgtgctgcaggagatgatcgcccagatccaggcgggcgaggccaagccgaacaagacggcgctcgccaagtggtgggagcagatcgagcagtggcgcagcgtcgactgcctgaagtacgaccgcacctccgagatcatcaagccgcagtacgtggtcgagaagatctgggaactgaccgcgggcgatgccttcgtctgttccgacgtgggccagcaccagatgtgggccgcgcagttctacaagttcaacgagccgcgccgctggatcaactccggcggtctgggcacgatgggcgtgggcctgccgtatgccatgggcgtcaagaaggcgttcccggacaaggaggtcgtcaccatcaccggtgagggctcgatccagatgtgcatccaggaactctccacctgtctgcagtacgacacgccggtgaagatctgctcgctcaacaacggctacctgggcatggtgcgccagtggcaggagatcgagtacgacaaccgttattcgcactcctacatgcaggcgctgcctgacttcgtgaagctggccgaagcgtatggccacgtgggcatgcggatcgaaaagaccgccgatgtcgagcccgcgctgcgcgaagccttccgactcaaggaccgcaccgtgttcctcgacttccagaccgacccgaccgaaaacgtctggccgatggtccaggcaggcaagggcatctctgaaatgctgctcggcgcggaggatctgtaa

SEQ ID NO: 82163 - protein, 585 aa, Ralstonia solanacearum GMI1000
MNMPSAEFSHANSGSPAEMMGSDILVNALAAEGVEFVWGYPGGAVLYIYDAFYKQNKIEHILVRHEQAAVHAADGYARATGKVGVALVTSGPGVTNAVTGIATAYLDSIPMVIITGNVPTHAIGQDAFQECDTVGITRPIVKHNFLVKDVRNLASTIKKAFYIASTGRPGPVVVDIPKDVSRELCKYEYPKTIEMRSYNPVNKGHSGQIRKAVSLLLQAERPYIYTGGGVVLANASEELRQLAALTGYPVTNTLMGLGAFPGASKQFLGMLGMHGTYEANMAMQHCDVLIAVGARFDDRVIGSPAHFASQPRKIIHIDIDPSSISKRVKVDIPIVGNVKDVLQEMIAQIQAGEAKPNKTALAKWWEQIEQWRSVDCLKYDRTSEIIKPQYVVEKIWELTAGDAFVCSDVGQHQMWAAQFYKFNEPRRWINSGGLGTMGVGLPYAMGVKKAFPDKEVVTITGEGSIQMCIQELSTCLQYDTPVKICSLNNGYLGMVRQWQEIEYDNRYSHSYMQALPDFVKLAEAYGHVGMRIEKTADVEPALREAFRLKDRTVFLDFQTDPTENVWPMVQAGKGISEMLLGAEDL

SEQ ID NO: 82164 - DNA, 1824 bp, Brucella melitensis 16M
  CDS (1)..(1824): transl_table=11
atgaatgcaggtaaacatgaggcggaagcaaacgccgggcaagcgcaggacgcaggccatccacgcgaaatgaccggcgcagaaatggttatccaggcgctgatcgatcagggtgtggaaagcattttcggctatcccggcggcgcggtgcttccgatttatgacgggctgtttcagcaggatcaaatccagcacgttctggttcgccatgagcagggtgcaggccatgcagcggaaggctatgcgcgctcgacgggtaaagtcggcgtcatgctcgtcacttcggggccgggtgcaaccaatgccgtgacgccgttgcaggatgccttgatggattccatcccgctggtctgcatttccggtcaggttcccacgacgctgatcggttccgatgcgtttcaggaatgcgatacgattggcatcacgcgcccctgcaccaagcacaactggctggtaaaggacgtcaacgacctgtcgcgcgtcctgcatgaagctttccatgtcgcatccaccggccgtcccggccccgtcgtcgtcgatattccgaaggatattcagttcgccaagggcatctatacgccgccggaaactgcaccgcgcacaagttaccgtccagttctcgacggcaatgccgaggctatttccgaggctgtccgtctgctcgccaatgccagaaagccggttatttattcgggcggcggcgtgatcaattccggccccgcggcttcccgtctgctgcgtgagctggtcgagatcagcaatttcccgatcacctccacgctgatggggcttggcgcctatcccgcctccggcaagaactggctcggtatgctgggcatgcacggcacctatgaagccaacatgaccatgcatgattgcgatgtcatgctgtgcgtcggtgcgcgtttcgacgaccgcatcaccggccgcctcaacgctttctcgccgaattccaagaaaattcatatcgatatcgatccgtcgtcgatcaacaagaacgttcgggtcgatgtgccgatcatcggcgatgtcgcgcatgtgctggaggatatcgtccgccagtttcgtgctttcgaccgcaagccggacaggcaggcattgaccgaatggtgggggcagatcgaccgttggcgcgcgcgcaattcgctggcctatacgccgaacaaagacgtcatcatgccgcaatatgccatcgagcggctttatgaactgaccaggaaccgcaacacctatatcaccaccgaggtgggccagcaccagatgtgggcggcgcaattcttcggctttgaacagccgaaccgttggctgacttccggcggccttggcaccatgggctatggtctgcctgcggcgctgggcgtgcagattgcacatccggatgcgctggttatcgatattgcaggcgatgcctcgatccagatgtgtatccaggaaatgtcggcagcaatccagcataatgcgccgatcaagattttcatcctgaacaaccagtatatgggcatggtgcgccagtggcagcaattgctgcatggcaaccgcctgtcgcattcctacacggaagcgatgcccgatttcgtgaaacttgcggaagcatacggcgcgcacggcattcgctgcgagaagccgggcgatctcgatgccgccattcaggagatgatcgatatcgacaagccggtcattttcgattgccgcgtggcaaaccttgccaactgcttcccgatgatcccgtcgggcaaggcgcataatgaaatgctgttgccggacgaagcgacagatgaggccgtcgccaatgccattgatgccaagggccgcgcgctcgtctga

SEQ ID NO: 82165 - protein, 607 aa, Brucella melitensis 16M
MNAGKHEAEANAGQAQDAGHPREMTGAEMVIQALIDQGVESIFGYPGGAVLPIYDGLFQQDQIQHVLVRHEQGAGHAAEGYARSTGKVGVMLVTSGPGATNAVTPLQDALMDSIPLVCISGQVPTTLIGSDAFQECDTIGITRPCTKHNWLVKDVNDLSRVLHEAFHVASTGRPGPVVVDIPKDIQFAKGIYTPPETAPRTSYRPVLDGNAEAISEAVRLLANARKPVIYSGGGVINSGPAASRLLRELVEISNFPITSTLMGLGAYPASGKNWLGMLGMHGTYEANMTMHDCDVMLCVGARFDDRITGRLNAFSPNSKKIHIDIDPSSINKNVRVDVPIIGDVAHVLEDIVRQFRAFDRKPDRQALTEWWGQIDRWRARNSLAYTPNKDVIMPQYAIERLYELTRNRNTYITTEVGQHQMWAAQFFGFEQPNRWLTSGGLGTMGYGLPAALGVQIAHPDALVIDIAGDASIQMCIQEMSAAIQHNAPIKIFILNNQYMGMVRQWQQLLHGNRLSHSYTEAMPDFVKLAEAYGAHGIRCEKPGDLDAAIQEMIDIDKPVIFDCRVANLANCFPMIPSGKAHNEMLLPDEATDEAVANAIDAKGRALV

SEQ ID NO: 82166 - DNA, 1695 bp, Brucella melitensis 16M
  CDS (1)..(1695): transl_table=11
atgcatatcatgacgagcaaaccaaatgtccgtaccggaggccagattttggtggatgcgctgcgcatccatggcgcggaccgggtcttctgcgtgcccggcgaaagctatctcgctgcgctcgacgcctttcacgatgcaagcgacgccatcgacctgattgtctgccggcaggagggcggggcatcctatatggcagaggcctatggcaaactgacgggtaagcccggcatttgcttcgtcacgcgcggccccggcgccaccaatgcatcgattggcgtgcacacggcttttcaggattcgacgcccatgctgctcttcatcggtcaggtcgcaagcgatcaggtcgagcgtgaggcatttcaggaaatcgattatcgccgcatgttcggccagatggccaaatgggtcgtgcagattgacgatgccgcgcgcattcccgaactggtgagccaggcattccatcgcgcggtgaacgggcgtcccggtccggtggtggtcgccttgccggaagacatgctgacgtcctatgcggcggtcagcgatgcgcctgcctataagcaggtggccatgcatccgggtggcgaacagttgcaggcaatgcgggcgctgatcgaaaaggcagagcgtccgctgatgatcgtcggcggcggtggctggacacaggatgccgtgcgcgacctgcgccagtttgccgaaaatatgtctctgccggttgccgcatccttccgctgtcaggatatgttcgacaatacgcatcccctttatgcgggcgaaatggggacctcgatcagtgccaggcttgtccagcgggtgaaggattccgacctgcttgtcgtggttggcgcgcgccttggtgaaatgacgacacagggctatgaactcgtcaccattccggtgccgcagcagaagcttgtccatatccatccgggcgcggaggaactgggccgggtctatcatgccgatgttccgatcaatgccgggatgcctgccttctgtgctgcggctgcaaagcttgcgccggttgccgatccgcgctggaaggcatgggccgacagcgccaatgccgactatcgcgacaatatcaagtcgccggtcatttcgggcgaagtgcagatgggcgaggtgatggagtggctgcgcgcgcatctgcccgccgatgccattatcaccaatggcgcgggcaattattccgcatggccgcatcgcttttaccagtatcgcacctatcgcagccagttggccccgaccaatggctccatgggctatggtgtgccggctgctgttgcggccaagctcaccgcgccggagcggaccgtggtggctttcgcgggagatggctgtttcctcatgaacgggcaggagcttgcaactgccgcgcaatatggcgcgaatgccattttcatcgtcgtgaacaacggcatgtatggcacgatccgtatgcatcaggagcgcacctatccggcgcgcatttcgggtacggccctggccaatcccgactttgcggcgcttgcgcgggcctatgggctgcatggtgaagtagtggaaaagaccgctgatttcgcacccgccttcaagcggtgcgaacagtccggcaagccggcgctgatcgagatcaggatcgatcccgaggcactgtcgcccaagatgagcctcagccagatgcgggagcagggtttcgcgaaacagcgctga

SEQ ID NO: 82167 - protein, 564 aa, Brucella melitensis 16M
MHIMTSKPNVRTGGQILVDALRIHGADRVFCVPGESYLAALDAFHDASDAIDLIVCRQEGGASYMAEAYGKLTGKPGICFVTRGPGATNASIGVHTAFQDSTPMLLFIGQVASDQVEREAFQEIDYRRMFGQMAKWVVQIDDAARIPELVSQAFHRAVNGRPGPVVVALPEDMLTSYAAVSDAPAYKQVAMHPGGEQLQAMRALIEKAERPLMIVGGGGWTQDAVRDLRQFAENMSLPVAASFRCQDMFDNTHPLYAGEMGTSISARLVQRVKDSDLLVVVGARLGEMTTQGYELVTIPVPQQKLVHIHPGAEELGRVYHADVPINAGMPAFCAAAAKLAPVADPRWKAWADSANADYRDNIKSPVISGEVQMGEVMEWLRAHLPADAIITNGAGNYSAWPHRFYQYRTYRSQLAPTNGSMGYGVPAAVAAKLTAPERTVVAFAGDGCFLMNGQELATAAQYGANAIFIVVNNGMYGTIRMHQERTYPARISGTALANPDFAALARAYGLHGEVVEKTADFAPAFKRCEQSGKPALIEIRIDPEALSPKMSLSQMREQGFAKQR

SEQ ID NO: 82168 - DNA, 1671 bp, Pyrobaculum aerophilum str. IM2
  CDS (1)..(1671): transl_table=11
ttgggaatcccgggcggtcagataatgccgttatttgacgccttgtacggccaagacatcgagacaattctattcagacatgaacaaggcgctatacacgccgcggagggatatgcaagggtgtcggggaggccggcggtagtggcagttactagcgggcccggcgccacgaacttagtgactgggattacagatgcctatatggactcaacacctgtggtggctataacgggacaggtcgtcacgagcgtttttgggcgcgatggctttcaggaaactgatatcttaggcgtagttacccctgtcacgaagtttacctatcaagtcaaaaaaccttcggaggccacttcggcctttaaaaccgcctatgaaatctccataattggaaggccggggcccacgttaatcgacttgcccagagatatacaattggcgccagcgccagattatgaagaaaagataattgtgaacagagagaaatttattccgccgccgcctgacgaggacaagttaaggctagccgccaagtatctcattgaggctaaaagacctgtgatattagtcggcggcggcgttttatggtcgggggcaaccccagaggttttagaagtctctaggctgttaaatgcgcctattgtatcaactctgccgggaaagacggcagtgccacacgactaccccctctatatgggaccggcgggcatgcacggacgcgttgaggcagatgccgcattggcaaatgccgacgtaattctagccgtgggcacaaggtttagcgacagaacctgggggaggtttaaggaattaattgaaaatgtaacaagcggtaaattaaaactaatacatattgatatagacaaaagtgaaatagggaaaaatgtgaagccaactgtcggtattgtaggagatgctaaaatagccttaagaaaacttatagattatattcaatctggtgcaattcaaaataataggttcatatcatggctattaaatatacgtaaaatgtatgatgaggccatgtccaaaatagctaattcaacgcctggttttcacccgtggaaggctcttaaagtgataagaaatgccgctccaagaaacacaatcacagtgaccggcgtggggtcgcaccaaatgtgggctgagatagcatgggatgtttacgagcctggtagcttcatcacgtcggccggattgggcaccatgggcttttgcgtccccgcagcgctgggagcaaaattagcagaccgctctagaccggtattgtgtattgatggagacggctccttccaaatgacaatgaacaacctggcgttagtcagagactataacttacccatagtggtaacgatttttgacaacagagctctgcaattagtaaaacagtggcaagtatatttgtataaaaggaggataatcgcaacggagtttagcccaagacctgacttcttaaaaatcgccgaggcttacgacatcgaaggcgttaggcccgaaagctacgaggaacttgagcgcgttgtgtctagagctttaaaaaacgacgagccgcttatcgtcgatttaattatagacagtgaatatgacatagtgctaccctgggtgaagccgggggactggctcacctcagtcataatgccagaaggcatgcacgtgcaactaacttatgaggattag

SEQ ID NO: 82169 - protein, 556 aa, Pyrobaculum aerophilum str. IM2
MGIPGGQIMPLFDALYGQDIETILFRHEQGAIHAAEGYARVSGRPAVVAVTSGPGATNLVTGITDAYMDSTPVVAITGQVVTSVFGRDGFQETDILGVVTPVTKFTYQVKKPSEATSAFKTAYEISIIGRPGPTLIDLPRDIQLAPAPDYEEKIIVNREKFIPPPPDEDKLRLAAKYLIEAKRPVILVGGGVLWSGATPEVLEVSRLLNAPIVSTLPGKTAVPHDYPLYMGPAGMHGRVEADAALANADVILAVGTRFSDRTWGRFKELIENVTSGKLKLIHIDIDKSEIGKNVKPTVGIVGDAKIALRKLIDYIQSGAIQNNRFISWLLNIRKMYDEAMSKIANSTPGFHPWKALKVIRNAAPRNTITVTGVGSHQMWAEIAWDVYEPGSFITSAGLGTMGFCVPAALGAKLADRSRPVLCIDGDGSFQMTMNNLALVRDYNLPIVVTIFDNRALQLVKQWQVYLYKRRIIATEFSPRPDFLKIAEAYDIEGVRPESYEELERVVSRALKNDEPLIVDLIIDSEYDIVLPWVKPGDWLTSVIMPEGMHVQLTYED

SEQ ID NO: 82170 - DNA, 1695 bp, Pyrococcus furiosus DSM 3638
  CDS (1)..(1695): transl_table=11
atggaaatgtccggtgcaaaagccctcgtccgggccctcgaaaaagaaggcgtgcaacacacgtttgggataattggtggaagtataatgccagtgtttgatgaactactagatagcaacataagacacataaccactagacacgagcagggagcagcccatgctgcagatggatacgcaagagtaagtggaaggcctggggtggcaataactacctcaggcccaggggccacaaatctagttactggaatagctacggcatatatggactcatcacctatagtagcattgacagggcaggttccaacatacatggtaggaaagatggcgtttcaagaaacggatatcataaacataactaagccaataacaaagtggaattaccaggtgaaaagaccgagggagatccccgaagctgtaaaaatggcattcacaatcgccacactaggaagacctggccctacactaattgaccttcctaaggatgctcaaacagatgttgaagatgtagattttgacgttgatatttcccaaaaggtaacgccctggagaccacctaagcttgatgcttgccctgaagaggtaaagaaagctgttgacatgattctctcagctgagagacctgtgatcattgttggtggaggagttgtttggtcaggagcaactgatgaagttttggctatagctgagtacttgctaatcccaataatggccaccttcatggggaaaggagccgtcccagaaaatcatccactctacgtgggaaatcttggaatgcacggaaaaattgctgcaaacaaactccttcctcagactgatttgataatagctgtaggaatgaggtggagcgataggacagttagcgaatttgagaactttgctccagaggctaagataatacacattgacattgacccgaaggaagttgggaagaacgtaaaagtggacctagggattataggggatgccaagagagtactcagggctatctacaacgaaattgttagaagggcaaagaaaagagagagctggccatggttagagaaagttagggaattcaaagagaaatataaagaagagctagtcccaattgatggggactatctcagaccccctgagattttgaaggagttgaggaagctcctccctccagatgccatagttgcaactgaagttggacaaaatcaaatgtgggtagcgttgttcttcccaatactaaagcctaggactttcttgacttcgggtggattggggacaatgggctttggcttcccagcggccataggggcaaaggtagcaaagccagagaaggtagttgtggatattgcgggtgatgggagctttatgatgtccgaaagagaattggccacagcagtcaacgaaaatcttccagtaatagtgataattctcaacaactcctccctgggaatggtcgcccaatggcagagaatgttctacaatagaagatacatagctacttatttcaaaaagaatcctgattttgtcaagctggctgaggcttatggagccaatggatacaaggctgagactatggatgagttgctcaaagcggtgaaggaaggaatgaactctgatgttcccacggttatagacgtcccaatccatccggaggatgatgttctcccaatggttcctcctgggcaacacatctcaaacgttgtgacaaggtattga

SEQ ID NO: 82171 - protein, 564 aa, Pyrococcus furiosus DSM 3638
MEMSGAKALVRALEKEGVQHTFGIIGGSIMPVFDELLDSNIRHITTRHEQGAAHAADGYARVSGRPGVAITTSGPGATNLVTGIATAYMDSSPIVALTGQVPTYMVGKMAFQETDIINITKPITKWNYQVKRPREIPEAVKMAFTIATLGRPGPTLIDLPKDAQTDVEDVDFDVDISQKVTPWRPPKLDACPEEVKKAVDMILSAERPVIIVGGGVVWSGATDEVLAIAEYLLIPIMATFMGKGAVPENHPLYVGNLGMHGKIAANKLLPQTDLIIAVGMRWSDRTVSEFENFAPEAKIIHIDIDPKEVGKNVKVDLGIIGDAKRVLRAIYNEIVRRAKKRESWPWLEKVREFKEKYKEELVPIDGDYLRPPEILKELRKLLPPDAIVATEVGQNQMWVALFFPILKPRTFLTSGGLGTMGFGFPAAIGAKVAKPEKVVVDIAGDGSFMMSERELATAVNENLPVIVIILNNSSLGMVAQWQRMFYNRRYIATYFKKNPDFVKLAEAYGANGYKAETMDELLKAVKEGMNSDVPTVIDVPIHPEDDVLPMVPPGQHISNVVTRY

SEQ ID NO: 82172 - DNA, 1698 bp, Methanopyrus kandleri AV19
  CDS (1)..(1698): transl_table=11
gtgagtgagttgcccacgggtgccagggtactcgtcgagtgcttgaaagaagagggcgtcgagcacattttcgggtacccgggaggtgccgtcctaccgatttatgacgagatctacgacgaggtttcgatcgaacacatcctcgtacgacacgagcagggagctgcccacgccgccgacgggtacgcgagggtgaaagggaaacccggagtctgcatggcgacatcgggacccggagcgacgaacctagtcacgggtatcgccacggcttacatggactcgtccccggtaatagccatcaccggacaggtccccaccaccatgatcgggaaggacgcgttccaggaggtcgacgccgtcggcgtgttcatgcccatcactaagcataactaccagatagggaaacccgaggagataccggaagtcgtgaaggaggcgttcaagatagctatcaccggtcggccggggcctgttcacatcgacgtgcccaaagacgtgcaggaagcggaagtggatgtcgagatacccaaaaccgtcgaggtcgagggcttgaacgtggtcaagcgcggtcatccggtacagatcaaacgggccgcggagttactcgccgaggcggagcgacccgtcatcttagcaggcggtgggtgtgtaatctccaacgctactcgggagctgatcgagctcgcggaactgctcggtgctccggtagctacgaccctcatggggaagggagcgtttcccgaggatcatccactagcactgggtatggccggtatgcacggcactaaggccgcgaactacgcgctgacggagtgcgacgtgctactcgctgtagggtgcaggttctcggacaggactacgggggatccctccggattcgctcccgaagcgaagatcatccatattgacatagaccccgccgagatcggcaagaacatcccagtcgacgtgcccatagttggtgatgcgaagctcgtcctcagggacctgattaaggagttgaagcggcgtaagtacctgagggaacgtaagcgctggggagagaggatcgaggaactgaaggctgaagtagagatgcctccggaatccacggagtccgaccaacggatcagcccgcgtgagctcgtacgtgtgttacacgaagccctgaaagatcgggattacattctcactacggacgtaggtcagaaccagatgtggatggcccgatacttcccggtggaagaaccgcgcaggttcatctcctccggtggtttaggaaccatgggattcggtcttccggccgcgctcggcgctaaggtagccgcaccggagaaaaccgtggtcgccgtggtaggagacggtgggttcttgatgaccgcgcaagagttagccaccgccgtggacaacgacatcgaggtgaaggtcttcgtcatggataatagactcttagggatggtagcgcagtggcagaggctgttctacgacgaaagattgtcggaatcgaaactcgatgagaaaaccgacatagtgaaactgacggagtcgtacggagcagccggaattaccgtggaggagccgagcgagctggagtccgcggtagaggaagccttcgagactccgggtacggtggtggtggatgtgttcgtagatccggaagaaatcatcccgatggtgccgccgggaggcgagttgcgcgacatccttggtgaaaaatga

SEQ ID NO: 82173 - protein, 565 aa, Methanopyrus kandleri AV19
MSELPTGARVLVECLKEEGVEHIFGYPGGAVLPIYDEIYDEVSIEHILVRHEQGAAHAADGYARVKGKPGVCMATSGPGATNLVTGIATAYMDSSPVIAITGQVPTTMIGKDAFQEVDAVGVFMPITKHNYQIGKPEEIPEVVKEAFKIAITGRPGPVHIDVPKDVQEAEVDVEIPKTVEVEGLNVVKRGHPVQIKRAAELLAEAERPVILAGGGCVISNATRELIELAELLGAPVATTLMGKGAFPEDHPLALGMAGMHGTKAANYALTECDVLLAVGCRFSDRTTGDPSGFAPEAKIIHIDIDPAEIGKNIPVDVPIVGDAKLVLRDLIKELKRRKYLRERKRWGERIEELKAEVEMPPESTESDQRISPRELVRVLHEALKDRDYILTTDVGQNQMWMARYFPVEEPRRFISSGGLGTMGFGLPAALGAKVAAPEKTVVAVVGDGGFLMTAQELATAVDNDIEVKVFVMDNRLLGMVAQWQRLFYDERLSESKLDEKTDIVKLTESYGAAGITVEEPSELESAVEEAFETPGTVVVDVFVDPEEIIPMVPPGGELRDILGEK

SEQ ID NO: 82174 - DNA, 1752 bp, Methanosarcina acetivorans C2A
  CDS (1)..(1752): transl_table=11
atggatcctcacggatgtctgcacgaagctgtgtcggcccacagggacaccagctcggcagacaagagccaggaagtaaaggagaagattgtggcagaggacaccactctcactacagctcagctcatggtccagtgcctcgagaatgagggtgtcgagtacattttcgggcttccaggtgaagagaacatcaggttcgtcgatgctctaggagattcaactatccgcttcattgtggtgcgccatgaacagggtgcttcattcatggctgacatttatggtcgagtcacgggcaaggcgggtgtctgtatatccacgctgggaccgggtgctattaatctgcttctgggaacagccgacgccttcaccgacagcacccctctggtggcgatcagcgcccaggtcagcctcaaccgcatctacaaggagactcatcaggttgtcgatctgctgaacatgttcaagccggttacaaaatgggccgagatgattatcggttccgctgccatacccgaaatgatgcgggaagcgtttgagaaagcccaaacttcgcggccgggtgccgtctatctttgcgttcctgaggacgtagagtcaatctcgggcctcaccggcttgcgcccgcttgcccggtccgatgaagcggacagtatgccagggtccgcacagattacacgcgcagctcaagtcctgcaagaggcgacaaaaccgattatcctcgcaggccatggcgcagtgcgagactacgccggggacgctcttgtccggttctccgaacgccttcggatcccggttgcaaccacgttcatgggcaagggtatcttccctgatgaccatcccaactccctgggcaccatagggttcatgcagcatgactacgtgaacttcggattcgatgaggcggatgtgatcgtctgcgtcggctatgatctccaggagttcgatcccgtacgcataaaccccaatgccgacaagaagatcctgcacctgcatcgatacccggccgagatcgatgctcactatcccgtcaccgtcagtgttgaggggaacctctcggctgcgcttgacgggctagccgcaataataactccgaaagagggattggatgccgaggacagaaaaatccgtaacctgctcagggaagagctcgagtatggggcacgtgccgatgcatatccagtcaaaccgcagcggctggtctccgacatccgcgcggccatgggggattcggatatcgcgctggttgataccggtgccctgaaaatgtggatggcccgcctctacccgacgtatcagccgaatacctgtgtgatctcgaacggtttagcgacgatggcgtttgctgtgcccggggcgatcggcgcgaaactcgcttatcctgaccggaaggtgctcgccgtaacgggagatggcagcttcctgatgaattcccaggaactggagactgcgatacgggaacgtatcccgttcgttgtactcgtctgggtcgatgacgcctacggcctgatcaagtggaagatggacttggaactggggcgccattcctttgtcgatttcggcaacccggaccttgtcaagtacgccgaaagcttcggggccaggggctaccgcattgaggtggctgccgacctcttgccaacgctcaagaaggctcttgccgaagatgtggtctcagtggtcgtctgtccggtcgactattcagagaatatcaggctcaccgataagctgggacagctgacgcagcctatctga

SEQ ID NO: 82175 - protein, 583 aa, Methanosarcina acetivorans C2A
MDPHGCLHEAVSAHRDTSSADKSQEVKEKIVAEDTTLTTAQLMVQCLENEGVEYIFGLPGEENIRFVDALGDSTIRFIVVRHEQGASFMADIYGRVTGKAGVCISTLGPGAINLLLGTADAFTDSTPLVAISAQVSLNRIYKETHQVVDLLNMFKPVTKWAEMIIGSAAIPEMMREAFEKAQTSRPGAVYLCVPEDVESISGLTGLRPLARSDEADSMPGSAQITRAAQVLQEATKPIILAGHGAVRDYAGDALVRFSERLRIPVATTFMGKGIFPDDHPNSLGTIGFMQHDYVNFGFDEADVIVCVGYDLQEFDPVRINPNADKKILHLHRYPAEIDAHYPVTVSVEGNLSAALDGLAAIITPKEGLDAEDRKIRNLLREELEYGARADAYPVKPQRLVSDIRAAMGDSDIALVDTGALKMWMARLYPTYQPNTCVISNGLATMAFAVPGAIGAKLAYPDRKVLAVTGDGSFLMNSQELETAIRERIPFVVLVWVDDAYGLIKWKMDLELGRHSFVDFGNPDLVKYAESFGARGYRIEVAADLLPTLKKALAEDVVSVVVCPVDYSENIRLTDKLGQLTQPI

SEQ ID NO: 82176 - DNA, 1695 bp, Methanosarcina acetivorans C2A
  CDS (1)..(1695): transl_table=11
atgacaaccgggtcaacagaaaaagtcaacggcgcaaaggctctaataaagtgccttgaaaaagaaggggttgacacgctcttcgggtatccgggagggcagatcattcctttctacaacgaactctatgattcagatctgcgccacatacttgtacgtcacgaacaggcagcagctcatgctgcggacgggtacgcccgtgctactggaaagaccggggtctgcgtttctacttcaggtcccggagcaactaacctggtaacaggtattgccaccgcatatatggactcagtgccaattgtagccttaaccggccaggtaccaaggccccttatcggaaacgatgctttccaggaagcagatattaccggcatcactctgccaattaccaagcacaattatcttgtacaggatgcagaagaaatcccgaggattgtaaaagaagccttccatatcgcttccaccggaaggcctggcccggtattaattgaccttccaaaggatgtacagaatatagagattgatttacaatatcctgacaaggtagaactcagaggctataagcccacttacaagggtaatacccagcagataaaacgagccgctgaagagatcgcaaactcctgcaggcccataatctatgcaggaggaggagtaataagttcgaacgcgagtgcggaacttgttgagctggccgagactctcatggctccggttaccactacccttatggggataagcgctatcccgaccgagcatcccctctatgtcggaatgctcggaatgcacgggtgcaaatacgcaaactatgcagtccaggagtccgatcttattattgctgtgggcgcaaggtttgacgaccgggttaccggcaagctcgagtcttttgcccccaacgccagggttatccatattgatgttgaccctgccgagatttccaagaatgtgaaggtccatgtgcctattgtcggggacgcaaagcagatactcaagtctcttatcaaatatatccagcgctgcaattccgcggaatggattgaaaagataaaccagtggaagaaagaataccctcttgcctacaggtatgtgtcttcggatactataatgccccagtttgttgtcgagcagatttccgaagtctgcaaagatgcgatcatagttacggaagtcgggcaacaccagatgtgggcagctcagtacttcaaataccgcaaacccaggaccttccttacttcaggcgggctcggtacaatgggatatgggcttcctgcagccatgggagccaaggtcggaaagccggataagaccgttatcaatatcgcaggcgacggctctttccagatgaactctcaggagcttgcaactctggtccaaaacgatatcccggttgtttccgtgatcctgaacaacggttacctgggcatggtcaggcagtggcaggaactcttctatgaccggaggtattcccacacctttatcaagggcagtgttgacttcgtaaagcttgccgaagcctacggtgcgctcggactgcgtgcggaaaagccgtctgaagtcaggcctgcaatcgaagaggctgtagggtccggaaggcctgctgttgttgaagtgattgttgaatgtgaagcgaatgtctatccgatggtgccggcaggagctgcaattaatgagatcatcgacctggaggagcactga

SEQ ID NO: 82177 - protein, 564 aa, Methanosarcina acetivorans C2A
MTTGSTEKVNGAKALIKCLEKEGVDTLFGYPGGQIIPFYNELYDSDLRHILVRHEQAAAHAADGYARATGKTGVCVSTSGPGATNLVTGIATAYMDSVPIVALTGQVPRPLIGNDAFQEADITGITLPITKHNYLVQDAEEIPRIVKEAFHIASTGRPGPVLIDLPKDVQNIEIDLQYPDKVELRGYKPTYKGNTQQIKRAAEEIANSCRPIIYAGGGVISSNASAELVELAETLMAPVTTTLMGISAIPTEHPLYVGMLGMHGCKYANYAVQESDLIIAVGARFDDRVTGKLESFAPNARVIHIDVDPAEISKNVKVHVPIVGDAKQILKSLIKYIQRCNSAEWIEKINQWKKEYPLAYRYVSSDTIMPQFVVEQISEVCKDAIIVTEVGQHQMWAAQYFKYRKPRTFLTSGGLGTMGYGLPAAMGAKVGKPDKTVINIAGDGSFQMNSQELATLVQNDIPVVSVILNNGYLGMVRQWQELFYDRRYSHTFIKGSVDFVKLAEAYGALGLRAEKPSEVRPAIEEAVGSGRPAVVEVIVECEANVYPMVPAGAAINEIIDLEEH

SEQ ID NO: 82178 - DNA, 1659 bp, Thermoanaerobacter tengcongensis MB4
  CDS (1)..(1659): transl_table=11
atgaagctaaaaggggctcaagttgtgatagaagttttaaaggagatgggggttgataatgtatttggaatccctggaggagcagttattccgatttacgatgctttgtatgactctgacataaggcatattttagcaacacacgaacaaatggctgctcatatggcagatggatatgctagggctaccggaaaagttggggtgtgcattgcaacttcagggccaggagctactaatttagttacagggattgccaatgcttatatggattctgttccggttgtcgctataaccggccaggttccaacttacctgataggaaaggacgcatttcaggaggtagacattacaggcatcacaatgcctattacaaagcacaattttgtggtaaaatctcctgaaaagctggcagatactttaagggaagcatttgcaattgcaaagagcggaaggccagggccggttttggtggacattccaaaggatatacaaaatgcagaaatagagtatgaaagaaagggagagatagaatacaaaaatggaataaaagaaattatttctgaagagagcttgtcaaaggcggtggagttgattttagaaagcaagaagcctgttatctttgcaggcgggggagtgatatggggagaagcctgtggggaacttttggaatttgctgaaaagacgaatatccctgttgcaacttcactgatggggttaggatgcttccccggagaccatcctctatctttgggacttataggtatgcatggaagcagatttgcaaatttagctgtatatcactcagaccttgtgatagctgtaggaacgagatttagcgatagagtggcaggaaaggccggagggcttgcaccaaaggccaaatttatacacattgacatcgatgcagcagaaataggcaaaaatgtagaagtggatgtggggatagttgggaagataaagaaggtattaaagcttcttgcagatagagttccatctatggaaagaagagaatggttagaggaagtagaagaattaagagtgaaacatgggcttagatataaaaaagacgacatgttaaggccccaatggatagtagaaaaaattcaagagctctcaaatgatgatctcattatagctacagaagtagggcaaaatcaaatgtgggcagcacagttttacaaatttaaaaagcctagaacttttgtcacttcagggggattaggggcaatgggttttggccttcccgcatcaataggtgcgcaggtgggaaggccagataaaagggttgtgaatattgcaggagatggaagcttgagaatgaatatacacgccttagagactgctgctttctacaatatcccggttattatagtactacttaataatcaggctttaggaatggtaaggcagtggcagtatctttttaacgaaaagagattttctcagacagatttaaatccacaccttaactttgccaaaattgccagtgattttggagtggaaggaataagagttacaacaaaagaggattttgaaaaagcttttaaaaaagcctatagcgaaaaaaaaccttttatgatagaatgtattatagacaaagacgaaatggtgcttccatttattcccgcaggtgggactgtggaagatactattgcataa

SEQ ID NO: 82179 - protein, 552 aa, Thermoanaerobacter tengcongensis MB4
MKLKGAQVVIEVLKEMGVDNVFGIPGGAVIPIYDALYDSDIRHILATHEQMAAHMADGYARATGKVGVCIATSGPGATNLVTGIANAYMDSVPVVAITGQVPTYLIGKDAFQEVDITGITMPITKHNFVVKSPEKLADTLREAFAIAKSGRPGPVLVDIPKDIQNAEIEYERKGEIEYKNGIKEIISEESLSKAVELILESKKPVIFAGGGVIWGEACGELLEFAEKTNIPVATSLMGLGCFPGDHPLSLGLIGMHGSRFANLAVYHSDLVIAVGTRFSDRVAGKAGGLAPKAKFIHIDIDAAEIGKNVEVDVGIVGKIKKVLKLLADRVPSMERREWLEEVEELRVKHGLRYKKDDMLRPQWIVEKIQELSNDDLIIATEVGQNQMWAAQFYKFKKPRTFVTSGGLGAMGFGLPASIGAQVGRPDKRVVNIAGDGSLRMNIHALETAAFYNIPVIIVLLNNQALGMVRQWQYLFNEKRFSQTDLNPHLNFAKIASDFGVEGIRVTTKEDFEKAFKKAYSEKKPFMIECIIDKDEMVLPFIPAGGTVEDTIA

SEQ ID NO: 82180 - DNA, 1755 bp, Methanosarcina mazei Go1
  CDS (1)..(1755): transl_table=11
gtgcattctgtgccagttttgtttctttccgggtgttttaagatgaaagaaatgaatggagcagaagtcctgattaagtgtctggaggaccttggtgtcaaacatatctttggctatacgggagcagcaatacttccggtattccatgccctcaggcatagtgatattgagattatagttaattccaatgagcaatctgcagcattcagcgcggcaggctattcacggtcaagtaaccgggtaggtgtggctatagttacatccggacctgccataactaacacgctcacgagtgttgctgatgcttatggggacagcattcccctgcttgtatttgcagggcaggtccctgagcataagataggcaccgattcctttcagcatattaacgtaagaggtatcttcagggatgcagccaaaaaggtcatacagctctccaatggtgatgacatagaaaccataatcaaggatgcctattacttttcaaagtcaggaaaacccggacctgtagtcatagattttcctcttgacaaacagataaaaaaccatgagtatcatggtatggacgtcaaaaggttcgagggaagttatcatgatgatagacatctgtctgaaggccagtgtgaaaatttttttaagctgctgctcaactccagaaggcccctgctctatcttggaggcggtctgaattcggagtccggaagccaggcagtcagggaattcaatgagcttttcggaataccttctgtcaatacacttatggcaaaaggtgtcgttgacgaaaggcatgacatgaacctgggaatgctgggaatgttcggtacaccttatgcaaacatgctcatacaggagaacgacttattcttcgctatcggagtaagatgggatgaccgggttgcggaaaaggtcgggtttgcaataggtactgacatagcttacattgatatcaatcccgaaaaaatgcatcagataaaaatcgagcgcagcccgaaattcacattcataggagatgctgccacagcgctacgcgacctgctgaactatgccaggaagcataatatccgtcttgatattcgggaatggcagatacgtgcaagatacctgaaaaagtcgtggcctctgaattacaacagatcatccgaatacatacaggctgccaaggtaatttcaatgcttgcaaaccacgttgacgaaagcacaaagataactactggtgtaggtaaccaccagatgcttgcagctcagtacctgtcaatgcaatgcccaaaatctttcatgacttccggctcttttggcacaatgggcttttccctgcccacagcaattggtgtccattatgcgaacccacattcaggagtcatagcaatcgatggtgacggcagcctgagaatgaatctgggagaactgcatacaattgcatcactggaccttccaatcaagattctcatgttgaataacagaagcgatggtatggtccagaaccttcaggatgcagcttatgaaggagtacgcacaggaacacaaaggccaaaagatgtgaattttgcagagattgcaaggtcatttggtttcagttatgcagagagggtaagcaacagaaatgatttgaatgtgaaaatggaagcatttattgatgcagagggaccttgcttcctggaagcctgcacagacagggaagaggtcctgtatccgaaggttccggctggagggtcttataaagatatgattctgggtccttacattaaatcaacttga

SEQ ID NO: 82181 - protein, 584 aa, Methanosarcina mazei Go1
MHSVPVLFLSGCFKMKEMNGAEVLIKCLEDLGVKHIFGYTGAAILPVFHALRHSDIEIIVNSNEQSAAFSAAGYSRSSNRVGVAIVTSGPAITNTLTSVADAYGDSIPLLVFAGQVPEHKIGTDSFQHINVRGIFRDAAKKVIQLSNGDDIETIIKDAYYFSKSGKPGPVVIDFPLDKQIKNHEYHGMDVKRFEGSYHDDRHLSEGQCENFFKLLLNSRRPLLYLGGGLNSESGSQAVREFNELFGIPSVNTLMAKGVVDERHDMNLGMLGMFGTPYANMLIQENDLFFAIGVRWDDRVAEKVGFAIGTDIAYIDINPEKMHQIKIERSPKFTFIGDAATALRDLLNYARKHNIRLDIREWQIRARYLKKSWPLNYNRSSEYIQAAKVISMLANHVDESTKITTGVGNHQMLAAQYLSMQCPKSFMTSGSFGTMGFSLPTAIGVHYANPHSGVIAIDGDGSLRMNLGELHTIASLDLPIKILMLNNRSDGMVQNLQDAAYEGVRTGTQRPKDVNFAEIARSFGFSYAERVSNRNDLNVKMEAFIDAEGPCFLEACTDREEVLYPKVPAGGSYKDMILGPYIKST

SEQ ID NO: 82182 - DNA, 1722 bp, Xanthomonas campestris pv. campestris str. ATCC 33913
  CDS (1)..(1722): transl_table=11
atgaacacctccgcacacagcaagccccgcaatggcgcgcgctggctgacgcaggccctggaagccgagggcgtggaaacgctgttcggctatccgggcggcaccatcatgccgttctacgacgccctggtggattccaagctcaagcacatcctggtgcgtcacgaacaaggtgccgcattggcggccaacgggttcgcccgtgccagtggccgtgtcggcgtgtgcgtggccacctccggcccgggcgcgtccaacctggtcaccggcattgccgacgccatgctcgactcggtgccgatggtgtgcctgaccggccaggtcgccacgccgttgctgggcaccgatgcgttccaggaactggacgtgttcggcatgaccatgccgatcgtcaagcacagctttctggtgcgcagcgtggatgagttgccggagatggtgcgcgaggcgtttcggattgcacgcgaagggcgtcccgggccggtgctgatcgacctgccaaaggacgtgcagattgccgatgcctcgcatctgcccgaccacgtgccggcgcaggtgctgcctccgccggcgccgcaggacgccaaattggccgaagcgttggcggcgatcgccagcgccgaacgcccggtggtctacggcggtggcggcattgcgctggcgggtgcggtggaggctttccgccgcttcgtggaagccaccggcatgccgaccgcgctgaccttgcgcggcctgggcgccttgccgcacgcccatccggactacctgggcatgttgggcatgcatggcacgcgcgcggcgaacatggccatccaggaatgcgatctgctggtggtggtcggcgcccggttcgacgaccgcgccaccggcaaactgagcgaatttgcaccatttgcgcgcgtcatccacctggatgccgacgcgtatgaaatttccaagctgcgcaccgccgatgtggcggtgcccggcgatgtagccaccagcctgaaggcgttgagcgcggcacgtgccaattgccaggcctggcgcacgcggtgttttgccaaccgtgaaaagttcggcgcgcgctatgacgcaccgggcaccgatatctacgcaccggcactgctgaagcgcctgagcgaagtggccccggccgacaccatcattgcctgcgatgtcggccagcatcagatgtgggttgcccagcattgccgcttcaaccacccacgcaaccatctcaccagcggcgcgctcggcaccatgggcttcggcctgccggcggcgatgggcgcgcagttcgcctgcccggaccgcaccgtggtgctggtctccggcgatggcagcttcatgatgaatgtgcaggaactggtgacgattgcgcgttgcaagttgccggtgaagatcgtgctgctggataacagctcgctgggcatggtgcggcagtggcaggaactgttcttcgccgagcgctacagcgagatcgacctctccgacaacccggatttcgccgcattggcgcaggtattcggcatcccggccaagcgcatcattgcgcgcggcgatgtggacgccgcgctggccgagttgctggcgcagcccggcccgggcctgctgcatgtggccatcgacgcacgcgccaacgtgtggccgctggtgccgcccaacaacgccaacagcaccatgctggacagcaatcccgcacatgcggccaaggagacccctcatgcgttaccggcttga

SEQ ID NO: 82183 - protein, 573 aa, Xanthomonas campestris pv. campestris str. ATCC 33913
MNTSAHSKPRNGARWLTQALEAEGVETLFGYPGGTIMPFYDALVDSKLKHILVRHEQGAALAANGFARASGRVGVCVATSGPGASNLVTGIADAMLDSVPMVCLTGQVATPLLGTDAFQELDVFGMTMPIVKHSFLVRSVDELPEMVREAFRIAREGRPGPVLIDLPKDVQIADASHLPDHVPAQVLPPPAPQDAKLAEALAAIASAERPVVYGGGGIALAGAVEAFRRFVEATGMPTALTLRGLGALPHAHPDYLGMLGMHGTRAANMAIQECDLLVVVGARFDDRATGKLSEFAPFARVIHLDADAYEISKLRTADVAVPGDVATSLKALSAARANCQAWRTRCFANREKFGARYDAPGTDIYAPALLKRLSEVAPADTIIACDVGQHQMWVAQHCRFNHPRNHLTSGALGTMGFGLPAAMGAQFACPDRTVVLVSGDGSFMMNVQELVTIARCKLPVKIVLLDNSSLGMVRQWQELFFAERYSEIDLSDNPDFAALAQVFGIPAKRIIARGDVDAALAELLAQPGPGLLHVAIDARANVWPLVPPNNANSTMLDSNPAHAAKETPHALPA

SEQ ID NO: 82184 - DNA, 1722 bp, Chlorobium tepidum TLS
  CDS (1)..(1722): transl_table=11
atgcataacaacggagagaaactgatcggatccgaaatatttttcgagtgtctaaggcgtgaaaacgtcgaatacatcttcggctaccccggcggggcattgctgaaagtctatgaaaccctgcacgatgtcgaggatattgagcacattctggcgcgccacgaacagggtgcgacccacatggccgagggctacgcccgcgccaccggcaggcccggcgtggtgctggtcacctccggccccggcgcgaccaacaccgtcaccggcatcaccaacgcctacatggactccacgccgctagtggtcttcaccggccaggtgccgagttcgctgatcggcaacgacgcctttcaggaagcggacatcgtcggcatcacgcggccgatcaccaagcacaacttcctcgtcaaggatgtgcgcgagctggctacgaccatccgcaaggcattttacctggccaccaacggacggccaggcccggtgctggtcgatatgcccaaagatgtgctgaacgccgaatgcaccttcgagtggccggagaacgttgacattcgaggcttcaagccgacgatcaagtgccacgccaaccaggtcagcaaagcggcgaaaatgatcgccaaagccaagcgtccgctcttctacgtcggcggcggcgtcatcagcgcggaggcatcggcggagctgcgcaagctggccatcgaccagcagattccggtcaccatgaccctgcaaggactcggcgcgttccccggcgaccatccgctctccatgggaatgctcggcatgcacggcacctactgggccaaccaggcggtgagcaactgtgacctgttgatcgccgtcggtgcgcgcttcgacgaccgcgtcaccggcaaggttgacaccttcgccacccatgcgtacaaaatccacaacgacatcgacccgaccaacgtggacaagaacatcaaggtcgatctgccggtggtcggcgactcgaaggacttcctcgcctcgctcatcgaagcgatgccgaaatcgagggaggatcgcagcgcgtggctcgccgaaatcgagaagtggcgcaagcagtgtccgctcgactacgagatcgagccggattcgctcaaaaccgagttcgtcatcgacgaggtctccaggcagaccaaaggtcacgcggtggttgttaccgacgtcggccagcaccagatgtggacgtcgcagtactacaagttcaccgaaccgcgctcgatcatcacgagtggcggactcggcaccatgggcttcggcctgccgtcggccatcggcgcggccttcggcgtcaccgaccggccagtgttgctcttcagtggcgacggcggtctgatgatgaacatccaggagatggtcacggcggtttacaacaaactgccgatcaagattttcctgatcaacaacagctacctcggcatggtgcgccagtggcaggagctgttccatcaggagaagtacaccttcaccgacctggcgtcgagcaaccccgatttcgtcaaggttgccgaagcctttggctgcaaggcgatgagcgccagcaatccggaagcagcgcgcgccgccatcaccgaagcgctcgcgtacaacgacgggccagtgctggttgatttcagggttatccgcaaggatatggtttttccaatggtacccgccggcggctcgatttcagacatgctgttggcccggctgaatccgaaaacaatggtttaa

SEQ ID NO: 82185 - protein, 573 aa, Chlorobium tepidum TLS
MHNNGEKLIGSEIFFECLRRENVEYIFGYPGGALLKVYETLHDVEDIEHILARHEQGATHMAEGYARATGRPGVVLVTSGPGATNTVTGITNAYMDSTPLVVFTGQVPSSLIGNDAFQEADIVGITRPITKHNFLVKDVRELATTIRKAFYLATNGRPGPVLVDMPKDVLNAECTFEWPENVDIRGFKPTIKCHANQVSKAAKMIAKAKRPLFYVGGGVISAEASAELRKLAIDQQIPVTMTLQGLGAFPGDHPLSMGMLGMHGTYWANQAVSNCDLLIAVGARFDDRVTGKVDTFATHAYKIHNDIDPTNVDKNIKVDLPVVGDSKDFLASLIEAMPKSREDRSAWLAEIEKWRKQCPLDYEIEPDSLKTEFVIDEVSRQTKGHAVVVTDVGQHQMWTSQYYKFTEPRSIITSGGLGTMGFGLPSAIGAAFGVTDRPVLLFSGDGGLMMNIQEMVTAVYNKLPIKIFLINNSYLGMVRQWQELFHQEKYTFTDLASSNPDFVKVAEAFGCKAMSASNPEAARAAITEALAYNDGPVLVDFRVIRKDMVFPMVPAGGSISDMLLARLNPKTMV

SEQ ID NO: 82186 - DNA, 1647 bp, Yersinia pestis KIM
  CDS (1)..(1647): transl_table=11
atgaatggtgctcagtgggtggtccaagcgttgcgtgcgcagggcgttgatacggtatttggctatccgggcggggcgatcatgcctgtctatgatgcgttgtatgatggtggtgttgaacatttactctgccgccatgagcaaggtgctgccattgctgctatcggttatgcacgtgcaaccggcaaagttggggtgtgtatcgccacttctggtcccggagcgactaacctgatcaccggtctggctgacgctttactggactctgtgccggtgatagctatcaccggtcaggtagggtcggccttaatcggtaccgatgcctttcaggagatcgatgtgctggggctatcactggcctgcaccaagcacagtttcttggttgagtcattggatgcgctgccagagatcatggctgaagcgtttgccattgccaccagtggccgccctgggccggtgttaatcgatattcccaaagatatccagttggcggtgggggagttaacgccacacttgaagccagttgaagagcattccgttgattctgccgctgagttacaacacgcttgggatatgctggcgaacgcacagaaaccgatgctgtatgttggcggtggtgtcggcatggcgcaggcggtacctgccttacgtgattttatcgccatgacggggatcccggcggtcgccaccctgaaagggctgggtgcaccagatatcgcgcacccttgttatctgggtatgctgggtatgcacggtactaaagcggcgaattttgccgtacaggattgtgatttattggtagcggttggcgcacggtttgatgaccgcgtaaccggtaagttgaatacgttcgcatcgaaagcaaaagttattcatatggatattgacccggctgagctgggcaaattgcgtcaggttcatgtggcattgcagggcaatttaaacgtgttgttgccggccttacaacagccgttaaatattcagtcgtggcgtgatgaagtgatggcgctgaaacagcaacatcactggcgttatgaccaccctggtcaggcgatttatgcgccgttattactgaagcagatctcggagcgcaaagcccctgaaacggtagtgaccacggatgtgggccagcaccagatgtggacggcacagcatatgaactttacccgcccggagaatttcatcacttccagcgggttggggaccatgggcttcggagtgcccgctgcggtaggtgctcagatggcccgccctgatgatatggttatctgtgtctctggcgatggctcctttatgatgaatgtgcaggaattgggcacgataaaacgaaaacagttgccgctgaaaatcgttttattggataaccagcggttggggatggttcggcagtggcagcaattgttcttcgatggacgttatagcgagaccaatctttctgataaccccgattttatcactctggccagcgcttttgatatccccggccaacgtatcacccgtaaagaccaagtcgatgccgctctggatgcgctgtttaatagcgaaggcccttatctgctccaggtttccattgacgaactcgagaacgtttggccgttagtgccgccaggcgcaggtaatgaaaccatgctggagaaaatctcatga

SEQ ID NO: 82187 - protein, 548 aa, Yersinia pestis KIM
MNGAQWVVQALRAQGVDTVFGYPGGAIMPVYDALYDGGVEHLLCRHEQGAAIAAIGYARATGKVGVCIATSGPGATNLITGLADALLDSVPVIAITGQVGSALIGTDAFQEIDVLGLSLACTKHSFLVESLDALPEIMAEAFAIATSGRPGPVLIDIPKDIQLAVGELTPHLKPVEEHSVDSAAELQHAWDMLANAQKPMLYVGGGVGMAQAVPALRDFIAMTGIPAVATLKGLGAPDIAHPCYLGMLGMHGTKAANFAVQDCDLLVAVGARFDDRVTGKLNTFASKAKVIHMDIDPAELGKLRQVHVALQGNLNVLLPALQQPLNIQSWRDEVMALKQQHHWRYDHPGQAIYAPLLLKQISERKAPETVVTTDVGQHQMWTAQHMNFTRPENFITSSGLGTMGFGVPAAVGAQMARPDDMVICVSGDGSFMMNVQELGTIKRKQLPLKIVLLDNQRLGMVRQWQQLFFDGRYSETNLSDNPDFITLASAFDIPGQRITRKDQVDAALDALFNSEGPYLLQVSIDELENVWPLVPPGAGNETMLEKIS

SEQ ID NO: 82188 - DNA, 1809 bp, Thermosynechococcus elongatus BP-1
  CDS (1)..(1809): transl_table=11
gtgcaagcaactggagcatacattctgattgataccctatgccgtcacggtgttaagcatatttttggatatcctggtggggccattttaccgatttatgatgaactttaccgtgctgagtccaagggcatcattcagcacattctggtgcgccacgaacagggggcagcccatgctgctgacggctacgcccgtgccacaggtcaggtgggggtgtgttttgcgacttccggaccaggggcaacaaacttagttacaggcattgccacagcccacatggattcaattccactgctggtgatcacgggtcaggtacctcgctctgccattggcaccgatgcctttcaagaaaccgatatttttggcattacgctgcccattgttaaacactcctacgtggtgcgtgcagctaaggacatggcacggatcattgctgaggcgatctacattgccaccactggtcgaccgggacccgtgcttgtggatattcccaaggatgtggggttagaggtctgtgagtatgagccggtcgagccggggcaggtgaagctgcggggctatcgccccacgattcgcggcaatgcccgtcaaattgcccaagcggtccaattgattcgtgaggccaagcgaccgttgctttatgtggggggcggggcaattacagcgggtgctcacgaggaggtcctcaagttagccgagctcttccagattccagtgaccacaacactcatggggaagggggcttttcctgaatcccatcccctctctgtgggtatgttggggatgcatggcaccgcctatgccaactttgccgtcagtgaatgcgatctcctgattgcggtgggggcgcgctttgacgatcgcgtcaccggtaagctggacgagtttgcctcccgcgctaaggtcattcacattgacattgatcctgctgaggtgggcaaaaaccgtgtccctgatgtgccgattgtgggcagcgttaaaccagtgctgcagcagctcctcaagcacattgaagacagtggtcaagcggttgaacctcagacccaagcctggttagagcggattactatctggaagcaggattatcccctcattgtgccccaacccagtggtgaactctcaccgcaggaggtgattgtcgcttttggccgtcacgcccccgatgcctattacaccactgatgtgggtcagcaccagatgtgggcagcacaattcctgaaaaatggccctcggcgttggatctccagtgcgggcttgggcacaatgggctttggtatgcctgcggccatgggggtcaaagtagctttgccggatcaacaggtgatttgtattagtggcgatgccagtttccagatgaattcccaagagctggctacactggctcagtacggtattgctgtcaagactgtcattattaacaacttctggcagggaatggtgcggcagtggcagcaggccttttatgaggagcggtattcccattccaatatggccgagggaatgcccgattttgtgaaattggcggaggcctatggggttaaggggctacgggtgagcgatcgccaggatttggatgccattgtccaagaggttttggcctacgatgggccagtactgctggatgcccatgtcacccgcgatgaaaactgctacccaatggttgcccccggcaagcctaactctcaaatgctcggtctgccggaagccaaggttcttgaaaaggctgctgaactggtctactgtgccaattgtggagccaagacgatttcaacccatcgcttttgtccagagtgtggcagcaagctctag

SEQ ID NO: 82189 - protein, 602 aa, Thermosynechococcus elongatus BP-1
MQATGAYILIDTLCRHGVKHIFGYPGGAILPIYDELYRAESKGIIQHILVRHEQGAAHAADGYARATGQVGVCFATSGPGATNLVTGIATAHMDSIPLLVITGQVPRSAIGTDAFQETDIFGITLPIVKHSYVVRAAKDMARIIAEAIYIATTGRPGPVLVDIPKDVGLEVCEYEPVEPGQVKLRGYRPTIRGNARQIAQAVQLIREAKRPLLYVGGGAITAGAHEEVLKLAELFQIPVTTTLMGKGAFPESHPLSVGMLGMHGTAYANFAVSECDLLIAVGARFDDRVTGKLDEFASRAKVIHIDIDPAEVGKNRVPDVPIVGSVKPVLQQLLKHIEDSGQAVEPQTQAWLERITIWKQDYPLIVPQPSGELSPQEVIVAFGRHAPDAYYTTDVGQHQMWAAQFLKNGPRRWISSAGLGTMGFGMPAAMGVKVALPDQQVICISGDASFQMNSQELATLAQYGIAVKTVIINNFWQGMVRQWQQAFYEERYSHSNMAEGMPDFVKLAEAYGVKGLRVSDRQDLDAIVQEVLAYDGPVLLDAHVTRDENCYPMVAPGKPNSQMLGLPEAKVLEKAAELVYCANCGAKTISTHRFCPECGSKL

SEQ ID NO: 82190 - DNA, 1659 bp, Thermosynechococcus elongatus BP-1
  CDS (1)..(1659): transl_table=11
gtgcctgcgatcgcccatcctatgaataccgccgaattactcgtaaaatgccttgaaaatgaaggcgttgaatatatttttggtttgccgggggaagagaatctagatgtcctccatgccctccatcgctctcggattcaatttataaccacccgccacgaacagggggcggcctttatggccgatgtctatggtcgcctcaccggcaaagcaggggtctgtctttctaccctcggccccggggccacgaatttaatgaccggtgttgccgatgccaacctcgacggcgctcccctggtggcgattacagggcaagtggggacggatcgcatgcacatcgagtcccaccaatatttggacttggtggccatgtttagccccgtaaccaaatggaatgcccagattgtccgccctagtattaccccagaaattgtccgcaaggcctttaaaattgcccagaatgagaagccgggcgccgttcacattgatgtgcctgaaaacattgccgccatggaagccgagggcgctccccttaagcccagctcccccgaaaaaacctatgcctctttccagagtattcttaaggccgctgaactcatcaatgctgccgagaaccccctgatcctagtggggaatggcgccattcgcgcccatgctgccgctgccctcacccattttgccgaaaagctgaatatccccgtggccaataccttcatgggcaaaggggtcattccctatcaacacccccttgctctgtggaccgtggggctccaacagcgggattacattagctgcggctttgatcatgctgacttagtgattgccgttggctatgacttaattgagtattccccaaaaagctggaaccccgagggccgcttgccgattatccatattgcggccactcctgcggaaattgacagcagctatatccctgtcgttgaggttgtcggcgatatttctgactccctctatgaaattcttaagcgggccgatcgccaagataagcccaccccctatgccgtgcaactgcgtcaggagattgtggcggactattaccaatatgcccaggatgagagttttccggttaagccccaaaagctaatctatgacctgcgccaagtcatggggcccgaggacattgttatttctgatgtgggtgcccataaaatgtggattgctcgtcactaccactgcgatcgccccaacacctgcttgatttccaatggctttgcggcaatggggattgcggtaccgggggcaatggccgccaaattagtctatccgcagcggcatgtggtggcagtcacgggggatggtggcttcatgatgaatttccaagaactggaaactgccctgcgtatggggacaaactttaccaccatcatctttaatgacggcggctatggtctcattgagtggaagcagcagcgctactttggtgaatctgcctatgtccactttagtaatcccgattttgtcaagttagccgaaagcatgggactcaaaggctatcgcattgaggagaccactgactttatcccaaccctcaaaaccgccttggcacagaatgttcccactctcattgatgtccctgtggactatagtgaaaatctgcgctttaaccaacgtcttggggagctcagctgcaccccttag

SEQ ID NO: 82191 - protein, 552 aa, Thermosynechococcus elongatus BP-1
MPAIAHPMNTAELLVKCLENEGVEYIFGLPGEENLDVLHALHRSRIQFITTRHEQGAAFMADVYGRLTGKAGVCLSTLGPGATNLMTGVADANLDGAPLVAITGQVGTDRMHIESHQYLDLVAMFSPVTKWNAQIVRPSITPEIVRKAFKIAQNEKPGAVHIDVPENIAAMEAEGAPLKPSSPEKTYASFQSILKAAELINAAENPLILVGNGAIRAHAAAALTHFAEKLNIPVANTFMGKGVIPYQHPLALWTVGLQQRDYISCGFDHADLVIAVGYDLIEYSPKSWNPEGRLPIIHIAATPAEIDSSYIPVVEVVGDISDSLYEILKRADRQDKPTPYAVQLRQEIVADYYQYAQDESFPVKPQKLIYDLRQVMGPEDIVISDVGAHKMWIARHYHCDRPNTCLISNGFAAMGIAVPGAMAAKLVYPQRHVVAVTGDGGFMMNFQELETALRMGTNFTTIIFNDGGYGLIEWKQQRYFGESAYVHFSNPDFVKLAESMGLKGYRIEETTDFIPTLKTALAQNVPTLIDVPVDYSENLRFNQRLGELSCTP

SEQ ID NO: 82192 - DNA, 1671 bp, Oceanobacillus iheyensis HTE831
  CDS (1)..(1671): transl_table=11
ttgaatcaaaatggaattgatttaaatgcggcagaagctattgtaaaaggattacgaagagaagaagtaaagcatattttttgtgttccgggtgaaagttatcttcctgtattaaacgcactttatgatgagcaagatatacaagtcatttcaggtcgtcatgaaggtggtattgcatttatggcagaaggatatgcaaaagctacaaaaaaaccgggaattgttatggcaacaagaggagtgggagcaagtaacctatccattggtgtacataccgctcatcaagactctactccaatggttgtactgttagggcaagtaagtacaaagtttagagggagagaaggctttcaagaagtggatttagaaagtttctttcgtccaatatctaaatgggcggtagaaataaccgatgtactgcgcatacctgaaatactagctaaagcttttcgagttgcaaaaaccggtagaccaggaccagtagtaatctctctaccggaagatatcctttacgaacaaggagaatttacttttagagcacctgtgagtattccacgtccggcaccatcgataaaagaaatatccatgtttcagcattttttacaaattgcaaaaaaaccattgattatcgctggaggaggtattcggttttctggtgctgaagatgcgcttcttgaatttgccgaatcatttcaaatacctgtgatgacagcctttcggaggcatgatgtatttccaaacaataatgatttatatctcggacatttaggattaggtattacatccgaaatacgtgaagctgtagatgaagcagatgttatctttgcatttggtacaagattatcggaaattacgacacaggattattcgattattacagatgaaaaacgacttgtccatattgatatatcttttgaaacgataggaaatatatattcaccagatttaggcattgtcgcagatatcaaagaagctttattggcattaaagacgattaatattgacgaggtaaagggttcaggagactttatttggaaagaatgggcagagaatagatacactaaacaaaaagaatcgataaaacaattatatcaaaaacaggatattcaaagtaaaataataggttatttacaacaacagttaaaccatgaatttattattacaaatgatgcgggtaattttgcaggttggctacatacgtatttccagtttaaccataaaaactcttatattggaccgacatcaggagcaatggggtatggagtaccttctgcaattggagctgctatagcaagtccacataaaacggtaatagcattatctggagatggcggattcatgatgactgcacaagagttagaaacagcagtaagatataaggttggtatgttaagtcttgtttttaataaccagatgtatggaacaattcgaatgcatcaagaaatacattatccaaaaaaagtaatagcaacagacttaggaaatatttcatttaaatcgtatattcaaagtcttggaggtaaagggtatcaagttaccagctttcaagaatttgaacatgtctatcctatagcactcgaacatgcaaaacatgcacctgttgtcattgaaatacttacagatcgcgaacaaattagtgtaagtaaaaaaataaatgactttcatacctaa

SEQ ID NO: 82193 - protein, 556 aa, Oceanobacillus iheyensis HTE831
MNQNGIDLNAAEAIVKGLRREEVKHIFCVPGESYLPVLNALYDEQDIQVISGRHEGGIAFMAEGYAKATKKPGIVMATRGVGASNLSIGVHTAHQDSTPMVVLLGQVSTKFRGREGFQEVDLESFFRPISKWAVEITDVLRIPEILAKAFRVAKTGRPGPVVISLPEDILYEQGEFTFRAPVSIPRPAPSIKEISMFQHFLQIAKKPLIIAGGGIRFSGAEDALLEFAESFQIPVMTAFRRHDVFPNNNDLYLGHLGLGITSEIREAVDEADVIFAFGTRLSEITTQDYSIITDEKRLVHIDISFETIGNIYSPDLGIVADIKEALLALKTINIDEVKGSGDFIWKEWAENRYTKQKESIKQLYQKQDIQSKIIGYLQQQLNHEFIITNDAGNFAGWLHTYFQFNHKNSYIGPTSGAMGYGVPSAIGAAIASPHKTVIALSGDGGFMMTAQELETAVRYKVGMLSLVFNNQMYGTIRMHQEIHYPKKVIATDLGNISFKSYIQSLGGKGYQVTSFQEFEHVYPIALEHAKHAPVVIEILTDREQISVSKKINDFHT

SEQ ID NO: 82194 - DNA, 1722 bp, Oceanobacillus iheyensis HTE831
  CDS (1)..(1722): transl_table=11
gtgaaagtagatgcaaaccagcagatggaggttaaaagtaatttagtaacgggtgctgatttgtttgtgcaagcattggaaagagcaaatgtggaagtagtttttggttatcctggaggtgcagtattaccgatttacgatgcgttacatcggaatcaaacatcttttgagcatgtactttcgcgacatgagcaaggatccattcatgcagcagaaggttatgcgagagtctctggcaaaccaggagttgtaattgctacttctggaccgggcgcgacaaatctaattactgggataacggatgcgatgatggactctatacctcttgtcatttttactggtcaagttgcaaaaggagttattggaacagatgcttttcaagaagcagatgtaatgggaattacaacacctattaccaaatataactaccaagtgaatgaaatagctgaactgccccgtattgtaaatgaagcatttcacattgcgacaacaggtagaccagggccagtcgttgtagatattccaaagaatatttcttcgacagtgacggtgaatgattatgaagcggattttcatttacctggttatcagccaacaatcacaccgaatcctttacaaattaccaaagtaaatgaagcattaaaacgagcggagaagccggtactattagctggagcgggaattcttatctctgacgcttccaatgaattaaaacagtttgctcaacattatcaactaccggtagttaccaccttacttggattaggaagctatcctggtaaggaatccttatcattaggaatggcggggatgcacggaacgtatgcagcaaatatggcaatctatgaatgtgatttgttaataaatattggtgcacgatttgatgataggctgacgggaaatattaaacactttgcaccaaatgcgaagatcgttcacattgatatcgaccctgctgaaattgggaaaaatatcgaaacgaatattcctgttgttgctgatgcaaaacgagcattaacagctcttttaaaaaatacaacagaaaaatgtgatcatcaaaattggctccatcagttgaagcataatcaattagatttcccattgtggtatgatcgttccgatcaagaaatctctccccaatggttaatggagcaaatatatgagctgtctaagggagaagcagttgtaacaacagatgtagggcagcatcaaatgtgggctgcacagtattactcatttaaagatccacataattgggtgacatctggtggattagggacaatggggttcggcttccctgcagccattggagctcaaatggctaaaccaaacagtttagttttagcagtagttggtgatggtggttttcaaatgactttacaggaattgtccatactgaaatcacagaatctgccagtaaaagtaataatcttaaataatgaagcgcttggtatggtacgccaatggcaggaaagtttttacgaagaaagatattcacattcgctgttttcagaaaaccctgattttgtgaaattggcagaaagttatggtgtgagaggaatgagagtggagaaagaagctgatgttccaaatatcttatctgaagtatttacctacgatggcccagttgtaattgattgcagagtagtgcaaaaaacctctgtttatccaatgattgcaccaggtacaggaatccaagaaatgattggagtgagaagatga

SEQ ID NO: 82195 - protein, 573 aa, Oceanobacillus iheyensis HTE831
MKVDANQQMEVKSNLVTGADLFVQALERANVEVVFGYPGGAVLPIYDALHRNQTSFEHVLSRHEQGSIHAAEGYARVSGKPGVVIATSGPGATNLITGITDAMMDSIPLVIFTGQVAKGVIGTDAFQEADVMGITTPITKYNYQVNEIAELPRIVNEAFHIATTGRPGPVVVDIPKNISSTVTVNDYEADFHLPGYQPTITPNPLQITKVNEALKRAEKPVLLAGAGILISDASNELKQFAQHYQLPVVTTLLGLGSYPGKESLSLGMAGMHGTYAANMAIYECDLLINIGARFDDRLTGNIKHFAPNAKIVHIDIDPAEIGKNIETNIPVVADAKRALTALLKNTTEKCDHQNWLHQLKHNQLDFPLWYDRSDQEISPQWLMEQIYELSKGEAVVTTDVGQHQMWAAQYYSFKDPHNWVTSGGLGTMGFGFPAAIGAQMAKPNSLVLAVVGDGGFQMTLQELSILKSQNLPVKVIILNNEALGMVRQWQESFYEERYSHSLFSENPDFVKLAESYGVRGMRVEKEADVPNILSEVFTYDGPVVIDCRVVQKTSVYPMIAPGTGIQEMIGVRR

SEQ ID NO: 82196 - DNA, 1968 bp, Bifidobacterium longum NCC2705
  CDS (1)..(1968): transl_table=11
atggctttacccacgcctttgcaggcattcagcggtgtaccgaaaatcaacacggcccccgataagcagaccatcgtcgatggcgagaagatgactggcgcccaggcgctgattcgttcgctggaggacctcggcgtcgaggacgtcttcggcattcctggcggcgcgattctgcccgtctaccacgagatcaaagacaacacgaagttccgcttcgtgcttatgcgccacgagcaggccgccggccacgccgccgaaggctacgcactggccactggcaaggtgggcgtgtgcatcgtgacttccggcccgggtgccacaaacgtggtcacggccattgcggacgcgaacatggactccgtgcccatggtcgtgattaccggtcaggtgggcgtgcaagccatcggcactgatgccttccaggaggcggatatcgtgggcatcacctacccggtgtccaagcactccttcctcgtgacccgcgcgcaggacattcctcgcgtgctttccgaggcgtactacatcgccaacaccggccgccccggcccggtggtcgtggatctgaccaagaccgcacagaccggcgacatgtactactcatggccgcagcgcatgattctgcccggctacaaccccaccaccaaggcgcacggccgtgtgctgtccgacgcggcgaagctgttctctcagtcgtaccgcccggtgctgtatgtgggtggcggcgccgcccgctccaacgccggcgcacaggtcaaggctctggccgacctgaccggcgctcccgtggtcacgaccctgcccgcacgcggcatcattcccgactccgacccgaagaacctcggcatgctaggcatgcacggtacgattgccgcaaccggcgccgtgcagcgcgctgacctgcttgtggccatcggtgcacgtttcgacgaccgcgtgaccggcaagctcgacgccttcgcaccgaccgcccgcgtgattcacattgacatcgacccggctgaaatcggcaagaaccgtcagcccgacgtgccgatcgtgggcgatgtggctaccgtgctcgacgacttgattcccgagattcagcgtacgcaggccattcagggcaagccgaatctggccccctggtggaaggcgatcgacggctggcgcgaggaatacccgatgacgtgggatgagccgaccgacggatcgctggccccgcagtgggtcatcaagaagctctctgagatggccgatccgtccaccatctgggtgaccggtgtgggccagcaccagatgtgggcttcgcagttcatcgattttgagaaccagcacgcttggatctcctccggaggcctcggcacgatgggctacggtctgccggctgccatcggcgcatccgtgggctcggcccgtgaattcgagggcaagaagccggtgtggctgatcgatggtgacggttccttccagatgacctctgaggagctggccgccgcgttcctggaccacgctccggtgaagatcgcgattctgaacaactccgtatacggcatggtccgtcagtggcagacgctgttctacgagcaccactactcgcagaccaacctgctcgatggtgaagcgcacggtgccgatggtgcggcggcactggccgacggcgatgcgccgctcgaagtgcctgatttcatcaagttggccgaggcatacggctgcgtgggtatccgcgcgttcaccgaggaagaggcgattgccgccatcgaaaaggcgaaccagatcaacgaccgcccggtgctgatcgacttccgcgtgtggaaggatgcgatggtgtggccgatggtagccgccggcgcccccaacgacgaggtgacgtacaagcccggcatcaagccgctggctggcggcaccccggctccgggaaccggtccggacgagcatgcgaccggcgtgttcgagcacgagaccgccgctgccactgcgagcgagcactga

SEQ ID NO: 82197 - protein, 655 aa, Bifidobacterium longum NCC2705
MALPTPLQAFSGVPKINTAPDKQTIVDGEKMTGAQALIRSLEDLGVEDVFGIPGGAILPVYHEIKDNTKFRFVLMRHEQAAGHAAEGYALATGKVGVCIVTSGPGATNVVTAIADANMDSVPMVVITGQVGVQAIGTDAFQEADIVGITYPVSKHSFLVTRAQDIPRVLSEAYYIANTGRPGPVVVDLTKTAQTGDMYYSWPQRMILPGYNPTTKAHGRVLSDAAKLFSQSYRPVLYVGGGAARSNAGAQVKALADLTGAPVVTTLPARGIIPDSDPKNLGMLGMHGTIAATGAVQRADLLVAIGARFDDRVTGKLDAFAPTARVIHIDIDPAEIGKNRQPDVPIVGDVATVLDDLIPEIQRTQAIQGKPNLAPWWKAIDGWREEYPMTWDEPTDGSLAPQWVIKKLSEMADPSTIWVTGVGQHQMWASQFIDFENQHAWISSGGLGTMGYGLPAAIGASVGSAREFEGKKPVWLIDGDGSFQMTSEELAAAFLDHAPVKIAILNNSVYGMVRQWQTLFYEHHYSQTNLLDGEAHGADGAAALADGDAPLEVPDFIKLAEAYGCVGIRAFTEEEAIAAIEKANQINDRPVLIDFRVWKDAMVWPMVAAGAPNDEVTYKPGIKPLAGGTPAPGTGPDEHATGVFEHETAAATASEH

SEQ ID NO: 82198 - DNA, 1755 bp, Brucella suis 1330
  CDS (1)..(1755): transl_table=11
atgaccggcgcagaaatggttatccaggcgctgatcgatcagggtgtggaaagcattttcggctatcccggcggcgcggtgcttccgatttatgacgagctgtttcagcaggatcaaatccagcacgttctggttcgccatgagcagggtgcaggccatgcagcggaaggctatgcgcgctcgacgggtaaagtcggcgtcatgctcgtcacttcggggccgggtgcaaccaatgccgtgacgccgttgcaggatgccttgatggattccatcccgctggtctgcatttccggtcaggttcccacgacgctgatcggttccgatgcgtttcaggaatgcgatacgattggcatcacgcgcccctgcaccaagcacaactggctggtaaaggacgtcaacgacctgtcgcgcgtcctgcatgaagctttccatgtcgcatccaccggccgtcccggccccgtcgtcgtcgatattccgaaggatattcagttcgccaagggcatctatacgccgccggaaactgcaccgcgcacaagttaccgtccagttctcgacggcaatgccgaggctatttccgaggctgtccgtctgctcgccaatgccagaaagccggtcatttattcgggcggcggcgtgatcaattccggccccgcggcttcccgtctgctgcgtgagctggtcgagatcagcaatttcccgatcacctccacgctgatggggcttggcgcctatcccgcctccggcaagaactggctcggtatgctgggcatgcacggcacctatgaagccaacatgaccatgcatgattgcgatgtcatgctgtgcgtcggtgcgcgtttcgacgaccgcatcaccggccgcctcaacgctttctcgccgaattccaagaaaattcatatcgatatcgatccgtcgtcgatcaacaagaacgttcgggtcgatgtgccgatcatcggcgatgtcgcgcatgtgctggaggatatcgtccgccagtttcgtgctttcgaccgcaagccagacaggcaggcattgaccgaatggtgggggcagatcgaccgttggcgcgcgcgcaattcgctggcctatacgccgaacaaagacgtcatcatgccgcaatatgccatcgagcggctttatgaactgaccaggaaccgcaacacctatatcaccaccgaggtgggccagcaccagatgtgggcggcgcaattcttcggctttgaacagccgaaccgttggctgacttccggcggccttggcaccatgggctatggtctgcctgcggcgctgggcgtgcagattgcacatccggatgcgctggttatcgatattgcaggcgatgcctcgatccagatgtgtatccaggaaatgtcggcagcaatccagcataatgcgccgatcaagattttcatcctgaacaaccagtatatgggcatggtgcgccagtggcagcaattgctgcatggcaaccgcctgtcgcattcctacacggaagcgatgcccgatttcgtgaaacttgcggaagcatacggcgcgcacggcattcgctgcgagaagccgggcgatctcgatgccgccattcaggagatgatcgatatcgacaagccggtcattttcgattgccgcgtggcaaaccttgccaactgcttcccgatgatcccgtcgggcaaggcgcataatgaaatgctgttgccggacgaagcgacagatgaggccgtcgccaatgccattgatgccaagggccgcgcgctcgtctga

SEQ ID NO: 82199 - protein, 584 aa, Brucella suis 1330
MTGAEMVIQALIDQGVESIFGYPGGAVLPIYDELFQQDQIQHVLVRHEQGAGHAAEGYARSTGKVGVMLVTSGPGATNAVTPLQDALMDSIPLVCISGQVPTTLIGSDAFQECDTIGITRPCTKHNWLVKDVNDLSRVLHEAFHVASTGRPGPVVVDIPKDIQFAKGIYTPPETAPRTSYRPVLDGNAEAISEAVRLLANARKPVIYSGGGVINSGPAASRLLRELVEISNFPITSTLMGLGAYPASGKNWLGMLGMHGTYEANMTMHDCDVMLCVGARFDDRITGRLNAFSPNSKKIHIDIDPSSINKNVRVDVPIIGDVAHVLEDIVRQFRAFDRKPDRQALTEWWGQIDRWRARNSLAYTPNKDVIMPQYAIERLYELTRNRNTYITTEVGQHQMWAAQFFGFEQPNRWLTSGGLGTMGYGLPAALGVQIAHPDALVIDIAGDASIQMCIQEMSAAIQHNAPIKIFILNNQYMGMVRQWQQLLHGNRLSHSYTEAMPDFVKLAEAYGAHGIRCEKPGDLDAAIQEMIDIDKPVIFDCRVANLANCFPMIPSGKAHNEMLLPDEATDEAVANAIDAKGRALV

SEQ ID NO: 82200 - DNA, 1686 bp, Brucella suis 1330
  CDS (1)..(1686): transl_table=11
atgacgagcaaaccaaatgtccgtaccggaggccagattttggtggatgcgctgcgcatccatggcgcggaccgggtcttctgcgtgcccggcgaaagctatctcgctgcgctcgacgcctttcacgatgcaagcgacgccatcgacctgattgtctgccggcaggagggcggggcatcctatatggcagaggcctatggcaaactgacgggtaagcccggcatttgcttcgtcacgcgcggccccggcgccaccaatgcatcgattggcgtgcacacggcttttcaggattcgacgcccatgctgctcttcatcggtcaggtcgcaagcgatcaggtcgagcgtgaggcatttcaggaaatcgattatcgccgcatgttcggccagatggccaaatgggtcgtgcagattgacgatgccgcgcgcattcccgaactggtgagccaggcattccatcgcgcggtgaacgggcgtcccggtccggtggtggtcgccttgccggaagacatgctgacgtcctatgcggcggtcagcgatgcgcctgcctataagcaggtggccatgcatccgggtggcgaacagttgcaggcaatgcgggcgctgatcgaaaaggcagagcgtccgctgatgatcgtcggcggcggtggctggacacaggatgccgtgcgcgacctgcgccagtttgccgaaaatatgtctctgccggttgccgcatccttccgctgtcaggatatgttcgacaatacgcatcccctttatgcgggcgaaatggggacctcgatcagtgccaggcttgtccagcgggtgaaggattccgacctgcttgtcgtggttggcgcgcgccttggtgaaatgacgacacagggctatgaactcgtcaccattccggtgccgcagcagaagcttgtccatatccatccgggcgcggaggaactgggccgggtctatcatgccgatgttccgatcaatgccgggatgcctgccttctgtgctgcggctgcaaagcttgcgccggttgccgatccgcgctggaaggcatgggccgacagcgccaatgccgactatcgcgacaatatcaagtcgccggtcattccgggcgaagtgcagatgggcgaggtgatggagtggctgcgcgcgcatctgcccgccgatgccatcatcaccaatggcgcgggcaattattccgcatggccgcatcgcttttaccagtatcgcacctatcgcagccagttggccccgaccaatggctccatgggctatggtgtgccggctgctgttgcggccaagctcaccgcgccggagcggaccgtggtggctttcgcgggagatggctgtttcctcatgaacgggcaggagcttgcaactgccgcgcaatatggcgcgaatgccattttcatcgtcgtgaacaacggcatgtatggcacgatccgtatgcatcaggagcgcacctatccggcgcgcatttcgggtacggccctggccaatcccgactttgcggcgcttgcgcgggcctatgggctgcatggtgaagtagtggaaaagaccgctgatttcgcacccgccttcaagcggtgcgaacagtccggcaagccggcgctgatcgagatcaggatcgatcccgaggcactgtcgcccaagatgagcctcagccagatgcgggagcagggtttcgcgaaacagcgctga

SEQ ID NO: 82201 - protein, 561 aa, Brucella suis 1330
MTSKPNVRTGGQILVDALRIHGADRVFCVPGESYLAALDAFHDASDAIDLIVCRQEGGASYMAEAYGKLTGKPGICFVTRGPGATNASIGVHTAFQDSTPMLLFIGQVASDQVEREAFQEIDYRRMFGQMAKWVVQIDDAARIPELVSQAFHRAVNGRPGPVVVALPEDMLTSYAAVSDAPAYKQVAMHPGGEQLQAMRALIEKAERPLMIVGGGGWTQDAVRDLRQFAENMSLPVAASFRCQDMFDNTHPLYAGEMGTSISARLVQRVKDSDLLVVVGARLGEMTTQGYELVTIPVPQQKLVHIHPGAEELGRVYHADVPINAGMPAFCAAAAKLAPVADPRWKAWADSANADYRDNIKSPVIPGEVQMGEVMEWLRAHLPADAIITNGAGNYSAWPHRFYQYRTYRSQLAPTNGSMGYGVPAAVAAKLTAPERTVVAFAGDGCFLMNGQELATAAQYGANAIFIVVNNGMYGTIRMHQERTYPARISGTALANPDFAALARAYGLHGEVVEKTADFAPAFKRCEQSGKPALIEIRIDPEALSPKMSLSQMREQGFAKQR

SEQ ID NO: 82202 - DNA, 1779 bp, Leptospira interrogans serovar Lai str. 56601
  CDS (1)..(1779): transl_table=11
ttgaaaatacggttcctcttgacagtagcctttctgctatctttatggacgttaagggggagaatcatcatgtccgcagaatcaagaagagtaaccggtgccagattgatggtggaacttctggaagaatacggagtggatgtcgtttttggataccccggcggagccattcttcccttttatgatgaaatttataagagtaaaaaaatcaaacatatcttggtaagacacgaacaaggtgcggttcatatggccgaaggatatgcaagagcgactggaaaattgggagtttgtattgcaacgtctggaccgggagcaactaatctagttaccggaattactgacgcaaaaatggattcggttccgattttagccattacgggacaggtcgctacgaatgcgatagggacagacgcttttcaagaagcggatattttcggaattaccataccgatcacaaaatacaatgctctgataaaatcggcagacgatatagcaagacattttgaagaggccaccttaattgcgttaggcggtcgtcctggaccggttttattggattttcctaaggacgtacaaacggagctgactaatgtcagaaagtcttctcgattaaaaattgctcctcatcattataaaaaaccagcggttagtggaaatttagaagaatttgcggaagcgatcaatcgatctcaaaaacctcttttatatgtaggtgggggtgcaattaacgcaggcgcttccaaagaaattttagaattagctacgaaaggaggaattccggttacaacaactctgatggggcttggggcttttccaggaactcatcctttgagtattggaatgttgggaatgcacggaaccgccactgcaaataaagcagtattagaatgtgattatatacttaatttaggagctagatttgacgaccgggttgcaaaaataggagaatttgcggaaggagcggttcgagcacatattgatatagacacggcggagtttaataagcgaattcaggtggattatcttttacacggagatttaaaggacgcgttaagtgccattttaccgtttgtaaaaaaacaagaacgtaaggaatggttgactcatcttcaaaatttgaaaaaagaacatcctttagattttgacaattctggaaatgaaattaaaccgcaggactttttagaacgtctttataaaaaaacacaaggcaaagcgattgtttccacggatgtaggacaacatcagatgtgggctgctcaatattatcttatggatgaaccaaataattggcttacttccggaggattaggaacaatgggttacggacttcccgcagcgattggagcgaaatttggaagaccagataaaactaccatctgtatttcgggtgacggatcgattcagatgaatattcaagaattagcaactattgtagcgaacaaattgggagtaaaaattttagtattcaataataactttttaggaatggttcgtcagtggcaggaattattttatgaggaaaggttttcagagtccgagtggaattttaatcctgattttgtgaaactcgcggaagcgtattctattccagccatgaaaatttcaaataagtcggaaatagataaagcgattgaattttttacaaaagacgatggagctgcatttttagaagtaatgataccggcagaagaaaaagtatttccgatgataccggcaggaaagtctcaaaaggaaatgatcgaatttaaggatttggccggattaaaaaaagtatga

SEQ ID NO: 82203 - protein, 592 aa, Leptospira interrogans serovar Lai str. 56601
MKIRFLLTVAFLLSLWTLRGRIIMSAESRRVTGARLMVELLEEYGVDVVFGYPGGAILPFYDEIYKSKKIKHILVRHEQGAVHMAEGYARATGKLGVCIATSGPGATNLVTGITDAKMDSVPILAITGQVATNAIGTDAFQEADIFGITIPITKYNALIKSADDIARHFEEATLIALGGRPGPVLLDFPKDVQTELTNVRKSSRLKIAPHHYKKPAVSGNLEEFAEAINRSQKPLLYVGGGAINAGASKEILELATKGGIPVTTTLMGLGAFPGTHPLSIGMLGMHGTATANKAVLECDYILNLGARFDDRVAKIGEFAEGAVRAHIDIDTAEFNKRIQVDYLLHGDLKDALSAILPFVKKQERKEWLTHLQNLKKEHPLDFDNSGNEIKPQDFLERLYKKTQGKAIVSTDVGQHQMWAAQYYLMDEPNNWLTSGGLGTMGYGLPAAIGAKFGRPDKTTICISGDGSIQMNIQELATIVANKLGVKILVFNNNFLGMVRQWQELFYEERFSESEWNFNPDFVKLAEAYSIPAMKISNKSEIDKAIEFFTKDDGAAFLEVMIPAEEKVFPMIPAGKSQKEMIEFKDLAGLKKV

SEQ ID NO: 82204 - DNA, 1719 bp, Shewanella oneidensis MR-1
  CDS (1)..(1719): transl_table=11
atggagaagttatccggcgccagcatgattgtgcgttcccttattgatgaaggtgtaaagcacatttttggttatcctggcggctcagtgttagatatctacgacgccctgcaccttatccccggtattgaacatatcctcgttcgccacgaacaagccgcagtgcatatggccgatggttatgcccgcgccacgggaaaagtgggtgtggtattagtgacctcaggtccaggcgccaccaatgcgattaccggtatcgctaccgcttatatggattcaattccattagtagtactatcgggccaagtacctagcaatcttatcggtaatgatgccttccaagaatgcgacatgattgggatttcacgccccgtcgtcaaacacagctttttagtacaagatcccactcaaattcctgagatcattaaaaaagccttttatattgcctccacgggtcgtcccggccccgtcgtggtagacttgcccaaggattgcctcaatccagcattactgcacgactatatttaccccgagagcataaaaatgcgctcctataatccaacgacatcgggccataaaggtcaaattcgtcgaggattacaggcattattagcagcgaaaaaacccgtgctgtatgtgggcggcggcgcgattatctcaggatctgaaaaacaaatcttaacgctggcagaaaaattaaatattcccgttatcagcaccttaatgggtcttggcgccttccctggcacccacaaaaacagcttaggtatgctggggatgcacggtcgttacgaagctaacatggcgatgcataactgcgatcttatctttggtattggcgttcgtttcgatgatagaaccaccaataacattgaaaaatactgccccaatgccacgattttgcatattgatatcgacccatcatccatttcaaaaaccgtaagagtagatatccctattgtaggttcggccgatatcgtattggatagcatattggcgctgcttgatgaagccagtgagaccaatgatttcgttgcaatcaatcaatggtggcaagagatcactacgtggcgcaatcgtcagtgcctggcatacgataaagaaagtaaccggatcaaaccacaacaagtcattgaaaccttatataaactcaccaatggtgaggcctatgttgcttccgatgttggtcaacaccagatgtttgccgcactatattatccctttgataaaccacgtcgttggataaactccggtggccttggcaccatgggctttgggttacccgctgccatgggggtcaaaatggcgatgccagacgaaaccgtggtctgcgtaaccggtgatggttcaattcaaatgaacattcaagaactatcaaccgctctgcaatacgatacgccagttaaaattatcaacttaaacaaccgtttccttggcatggtgaaacagtggcaagatatgatctactctggtcgccattcccattcctatatggattcggtacctaattttgcaaaaattgccgaagcctatggccatgttggcatgaccattagcgatcccgctgagcttgaatctaagatggccgaagccctcgccatgaaagacagactggtatttatcgatattatggtggatgagactgagcacgtttacccgatgcttatccgcggtggagcgatgaacgaaatgtggttaagcaaaacggagaagtgctaa

SEQ ID NO: 82205 - protein, 572 aa, Shewanella oneidensis MR-1
MEKLSGASMIVRSLIDEGVKHIFGYPGGSVLDIYDALHLIPGIEHILVRHEQAAVHMADGYARATGKVGVVLVTSGPGATNAITGIATAYMDSIPLVVLSGQVPSNLIGNDAFQECDMIGISRPVVKHSFLVQDPTQIPEIIKKAFYIASTGRPGPVVVDLPKDCLNPALLHDYIYPESIKMRSYNPTTSGHKGQIRRGLQALLAAKKPVLYVGGGAIISGSEKQILTLAEKLNIPVISTLMGLGAFPGTHKNSLGMLGMHGRYEANMAMHNCDLIFGIGVRFDDRTTNNIEKYCPNATILHIDIDPSSISKTVRVDIPIVGSADIVLDSILALLDEASETNDFVAINQWWQEITTWRNRQCLAYDKESNRIKPQQVIETLYKLTNGEAYVASDVGQHQMFAALYYPFDKPRRWINSGGLGTMGFGLPAAMGVKMAMPDETVVCVTGDGSIQMNIQELSTALQYDTPVKIINLNNRFLGMVKQWQDMIYSGRHSHSYMDSVPNFAKIAEAYGHVGMTISDPAELESKMAEALAMKDRLVFIDIMVDETEHVYPMLIRGGAMNEMWLSKTEKC

SEQ ID NO: 82206 - DNA, 1746 bp, Shewanella oneidensis MR-1
  CDS (1)..(1746): transl_table=11
atgagtacgtccccaattacagtagtagcagatgctattattgaatttttagcccaccaagggattaaagcatttcacaattatcccggtggaaccatcgctcctttattagatgcttgcaaacgtttcggagtaaccgtttacacttctcgaaatgagcaaggcgccggttatgccgcgctggctcaaggcaaactaacccaattaccaggtatcgtggcggtaacatcaggcccgggtgtaaccaatgtattaacgcccgtcgccgatgcctattttgatggtattccgatgttagtatttacgggccaagtgggtactggcgacctcacaggccaaaaacgagtaagacaatctggattccaagaagttgataccccatcattgatgaaacctatcactaagggacaattccaacctaaaaacagtgaagaactatacgctattcttcctatcgcatggcaactggctttagaaggcagaaaaggcccagtttcgattgatttaccaatggacgttcaacgcagtgcagcaattaaatccatcaaagtacccgaaatagttacttatcctgtcaatcgcacagagctaggcacttttatcgatgagctaatcaatgccattgaccattcgcaaaaaccagtgattatttgcggcaatggtatgacatcaccagcattagtggatgcaatccgtaccttaagaaactactggcctgcacctgtgagccatagcttgctgggcgttggagttttggacaccgatgattctgggtcattagggtttcatggccatacaggtagccaattagcaggtaaagccattgctgagtgtgatttattactggtattaggttccagattagatgttcgccaaactggcacactgaaaacagcctttgcctccaatgcgaaaatttttagagtcgatttagatattggagaattaactgatagtcgtatcgctcaccataaggctgttcaagctgaacttgagcaattttttgatgccttacaccccaaatttgctcaattatcaccacctaatctatcatcatggcataacaccatttcgcagtggaaagcgcaattagcttggccctacccagattatccaggaattgcacctaaactcttgctagaaaaactaagcaactctttaccagagaacactatcgtcaccacaggtgttggcgcacatcaacattgggttgcaaggcattttagatttgccctcccccatcgccagctttttacctcggcaggccatggcaccatgggctatgatctcccgacagcgataggtgccgcaatccactcaccagagtccaccattttgtgtatcgctggagacggttcatttcaaatgaatatccaagaactgggcgtgatcaaggagttaggccttaagatcaaaatactggttctggataaccacagattaggcttagtatctcaattccaattaatgaattgggaaactgatactgcttgcggtaacaaacaatcgcctaattttgccttaatagctcaaggttacggcattaaagcattgcattgtagtgatagcgctaaactagaacaaacattggctgaatttattgagaccgatgaatctattctgcttcatatcgaaattgccacacagcatgatgtcctcccaatgctattagggggtcaaacaacagataaaatgtggccttactttgacatgcaaggtaatccaagggatccatcaaatgtctaa

SEQ ID NO: 82207 - protein, 581 aa, Shewanella oneidensis MR-1
MSTSPITVVADAIIEFLAHQGIKAFHNYPGGTIAPLLDACKRFGVTVYTSRNEQGAGYAALAQGKLTQLPGIVAVTSGPGVTNVLTPVADAYFDGIPMLVFTGQVGTGDLTGQKRVRQSGFQEVDTPSLMKPITKGQFQPKNSEELYAILPIAWQLALEGRKGPVSIDLPMDVQRSAAIKSIKVPEIVTYPVNRTELGTFIDELINAIDHSQKPVIICGNGMTSPALVDAIRTLRNYWPAPVSHSLLGVGVLDTDDSGSLGFHGHTGSQLAGKAIAECDLLLVLGSRLDVRQTGTLKTAFASNAKIFRVDLDIGELTDSRIAHHKAVQAELEQFFDALHPKFAQLSPPNLSSWHNTISQWKAQLAWPYPDYPGIAPKLLLEKLSNSLPENTIVTTGVGAHQHWVARHFRFALPHRQLFTSAGHGTMGYDLPTAIGAAIHSPESTILCIAGDGSFQMNIQELGVIKELGLKIKILVLDNHRLGLVSQFQLMNWETDTACGNKQSPNFALIAQGYGIKALHCSDSAKLEQTLAEFIETDESILLHIEIATQHDVLPMLLGGQTTDKMWPYFDMQGNPRDPSNV

SEQ ID NO: 82208 - DNA, 1659 bp, Shewanella oneidensis MR-1
  CDS (1)..(1659): transl_table=11
atgataagaggcgcagacgcggttataaaagtgttggcagcacatggtgtgaccacagtatttggttacccaggtggtgccattatgccaatctacgatgccctctatggaagccctgtcgaacatctcttaagccgtcacgaacaaggcgcagcctttgctgccgtgggttacgccagagccagtggtaaaaccggtgtgtgctttgcaacctctggccctggtgccactaacttaatcacttcacttgccgatgcgctattggattctgtgcccgttgttgcgatcaccggtcaggtctcaactgccgtgattggcacagatgcgtttcaagagatcgatgtgttggggatgtcgctaagttgtaccaagcacagttttatggtgacggatgtaaacgatcttatcccaaccttataccaagcttttgaaatcgccgcatcgggtcgaccaggcccagtgctggtggatatccccaaagatatccaaatcgctcaccttgaataccgcacacctttactggccgtgaccaatgaaccccaagccgagatgagtgatatcaatgctgcccgtgcgctgttggcgcaagcgaaacaacccatgttgtatgtgggtggcggtgtgggtatggcgggggcggtcgatcaactgcgggattttatcaacacgacaggtatgccatcggtcgccacgttaaaaggcttaggcagcatcgcccatggtacgcccggttatttaggtatgttgggtatgcacggtggtaaggcggccaatcttgcggtgcaggattgtgatttattagtggttgcgggtgcgcgctttgatgaccgagtgactggccgtttagcgacttttgccaataaagccaaagttatccatttagatatcgatgccgccgagctcggtaaattacgccagcccgatgttgccatcgccggtgatttacgccagattttccccgcccttgctatgtcgctgaatatcactccttggcaagttgaagtggagcatcttgcccgcaaacaccaatgggattatcaacatcccggaagtttaatttatgcccccgccatgctgcgccgccttgccaataaactgcccgaagacagcgtagtgtgctgcgatgtgggccagcatcaaatgtgggttgcccagcatatgtggttccgccgccctgaagatcatttatccagcgcgggcttaggcactatgggatttggtttacctgccgccattggcgctcaagtggcacgccctgatgcgaccgtagtgaccgtatctggcgatggctcttttatgatgaacgtgcaggagctgaccaccatcaagcgtcgcaaattgccagtgaagatcctgctgattgataaccaaaaactggggatggtgaagcagtggcaacagctgttttttgaagggcgctacagcgaaaccgatctgtctgacaaccctgattttgtgcaactcgcctcggccttcgacattcccggccgcacgattttctcttccgacgaagtggaggaggccttaaccgaaatgttagcggctaagggaccttatttgttacacgttgcaatcgacgatgcttttaacgtttggccactggtgccccccggcgcatcaaacagcgatatgatggacgaaatggagaaacaaacatga

SEQ ID NO: 82209 - protein, 552 aa, Shewanella oneidensis MR-1
MIRGADAVIKVLAAHGVTTVFGYPGGAIMPIYDALYGSPVEHLLSRHEQGAAFAAVGYARASGKTGVCFATSGPGATNLITSLADALLDSVPVVAITGQVSTAVIGTDAFQEIDVLGMSLSCTKHSFMVTDVNDLIPTLYQAFEIAASGRPGPVLVDIPKDIQIAHLEYRTPLLAVTNEPQAEMSDINAARALLAQAKQPMLYVGGGVGMAGAVDQLRDFINTTGMPSVATLKGLGSIAHGTPGYLGMLGMHGGKAANLAVQDCDLLVVAGARFDDRVTGRLATFANKAKVIHLDIDAAELGKLRQPDVAIAGDLRQIFPALAMSLNITPWQVEVEHLARKHQWDYQHPGSLIYAPAMLRRLANKLPEDSVVCCDVGQHQMWVAQHMWFRRPEDHLSSAGLGTMGFGLPAAIGAQVARPDATVVTVSGDGSFMMNVQELTTIKRRKLPVKILLIDNQKLGMVKQWQQLFFEGRYSETDLSDNPDFVQLASAFDIPGRTIFSSDEVEEALTEMLAAKGPYLLHVAIDDAFNVWPLVPPGASNSDMMDEMEKQT

SEQ ID NO: 82210 - DNA, 1998 bp, Corynebacterium efficiens YS-314
  CDS (1)..(1998): transl_table=11
ttgttgtgggtggacacccctgcatccaacatcgcacggacatctgtcgcaccgcgtgaacacgcacctgcgtcggaacaattaaacagtgactctccccggggagtcatcagaaatccttctacgaaaaggagccagaaagtcgtgaacgtggcagcttctcaacagcccactccagccacggttgccagccgtggacgctccggtgccccggagcggatgacaggcgcacaggcaattgttcgatcgctagaggaattgaatgccgacattgtgttcggtattccgggcggtgcggttctccccgtatacgacccactgtattcctccacgaaggttcgccacgtgctcgtgcgccacgagcagggcgcgggacatgccgcaaccggttatgcacaggtcaccggtcgcgtcggtgtctgcatcgccacctccggccccggtgccaccaacctggtcaccccgatcgccgatgcgcacctggattctgttccactggtcgccatcaccggtcaggtcggccgcagcctcctgggtaccgacgccttccaggaagcagatatccgtggcatcaccatgccggtgaccaagcacaacttcatggtcaccgaccccaacgacatccccaaggccctggccgaggcattccacctcgccatcaccggccgcccgggaccgattctggtcgatatccccaaggacatccagaacgccgaactggacttcgtctggccccccaagatcgacctgccgggttaccgcccggtcaccgttccgcactcccgccagatcgagcaggccgtcaagctcatcggtgaggcccagaagcccgtcctctacatcggtggcggtgtcatcaaggcggacgcccacgaggaactgctcgccttcgccgagtacaccggcatcccagttgtcaccaccctcatggcgctgggcgccttcccggagtcccacgaactgaacatgggtatgccgggtatgcacggcaccgtggccgccgtgggtgccctgcagcgctccgacctgctcatcaccatcggcgcgcgtttcgacgaccgcgtcaccggcgaggtcagcagcttcgccccggacgccaagatcatccacgccgatatcgacccggccgagatcggcaagatccgtcaggctgatgtaccgatcgtcggcgatgcccgcgaggtgctcacccagctgctggcctccgtgcgcaacaagacgaacgccaccggcgacgtcagcgcctgggtggactacctgcgcgacctgcgcgagcgtttcccccgtggctacgacgagcagaccgacggctccctgtccccgcagtttgtcattgagacgctctcccgtgaggtcggtcccgacgccatctactgcgccggcgtcggccagcaccagatgtgggccgcacagttcatcgacttcgagaagccccgcacctggctcaactccggtggcctgggcaccatgggctacgccgtgccggctgccctcggtgccaaggcgggggctcccgagaaggaggtctgggctattgacggtgacggttgtttccagatgaccaaccaggaactgaccaccgccgcggtggagggcttcccgatcaagatcgccctgatcaacaacggcaatctcggcatggtgcgccagtggcagaccctgttctacgaaggtcgctactccaacaccaagctgcgcgagcagggttcctatgtgccggacttcgttcagctgtccgagggccttggatgcgtggccatccgcgtcaccaaggaggaggaggtcatcccggccatccagaaggcacgggagatcaacgaccgcccggtggtcatcgatttcatcgtcggtgaggatgcccaggtctggcctatggtgtccgccggtgcgtcgaactcggacatccagtacgcactcggcctgcgcccgctgttcgacaccgaggagtccgcaggcgagaaccccgcagacatcgacgcagtcaccaccagagcataa

SEQ ID NO: 82211 - protein, 665 aa, Corynebacterium efficiens YS-314
MLWVDTPASNIARTSVAPREHAPASEQLNSDSPRGVIRNPSTKRSQKVVNVAASQQPTPATVASRGRSGAPERMTGAQAIVRSLEELNADIVFGIPGGAVLPVYDPLYSSTKVRHVLVRHEQGAGHAATGYAQVTGRVGVCIATSGPGATNLVTPIADAHLDSVPLVAITGQVGRSLLGTDAFQEADIRGITMPVTKHNFMVTDPNDIPKALAEAFHLAITGRPGPILVDIPKDIQNAELDFVWPPKIDLPGYRPVTVPHSRQIEQAVKLIGEAQKPVLYIGGGVIKADAHEELLAFAEYTGIPVVTTLMALGAFPESHELNMGMPGMHGTVAAVGALQRSDLLITIGARFDDRVTGEVSSFAPDAKIIHADIDPAEIGKIRQADVPIVGDAREVLTQLLASVRNKTNATGDVSAWVDYLRDLRERFPRGYDEQTDGSLSPQFVIETLSREVGPDAIYCAGVGQHQMWAAQFIDFEKPRTWLNSGGLGTMGYAVPAALGAKAGAPEKEVWAIDGDGCFQMTNQELTTAAVEGFPIKIALINNGNLGMVRQWQTLFYEGRYSNTKLREQGSYVPDFVQLSEGLGCVAIRVTKEEEVIPAIQKAREINDRPVVIDFIVGEDAQVWPMVSAGASNSDIQYALGLRPLFDTEESAGENPADIDAVTTRA

SEQ ID NO: 82212 - DNA, 1644 bp, Pseudomonas putida KT2440
  CDS (1)..(1644): transl_table=11
atggccaaggccgccgatgtcgttgtgcaatgcctggaaaacgaaggtgtcgagtatgtattcggcattcccggtgaggaaaacctcgacctgctcgaatccctgcgcaagtcgaagatcaagctggtactgacccgtcacgagcagtccgcaggtttcatggctgccacctacggtcgcctgaccggcaagaccggcgtcagcctgtcgaccctcggccctggtgccaccaacctggtgaccgccagcgcctacgcctacctgggcggcatgccgatgatgatgatcaccgggcagaagccgatcaagaagtccaagcagggtcgcttccagatcattgacgtgtgcggcatgatggaccccatcaccaagtacacccaccagttcgcctcggccgacaacatcccggcccgcatgcgcgaagccttccgcctggccgaagaagaaaagccgggtgcggtgcacctggagctaccggaagacatcgccgccgagcagaccgacgcgctgccgatcccgcgcagcctgcaccgccgcccgctggccgagcacgtggccattgaagctgccgtcgagaaactgcagaacgcgcgtaatccgatcctggtgatcggtgccggtgccaaccgcaagatgaccgccaaggtcctcaagcagctgatcgacaagaccggcatcccgttcatcaccacccagatgggtaaaggcgtggtcgacgagcgccacccgcgcttcctcggcaacgctgcgctgtcgtcgggcgacttcgttcaccgcgccgtcgaagccgccgacctgatcatcaacatcggccacgatgtgatcgagaagccgccgttcttcatggtccgtggcggcaccgaagtcatccacatcaacttccgctctgccgaagtcgatgccgtgtacttcccgcaagtagaagtgatcggcgacatcgccaacgccgtgtggcagatcagtgaagcactgaacgacacgtcgcactgggacttcacccgcctgatggccatccgtgaagccaacgaagcacagatcgccgaaggcgccgacgacgaccgcttcccggtctacccacagcgcatggtggctgacatccgtcgtgtactgccgtccgaaggcatcgtcgccctggacaacggcatctacaagatctggttcgcccgcaactacaaagcgcacaagccaaacaccgtgctgctggacaacgccctggcgaccatgggcgccggcctgccatcggcaatggccgcgcacctggtgcacccggaccgcccggtaatctcggtgtgtggcgacggcggcttcatgatgaacagccaggaactggaaactgcagtacgtctgggcatgcacatcaccgtggtgatcctgcgtgacgacggctacggcatgatccgctggaagcaggccaacatgggtttcaccgatttcggcctggactacggcaacccggacttcgtcaagtatgccgaagcctacggcgccaacggccaccgcgtggaaagcgccgaaggcctgctgccgctgctggagcactgcatcaagaccccaggtgtgcacgtgatcgactgcccggtcgattacagcgagaacgaccgcatcctcaacagcgagctgcgtgagcgcgcgctggcggtgtaa

SEQ ID NO: 82213 - protein, 547 aa, Pseudomonas putida KT2440
MAKAADVVVQCLENEGVEYVFGIPGEENLDLLESLRKSKIKLVLTRHEQSAGFMAATYGRLTGKTGVSLSTLGPGATNLVTASAYAYLGGMPMMMITGQKPIKKSKQGRFQIIDVCGMMDPITKYTHQFASADNIPARMREAFRLAEEEKPGAVHLELPEDIAAEQTDALPIPRSLHRRPLAEHVAIEAAVEKLQNARNPILVIGAGANRKMTAKVLKQLIDKTGIPFITTQMGKGVVDERHPRFLGNAALSSGDFVHRAVEAADLIINIGHDVIEKPPFFMVRGGTEVIHINFRSAEVDAVYFPQVEVIGDIANAVWQISEALNDTSHWDFTRLMAIREANEAQIAEGADDDRFPVYPQRMVADIRRVLPSEGIVALDNGIYKIWFARNYKAHKPNTVLLDNALATMGAGLPSAMAAHLVHPDRPVISVCGDGGFMMNSQELETAVRLGMHITVVILRDDGYGMIRWKQANMGFTDFGLDYGNPDFVKYAEAYGANGHRVESAEGLLPLLEHCIKTPGVHVIDCPVDYSENDRILNSELRERALAV

SEQ ID NO: 82214 - DNA, 1776 bp, Pseudomonas putida KT2440
  CDS (1)..(1776): transl_table=11
atgagcaaaatgagagcaatcgatgcagccgttctggtcatgcgccgtgaaggtgtagataccgcgttcggcatcccgggggctgccatcaacccgttgtattcggccctgaaaaaagtcggtggcatcgatcacgtcctcgctcgtcacgtcgaaggtgcctcgcacatggccgagggctacacccgcgccaacccgggcaacatcggtgtgtgcatcggcacttccggccctgccggcaccgacatggtcaccggcctgtacagtgcctcggccgactccatcccgattctgtgcatcactggccaggcgccacgtgcccgtctgcacaaggaagacttccaggctgtcgacatcaccaacatcgtcaagccagtgaccaagtgggcgaccaccgttctggagccaggccaggtgccttacgccttccagaaggccttctatgaaatgcgtaccggccgcccaggcccggtgctgatcgacctgccgttcgacgtgcagatggccgaaatcgaattcgacatcgacgcctacgaaccgctgcccgtgcacaaaccgtccgccacacgcgtacaggccgaaaaagccctggccctgctcaatgacgccgagcgcccactgctggtagccggtggcggcatcatcaacgccgacgccagtgacaagctggtcgaattcgccgaactgaccggcgtacccgtgatcccgaccctgatgggctggggcaccatcccggacgaccacgcacagatggtcggcatggtcggcctgcagacctcgcaccgctatggcaacgcaaccctgctgaaatccgacctggtgttcggtatcggtaaccgctgggccaaccgccacaccggttccgtcgatgtctacaccgaaggccgcaagttcgtgcacgtcgacatcgaaccgacccagatcggccgcgtgttcaccccggacctgggcatcgtttccgatgctggtaaggcactggacgtgttcctggaagtggcccgcgagtggaaagccgccggcaagctcaaatgccgcaaggcctggctggaagagtgccaggagcgcaagtcgagcctgcagcgcaagacccacttcgacaacgtgccggtcaagccgcagcgcgtctacgaagaaatgaaccaagtgttcggcaaggacacctgctacgtcagcaccatcggcctgtcgcagattgccggcgcgcagttcctgcatgtgtacaagcctcgccactggatcaactgcggccaggccggcccgctgggctggaccatccctgctgcgctgggcgtggtcaaagccgatccgaagcgcaaggttgtggcgctgtcgggtgactacgacttccagttcatgatcgaagaactggcggtaggcgcccagttcaacctgccgtacgtccacgtactggtgaacaacgcctacctgggcctgatccgccaggcgcagcgtggcttcgacatggattactgtgtacaactggcgttcgagaacatcaactcgaccgacgctgccacctacggtgtcgaccacgtcgctgtggtcgaaggcctgggttgcaaggccatccgtgtgttcgagccagcagaaatcgcccctgccctgatcaaggcacagaagatggccgaagagttccgcgtgccggtggtggttgaagtgattctcgagcgtgtgaccaacatttccatgggcaccgagatcaacgcggtcaacgaattcgaagacctggccctggtcggcaacgacgcgccaaccgccatctcgctgctggactga

SEQ ID NO: 82215 - protein, 591 aa, Pseudomonas putida KT2440
MSKMRAIDAAVLVMRREGVDTAFGIPGAAINPLYSALKKVGGIDHVLARHVEGASHMAEGYTRANPGNIGVCIGTSGPAGTDMVTGLYSASADSIPILCITGQAPRARLHKEDFQAVDITNIVKPVTKWATTVLEPGQVPYAFQKAFYEMRTGRPGPVLIDLPFDVQMAEIEFDIDAYEPLPVHKPSATRVQAEKALALLNDAERPLLVAGGGIINADASDKLVEFAELTGVPVIPTLMGWGTIPDDHAQMVGMVGLQTSHRYGNATLLKSDLVFGIGNRWANRHTGSVDVYTEGRKFVHVDIEPTQIGRVFTPDLGIVSDAGKALDVFLEVAREWKAAGKLKCRKAWLEECQERKSSLQRKTHFDNVPVKPQRVYEEMNQVFGKDTCYVSTIGLSQIAGAQFLHVYKPRHWINCGQAGPLGWTIPAALGVVKADPKRKVVALSGDYDFQFMIEELAVGAQFNLPYVHVLVNNAYLGLIRQAQRGFDMDYCVQLAFENINSTDAATYGVDHVAVVEGLGCKAIRVFEPAEIAPALIKAQKMAEEFRVPVVVEVILERVTNISMGTEINAVNEFEDLALVGNDAPTAISLLD

SEQ ID NO: 82216 - DNA, 1752 bp, Staphylococcus epidermidis ATCC 12228
  CDS (1)..(1752): transl_table=11
atgattaaaatgtcaaatcaaaaatcaatggcttcgcctcacccttctgtgcatcaaacaaaggaatcacaacccttaataacacgcagtggttctcaattattagttgaagcacttcagcaggaagatgtagattttatcttcggttatcccggtggagctgtcttacctttatacgatacattttatgacgggaaaatcaaacatattcttgctcgtcatgaacaaggtgctacacatgctgctgaaggatatgcgcgtgtctctggtaaaacaggagtcgttgttgtgacaagtggacccggtgcaacaaatgccattacaggtattactgatgcatatagcgactctttaccactagtcgtttttactggtcaagttgctacacctggtattggtaaagatgctttccaagaagctgatttactctcgatgactacacctattacaaaacacaattatcaagttaaaaagattgaagacattccaagaattgttcatgaagcctttcatttagcgaacactggaagaaaaggtcctgtagtgattgatttccctaaagatatgggtgtgcttaaaactgatgttgaacttacaaaagatattaatattcctggttatgaagttaatagtaacccaaataaagaggatattaataagttaatatatatgattaaagaagctaagaaacctcttattcttgcaggtgctggtattaatcactctaaatctaatcatttattaacagaatttgtgacaagacatcaaatccctacagttacaactctcctaggacttggagcagtaccttatcatcaccctttattcttaggtatgggaggtatgcatggatcttatgcaagtaatatggctttaacaaattgtgatttacttatcaatttaggtagtagattcgatgatcgtcttgcaagtaagcctgatgcattcgcaccaaatgcaaaggttgtacatgtagatatcgacccttctgaaataaataaagttattaatacagatttaggtatagtcgctgattgcaagcttgtgcttgagaacttatgccatgagcaagttttaacatcctcccacgaagaatggaacgattattgtattaataacaaaagtaactatccatttaaatatgatgaaaatgataaaaacttttgcaaaccacaaaaagcgattgaatatattggcaaagttaccaatggaaatgcaattgttacaactgacgtaggccaacaccaaatgtggacagcacaattctatccatttaaaaattatggacaatgggtaacaagtggtggtttaggtactatgggatttggaattccatcagcaataggagcacaattagctgaacctgagaaaacagttgtatgttttgtaggagatggcggttttcaaatgacgaaccaagaaatggctttacttccagaatatggacttaatgtcaaaatagtacttattaataacggaactttaggtatggtaaaacaatggcaagataaattctttaataaacgattttctcattctgtatttaacgatcaacctgattttatgaaaatggcggaagcatatggtattaagggattcttgatagattctccagataaattagaatcttcaattgatgaagcatttgcatatcatggaccggcactcattgaagttagaatctcacctatagaaccagttaatccaatggtacctagtggcaaatcaaatcatgaaatggagggttactaa

SEQ ID NO: 82217 - protein, 583 aa, Staphylococcus epidermidis ATCC 12228
MIKMSNQKSMASPHPSVHQTKESQPLITRSGSQLLVEALQQEDVDFIFGYPGGAVLPLYDTFYDGKIKHILARHEQGATHAAEGYARVSGKTGVVVVTSGPGATNAITGITDAYSDSLPLVVFTGQVATPGIGKDAFQEADLLSMTTPITKHNYQVKKIEDIPRIVHEAFHLANTGRKGPVVIDFPKDMGVLKTDVELTKDINIPGYEVNSNPNKEDINKLIYMIKEAKKPLILAGAGINHSKSNHLLTEFVTRHQIPTVTTLLGLGAVPYHHPLFLGMGGMHGSYASNMALTNCDLLINLGSRFDDRLASKPDAFAPNAKVVHVDIDPSEINKVINTDLGIVADCKLVLENLCHEQVLTSSHEEWNDYCINNKSNYPFKYDENDKNFCKPQKAIEYIGKVTNGNAIVTTDVGQHQMWTAQFYPFKNYGQWVTSGGLGTMGFGIPSAIGAQLAEPEKTVVCFVGDGGFQMTNQEMALLPEYGLNVKIVLINNGTLGMVKQWQDKFFNKRFSHSVFNDQPDFMKMAEAYGIKGFLIDSPDKLESSIDEAFAYHGPALIEVRISPIEPVNPMVPSGKSNHEMEGY

SEQ ID NO: 82218 - DNA, 1665 bp, Bradyrhizobium japonicum USDA 110
  CDS (1)..(1665)
atgagcgggcaggagcgcaaggtgaagggatcggacctgtttgtcgcggcgctggagaatgaaggcgtcgatcgcatcttcggcgttcccggcgaagaaaacctcgatctcgtggaatcgctccgcacctccaagatcgagctgatcctgacccgccacgagcaggcggccgccttcatggctgccacccatggccggctcaccgggaagcccggcgtctgtctctcgacgctcggcccaggggcgctcaatctgtccacgggtgcggcctatgcgcatctcggcgcgatgccgatgatcctgatcaccggccagaagccgatcatgagcagcaggcaggcgcgcttccagatcgtggacgtggtcgcgaccatgaagccgctgacaaagctgtcgcggcagatcatcagcgcctccagcatcccgaccgtggtgcgcgatgcctttcgcgtggcgatggaggagcggccggggccggtgcatctcgaactgcccgaggacatcgcgggcgatgaagtgccggccgctcccgtgattccgatccatccgatcgagattccggtcgcccaccgcgccgcgctcgatcgtgccgccgagatgattctcgccgcaaggcatccgctggtgatgatgggcgccgcgaccagccggccgcgatcgacccacggcatcgcgagcttcgtgcggcgaaccggcattccctttttcaccacgcagatggggaagggcaccgtgcccggcggcaccaatctctatatgggcaccgcggcgctgtcggagcgcgactatgtccacgacgcgatcgacgccgccgatctgatcgtggcgatcggtcacgacccgatcgagaagccgcccttcatcatggggccgtcgggcccgaaggttattcacgtcagctacacgtcggccagcgtcgagcaggtctatttcccggatgccgaggttgtcggcgacgtgggcccgagtctggagctgctcgccgaccggctcgaaggcaagctgccgcaggccgcggcgctgctgccgctccgtgaggagatcctcaggcatatcgccgaccgcgccaccgaggcgcgctggccgccgacgccgcagcggatcgtgcacgacattcgccaggtgatcccggagaacggcatcgtcgcgctcgacaacggcatgtacaagatctggttcgcgcgcaactaccgcacccgcgtcgccaacacgctgttgttggacaacgcgctggcgacgatgggcgcaggcctgccgtcggcgatgatggcggcgatgctctatcccgatcgccgcgtgctcgcggtcgccggcgacggcggattcatgatgaacagccaggagatggaaaccgccgtccgcctcaagctcaacctggtcgtgctggtgctggaggacaacgcctacggcatgatccgctggaagcaggcagtcgatcatttcgccgatttcggcatgacctttggcaatcccgatttcgtcctctacgcgaaggcctatggagccaagggccatcgcatcgcgagtatcgacagcttcggcccgacgctggatgccgcgttcagggaaggcggcgtgcacctggtctcgatcccgatcgactattcggagaacgtgcgggtgctcgtggatgagctgcgggctcacgagaagtcgaaggcgtga

SEQ ID NO: 82219 - protein, 554 aa, Bradyrhizobium japonicum USDA 110
MSGQERKVKGSDLFVAALENEGVDRIFGVPGEENLDLVESLRTSKIELILTRHEQAAAFMAATHGRLTGKPGVCLSTLGPGALNLSTGAAYAHLGAMPMILITGQKPIMSSRQARFQIVDVVATMKPLTKLSRQIISASSIPTVVRDAFRVAMEERPGPVHLELPEDIAGDEVPAAPVIPIHPIEIPVAHRAALDRAAEMILAARHPLVMMGAATSRPRSTHGIASFVRRTGIPFFTTQMGKGTVPGGTNLYMGTAALSERDYVHDAIDAADLIVAIGHDPIEKPPFIMGPSGPKVIHVSYTSASVEQVYFPDAEVVGDVGPSLELLADRLEGKLPQAAALLPLREEILRHIADRATEARWPPTPQRIVHDIRQVIPENGIVALDNGMYKIWFARNYRTRVANTLLLDNALATMGAGLPSAMMAAMLYPDRRVLAVAGDGGFMMNSQEMETAVRLKLNLVVLVLEDNAYGMIRWKQAVDHFADFGMTFGNPDFVLYAKAYGAKGHRIASIDSFGPTLDAAFREGGVHLVSIPIDYSENVRVLVDELRAHEKSKA

SEQ ID NO: 82220 - DNA, 1746 bp, Tropheryma whipplei str. Twist
  CDS (1)..(1746): transl_table=11
ttggttaggatatcgggtgcacaagcggttataaaatcccttgaggaacttggtattgatcttgtttttggcattcctggcggggcgatacttgaggtttataactcgttatttagctcaagcattaggcatattcttgtgaggcatgaacagggcgctggtcatgctgccgaaggttatgcatgttcttctggaaagctgggggtttgtttggccacctcgggtccaggcgcaacaaatcttgtgactgccattgcggatgcgtatatggattctgttccgattctcgccataacaggtcaggtatattctcatttactcggaagtgatgcatttcaggagtcggatattatcgggataacaatgccgattacaaagcatgctttctctgtaaaaagggccacagagatcccggcggccatttttgccggtgcaaaaattgcaaccaccggaaggccaggacccgttttgatagatatcacaaaagatgcacaacaagacgaattcgattttatgtggccaccaaaaagcattgatttatccggatattccgttgcgcaaaacattccagatacattggcgcagtttgcagatggtttttttgacatgctgtctggcagcattaggcctgttatttatgctggcggagggaccgtgcgctctggagcctcagaagagcttattcgttttgcggaaggctttggtataccggttgtaaccaccctaaccgcgcgcggtgttttgccggattcaaataggctaaatctcggtatgccgggtatgcacggaactgttgcggcaattctcgccctgcagaagtcagatttactgattgctctgggtacacgttttgatgaccgtgtgacgggaaggcttgattcctttgcacaaaatgcacgggttgttcatgtggatattgatccggctgagattggcaagaatcgacgtccagatctttttgtgatcggggacgtaaaagaggtgttgggctatatcaactcgcattcggagaataaaaccacgggggatcttactgcttggtggcggtctttagagaaaatgcgtcagatttatccgttggtttttccacaaaaaagcagcgatggcaatttatctcccggttatgtgataaagagactcggagaattgtctggcccggatgcgatttatgcaaccggggttggacagcatcaaatgtgggcttcgcaggctataagtttttcgagacccaattcgtttctcacttccggtggggccggaaccatgggatacgctgtgccagcggctatgggcgctaaagctgcaaatcctgaaaaaattgtttgggccattgatggagatggttgttttcaaatgaccaatcaggagcttgcaacatgttctgtaaacggacttccaataaaagttgctgttataaacaaccgttctctcgggatggtgcgccagtggcagggattgttttataacaaacgctattctcagaccgacctgaataccggtgatgcgtatatacctgatttttgtaaacttgccgaatcgtattcatgcgcaagttgcagggttagctctgttgatgaagttgataatgcaattgaatttgccctggcaataaatgatagaccggttgttatagattttgtcgtctgtaaagactctatggtttggccaatggttccgcaagggcttggtaattcacatcttaagtatttacaggatgtatcacccgtttggcacgataatgaatag

SEQ ID NO: 82221 - protein, 581 aa, Tropheryma whipplei str. Twist
MVRISGAQAVIKSLEELGIDLVFGIPGGAILEVYNSLFSSSIRHILVRHEQGAGHAAEGYACSSGKLGVCLATSGPGATNLVTAIADAYMDSVPILAITGQVYSHLLGSDAFQESDIIGITMPITKHAFSVKRATEIPAAIFAGAKIATTGRPGPVLIDITKDAQQDEFDFMWPPKSIDLSGYSVAQNIPDTLAQFADGFFDMLSGSIRPVIYAGGGTVRSGASEELIRFAEGFGIPVVTTLTARGVLPDSNRLNLGMPGMHGTVAAILALQKSDLLIALGTRFDDRVTGRLDSFAQNARVVHVDIDPAEIGKNRRPDLFVIGDVKEVLGYINSHSENKTTGDLTAWWRSLEKMRQIYPLVFPQKSSDGNLSPGYVIKRLGELSGPDAIYATGVGQHQMWASQAISFSRPNSFLTSGGAGTMGYAVPAAMGAKAANPEKIVWAIDGDGCFQMTNQELATCSVNGLPIKVAVINNRSLGMVRQWQGLFYNKRYSQTDLNTGDAYIPDFCKLAESYSCASCRVSSVDEVDNAIEFALAINDRPVVIDFVVCKDSMVWPMVPQGLGNSHLKYLQDVSPVWHDNE

SEQ ID NO: 82222 - DNA, 1725 bp, Pseudomonas syringae pv. tomato str. DC3000
  CDS (1)..(1725): transl_table=11
gtggagcttttatctggcgctgaaatgatcgtccgctttttgcgtgacgaaggcgttgagcacatctatgggtacccgggtggtgccctcctgcatgtctacgatgccctgttcaaagaaccggccgtcagccatatccttgttcgtcacgagcaggcggctacgcacatggccgacggctatgcgcgcgccaccggcaaggcgggtgtggtgctggtgacgtccggccctggtgcaaccaatgccattaccggtatcgccacggcgtatatggactccattccgatggtggttctgtccggtcaggtagcgagcaccctggtgggcaccgacgcattccaggagaccgacatgatcggtatctcccggccgatcgtgaagcacagcttcatgatcaagcacccgtcggaaattccggaaattctgaagaaggctttctacctggcgcagtccggtcgtcccggccctgtggtcgtggatattccgaaagacatgaccaacccggccgagaaattcgaatacgtctttccgaaaaaagccaagctgcgctcctacagccctgcggtccgcggtcattccggccagatccgcaaggctgtggaaatgctcctggccgccaagcgtcctatcatctatgccggtggcggcgtgatcatgggcaacgcttcggcgcaactgaccgagctggctcaactgctcaatgccccagtgaccaatacgctgatgggcctgggttgctatcccggcaccgatcgccagttcgtcggtatgctcgggatgcacggcagctataccgccaaccttgcgatgcaccacaccgacgtgattctggctgtcggcgcgcgtttcgatgaccgggtgatcaatggcgcgagcaagttctgcccgaacgccaagatcatccacatcgatattgaccctgcgtcgatctccaagaccatcaaggctgacgtgcctatcgtcggccctgtcgaaagcgtgctgaccgaaatggtcgccaccctgaaagaaatcggcgaaacgcctgacaaggcgtcggtcgctgcatggtggaagcagattgacgagtggcgcggtagcggcgatctgttcccgtacaaccgtggcgatggcactgtcatcaagccgcaggcggtgatcgaaacactgtgcgaagtcaccaagggcgatgcctatgtgacctccgacgtgggtcagcatcagatgtttgctgcgcagtactaccgtttcaacaagccgaaccgctggatcaactccggcggtctgggcaccatgggctttggcttcccggcggcgatgggcgtcaagctgagctttccggacgagcacgttgcctgtgtgaccggtgaaggcagcatccagatgaacattcaggagctttcgacctgtctgcaatatggcctgccggtgaagatcattctgctcaataacggtgtgctgggcatggttcgccagtggcaggacatgagctacggcgcgcgtcactcgcattcctacatggaatcgctgcctgacttcgtcaagctggtcgaggcttatggccacgtcggcatgcgcatcaccgatttgaaagatctcaagccgaagatggaagaagcgtttgccatgactgaccggctggtgttccttgatattcaggtcgatgtgagcgagcacgtctatccgatgcagatcaaggacggctccatgcgcgatatgtggttgagcaagacggagcggacataa

SEQ ID NO: 82223 - protein, 574 aa, Pseudomonas syringae pv. tomato str. DC3000
MELLSGAEMIVRFLRDEGVEHIYGYPGGALLHVYDALFKEPAVSHILVRHEQAATHMADGYARATGKAGVVLVTSGPGATNAITGIATAYMDSIPMVVLSGQVASTLVGTDAFQETDMIGISRPIVKHSFMIKHPSEIPEILKKAFYLAQSGRPGPVVVDIPKDMTNPAEKFEYVFPKKAKLRSYSPAVRGHSGQIRKAVEMLLAAKRPIIYAGGGVIMGNASAQLTELAQLLNAPVTNTLMGLGCYPGTDRQFVGMLGMHGSYTANLAMHHTDVILAVGARFDDRVINGASKFCPNAKIIHIDIDPASISKTIKADVPIVGPVESVLTEMVATLKEIGETPDKASVAAWWKQIDEWRGSGDLFPYNRGDGTVIKPQAVIETLCEVTKGDAYVTSDVGQHQMFAAQYYRFNKPNRWINSGGLGTMGFGFPAAMGVKLSFPDEHVACVTGEGSIQMNIQELSTCLQYGLPVKIILLNNGVLGMVRQWQDMSYGARHSHSYMESLPDFVKLVEAYGHVGMRITDLKDLKPKMEEAFAMTDRLVFLDIQVDVSEHVYPMQIKDGSMRDMWLSKTERT

SEQ ID NO: 82224 - DNA, 1647 bp, Vibrio parahaemolyticus RIMD 2210633
  CDS (1)..(1647): transl_table=11
atgactggtgcacaacttgtcgtagccgctttaagacagcaaggcatcaagacggtgtttggttatcccggtggagccatcatgccaatctatgatgccttgtatgacgggggtgtcgagcacatcttatgccgccatgaacaaggggccgccatggccgccatcggtatggctcgatccactcaagatgttgccgtgtgcatggcaacttccggccctggggccaccaaccttgttaccggcctagccgatgctttccttgattccgttcctttggtagccatcacaggtcaggttgccagctctcatatcggtaccgatgcgttccaagaaatggatgtgattggtatgtctctcgcctgtactaagcacagttatcttgttactgacattgaagatcttgcccctacgctagccgaagcgtttgaagtggccaaaacgggtcgtccgggcccggtcattgtcgatattgcgaaagatgttcagcttgctcaagccccaacagaattactgccaccttacgttgcacctgaaatcgaagacgtcagcgctgaagacatcaaacgcgcgcaagacgtactggcggcgtccactcgcccggtattgtatgtcggcggcggtgtgcagcttgcgaaagcaacagatgcagtgagagagttcttacgtctgaacccgatgccagcagtaagcactctgaaaggcttaggtacgattgaacgccatgaccctcactacttaggcatgttgggtatgcacggcaccaaagcggccaaccttgtggttcaagaagcggatctgttgattgtcgtaggcgcgcgttttgatgaccgtgtgacgggcaaactcgatacctttgcgccgcacgccaaagtcatccatatcgacatcgatgcggccgaaatccataagcttcgtcacgcaaacgcaccactgcgaggcgacatcaataccattcttcctcagttggagctgactcaagatatctcatcgtgggttcaccacagtgaaagtctgcgtagcggctttaagtggcgttacgaccaccctggcgatcttatctacgcgccgctgctgcttaagcagttatctgacatgatgccagacagcgcaatcgtctcgactgacgtaggccagcaccaaatgtgggcagctcagcacattcagccacgcgatccgcaaaacttcattacttccgcaggcttaggcaccatgggttttggtttgccagcagcaatgggcgcatcagtcgcgcgtccggatgatcagtctatccttattacaggtgacggttcattcatgatgaacgtgcaggagctaggcacgctaaaacgtcgccaaattcctgtgaagattgttctcctaaacaaccaacgtcttggcatggttcgccaatggcaatcactgtttttcgacggtcgccacagtgaaaccattcttgatgacaacccagatttcgtgatgttggcaaaagccttcgacattccgggcaaaaccatcaccaagaaagaagaagtcgaaccagcacttaaagaaatgctagcgagcgaaacttcttacatgcttcacgttttaattgatgaagaagaaaacgtgtggccacttgtaccacctggtgcatcaaacagtgatatgttggaaaacacgtag

SEQ ID NO: 82225 - protein, 548 aa, Vibrio parahaemolyticus RIMD 2210633
MTGAQLVVAALRQQGIKTVFGYPGGAIMPIYDALYDGGVEHILCRHEQGAAMAAIGMARSTQDVAVCMATSGPGATNLVTGLADAFLDSVPLVAITGQVASSHIGTDAFQEMDVIGMSLACTKHSYLVTDIEDLAPTLAEAFEVAKTGRPGPVIVDIAKDVQLAQAPTELLPPYVAPEIEDVSAEDIKRAQDVLAASTRPVLYVGGGVQLAKATDAVREFLRLNPMPAVSTLKGLGTIERHDPHYLGMLGMHGTKAANLVVQEADLLIVVGARFDDRVTGKLDTFAPHAKVIHIDIDAAEIHKLRHANAPLRGDINTILPQLELTQDISSWVHHSESLRSGFKWRYDHPGDLIYAPLLLKQLSDMMPDSAIVSTDVGQHQMWAAQHIQPRDPQNFITSAGLGTMGFGLPAAMGASVARPDDQSILITGDGSFMMNVQELGTLKRRQIPVKIVLLNNQRLGMVRQWQSLFFDGRHSETILDDNPDFVMLAKAFDIPGKTITKKEEVEPALKEMLASETSYMLHVLIDEEENVWPLVPPGASNSDMLENT

SEQ ID NO: 82226 - DNA, 1689 bp, Salmonella enterica subsp. enterica serovar Typhi Ty2
  CDS (1)..(1689): transl_table=11
atggcaagttcgggcacaacatctacacctcagcgctttacgggcgcggaatttatagttcattttctggagcgccaggggattcgtatcgtcaccggcattcccggcggttcgatcctccccgtttacgacgcgttaagccaaagcacgcaaatccgtcatattctggcgcgccacgaacaaggcgcggggtttattgcgcaggggatggcgcggacggagagtaaacctgctgtttgtatggcctgtagcgggccaggcgcgaccaatctggtcacggctattgccgatgcgcgcctggattccattccgttaatctgcattaccgggcaggttccggcgtccatgatcggtactgacgcgtttcaggaagtggatacctacggtatctctatccccatcaccaagcacaactatctggtcagaaatatcaatgagctgcctcaggtgatgagcgatgcttttcgtctggcgcagtcggggcgtcctggcccggtgtggatagacgttcctaaagatgtgcagacggcgaccattgagctggatgcgttgccgtcgccggcggaaaaatcacccccgccggagtttagcgcggagagtatccgcgaggccgccgcaatgattaacgcggcgaagcgtccggtgctgtatctgggcggcggcgtgatcaatgcgccgacacgcgtgcgcgaactggcggaaaaagcgcaactgccgacgacaatgaccttaatggcgctgggaatgctgcctaaggcgcatccgctgtcgttaggaatgctgggaatgcacggcgcgcgcagtaccaattttattctgcaagaggccgatttactgattgttctgggcgcgcgttttgatgaccgggcgattggcaaaacggagcagttttgtccgaacgccaaaatcatccatgtggatatcgatcgcgccgagttaggcaaaattaagcagccgcatgtggctattcaggcggatgtcgatgatgtactggcacagttaattccccatatcgaggcacagccgcgggaagcatggcatcagttggtggcggacttgcagcaagaattcccttgcggtattccccaggaaaataacccgcttagtcactatgggctgattaacgcggtcgcagcctgtgtggacgacaacgcgattattaccactgacgtaggtcagcatcagatgtggaccgcgcaggcttatccgctcaaccgtccgcgtcagtggctgacttccggcgggctgggcaccatggggtttggtctgcccgcggcgattggcgcggcgctggcgaatccgggcaacaaggtgctgtgtttttccggcgacggtagtttgatgatgaatattcaggagatggctaccgccagcgaaaaccagttggatgtgaaaatcatcctgatgaataacgacgcgctgggactggtgcatcagcaacagagtctgttctataaacagggcgtttttgcggcaacctatccgggaagcatcaactttatgcagattgccgccgggtttggtctggacacctgtgatttgaataacgaagccgatccacaggcggcgttgcaggctatcattcgtcgtcctggaccggcgttgatccacgtgcgcattgatgcagaagaaaaagtgtatccgatggtgccgccgggtgcggcaaatacagagatggtgggggaataa

SEQ ID NO: 82227 - protein, 562 aa, Salmonella enterica subsp. enterica serovar Typhi Ty2
MASSGTTSTPQRFTGAEFIVHFLERQGIRIVTGIPGGSILPVYDALSQSTQIRHILARHEQGAGFIAQGMARTESKPAVCMACSGPGATNLVTAIADARLDSIPLICITGQVPASMIGTDAFQEVDTYGISIPITKHNYLVRNINELPQVMSDAFRLAQSGRPGPVWIDVPKDVQTATIELDALPSPAEKSPPPEFSAESIREAAAMINAAKRPVLYLGGGVINAPTRVRELAEKAQLPTTMTLMALGMLPKAHPLSLGMLGMHGARSTNFILQEADLLIVLGARFDDRAIGKTEQFCPNAKIIHVDIDRAELGKIKQPHVAIQADVDDVLAQLIPHIEAQPREAWHQLVADLQQEFPCGIPQENNPLSHYGLINAVAACVDDNAIITTDVGQHQMWTAQAYPLNRPRQWLTSGGLGTMGFGLPAAIGAALANPGNKVLCFSGDGSLMMNIQEMATASENQLDVKIILMNNDALGLVHQQQSLFYKQGVFAATYPGSINFMQIAAGFGLDTCDLNNEADPQAALQAIIRRPGPALIHVRIDAEEKVYPMVPPGAANTEMVGE

SEQ ID NO: 82228 - DNA, 1698 bp, Bacteroides thetaiotaomicron VPI-5482
  CDS (1)..(1698): transl_table=11
atgagtaaggacttaataacaggcgcagaggcaatgatgcgctctctggaacatcagggagtgactaccattttcggttatcccggcggttccatcatgcctacgttcgatgccctgtacgaccatcaaaatacattgaaccatatcttggttcgccatgaacagggagctgcccatgcggcacaaggctacgcccgtgtatcgggtaaagtcggtgtttgcttggtgacaagcggccccggagcaaccaatacgatcacaggtattgcagatgcgatgatagacagtacgcctatcgttgtcattgcaggacaggtgggaacaggctttcttggaacagacgcttttcaggaagtcgatctcgtaggtatcactcagccaatcgctaaatggagctatcagattcgccgtgccgaagacgtagcctgggcgatagcacgtgctttctacattgccagtagtggtcgtcccggtccggtggtactcgactttgccaagaatgcgcaggttgaaaaaacgaaatacgagccgacaaagcaggagtttatccgcagctatgttccggttcccgatacagacgaagaatcagtaaaggctgccgccgaactgatcaataacgccgaacgcccgcttgtcttggtaggacagggagtggaactgggaagcgctcaggaagaactgcgtatctttatcgaaaaggcggatatgcccgcaggttgtaccttgctcggactttccgcattgcctaccgaccatccgttgaataaaggaatgctgggtatgcacggaaatctgggaccgaatatcaatactaacaaatgtgatgtactgattgctgtcggtatgcgtttcgacgaccgtgtgaccggtaatctggctacttacgccaaacaagcgaaagtgatccattttgacattgatccggcggaagtaaataagaatgtaaaggtagacattgccgttttgggcgactgcaaaaagacgctggctgctgtgaccggactgctgaaaaagaaccggcacaccgagtgggtcgatagtttcaaggaatatgaagcggtagaggaagaaaaagtcattcgtcccgaacttcatcctgcaacggattcactgagtatgggcgaagtggtgcgtgcggtaagcgaagcgacccgtcacgaagccatattggtgacagatgtaggtcagaatcagatgatctctgcccgctactttaaatataccagggaacgtagtatcgttacttcgggtggactcggcacgatgggttttggccttccggcagctatcggagctactttcggccgtcccgaccgcacggtatgtgtatttatgggtgacggcggactgcaaatgaacattcaggagctgggtacgatcatggaacagaaagctccggtgaagattatctgcctgaacaacaattatctcggcaacgtgcgccaatggcaggctatgttctttaatcgccgttattcatttactccgatgctgaatccggattacatgaaaatcgcttccgcctacgatattccttccaaacgtgtcttttcacgggaagaattgaaagcggccatcgacgaaatgctctcgacagacggggcgttcctgctcgaagcctgtgtggtagaagaaggcaatgtcctcccgatgacccctccgggcggttcagtcaatcagatgttgctggaatgttaa

SEQ ID NO: 82229 - protein, 565 aa, Bacteroides thetaiotaomicron VPI-5482
MSKDLITGAEAMMRSLEHQGVTTIFGYPGGSIMPTFDALYDHQNTLNHILVRHEQGAAHAAQGYARVSGKVGVCLVTSGPGATNTITGIADAMIDSTPIVVIAGQVGTGFLGTDAFQEVDLVGITQPIAKWSYQIRRAEDVAWAIARAFYIASSGRPGPVVLDFAKNAQVEKTKYEPTKQEFIRSYVPVPDTDEESVKAAAELINNAERPLVLVGQGVELGSAQEELRIFIEKADMPAGCTLLGLSALPTDHPLNKGMLGMHGNLGPNINTNKCDVLIAVGMRFDDRVTGNLATYAKQAKVIHFDIDPAEVNKNVKVDIAVLGDCKKTLAAVTGLLKKNRHTEWVDSFKEYEAVEEEKVIRPELHPATDSLSMGEVVRAVSEATRHEAILVTDVGQNQMISARYFKYTRERSIVTSGGLGTMGFGLPAAIGATFGRPDRTVCVFMGDGGLQMNIQELGTIMEQKAPVKIICLNNNYLGNVRQWQAMFFNRRYSFTPMLNPDYMKIASAYDIPSKRVFSREELKAAIDEMLSTDGAFLLEACVVEEGNVLPMTPPGGSVNQMLLEC

SEQ ID NO: 82230 - DNA, 1785 bp, Streptomyces avermitilis MA-4680
  CDS (1)..(1785)
atggctcgtatgaccgctgcccgtgcggcagtcgagatcctcaagcgcgagggcgtccgcagcgcgttcggtgtcccgggcgcggcgatcaaccccttctacgcggccctcagggcctccggcgggatcgatcacaccctcgcccgccatgtcgagggcgcctcgcacatggccgagggctacacccgtgcgcacccgggcaacatcggcgtctgcatcggtacgtcgggccccgcgggcaccgacatgatcaccggtctctactccgccatcggcgactcgatcccgattctgtgcatcaccggccaggcgccgaccgccgtgatccacaaggaggacttccaggccgtcgacatcgcctcgatcgccaggccggtcacgaaaatggccgtcaccgtcctcgaggccgcgcaggttcccggcgtcttccagcaggccttccatctcatgcgctccggccggcccgggcccgtcctcatcgacctgccgatcgacgtccagctcaccgagatcgagttcgacccggagacgtacgaacccctcgcggtctacaggcccgccgccacccgcgcccagatcgagaaggcgatcacccttctcaacgagtccgagcgcccgctgatcgtcgccggcggcggcgtcatcaacgccgacgcctgcgaactcctcgtcgagttcgccgagttgacgggggtcccggtcgtcccgaccctgatgggctggggcgtcctgcccgacgaccacgagttgaacgccggtctggtcggcctccagacctcgcaccgctacggcaacgccaccttcctggagtccgacttcgtcctgggcatcggcaaccgctgggccaaccgccacaccggcagactggacgtctacacggccggccggacgttcgtgcacgtcgacgtcgagcccacccagatcggcaggatcttcgccccggactacggcatcgcgtccgacgcgaaggccgccctcgaactgttcgtcgaggtggcacgggagctgaagtccgcgggcgggctgcccgaccggtccgggtgggcggcctccacccaggagcggagggccaccctccagcgccgtacgcacttcgacgacatcccgatcaagccgcagcgcgtctacgaggagatgaacaaggccttcggcccacagacccggtacgtctccaccatcggcctctcgcagatcgccggcgcccagctgctgcacgtccaccggccgcggcactggatcaactgcggccaggccgggccgctcggctggaccgtcccggccgcgctcggcgtcgccaaggccgaccccgaggcacgggtcgtggcgctctccggggactacgacttccagttcatgatcgaggagctggcggtcggcgcgcagcaccggatcccgtacgtccacgtcctggtgaacaacgcctacctgggcctgatccggcaggcacagctcggtcttgacatcaacttccaggtcaacctggagtttgagaacatcaactccccggagctgggcgtctacggcgtcgaccacgtcaaggtcgtcgaaggcctcggctgcaaggcgatccgggtcaccgaccccggcgagctgggcgccgccttcgagcaggccaagaagctcgccgcggagtaccgggtgccggtcgtcgtcgaggcgatcctggagcgggtcaccaacatcgcgatgagcaggacgaacgacatcagcgacgtcgtggagttcgaggaggtggcgaccgagcccgggcacgccccgacctcgatcaggacgctgaaggtctga

SEQ ID NO: 82231 - protein, 594 aa, Streptomyces avermitilis MA-4680
MARMTAARAAVEILKREGVRSAFGVPGAAINPFYAALRASGGIDHTLARHVEGASHMAEGYTRAHPGNIGVCIGTSGPAGTDMITGLYSAIGDSIPILCITGQAPTAVIHKEDFQAVDIASIARPVTKMAVTVLEAAQVPGVFQQAFHLMRSGRPGPVLIDLPIDVQLTEIEFDPETYEPLAVYRPAATRAQIEKAITLLNESERPLIVAGGGVINADACELLVEFAELTGVPVVPTLMGWGVLPDDHELNAGLVGLQTSHRYGNATFLESDFVLGIGNRWANRHTGRLDVYTAGRTFVHVDVEPTQIGRIFAPDYGIASDAKAALELFVEVARELKSAGGLPDRSGWAASTQERRATLQRRTHFDDIPIKPQRVYEEMNKAFGPQTRYVSTIGLSQIAGAQLLHVHRPRHWINCGQAGPLGWTVPAALGVAKADPEARVVALSGDYDFQFMIEELAVGAQHRIPYVHVLVNNAYLGLIRQAQLGLDINFQVNLEFENINSPELGVYGVDHVKVVEGLGCKAIRVTDPGELGAAFEQAKKLAAEYRVPVVVEAILERVTNIAMSRTNDISDVVEFEEVATEPGHAPTSIRTLKV

SEQ ID NO: 82232 - DNA, 1689 bp, Shigella flexneri 2a str. 2457T
  CDS (1)..(1689): transl_table=11
atggcaagttcgggcacaacatcgacgcgtaagcgctttaccggcgcagaatttatcgttcatttcctggaacagcagggcattaagattgtgacgggcattccgggcggttctatcctgcctgtttacgacgccttaagccaaagcacgcaaatccgccatattctggctcgccatgaacagggcgcggggtttatcgctcagggaatggcgcgcaccgacggtaaaccggcggtctgtatggcctgtagcgggccgggtgcgactaacctggtgaccgccattgctgatgcgcggctggactccatcccgctgatttgcatcactggtcaggttcccgcctcgatgatcggcaccgacgccttccaagaagtggacacctacggcatctctatccccatcaccaaacacaactatctggtcagacatatcgaagagctcccacaggtcatgagcgatgccttccgcattgcgcaatcaggccgccctagcccggtgtggatagacattcctaaggatgtacaaacggcggtttttgagattgaagctcagcccgcggtggcagaaaaagccgttgcacccgcctttagcgaagaaagcattcgtgacgcagctacaatgattaacgctgccaaacgcccggtgctttatctgggtggtggtgtgatcaatgcgcctgcgcgggtgcgtgaactggcggagaaagcgcaactgcctaccaccatgactttaatggcgctgggcatgctgccaaaagcgcatccgttgtcgctgggtatgctggggatgcacggcgtgcgcagtaccaactatattttgcaggaggcggatttgttgattgtgctcggtgcgcgttttgatgaccgggcgattggcaaaaccgagcagttctgtccgaatgccaaaattattcatgtcgatatcgatcgcgcagagctgggtaaaatcaagcagccgcatgtggcgattcaggcggatgttgatgacgtgctggcgcaattgatcccgcgggtggaagcgcaaccgcgtgcagagtggcaccagttggtagcggatttgcagcgcgaattcccgtgtccaatcccgaaagcgtgcgatccattaagccattacggcctgatcaacgccgttgccgcctgtgtcgatgacaatgcgattatcaccaccgatgtgggtcagcatcagatgtggaccgcgcaagcttatccgctcaatcgcccacgccagtggctgacctccggtgggctgggcacgatgggttttggcctgcctgcggcgattggcgcggcgctggcgaacccggatcgcaaagtgttgtgtttctccggcgacggcagcctgatgatgaatattcaggagatggcgaccgccagtgaaaatcagctggatgtcaaaatcattctgatgaacaacgaagcgctggggctggtgcatcagcaacagagtctgttctacgagcaaggcgtttttgccgccacctatccgggcaaaatcaactttatgcagattgccgccggattcggcctcgaaacctgtgatttgaataacgaagccgatccgcaggctgcattgcaggaaatcatcaatcgccctggcccggcgctgatccatgtgcgcattgatgccgaagaaaaagtttacccgatggtgccgccaggtgcggcgaatactgaaatggtgggggaataa

SEQ ID NO: 82233 - protein, 562 aa, Shigella flexneri 2a str. 2457T
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPSPVWIDIPKDVQTAVFEIEAQPAVAEKAVAPAFSEESIRDAATMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPRVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYEQGVFAATYPGKINFMQIAAGFGLETCDLNNEADPQAALQEIINRPGPALIHVRIDAEEKVYPMVPPGAANTEMVGE

SEQ ID NO: 82234 - DNA, 1704 bp, Nitrosomonas europaea ATCC 19718
  CDS (1)..(1704): transl_table=11
atgagtactgaactgacaggtgccgagattacgatacgttgtctgcaggaggagggggtaagtcatatttttggctatcccggcggtgccgtattgttcctgtatgatgaattgttcaagcaggataaagtcaagcatattctggttcgccatgaacaggctgccctccatgcagcggatggttatgcgcgttccagtaacaaggtcggtgtagcactggtgacatctggcccgggggtgaccaatgccgtaacgggtattgctaccgcttacatggattccatcccaatggtgattatcagtgggcaggttcccacggctgccattggtcaggatgccttccaggaagtggataccgtgggaattacacggccttgtgtcaaacacaactttctggtgaaggatgtatcggagctggcggtcacaatcaaaaaagctttttatattgcttcaaccggtcgtccaggaccggtattggtggatattcccaaggacgtcacccagcagaaggcggaatttcattatcctgccagtatctcattgcgttcctactcaccggtaatcaacggggatgcccaacagctcaggaaagccgtccagatgatcctggaagccaagcgtcccatggtctataccggtggcggggtgattctggatgatgctgcggcagaattgacagaactcgtgcagatgctgaattttccctgtaccagtaccctcatggggttgggaggatatccggcgactgaccggcaatttgtcgggatgctgggcatgcatggtacctacgaagccaatatggccatgcaatactgcgatgtgctgatcgcagtcggtgctcgttttgatgatcgcgtcatcggaaatcccaagcatttctacagcgaagaacggaaaatcatccatatcgacatcgatccatcatcgatttccaagcgggtcaaggtggatgttcctatcgtcggcagtgtatctgcggtactgaaagagttgatcatgctgctgagagccggcagggagacgactgatgtccatgctttgaacaaatggtgggagcaggtcgagttgtggcgggcacgtgattgcctgaaatatgaccggtcggccagcgttatcaagccgcagctggtggtggaaaaactgtatgaaataaccggcggagacgccttcattacttctgacgtcgggcagcatcagatgtgggcagcccagttttacaaatttgataaaccgcgccgctgggttaattccggtggcttgggtacgatgggattcggtctgccttctgcgatgggggtacagatggccaacccgggcagtacggtggcctgtattaccggagaggcaagtatccagatgtgcattcaggagttatccacctgtaaacagtatcgtctgcccatcaagatcatcaatttgaacaaccgttacatggggatggtgcgtcaatggcaggagtttttccatggcaaccgttacgctgaatcctatatggatgcattacccgattttgtcaaactggcagaaagttacgggcatgtcggcatgcggatcgataaaccggaagatatcgatggtgcgttgagagaagccttcaaactggaagaacaactggtattcatggatttcattacggatcagaccgagaatgtttttcctatggtacctggtggcaaaggtttgtccgaaatgattctggtataa

SEQ ID NO: 82235 - protein, 567 aa, Nitrosomonas europaea ATCC 19718
MSTELTGAEITIRCLQEEGVSHIFGYPGGAVLFLYDELFKQDKVKHILVRHEQAALHAADGYARSSNKVGVALVTSGPGVTNAVTGIATAYMDSIPMVIISGQVPTAAIGQDAFQEVDTVGITRPCVKHNFLVKDVSELAVTIKKAFYIASTGRPGPVLVDIPKDVTQQKAEFHYPASISLRSYSPVINGDAQQLRKAVQMILEAKRPMVYTGGGVILDDAAAELTELVQMLNFPCTSTLMGLGGYPATDRQFVGMLGMHGTYEANMAMQYCDVLIAVGARFDDRVIGNPKHFYSEERKIIHIDIDPSSISKRVKVDVPIVGSVSAVLKELIMLLRAGRETTDVHALNKWWEQVELWRARDCLKYDRSASVIKPQLVVEKLYEITGGDAFITSDVGQHQMWAAQFYKFDKPRRWVNSGGLGTMGFGLPSAMGVQMANPGSTVACITGEASIQMCIQELSTCKQYRLPIKIINLNNRYMGMVRQWQEFFHGNRYAESYMDALPDFVKLAESYGHVGMRIDKPEDIDGALREAFKLEEQLVFMDFITDQTENVFPMVPGGKGLSEMILV

SEQ ID NO: 82236 - DNA, 1689 bp, Bacillus anthracis str. Ames
  CDS (1)..(1689): transl_table=11
ttgagtacaggtgtaaaagcaaacgacgtgaagacaaaaacaaaaggagcagatcttgttgttgattgtttaattaaacaaggtgttacacatgttttcggtattccaggagcgaagattgactctgtatttgatgtactgcaagaaagaggaccagagttaattgtttgtcgtcatgaacaaaatgcagcatttatggcagctgcgattggtagattaacaggaaaaccgggcgtatgtcttgtaacttcagggccagggacatcaaatttagcgacaggtcttgttactgcgaatgcggagagtgatcccgttgttgctttagctggtgcagttccgcgtacagatcgattaaaacgtacgcaccaatctatggataatgctgcactattcgaaccaatcacaaaatatagcgtagaagtagagcatcctgataatgtgccagaagcattatcaaatgcattcagaagtgcaacttctacaaatccaggcgctactttagtaagtttgccgcaagacgttatgactgcggaaacaactgtagagtctatcggtgcactttctaagccacagcttggaatcgctcccacacatgatattacatacgtagtagaaaaaataaaagcagcgaaattaccagttattttactcggtatgagagcgagtacgaatgaagtgacgaaagctgttcgtgcattaattgcggatacagagcttcctgtcgttgaaacatatcaagcagctggtgcgatttcacgtgagttagaagatcatttcttcggccgcgttggattattccgtaaccaaccaggtgatattttactagaagaagcggaccttgttatttctatcggttatgacccaattgagtatgatccgaaattctggaataaacttggggacagaacgattattcatcttgatgaccatcaagcagatatcgatcatgattaccaaccagagcgtgaattaattggtgatattgccttaacggtaaatagcatcgcagaaagattaccgaaacttgtgttaagtacgaaatcagaagcagtgttagaacgattacgcgcgaaattatcagaacaagcagaagttccaaaccgtgattcagaaggtgttacgcatccacttcaagtgattcgtacacttcgttctttaattagtgacgatacaaccgttacatgtgacatcggttcccattctatttggatggcgagatgtttccgttcttatgaaccacgtagattattatttagtaacggtatgcaaacgttaggtgttgcacttccttgggcaatcgcagctactttagtagaaccaggtaaaaaagtagtttctgtatcaggtgacggtggtttcttattctcagcgatggagttagaaacggcggtacgtttaaattctccaatcgtccatctcgtttggagagacggcacatatgatatggttgcattccaacaaatgatgaaatacggcagaacatcagctacagagtttggtgatgttgatcttgtgaaatatgcggaaagtttcggtgcgacaggtcttcgcgttaacacgcctgatgaattagaaggtgtattaaaatccgcattagcagcagacggtcctgtcattattgatattccaattgactatcgtgacaatattaaattaagcgaaaaattattaccaaaccaattaaactaa

SEQ ID NO: 82237 - protein, 562 aa, Bacillus anthracis str. Ames
MSTGVKANDVKTKTKGADLVVDCLIKQGVTHVFGIPGAKIDSVFDVLQERGPELIVCRHEQNAAFMAAAIGRLTGKPGVCLVTSGPGTSNLATGLVTANAESDPVVALAGAVPRTDRLKRTHQSMDNAALFEPITKYSVEVEHPDNVPEALSNAFRSATSTNPGATLVSLPQDVMTAETTVESIGALSKPQLGIAPTHDITYVVEKIKAAKLPVILLGMRASTNEVTKAVRALIADTELPVVETYQAAGAISRELEDHFFGRVGLFRNQPGDILLEEADLVISIGYDPIEYDPKFWNKLGDRTIIHLDDHQADIDHDYQPERELIGDIALTVNSIAERLPKLVLSTKSEAVLERLRAKLSEQAEVPNRDSEGVTHPLQVIRTLRSLISDDTTVTCDIGSHSIWMARCFRSYEPRRLLFSNGMQTLGVALPWAIAATLVEPGKKVVSVSGDGGFLFSAMELETAVRLNSPIVHLVWRDGTYDMVAFQQMMKYGRTSATEFGDVDLVKYAESFGATGLRVNTPDELEGVLKSALAADGPVIIDIPIDYRDNIKLSEKLLPNQLN

SEQ ID NO: 82238 - DNA, 1713 bp, Bacillus anthracis str. Ames
  CDS (1)..(1713): transl_table=11
atgaagcaatatacaacctatgagaaattgcagtgtgaagaagtgacaggagctggacacgttattcaatgcttaaagaaattaggcgtaacgactgttttcggttatccgggcggagcaattttaccagtgtacgatgcgctatatgaaagtggattgaagcatatattaactcgtcatgaacaagctgctattcatgcggctgaaggttatgcaagagcttctggaaaggtcggggtagtatttgctacctctggcccaggggcgacgaatttagttacaggcttagcagatgcttatatggattcgattcctttagttgtcattacagggcaagttgcaacaccactcattggaaaagacgggtttcaagaagctgatgttgtcggaattacagtacctgttacgaagcataattaccaagttcgtgatgtgaatcagttatcacgtattgtacaagaagctttttacatcgccgaaagcgggcggccaggaccagtattaattgatattccaaaagatgttcaaattgaaaaggtaacaagtttttacaatgaagtaattgagattccaggatacaaactagagcctaggccagatagtatgaagcttagagaagtggctaaagccatttcagaagcaaaacgcccacttctttatatcggaggaggaatcattcatgcagatggatctgaagaacttattcagtttgcgaggaagaaggggattcctgtcgtttccactttaatgggacttggtgcatatccgccgggagatccattatttttaggaatgctcggtatgcatggaacgtacgcagcaaacatggcagtaacagaatgtgatttactgcttgcgttaggtgttcgttttgatgaccgtgtaacaggaaaactggaacttttttctccgcattcgaaaaaggtacatattgatatagatccttcagagtttcaaaaaaatgtagcggtagagtatccagttgttggtgatgtaaaaaaagcattacacatgctgttacatatgtctattcatacacaaacagacgaatggcttcagaaagtaaagacatggaaagaagaatatcaactttcttataagcaaaaagaatctgagttaaaaccacaacatgtcatcaacttagtaagcgaattaacgaatggtgaagcgattgtgacgacagaagtaggacagcatcaaatgtgggctgcgcatttttataaagcgaaaaacccgcggacttttctaacatctggtgggttaggaacgatgggattcggtttcccagcggcaataggtgctcagcttgctaaagaagaagaacttgtcatttgtatcgcgggcgatgcttcttttcaaatgaacattcaagaactgcaaacaattgctgaaaataacatccctgtaaaagtatttataataaacaacaaatttttagggatggtaaggcaatggcaagaaatgttttatgaaaaccgattgtcagagtcgaaaattggatcgccagattttgtgaaagtggcagaagcttatggggtgaaaggattaagagcgacaaatgcaaccgaggcgaaacaagtgatgttagaagcatttgctcataaaggccctgtcgtagttgatttttgtgtagaagaaggtgaaaacgtatttccgatggttccgccaaataaagggaataacgaaatgattatgaagaggtgggaagaatga

SEQ ID NO: 82239 - protein, 570 aa, Bacillus anthracis str. Ames
MKQYTTYEKLQCEEVTGAGHVIQCLKKLGVTTVFGYPGGAILPVYDALYESGLKHILTRHEQAAIHAAEGYARASGKVGVVFATSGPGATNLVTGLADAYMDSIPLVVITGQVATPLIGKDGFQEADVVGITVPVTKHNYQVRDVNQLSRIVQEAFYIAESGRPGPVLIDIPKDVQIEKVTSFYNEVIEIPGYKLEPRPDSMKLREVAKAISEAKRPLLYIGGGIIHADGSEELIQFARKKGIPVVSTLMGLGAYPPGDPLFLGMLGMHGTYAANMAVTECDLLLALGVRFDDRVTGKLELFSPHSKKVHIDIDPSEFQKNVAVEYPVVGDVKKALHMLLHMSIHTQTDEWLQKVKTWKEEYQLSYKQKESELKPQHVINLVSELTNGEAIVTTEVGQHQMWAAHFYKAKNPRTFLTSGGLGTMGFGFPAAIGAQLAKEEELVICIAGDASFQMNIQELQTIAENNIPVKVFIINNKFLGMVRQWQEMFYENRLSESKIGSPDFVKVAEAYGVKGLRATNATEAKQVMLEAFAHKGPVVVDFCVEEGENVFPMVPPNKGNNEMIMKRWEE

SEQ ID NO: 82240 - DNA, 1710 bp, Cyanidioschyzon merolae strain 10D
  CDS (1)..(1710): transl_table=11
atgatgactactggttcctacgcacttttagatacacttgtttcgcttggtgttcgccatgtttttggttatcctggtggtgctattttacctatttatgatgaactttatcattgggaaaagaaaggtttgattcaacattatttagtacgccatgaacaagcagccgcacatgccgcagatgcttatgctcgtacaactggtcaagtgggtgtttgttttgctacttctggaccaggagctaccaatttagttacgggcatcgccactgcttgcatggattctgtacctttacttgtaatcactggtcaagttagccgtgctttcattggtactgatgcttttcaagaaaccgatatcttcggaattactttgcctattgttaaacattcttatcttgtacgagatgctcgagatatctctcgtattattgttgaagcctttaccatcgctaaacatggtcgtcctggcccagtcttagtggatattcctaaagatgtgggattagaagaaatcgattacgaacgttgtgtcaaggtcaatattcctggttgccgccctattttaccaccaactactaaacaaattgagcaaatgctcatgatgttgcaaagcagtcgtcaacctttactttacgtgggtggaggtgcccaagctgcctctcaagaattgtatcaattagctactcaatttcaaattcctgtaaccactaccctaatgggaaaaggttgttttgatgaaacgcatcctctttatttgggtatgcttggcatgcatggtacggcttatgccaattttgctgtaagcgaatgtgatcttttaattgctctaggtgcacgctttgatgatcgcgtcaccggtaaacttgatgaatttgcctcttctgcacaagtaattcatatagatattgatgctgctgaaatcggaaaaaatcgaattcctcaattagccatctgttctgatgtcaaacttgttttacaacatttcttagctgccacctcaattgctcctaatcttgttgctaatgatgaaacctatgcttggagaaaacgtattgcacgttggaaacacgattatcccttactaattcctcgtccttcctcttatctatccgcacaagaaattttaaatgcacttgcccaattagctcctcatgctatctatagtactgacgtaggacaacatcaaatgtgggcagcacagttattacgtgttcaaccccgtcaatggctttccagctctggcttaggtactatgggctatggcttacctgcagctataggtgctgccatcgcacatcaaggcaatcgatccattatttgtatttctggtgatgcaagttttcaaatgaatttacaagaacttgccacaatttcacaatataagctcaaaatcaaaatctttcttcttaacaatggttggcaaggtatggtacgtcaatggcaacaagctttctatggcgaaagatattcacattcttctatgcaagaaggtcaacctgattggatgctgttagcacaagcttatggtatcaaaggcatctgtttagattctcgagaacatctcatcgaacaattagaatctatcttgcatctagacgaaagtgttttagtcaattgtttaattcaacctgatgaaaattgttatcctatggtggctcctggtaaaagtaattctcaaatgttaggtctgctgtcaagctcaacgtga

SEQ ID NO: 82241 - protein, 569 aa, Cyanidioschyzon merolae strain 10D
MMTTGSYALLDTLVSLGVRHVFGYPGGAILPIYDELYHWEKKGLIQHYLVRHEQAAAHAADAYARTTGQVGVCFATSGPGATNLVTGIATACMDSVPLLVITGQVSRAFIGTDAFQETDIFGITLPIVKHSYLVRDARDISRIIVEAFTIAKHGRPGPVLVDIPKDVGLEEIDYERCVKVNIPGCRPILPPTTKQIEQMLMMLQSSRQPLLYVGGGAQAASQELYQLATQFQIPVTTTLMGKGCFDETHPLYLGMLGMHGTAYANFAVSECDLLIALGARFDDRVTGKLDEFASSAQVIHIDIDAAEIGKNRIPQLAICSDVKLVLQHFLAATSIAPNLVANDETYAWRKRIARWKHDYPLLIPRPSSYLSAQEILNALAQLAPHAIYSTDVGQHQMWAAQLLRVQPRQWLSSSGLGTMGYGLPAAIGAAIAHQGNRSIICISGDASFQMNLQELATISQYKLKIKIFLLNNGWQGMVRQWQQAFYGERYSHSSMQEGQPDWMLLAQAYGIKGICLDSREHLIEQLESILHLDESVLVNCLIQPDENCYPMVAPGKSNSQMLGLLSSST

SEQ ID NO: 82242 - DNA, 1713 bp, Helicobacter hepaticus ATCC 51449
  CDS (1)..(1713): transl_table=11
atgaaggtaatgaaaggggctcaaatgcttattcaagctttacatcttgaaggtgtaaaggttgtttttggctatccgggcggtgcagtattacatatttatgatgagatttataaacaaaactatttttcacatattctcgcacgacacgaacaaggagcagtgtgtgcagccgatggttatgcgcgtagtagcggagaagttggtgtagcaatcatcacttcaggtccgggatttacaaatgcaattacaggcattgctacggcttatacagattctatacctcttgtggtcattagtgggcaagtgcccattacgcaaattggcactgacgcatttcaagaaattgatgcagtaggtatttctcgtccttgcacaaagcataattttttggtgcgtaatattagtgaattgcctagaatccttaaagaagctttttatattgcgcgtagtgggaggcaaggacccgtgcttgtagatattccaaaggatattacaggcactttgggtgaatttgcctacccagaatctatttcacttcaaagttataagcctacaataaaaggcaattcgcgtcaaattaaaaaactttgtgaagcaattatgagtgcgcaaaagcctttattttatattggcggtggagcgatactttcaaatgcgagtgagattattcgtgaaattgtgcattgcacagggattccgtgtgcagaaacactccttgcacgtggagtactaagatatgatgatgagaatctacttggaatgcttggaatgcacgggagctatgctgcaaatatggcagtaagtgaatgtgatttattagtatgtcttggtgcgcgctttgatgatagggtaacaggtaagttaagtgaatttgcaaaaaatgcaaaaattgcacatattgatattgatcctagctctattggtaaaattatagctgtagattaccctattgtcggtgatttaaagcatattgtatcagatatgatgattgagctaagtggatatgatacacaaaaaattatgagatggagagaacatttgcgttcttatgcactcacacatcctatgagttttgaagatagtgtagattctattaagcctcaatgggtgattcaaagacttggcgaacatttaggagataatgcaatcattactactgatgtaggacagcatcaaatgtgggctgcgcagttttatccttttagctttccgcgtcaatttttaagcagtggagggcttggcacaatgggttatggattgcctgcagcacttggggcgaaacttgcgtgtcctcataaaaccattattaatattacaggtgatggctcaattttaatgaatattcaagagttaatgacttgtgttgtgtatggtattccttttgttaatgttattttaaataataattatttaggaatggtgcggcaatggcaaagctttttttatgaacatcgtttctcgcatacagatttgagtttgcaacccgattttattaaacttatagaatcttttggcggtgtgggctttagagtagagaaaaaatgtgaatttgatgaggcgtttaaaaaggcattagatgctaaaaaagtggcatttattgaagtaatgatagatagatacgaagatgttttgccgatggtgccaagtggtggagcaatctatgagatgattctctcaagtggagaaaaagccttaagagaggggaagtga

SEQ ID NO: 82243 - protein, 570 aa, Helicobacter hepaticus ATCC 51449
MKVMKGAQMLIQALHLEGVKVVFGYPGGAVLHIYDEIYKQNYFSHILARHEQGAVCAADGYARSSGEVGVAIITSGPGFTNAITGIATAYTDSIPLVVISGQVPITQIGTDAFQEIDAVGISRPCTKHNFLVRNISELPRILKEAFYIARSGRQGPVLVDIPKDITGTLGEFAYPESISLQSYKPTIKGNSRQIKKLCEAIMSAQKPLFYIGGGAILSNASEIIREIVHCTGIPCAETLLARGVLRYDDENLLGMLGMHGSYAANMAVSECDLLVCLGARFDDRVTGKLSEFAKNAKIAHIDIDPSSIGKIIAVDYPIVGDLKHIVSDMMIELSGYDTQKIMRWREHLRSYALTHPMSFEDSVDSIKPQWVIQRLGEHLGDNAIITTDVGQHQMWAAQFYPFSFPRQFLSSGGLGTMGYGLPAALGAKLACPHKTIINITGDGSILMNIQELMTCVVYGIPFVNVILNNNYLGMVRQWQSFFYEHRFSHTDLSLQPDFIKLIESFGGVGFRVEKKCEFDEAFKKALDAKKVAFIEVMIDRYEDVLPMVPSGGAIYEMILSSGEKALREGK

SEQ ID NO: 82244 - DNA, 1860 bp, Rhodopirellula baltica SH 1
  CDS (1)..(1860): transl_table=11
atgatcggagcaaggtccatttcgactcttttcgaatcccactctgtccccagtagaccaccaccgatgagtaccgcttcgagctcttccagcgccaacgccgcgaaaggcgatcagcaaccgatgaatggagccgatgttctcgtcaaatcgttggtcgatcacggcgtcgaagtcttgttcgcctaccccggcggatgcagcatgcccatgcaccaggctctgacccggtacggggactcgatccgcacgattctgccacggcacgagcaaggcggtgccttcgccgcacaaggctactcgcgcagcaccggcaaaattggcgtggtgatggcgaccagcggccccggtgccaccaacttggtcaccgccatcgcggacgcgaaactggacagcatcccgatgctgtgcatcaccggccaagttcccaccggagcgatcggaaccgacgcgttccaagaaactccgatggtcgaaatctgccgcggaatcaccaaacaccactacctcgtgacggatttggctgacttgccccgcgtcatgaaggaagccttccacatcgccaccagcggtcgccccggccccgttttggtcgatatgcccaaagacgtgcagctgggcaatttcccaatcgacatggatccagagatggatctgccgggatacagccccgaggctcctaaagtcgctggcgaaacgatcaagcagatggcagcggccatcaaactggcccgtcgacctgtcatctacgccggtggcgggatcatttctggtgaagccagcgaagaacttcgcgagctgatcaagaaaacgggtatcccaacggtcacgaccatcatgggactgggcgcggtttcgcccgatgaccctcgttcgctcgattggctgggcatgcacggagccgcctacgccaactacgccgttcgcgattgcgatttattgattgcactgggcgtgcgttttgacgaccgagtgaccggcaaagtggaagcgttcgcgaaagatgcgaaaatcatccacgtcgacatcgattcgtcagaactgaacaagaacaaacaagcccacatcccagttcgcggcgacgtgaaggatgtgctcgtccagctgaacaaaatcgttcagcctcccgaaatcgaagcttggcagaaaacctgcaccgacctgaaagccaaatacccgctgaagtacgacaactcgttcgacggcattttgcaacagcacgcgatcgcgacgctcagcaaaatcaccgccgatcgtgagacctacgtcagcgtcggtgtgggccaacaccaaatgtgggccgcacagttcttcaagttccgcaaccctcggacttggatgagcagctccggactgggcacgatgggattcggattgccagccgccatgggcgtgcaagcagctcacccggatgctctggtcatcgacatcgatggcgacggcagcttccaaatgaacatccaagaactcgcaacgtgcttctgcgaaaagctccccgtgaaagtcttgttgctgaacaatcaacacctgggaatggtggttcagtgggaagaccgattcatggatcgcaaccgcgctcacacttacctcggccccatcgatcacgatgaagccaagggcaagagcaccgcggatcgcttcgaatacgccagcgaccgttacccgaactttgtgcaaatcgccaagggctacggatgcggtgccgccacggtcaaaaagaaagcggacctcgaaggtgccttgcaagaaatgatcgatcacaaaggccccttcttgctggacgtcgaagtgccctaccaagaacacgtgctgccaatgatccccggtggaatgaccgtggacgacatgctcttggactga

SEQ ID NO: 82245 - protein, 619 aa, Rhodopirellula baltica SH 1
MIGARSISTLFESHSVPSRPPPMSTASSSSSANAAKGDQQPMNGADVLVKSLVDHGVEVLFAYPGGCSMPMHQALTRYGDSIRTILPRHEQGGAFAAQGYSRSTGKIGVVMATSGPGATNLVTAIADAKLDSIPMLCITGQVPTGAIGTDAFQETPMVEICRGITKHHYLVTDLADLPRVMKEAFHIATSGRPGPVLVDMPKDVQLGNFPIDMDPEMDLPGYSPEAPKVAGETIKQMAAAIKLARRPVIYAGGGIISGEASEELRELIKKTGIPTVTTIMGLGAVSPDDPRSLDWLGMHGAAYANYAVRDCDLLIALGVRFDDRVTGKVEAFAKDAKIIHVDIDSSELNKNKQAHIPVRGDVKDVLVQLNKIVQPPEIEAWQKTCTDLKAKYPLKYDNSFDGILQQHAIATLSKITADRETYVSVGVGQHQMWAAQFFKFRNPRTWMSSSGLGTMGFGLPAAMGVQAAHPDALVIDIDGDGSFQMNIQELATCFCEKLPVKVLLLNNQHLGMVVQWEDRFMDRNRAHTYLGPIDHDEAKGKSTADRFEYASDRYPNFVQIAKGYGCGAATVKKKADLEGALQEMIDHKGPFLLDVEVPYQEHVLPMIPGGMTVDDMLLD

SEQ ID NO: 82246 - DNA, 1755 bp, Prochlorococcus marinus subsp. marinus str. CCMP1375
  CDS (1)..(1755): transl_table=11
gtgactctgtcgtcttcaccttttggtataggtgattcaacaaaaaaggagcaaaatcagattctaggggcagatgcccttatggaatctcttaaaaatcacggtgtcgatactatttttgggtaccctggaggagctatccttcctatctatgatgcggtttataaagcagaaaaagcaggttgggtaaaacatattttagttagacatgagcaaggtggtgctcatgcagctgatggatatgcaaggtccacaggaaaagttggtgtatgttttggcacctcaggaccaggagcaacaaatttggttacaggaattgccacagctcaaatggactctgttccattggttgttattactggacaagtcccaagaccagctattggaactgacgcctttcaagaaacagatatttttggtattactctcccaattgttaagcattcttgggttgtaagagatccttctgaaatagcatctgttattgcccaagctttttttattgcttcttctgggcgcccaggaccagtcctagttgacattccaaaagatgttggccaagaactttttgattatcaacctgttcagccaggttctttaatccctgcaggctttactcctcctcaaaagccagacccagtggctatatctaaagcgctggatttaattgaaagagctaaaaagccacttttatatgtaggaggaggagttatttctgcaagtgctcatgacactttatttgctattgccaagcgatatcacttgcctgttacgacaacattgatgggtaaaggtgcatttgatgaacgtgaatctctttctgtggggatgttagggatgcatggcactgcatatgccaatttcgcagtaactgaatgcgatttattagtagctataggagcacgttttgacgaccgagtgactggaagacttgattcatttgcagcaaatgcaaaagttgttcattttgaagtagaccctgcagaaattaacaaaaacagagttgcagatgttgcggttttaggagatttagcaattagtctttctgatttacatgaacttagcaaaagaagaactgttaaaccaaatactcaagaatggttggctcaaatagaagagtggaagattaaatatccacttttaataccttcaaaagaaggggaaatatatccacaagaagtattgattgaaattagagatttagcaccagatgcttatataacaactgatgtgggccaacatcaaatgtgggcagctcaatatttaagaaatagtccacgtcattggattagcagtgcaggattgggaacaatgggtttcggagtacctgctgccttaggagtgcaagttgctttgccaaaacaacaagtgatttgcattgcaggtgatgcaagcattttgatgaatattcaagaattagggactatctcgcaatatcaattaaatacaaaaataattatcattaataatcattggcaaggtatggtgcgacaatggcagcaaagtttttatgatgaaaggtattcagcaactaatatgttaaacggggagccgaattttgttgctttagctaatgcttttggagttggaggcgtgattattaaagagcgtaattcattgaaagaaaagttaaaagaagctcttaattccgaaggaccaatgctcattgatgttcatgtccgtagagatgagaattgttatccaatggttccaccaggtaaaagcaatgctgaaatggttggtttgcctgattag

SEQ ID NO: 82247 - protein, 584 aa, Prochlorococcus marinus subsp. marinus str. CCMP1375
MTLSSSPFGIGDSTKKEQNQILGADALMESLKNHGVDTIFGYPGGAILPIYDAVYKAEKAGWVKHILVRHEQGGAHAADGYARSTGKVGVCFGTSGPGATNLVTGIATAQMDSVPLVVITGQVPRPAIGTDAFQETDIFGITLPIVKHSWVVRDPSEIASVIAQAFFIASSGRPGPVLVDIPKDVGQELFDYQPVQPGSLIPAGFTPPQKPDPVAISKALDLIERAKKPLLYVGGGVISASAHDTLFAIAKRYHLPVTTTLMGKGAFDERESLSVGMLGMHGTAYANFAVTECDLLVAIGARFDDRVTGRLDSFAANAKVVHFEVDPAEINKNRVADVAVLGDLAISLSDLHELSKRRTVKPNTQEWLAQIEEWKIKYPLLIPSKEGEIYPQEVLIEIRDLAPDAYITTDVGQHQMWAAQYLRNSPRHWISSAGLGTMGFGVPAALGVQVALPKQQVICIAGDASILMNIQELGTISQYQLNTKIIIINNHWQGMVRQWQQSFYDERYSATNMLNGEPNFVALANAFGVGGVIIKERNSLKEKLKEALNSEGPMLIDVHVRRDENCYPMVPPGKSNAEMVGLPD

SEQ ID NO: 82248 - DNA, 1665 bp, Candidatus Blochmannia floridanus
  CDS (1)..(1665): transl_table=11
atgaatggagctcatgaagtaattaaggcgctggtaaaacaaaaagtggatattatttttggatatccagggggagcgattatgcctatatatgatgctttgtttgattctgaagttaaacacttattatgcagacatgagcaaggagcgataattgctgctattggatatgctagagctacaggtaaagtaggggtatgttttgcaacgtctggacctggagcaacgaatttagttactgggttagctgatgcattactggattctattccgatagttgctattactgggcaggttggattagagtttataggcactgattcttttcaagaagttgatgttttgggattatctttagcatgtactaaacatagttttttagtgcgatctgtagatatgttgtctgatgttattgaagaagctttttttattgcattatctggaaggccaggtccagttttagtagatatacctaaagatattcagttgtctgacaatttgggttctttttctaaaaatatagaaaaacaaagagaatatcatattcttaataataattgtaatcaaaatgatgttaatcaagctcgtattttgatggttaactcttctcgtcctgtagcatatgtaggaggaggagtaggaatggctcgagccgtattgtcgttacgaaggtttattgctgaaaccgggggtatgccgactgtggtaactttaaaaggtttaggagctccagattgttcggaattgtgttatttaggtatgttaggtatgcatggtaatcaggcggctaatttggcggtgcaacaatgtgatttattagttgcaataggagcgagatttgatgatcgagttactgggcagttgtcttcttttgctccacaagccaaagtaattcatttggatattgattcatcagagtgtaataaattacgtttagtacaggtttttttattgggaaatttaaatagtttattattagaattaatacaatctttatctattaataaatggagagatcaagttcaatctttaaaattacaatatggttggtcttattcacgatctactaatgaaaaaatttccgttccagttttattaaaaacaattagtgataatgtacctattaatactattattactactgatgttggtcaacatcaaatgtgggttgcgcaacatatgcaatttagtaaacctgagaattttattacttctggaggactgggaactatgggttttggaattccagcggcgattggagcgcaattaggttgtcctaataatatggtgatatgtatttctggtgatggttcatttttgatgaatgtacaagaattagctactattaagcgtagaaagttgcctgtaaaaattgtgttattggataataaacgtttagggatggttcgtcagtggcaagagttattttttaataagcgttatagcgaaactattttaaatgataatcctgattttttaattttagctaaagcttttgatatagatggaatgtatatttctcatacatcgcaaatgttggatgcaatttatacattacttaattatcaaggtccttttttattacatgttttgattgatgtggatgcaaatgtttggccattagttcctcctggttcttcgaatgaagtgatgttaacacaataa

SEQ ID NO: 82249 - protein, 554 aa, Candidatus Blochmannia floridanus
MNGAHEVIKALVKQKVDIIFGYPGGAIMPIYDALFDSEVKHLLCRHEQGAIIAAIGYARATGKVGVCFATSGPGATNLVTGLADALLDSIPIVAITGQVGLEFIGTDSFQEVDVLGLSLACTKHSFLVRSVDMLSDVIEEAFFIALSGRPGPVLVDIPKDIQLSDNLGSFSKNIEKQREYHILNNNCNQNDVNQARILMVNSSRPVAYVGGGVGMARAVLSLRRFIAETGGMPTVVTLKGLGAPDCSELCYLGMLGMHGNQAANLAVQQCDLLVAIGARFDDRVTGQLSSFAPQAKVIHLDIDSSECNKLRLVQVFLLGNLNSLLLELIQSLSINKWRDQVQSLKLQYGWSYSRSTNEKISVPVLLKTISDNVPINTIITTDVGQHQMWVAQHMQFSKPENFITSGGLGTMGFGIPAAIGAQLGCPNNMVICISGDGSFLMNVQELATIKRRKLPVKIVLLDNKRLGMVRQWQELFFNKRYSETILNDNPDFLILAKAFDIDGMYISHTSQMLDAIYTLLNYQGPFLLHVLIDVDANVWPLVPPGSSNEVMLTQ

SEQ ID NO: 82250 - DNA, 1695 bp, Bordetella pertussis Tohama I
  CDS (1)..(1695): transl_table=11
atgactactgctaatcactccacccccgcatcccgcctcggcggccatatcctggtcgaccagctggccgcccatggcgtcaagcatgtgttctgcgtgccgggcgaaagctacttggccgtgctcgacggcctgcacgacgccagcatcgacgtcaccgtgtgccgccaggaaggcggcgcggccatgatggccgacgcccacggcaagctgaccggcgagccgggcatctgtatggtcacgcgcggccccggcgcctccaacgcgctggccggcgtgcacatcgccaagcaggactccacgcccatgatcctgttcgtgggccagatcgagcgcggcatgcgcgagcgcgaagccttccaggaaatggactatcgcgccgtgttcggcacccaggccaagtgggtgaccgaaatcgaccaggtcgagcgcattcccgaactgatttcgcgcgccttccacgtggcgacctccggacgtccggggccggtggtcatcgcgctgcccgaggacgtcctggtcgaaaccgccagcgtgcccgatgcgccgcgctatgaggtgatcgacgccgcgccggccgccggccagatggaccagctggcgcaaatgctggcgcaggccaaggcgccggtggcgatcctgggcggctcgcgctggaatgcccaggcggtgcagcagttcgccgatttcgcgcagcgccacgccttgccgaccgcggtgtcgttccgccgccagatgctgttcccggccgaccacccctgcttcatcggcgacgtcgggctgggcatcaatccggcgctgctcaagcgcatcgaacaggccgacctggtgctgatggtgggcggccgcatgtcggaaaaccccagccaggcctacaccctgctggatatcccggtgccgcgccagaagctggtgcacgtgcatccggacagcgccgagctgggccgcgtctaccgcgccaacctggcgatcaacacctcgccggcggcgttctgcgccgcgctggcgcaagcgaacggaccgtcccagccggcctgggccgacgatacgcaggccatgcgcgcgagctatctgcaatggagcgaccccgccgccatccgcacgcccggcgcgctgcaactgggcgaagtgatggcgttcctggaaaagaccttgccggccgacgccatcatggccaacggcgcgggcaactacgccacctggctgcaccgtttccaccgttacacgcgctacggcacgcaactggccccgacctccggctcgatgggctatggcctgcccgccgcggtgggcgccaagcgcatctggccgcagaagaccgtggtctgcttcgccggcgacggctgcttcctgatgcatggccaggaattcgccacggcggtgcagtacgacctgcccatcgtggtcgtgctgatcgacaacggtatgtacggcacgatccgcatgcaccaggagaagcactaccccggccgcatttcggccacgagcctgaagaaccccgacttcgccgagtacgcgcgcgccttcggcggccacggcgaacgcgtcgagaccaccgaacagttcgcgccggccttcgagcgtgcgctggccagcggcaagcccgccatcctgcactgcctgatcgacccggaaaccatcacgccgtcgaccacgctggagaaaatccgcgccgcggccctcaaggcacagtaa

SEQ ID NO: 82251 - protein, 564 aa, Bordetella pertussis Tohama I
MTTANHSTPASRLGGHILVDQLAAHGVKHVFCVPGESYLAVLDGLHDASIDVTVCRQEGGAAMMADAHGKLTGEPGICMVTRGPGASNALAGVHIAKQDSTPMILFVGQIERGMREREAFQEMDYRAVFGTQAKWVTEIDQVERIPELISRAFHVATSGRPGPVVIALPEDVLVETASVPDAPRYEVIDAAPAAGQMDQLAQMLAQAKAPVAILGGSRWNAQAVQQFADFAQRHALPTAVSFRRQMLFPADHPCFIGDVGLGINPALLKRIEQADLVLMVGGRMSENPSQAYTLLDIPVPRQKLVHVHPDSAELGRVYRANLAINTSPAAFCAALAQANGPSQPAWADDTQAMRASYLQWSDPAAIRTPGALQLGEVMAFLEKTLPADAIMANGAGNYATWLHRFHRYTRYGTQLAPTSGSMGYGLPAAVGAKRIWPQKTVVCFAGDGCFLMHGQEFATAVQYDLPIVVVLIDNGMYGTIRMHQEKHYPGRISATSLKNPDFAEYARAFGGHGERVETTEQFAPAFERALASGKPAILHCLIDPETITPSTTLEKIRAAALKAQ

SEQ ID NO: 82252 - DNA, 1698 bp, Bordetella parapertussis 12822
  CDS (1)..(1698)
atgccgattatcgcaagactgcccatccagaaaatcatgaatccgactcttgccgcccgtaccggcggccgtatcctggtcgatgcgttgaaggtccacggcgtgggccaggccttctgcgtgcccggcgaaagctatctgcccgtgctggacgccctgcgcgacgatgcgcaggccatccggctgactgtctgccgccaggagggcggcgcggccttcatggccgaagcctatggcaagctgaccggcaagcccggcatctgcttcgtgacgcgcgggccgggcgccaccaacgccagcataggcgtgcataccgccttccaggactcgacaccgatgattctgttcgtcggccaggtgggcgccgacgtggccgaacgggaggccttccaggagatcgactaccgcaggatgtacggccagatggccaagtgggtggccagcatcgacgacgcgcagcgcatcccggaattcgtccatcgggcgcaccaggtcgcgctgtcgggccggccggggcccgtggtgctggccctgcccgaggacgtcctgcgggcgacggcgcacgccgccgaccgcgttccccaccgcatcgcccgcgcctgcgcaaccagcgccgacatgaagcggctgcacgaactgctggcggcggcccggcggccgctgctgatcgtcggcggcggcggctggaacgaggcggccagcgccgccatcacccgctatgccgagcgcgccggcctgcccgtggccacggcgttccggcgccaggatcgcttcgacaaccgccacccctgctatgccggccacatcgggctgggcatcgcgcccagcctggcgcgccatgtgcggcaggccgacctgctgctggtcgtcggcgcgcgcctggccgacgccaccacggacagctacgcgctcatcacgccggagcatcccggccagaccttgatccacgtccatcacgatccgcaggaactgggccgcgtctatccggccgacctgcccatcgcgaccgacgtgcaggccttcgcggcgcaactggatgcctgcgacaacccgcccgcccgctgcgacgcctggctgcgcgagctggcggacgactaccggaccgacctggctgtcgccccgtcccgccgcgacaccgacctggcgcaggtcatgcattggctcaaccagcacttgccgcagaacgccatcgtgaccaacggcgccggcaactacgccggctgggtgcaccgctacttccagtattcgccgcagcgccggcaactcgcgcccaccaacggcgccatgggctacggcgtgccggccgccatcgccgccaagctggcggcgccggcccgcaccgtggtctgcttcgccggcgacggctgcttcatgatgaacggccaggaactggccaccgccatccagcacgacgccgccgtggtcttcatcgtcgtcaacaacggcatgttcggcaccatccgcatgcaccaggaaatgcattaccccgggcgcgtgtcgggcacctcgctgcgcaaccccgacttcgtcgcgctcgccagcgcctacggcgcccatgccgagcgcgtggcgcaccacgacgacttccccgcggcgttcgaacgggcctgcgccagcggccgggccgcgctcatcgagatacgcaccgaccccgccgcgatctcggcgcgccgcgacctgccgacccttgccgcatga

SEQ ID NO: 82253 - protein, 565 aa, Bordetella parapertussis 12822
MPIIARLPIQKIMNPTLAARTGGRILVDALKVHGVGQAFCVPGESYLPVLDALRDDAQAIRLTVCRQEGGAAFMAEAYGKLTGKPGICFVTRGPGATNASIGVHTAFQDSTPMILFVGQVGADVAEREAFQEIDYRRMYGQMAKWVASIDDAQRIPEFVHRAHQVALSGRPGPVVLALPEDVLRATAHAADRVPHRIARACATSADMKRLHELLAAARRPLLIVGGGGWNEAASAAITRYAERAGLPVATAFRRQDRFDNRHPCYAGHIGLGIAPSLARHVRQADLLLVVGARLADATTDSYALITPEHPGQTLIHVHHDPQELGRVYPADLPIATDVQAFAAQLDACDNPPARCDAWLRELADDYRTDLAVAPSRRDTDLAQVMHWLNQHLPQNAIVTNGAGNYAGWVHRYFQYSPQRRQLAPTNGAMGYGVPAAIAAKLAAPARTVVCFAGDGCFMMNGQELATAIQHDAAVVFIVVNNGMFGTIRMHQEMHYPGRVSGTSLRNPDFVALASAYGAHAERVAHHDDFPAAFERACASGRAALIEIRTDPAAISARRDLPTLAA

SEQ ID NO: 82254 - DNA, 1851 bp, Bordetella bronchiseptica RB50
  CDS (1)..(1851)
atggtcagcatgaacgaccgtctgcatacctccacgctttccgcccttcagcaagccgaacacgcggccgccgtcaatggcgcgaagattctcctgcacaccctgatcgagcgtggcgtcgacacggtgttcggctatccgggcggcgccgtgttgccgctatacgacgctttgtacgccgagccgcgcttgcggcatgtgctggtgcgccatgaacaggccgcggtgcacgcggcggaaggctacgcgcgcaccaccggcaggccgggcgtggtgttcgtcacctcggggccgggcatggccaacaccacttcgggtttgctggacgccatgtgcgattcggtgccggtgctgtgcatcagcggccaggtctcgaccgcggcgatcggcaccgacgcgttccaggaatgcgacgccatcggcatttcgcggtcggtcaccaagtggaatacgcagattcgcgcggtccaggacgtggccgaggtggtgggccgcgccttcgacctgacgcgccagggacgtcccggtccggtgctggtggattttccgaaagacatccagctggccagcccggcggacgcgccgcagggcgaggccgatccggcgcgcaggcagttggcggcgctgcgcgcacggcgccagggcggcaaggccgccacacgggtgccgcagggtgcggtacggcgcgccgcggcgctgctggcgcaggcgcgccggccggttttctacggcggcggcggtctggtcaattcggggccacaggcttgcgccgcgttcaccgagctggtgcgccagagcggcgcgccctgcacgctgaccctgatgggactgggcgcgtttcccgcctcggatccgcagttcgtgggcatgctgggcatgcacggcactctggaggccaacctggccatgcacaacgccgatctggtcgtgtgcatcggcgcgcgcttcgacgatcgcattaccggcaagctgtccgagttctgtccgcatgcgcgcaagatccacatcgacatcgatccggcgtcgatcaacaaggtcgtgcgcgtggacgtcgccctggtgggcgactgcctgccgctggtgcaggcgctgcgcgacgaactggcggcaagcccgctgccggcgcagcggctggggccctggtggcagcgtatcgacacctggcgcgcccgggactgcctggcgtacacgccggcggccgacgagatcctgccgcagcatctcatgcaccgcctgggcgcggcgctggacggacgcgacgccatcgtgtcgaccgatgtgggccagcaccagatgtgggccgcgcagtacctgcgcttcgaccgtcccaaccgctggctgacctcgggcggcgcgggcaccatgggctacggcgtgccggcggcgatcggcgcgcagatcgcgcatcccggcaagaccgtggtgtgcgtcagcggcgacgcgtcggtgctgatgaacatccaggagttgtccaccgccatgcagcatgacgtgccggtcaagatcgtgctgtgcaacaacggctacatgggcatggtgcgccagtggcaggagttgatccatggcgggcgctacagccacagctacaacgcgtcgctaccggatttcgtggcgctggcgcgcgccttcggctggggcgcggcgcgcgtggagcggccgcaggacctggacgccgcgctggcggcctgcctcgaacaccctggtccctacttcctcgacgtggcggtggccgagcaggagaactgctttcccatgatgccggccggccatggccaccatcgcatgatgctggccgaaggccagtggtacgaggagccgcccttgccggagtctccgggcccgcaggcatga

SEQ ID NO: 82255 - protein, 616 aa, Bordetella bronchiseptica RB50
MVSMNDRLHTSTLSALQQAEHAAAVNGAKILLHTLIERGVDTVFGYPGGAVLPLYDALYAEPRLRHVLVRHEQAAVHAAEGYARTTGRPGVVFVTSGPGMANTTSGLLDAMCDSVPVLCISGQVSTAAIGTDAFQECDAIGISRSVTKWNTQIRAVQDVAEVVGRAFDLTRQGRPGPVLVDFPKDIQLASPADAPQGEADPARRQLAALRARRQGGKAATRVPQGAVRRAAALLAQARRPVFYGGGGLVNSGPQACAAFTELVRQSGAPCTLTLMGLGAFPASDPQFVGMLGMHGTLEANLAMHNADLVVCIGARFDDRITGKLSEFCPHARKIHIDIDPASINKVVRVDVALVGDCLPLVQALRDELAASPLPAQRLGPWWQRIDTWRARDCLAYTPAADEILPQHLMHRLGAALDGRDAIVSTDVGQHQMWAAQYLRFDRPNRWLTSGGAGTMGYGVPAAIGAQIAHPGKTVVCVSGDASVLMNIQELSTAMQHDVPVKIVLCNNGYMGMVRQWQELIHGGRYSHSYNASLPDFVALARAFGWGAARVERPQDLDAALAACLEHPGPYFLDVAVAEQENCFPMMPAGHGHHRMMLAEGQWYEEPPLPESPGPQA

SEQ ID NO: 82256 - DNA, 1764 bp, Prochlorococcus marinus subsp. pastoris str. CCMP1986
  CDS (1)..(1764): transl_table=11
gtgacgcttacttcgacatctttatcaaaagatgattcagaaaaaaattaccccatatggattacaggtgctgaagcactaatggattcactaaaagttcatgatgtaaaagtgatatttggatatccaggcggcgccatacttcctatttatgatgcagtacataaagcagaaaatgatggatggttaaaacattacatggtaagacatgagcagggaggatcccatgctgcagatggatatgccaggtcaacaggtgaggtaggggtttgttttggtacttcgggtccaggggctacgaatttagtaactggtattgctacagctcaaatggattcagttccattggtagtagttactggccaagttccaagacctgctataggaacagatgcttttcaagagactgatatatttggaattacactccctattgttaaacattcatgggttgtaagagatccgtctgatatagcaaaagtagtttcagaggcgttttttattgcttcttctggaagacctggcccagttttaattgatataccaaaagatgtgggtcaagaattctttaattatgaaagaattttacctggtaagattattcctaagggctttaaaaggaatggagaaattaacgacgctgatatcaaccaggctattgaattgattcaagaatcttcaagacctctgttatacgtaggaggtggagcaatatcttcaggtgctcatgaggaagtggaaaccttagctaataattatcaaattccagtgactactacgttaatgggaaaaggggtctttgacgaaagggatgacttatcagtcggaatgttgggaatgcatggaaccgcatatgcaaactttgcagtcacggaatgcgatcttttgattgctgtaggtgcgagatttgatgatagggttacggggaaattagatacattcgccccatctgcaaaggttattcatattgatatcgatcctgcagaagttaataaaaatagacgtgttgatgttgctattgtttcggatgtagctaaagctctttccaaaattaatgaaaaatattttaataataaaacctcctgcaatacaaaaaattggctagaaaaaattaatttttggaaaaataagcatcctttatttgttcctccagaagaaggtgaaatttatcctcaagaagttcttttgaaagtaagggattttgctcctgaagccttcatcacaactgatgtaggtcaacatcaaatgtgggctgctcagtatctaagaaatgctccgagaagatggataagtagtgctggtttaggaacgatgggctttggattgcctgcagcaatgggagtaaaggctgctctgcctaacgaagaggttatctgcatagctggagatgcaagtgttttgatgaatatacaagaattgggtactttatctcaatatggtttaaatattaaattagtgatcataaataatcgctggcaggggatggtaagacagtggcaagaaagcttttatgaagaaaggtactcctcctctgatatgagttgtggagaacctgatttcgttaaactcgcggaatcgtttggagtaaaaggtttcttaatttcagagaggaaacaattattaaatgagtttaaatctgctttagattttgatgggccagccttaataaatgtacgagtgaggagaggtgaaaattgctatccaatggttcctccaggtaaaagtaatgctcaaatggtgggttacgtgaacagtgaaagctga

SEQ ID NO: 82257 - protein, 587 aa, Prochlorococcus marinus subsp. pastoris str. CCMP1986
MTLTSTSLSKDDSEKNYPIWITGAEALMDSLKVHDVKVIFGYPGGAILPIYDAVHKAENDGWLKHYMVRHEQGGSHAADGYARSTGEVGVCFGTSGPGATNLVTGIATAQMDSVPLVVVTGQVPRPAIGTDAFQETDIFGITLPIVKHSWVVRDPSDIAKVVSEAFFIASSGRPGPVLIDIPKDVGQEFFNYERILPGKIIPKGFKRNGEINDADINQAIELIQESSRPLLYVGGGAISSGAHEEVETLANNYQIPVTTTLMGKGVFDERDDLSVGMLGMHGTAYANFAVTECDLLIAVGARFDDRVTGKLDTFAPSAKVIHIDIDPAEVNKNRRVDVAIVSDVAKALSKINEKYFNNKTSCNTKNWLEKINFWKNKHPLFVPPEEGEIYPQEVLLKVRDFAPEAFITTDVGQHQMWAAQYLRNAPRRWISSAGLGTMGFGLPAAMGVKAALPNEEVICIAGDASVLMNIQELGTLSQYGLNIKLVIINNRWQGMVRQWQESFYEERYSSSDMSCGEPDFVKLAESFGVKGFLISERKQLLNEFKSALDFDGPALINVRVRRGENCYPMVPPGKSNAQMVGYVNSES

SEQ ID NO: 82258 - DNA, 1722 bp, Prochlorococcus marinus str. MIT 9313
  CDS (1)..(1722): transl_table=11
atgacgggcgccgatgccctgatggatgctcttcgccgcaacggtgtggagatcatctttggttatccaggtggtgcaatccttccgatttacgacgccgtttataaggctgagcagcagggatggttgaagcacatccttgttcgccatgagcaggggggcgcccatgcggctgatggctatgcaagggctacaggtcgtgttggagtttgctttggaacctctgggccaggcgcaaccaatctcgttactggtatcgccacggctcagatggattctgttccaatggtggtgattacaggacaggtccctcgaccatgcattggtacagatgcttttcaggaaactgatattttcgggatcacgctgcctatcgtgaaacactcctgggttgttcgcgatccgggtgatttggcttcggttgttgctcaagcattttttattgcagcttctgggagacctggtccggtgttgattgatatccctaaggatgtgggccaggaggaattcgactatcagccagttgaacctggatcggtcgtgcctgcaggatttcaccgattcccggctccagaactttcctcaattgaggcggctctcgatttaattgatgatgctcagaggcctctcctttacgttggcggaggagttatttctgccggggctcacgagagtcttaagggttttgcagaacgtcaccagatacctgtcaccaccacattgatgggtaagggggcgtttgatgagcgacatcctttggctttggggatgttgggaatgcatggcactgcctatgccaactttgcagttactgaatgtgatttgttgatcgctgttggtgcacgtttcgatgaccgtgttacaggcaagcttgatacttttgcgccccgtgcaagagtgattcattttgaaattgatccagcagaagtagctaagaaccgacgtcctgatgttgcggtattgggtgatgttggtgtcagcttggtgaagttattcgacttgagtaagcaaaagtctgttgagttgaggacttcagcgtggctaactcgtattgagagttggaagaacctttaccccttgatgactccgcctgaggaggggccaatttatcctcaggaggtgctcttggcgataagggacttggctcctgaggcctacataacaactgatgtgggccagcatcagatgtgggcggctcaatatttacggaatgggcctcgtcagtggatcagtagcgcgggattgggaacgatgggtttcgggatgccagctgctattggtgttcaagttgctttgccagatgaacaggttgtttgtatcgctggtgattccagcatcctgatgaatattcaggagttgggaacactgattgagtacaacatcccagccaagattgtgattgtgaacaaccactggcaagggatggttcgtcagtggcagcaaagcttctacgaagatcgttattcagccactgacatgcttccgggcatgcctgatttcgtggcattggcgaaggcctttagggttggcggggtgttgatcactgagcgaaaggatctcaggtcaagtttgaagcaggcccttgcgactccaggtccgatgctcatcgacgtgcatgtgcgacgtgatgaaaattgctatccgatggttcctcctggcaagagcaacgctcaaatggtgggtttatctaaccaccctgaactttctggggtttctttgtga

SEQ ID NO: 82259 - protein, 573 aa, Prochlorococcus marinus str. MIT 9313
MTGADALMDALRRNGVEIIFGYPGGAILPIYDAVYKAEQQGWLKHILVRHEQGGAHAADGYARATGRVGVCFGTSGPGATNLVTGIATAQMDSVPMVVITGQVPRPCIGTDAFQETDIFGITLPIVKHSWVVRDPGDLASVVAQAFFIAASGRPGPVLIDIPKDVGQEEFDYQPVEPGSVVPAGFHRFPAPELSSIEAALDLIDDAQRPLLYVGGGVISAGAHESLKGFAERHQIPVTTTLMGKGAFDERHPLALGMLGMHGTAYANFAVTECDLLIAVGARFDDRVTGKLDTFAPRARVIHFEIDPAEVAKNRRPDVAVLGDVGVSLVKLFDLSKQKSVELRTSAWLTRIESWKNLYPLMTPPEEGPIYPQEVLLAIRDLAPEAYITTDVGQHQMWAAQYLRNGPRQWISSAGLGTMGFGMPAAIGVQVALPDEQVVCIAGDSSILMNIQELGTLIEYNIPAKIVIVNNHWQGMVRQWQQSFYEDRYSATDMLPGMPDFVALAKAFRVGGVLITERKDLRSSLKQALATPGPMLIDVHVRRDENCYPMVPPGKSNAQMVGLSNHPELSGVSL

SEQ ID NO: 82260 - DNA, 1767 bp, Chromobacterium violaceum ATCC 12472
  CDS (1)..(1767): transl_table=11
atgcagatatcgggcgccgaaattgtagtccgctgcctgcaggaagagggggtcgaattcgtcttcggctatccgggtggcgcggtactggaaatctacgatgccatcttccggcaggacaagttcaaacacgtgctggtaaggcacgaacaggcggcggtccatgccgccgacgcctattcgcgctccagcgacaaggtgggcgtggcgctggtgacctccggtcccggcgcgaccaatgccgtgaccggcatcgccaccgcctacatggattccatcccgatggtggtgatctccggccaggtgccttccccggccatcggcctggacgcgttccaggaagtggacatggtgggcatcacccgtccctgcgtgaagcacaacttcctggtcaaggacgtgaacgagatcgccgcgaccatcaagaaggcgttctacatcgccaagagcggccgtcccggcccggtggtggtggacatccccaaggacgtgacccaggcgcgcgccgagttccgctatccggacagcgtgcacatccgctcctacgtgccggccacccgcgggcacagcggacagatcaagaaagcggtgaacctgctgcttgaggccaagcgtccttatatctacgtcggcggcggcgccgtgcagggccgcgccgaagccgaggtgaccgagctggtgcggtccttgaacctgccgtgtaccaacaccctgatgggcctgggcgcctatccgggttcggaccggcagttcctgggcatgctgggcatgcacggcacctacgaagccaatatggcgatgcagtactgcgacgtgctggtggcggtgggcgcgcgtttcgacgaccgcgtgatcagcgtgccctcgcacttcctcggccaggccaagaaaatcatccacatcgacgtggatccgtcgtcgatctccaagcgcgtcaaggccgacatccccatcgtcggcgacgtcaagctggtgctgcgcgagatgctggaccaactgaagcaggccggccagaagccggacggctcggcgctgaaccagtggtggaagcagatcgaggaatggcgcggccacgactgtctgctgtacgcgccgtcggacgagctgatcaagccgcagatggtggtagagacgctgtacgacatcaccggcggccaggccatcgtcacctccgacgtcggccagcaccagatgtgggcggcgcagtactacaagttcgaccggcccaagcagtggctgaattccggcggcctcggcaccatgggcttcggcctgccggcggccatcggcgcgcagctggccaaccccaacgcgcaggtggcctgcatcaccggcgagggatcgatccagatgaacatccaggaactgtccaccgccaagcagtatcacaccccggtaaaggtggtggcgctgaacaaccgctacctgggcatggtgcgccagtggcaggagttcttctacggcacccgctactccgagtcctacatggacgcgctgccggacttcgtcaagatcgccgaggcctacggccacatcggcttcaaggtggagaatccggccgacgtggagccggtgctgcgcgaggcgttcagcgacaagctgaaggagcgcctggtgttcctggatttccgcaccgaccagtcggagaacgtgttcccgatgatccagaacggcaagggcctggatcagatggacctgccggcgcacatgcgcgccgtccagcaggtgcctttcgagaacaaccgtgactacggcaacatgtgctaa

SEQ ID NO: 82261 - protein, 588 aa, Chromobacterium violaceum ATCC 12472
MQISGAEIVVRCLQEEGVEFVFGYPGGAVLEIYDAIFRQDKFKHVLVRHEQAAVHAADAYSRSSDKVGVALVTSGPGATNAVTGIATAYMDSIPMVVISGQVPSPAIGLDAFQEVDMVGITRPCVKHNFLVKDVNEIAATIKKAFYIAKSGRPGPVVVDIPKDVTQARAEFRYPDSVHIRSYVPATRGHSGQIKKAVNLLLEAKRPYIYVGGGAVQGRAEAEVTELVRSLNLPCTNTLMGLGAYPGSDRQFLGMLGMHGTYEANMAMQYCDVLVAVGARFDDRVISVPSHFLGQAKKIIHIDVDPSSISKRVKADIPIVGDVKLVLREMLDQLKQAGQKPDGSALNQWWKQIEEWRGHDCLLYAPSDELIKPQMVVETLYDITGGQAIVTSDVGQHQMWAAQYYKFDRPKQWLNSGGLGTMGFGLPAAIGAQLANPNAQVACITGEGSIQMNIQELSTAKQYHTPVKVVALNNRYLGMVRQWQEFFYGTRYSESYMDALPDFVKIAEAYGHIGFKVENPADVEPVLREAFSDKLKERLVFLDFRTDQSENVFPMIQNGKGLDQMDLPAHMRAVQQVPFENNRDYGNMC

SEQ ID NO: 82262 - DNA, 1734 bp, Chromobacterium violaceum ATCC 12472
  CDS (1)..(1734): transl_table=11
atgcatctgaacgacgcgctggcgcagcagcccgacatcgccgccgtccattgccatcatgagcaggcctgcggcatcgccgccgaggcctacggccggctggccgagcgcaccggcgtggccatggtgaccaccggccccggcgccaccaacatcctgacgccggtggccggcgcctggatcgaatcgctgccgctgctggtgatttccggccaggtgaagcgcgccgacctgctgcagggcagcggcctgcgccagaagggcgtgcaggaagtggatgtcgtgtccatggccaagccggtgaccaagtacgcggtcaccgtcaccgatccgcaagccatccgccagcatctggaggaggcgctctatctggcgcacagcggccgtcccggcccggtgtggctggacatcccgctggacgtgcaggccgcgcccatcgatccggccacgctgccgggctggcaaccggaaggcgaaaccgcgccggccgcgcaagaccatgtcgccgccatcgccgatctgttgaagcaggccgagcggccgctgatcctggccggccacggcgtgcgcattgccggcggcgccgacgcgctgcgccggctcagcgaaacgctgcaagtgccggtggccgccacctggaacgcgatggacctgatgccgtgggacagcccgctgtgcgccggccgtcccggcgtggtggcgctgcgtcccggcaacttcgcggtgcagaactgcgacctgttgatcgccatcggcacccgcctcgacaacatcctcaccgcctataaccccaagggcttcgcccgcgccgcgcgcaaggtggtggtggacgtcgacgccgccgagatcgccaagctggagatggagatcgacctgccgttggcgatggacgccaaggcctgcctggagggcctgctggcggccgtcgagcgcctgcccaaggccaagtggcagtcatggctggaccgctgcgccgactggaagcgccgctacccggtgcaggacggcgcgccgttcccgacctccggccagatcagccactatcacttcgtcgacgcgctgtccgacgccgcgccggaaaacacgctgatttccaccggcagctccggcctggcggtcgaggtgttctacaccgtgttccgcaacaagccgggccagcgcgtatttctgacttcgggcctgggatcgatgggctacggcctgccggcggcgataggcgcctgcctgggcaacggctccaggccgatgatcgcgttggaaagcgacggcagcctgcaactgaacctgcaggagcttgcgacgctgaaggcgctgcgactgcccatccgcctgttcatcatgaacaacaacggctacgcctccatccgcaacacccagcgcaattatttcgacagccgctatgtcggcaccgggcccgaagccggcgtgctgatcccggacctgctggagctggccgaggcctacggcctgcctgcggtgcgcatcgaacgcgtcgaggagctggcggaaggattggccaaggtgatggcgcatccgggaccgattctgtgcgacgtgcggctgaacgagaacgaaacgctgcagcccaaggccgccgcgctgccgcagccggacggctccatgctgtcgatgccgctggaagacatgtcgccgctgctgccgctggagcagctgcgcgcggaaatgctgattccgctgctgccggcgtcggaagccgccaagcggggcgtttga

SEQ ID NO: 82263 - protein, 577 aa, Chromobacterium violaceum ATCC 12472
MHLNDALAQQPDIAAVHCHHEQACGIAAEAYGRLAERTGVAMVTTGPGATNILTPVAGAWIESLPLLVISGQVKRADLLQGSGLRQKGVQEVDVVSMAKPVTKYAVTVTDPQAIRQHLEEALYLAHSGRPGPVWLDIPLDVQAAPIDPATLPGWQPEGETAPAAQDHVAAIADLLKQAERPLILAGHGVRIAGGADALRRLSETLQVPVAATWNAMDLMPWDSPLCAGRPGVVALRPGNFAVQNCDLLIAIGTRLDNILTAYNPKGFARAARKVVVDVDAAEIAKLEMEIDLPLAMDAKACLEGLLAAVERLPKAKWQSWLDRCADWKRRYPVQDGAPFPTSGQISHYHFVDALSDAAPENTLISTGSSGLAVEVFYTVFRNKPGQRVFLTSGLGSMGYGLPAAIGACLGNGSRPMIALESDGSLQLNLQELATLKALRLPIRLFIMNNNGYASIRNTQRNYFDSRYVGTGPEAGVLIPDLLELAEAYGLPAVRIERVEELAEGLAKVMAHPGPILCDVRLNENETLQPKAAALPQPDGSMLSMPLEDMSPLLPLEQLRAEMLIPLLPASEAAKRGV

SEQ ID NO: 82264 - DNA, 1689 bp, Wolinella succinogenes DSM 1740
  CDS (1)..(1689): transl_table=11
atgagactgagcggctcggaaatggtcatcgaagcctttaagaatgagggcgtcaaagtcgttttcggttatccaggcggtgcgatcatgaatgtttatgatgaaatttataaacaaaattacttcaagcatatcctgacgcgccacgaacaggccgccatccacgcagcggatggctacgcccgagctacgggtgaagtgggcgtctccattatcaccagcggccctggattcaccaatgcggtgacgggaattgccacggcttacatggattcggttccgatggtcatcctaagcggtcaagtccccatcactctcatcggaacggatgcatttcaagagattgacgcggtgggaatctctcgcccctgtacaaaacacaactatttagtcaaagatatctctgaattgccccgaattctcaaagaggccttttatatcgccagaagcggacgacctggacccgttcatgtggacttgcctaaagatattagcgccaccatgggagagtttttctaccctgaagagatcaaactcaaaacctataaacccacctatcgcgggaacgctagacagatcaaaaaagcagccgaatcgatcaagcatgccaaaaagcctcttctttatgtcggcggaggcgtgattgcttcggaagcctcaggacttttaagggagctttcgcacaccacctctattcccgtagtggaaaccttgatggcgcgtggttccatggagcacaacgatcctcttttgcttggcatggtagggatgcatgggacctatgccgccaatatggccatgagcgaatcagatctcatcgtcgcgcttggtgcgcgctttgatgaccgcgtcacagggaagctcagcgagtttgccaaatacgctgagatcatccatatcgatattgacccaagcagcattgggaagattgtcaagatcaactaccccatcgtaggcgacatctccgaagtccttaaagagctcttgccccttttgaaggatatcaatccccaagccacccaatcgtggctcacgcagttggatcgatacaaagcgctccaccctctaaaatatgaggattctaatctctccatcaagccccaatgggtcattgagcgaatcggtgaacttttgggtgatcaggccaacatcaccaccgatgtaggtcaacaccaaatgtggagtgctcaattctaccctttcactcgccctagacaattcatgactagcggcggcttgggcacgatgggctttggatttcctgcggcgatgggcgtaaagatgggctcacctgagaaggtctccatcaatatcacgggcgatggttcgattcttatgaatattcaagaactcatgaccgctgtggagaagcaaatccctgtcatcaatgtcatcttgaacaacaactacctaggcatggtgcgacagtggcagactttcttctatgacaaacgctactccgaaacggatctctcttgccagcccgatttcgtcaagcttgccgaatcttttggcggagtggggtttagatgtgagaccaaagcggagtttgacactgcccttttaaaggccgttgagcttggacgcgtcacgatgattgatgtgaaagtcgatcgcttagagaatgttttgccaatggttcctagtggcgggtcgctctttaatatgatgcttgagtataaggattaa

SEQ ID NO: 82265 - protein, 562 aa, Wolinella succinogenes DSM 1740
MRLSGSEMVIEAFKNEGVKVVFGYPGGAIMNVYDEIYKQNYFKHILTRHEQAAIHAADGYARATGEVGVSIITSGPGFTNAVTGIATAYMDSVPMVILSGQVPITLIGTDAFQEIDAVGISRPCTKHNYLVKDISELPRILKEAFYIARSGRPGPVHVDLPKDISATMGEFFYPEEIKLKTYKPTYRGNARQIKKAAESIKHAKKPLLYVGGGVIASEASGLLRELSHTTSIPVVETLMARGSMEHNDPLLLGMVGMHGTYAANMAMSESDLIVALGARFDDRVTGKLSEFAKYAEIIHIDIDPSSIGKIVKINYPIVGDISEVLKELLPLLKDINPQATQSWLTQLDRYKALHPLKYEDSNLSIKPQWVIERIGELLGDQANITTDVGQHQMWSAQFYPFTRPRQFMTSGGLGTMGFGFPAAMGVKMGSPEKVSINITGDGSILMNIQELMTAVEKQIPVINVILNNNYLGMVRQWQTFFYDKRYSETDLSCQPDFVKLAESFGGVGFRCETKAEFDTALLKAVELGRVTMIDVKVDRLENVLPMVPSGGSLFNMMLEYKD

SEQ ID NO: 82266 - DNA, 1638 bp, Gloeobacter violaceus PCC 7421
  CDS (1)..(1638): transl_table=11
atgaacacagccgaattgttggtgcagtgcctggagaacgaaggtgtccgctacatcttcggcttgcccggcgaggagaacatgcagtttctggaggcgctgcaaagctcatctattcagtttgtcaccacccgccacgaacagggcgccgccttcatggccgatgtctacgggcggctgaccggccgggcgggggtgtgcctttcgaccctgggtcccggtgcgaccaatttgatgaccggcgtggccgacgccaacctcgatcgcgccccactggtggcgatcaccggtcaggtgggtaccgatcgcatgcacgtcgacgcccaccagtacctcgacttggtggcgatgttcgctccggtgaccaagtggagcacccatatcgtccgcccgagcaacacccccgaaatcgtccgcaaggcgttcaagatcgcccaggccgaaaaaccgggggcagtgcacatcgaactaccggaaaacatcgcttcgatggcggcgatcggcgagccgctgcgcatcagcgacaatcacgacatattcgcttcattcagcagcatcacccgggcggccgagctgatttcccaggccgacaacccgcttatcctggtgggcaacggcgccatccgctgcaatgcgagtgccgcgctcaccgagttcgccgcccgcctgaatatcccggtggccaataccttcatgggcaagggggttattccttatacccatccgctggcgctgtgggcggtgggcctgcagcagcgcgactacatcagctgcggcttcgaccgcgccgacctggtgatcgccatcggctacgaccacatcgagtactcgcccaaaaagtggaaccccatgggcgacatcccgatcgtccatgtcggccgcaccgccgcggaagtcgacagcagctatatcccgcaagtcgaagtggtgggcgacatctccgacagcctgcaggagatcctgtcgcgcgccgaccgccagggcaaacccgacccctacgccatccaactgcgcgacgacatccgcgccgagtacaccgagtacgcccacgacaccggctatcccgtcaaaccccaaaaaataatctacgacctgcgccaggtgctgggctcggaggatatcttgatctccgacgtcggcgcccacaagatgtgggtggcccgccactaccactgcgaccgccccaacacctgcatcatctccaacggcttcgccgctatgggcatcgccatcccgggcgctgtcgccgccaaactcgtccacccccaccgcaaagtggtggccgtcaccggtgacggcggcttcatgatgaacatgcaggaactggagacggccctgcgcatcggtacgccctttgtgacgcttatcttcaacgacggcggctacggcctcatcgaatggaagcaacagacccacttcaaccgctccgccttcgtgcgcttcggcaaccccgactttgtgcgccttgccgagagtatgggtcttaagggctaccgcgtcgaggcgggcgacgagttgttgcccatcctcaaaactgccctcgaacaggaggttccggccatcatcgactgtccggtggactaccgggagaacatggaactctcgcagcgggtcatgcaactcagttgcgccgtttaa

SEQ ID NO: 82267 - protein, 545 aa, Gloeobacter violaceus PCC 7421
MNTAELLVQCLENEGVRYIFGLPGEENMQFLEALQSSSIQFVTTRHEQGAAFMADVYGRLTGRAGVCLSTLGPGATNLMTGVADANLDRAPLVAITGQVGTDRMHVDAHQYLDLVAMFAPVTKWSTHIVRPSNTPEIVRKAFKIAQAEKPGAVHIELPENIASMAAIGEPLRISDNHDIFASFSSITRAAELISQADNPLILVGNGAIRCNASAALTEFAARLNIPVANTFMGKGVIPYTHPLALWAVGLQQRDYISCGFDRADLVIAIGYDHIEYSPKKWNPMGDIPIVHVGRTAAEVDSSYIPQVEVVGDISDSLQEILSRADRQGKPDPYAIQLRDDIRAEYTEYAHDTGYPVKPQKIIYDLRQVLGSEDILISDVGAHKMWVARHYHCDRPNTCIISNGFAAMGIAIPGAVAAKLVHPHRKVVAVTGDGGFMMNMQELETALRIGTPFVTLIFNDGGYGLIEWKQQTHFNRSAFVRFGNPDFVRLAESMGLKGYRVEAGDELLPILKTALEQEVPAIIDCPVDYRENMELSQRVMQLSCAV

SEQ ID NO: 82268 - DNA, 1791 bp, Gloeobacter violaceus PCC 7421
  CDS (1)..(1791): transl_table=11
atgcaagccaccggagccttcgccgtcgtcgatagtctgtgctgccagggcgtccggcacatcttcggttaccccggtggggccattttgccggtctacgacgagatttacaaggccgaggccgaagggcggtttcagcactttctggtgcgccacgagcagggggcggcccacgccgccgacggctacgcccgggcgaccggccgggtgggcgtctgtgtggccacctccggtcccggggcgacgaatctggtgacgggcatcgccacggcccacatggattcggtgccgatggtggcgattaccggtcaggtgccgcgccggtcgatcggttccgacgcctttcaagaagccgatattctgggcatcaccctgcccatcgtcaagcactcctacgtcatccgcaacactggggacatcggccgcatcttcagcgaagccttccatatcgcaagcagcggccggcccggcccggtgctcatcgacgttcccaaggacgtgggccaagaaagcttcgagtacacgccggtccagacgacgcccaaaattcccgggtaccgcccaaccacacggggcaatccccgccaggtggcggcggcggcgaagctcatcctcgaagcggaccggcctctgctttatgtgggtggcggcgccatctccgccggggcgcacgccgaactgatgcgcctcgcggagctgggtttgatcccgaccaccaccaccttgatgggcaagggggccttccctgaagatcatccgctggccgtgggcatgctcggcatgcacggcaccgcctacgccaatttcgccgtcaccgagtgcgatttgctcatcgccgtgggggcgcgcttcgacgaccgggtgaccggcaaactggatgaatttgccgcccgcgcccgcgtcatccacatcgatatcgatccggcagaggtgggcaagaaccgggggccggaggtgcccatcgtgggcgacgtcaaactggtgctgcaggatctgattaaaaagctcatcgaatttcagccgcgcacccgggcgtggctggagcgcatcgagcgctggaaagccgagtatccgctggaggtgccgagcgatggcacccggctgtacccacaggaagtgatggtcgcctttcgcgaactggctaccgacgcctactacaccaccgacgtcggccagcaccagatgtgggcggcgcagtttctcaaaaacggcccccggcgctggatttcctcaggcggcctcggcacgatgggctacggctttccggcggccatcggcgtgcaggtggcactgcctgacgaagacgtcgtgtgcatctccggcgacgccagctttcagatgaacctacaagaaatcggcacggcggtgcagtacgacctgccggtcaaggccgccatcgtcaacaacggctggcagggcatggtccgccagtggcaagaatttttctacgaccgccgcttctcccactcccacatgaagccctcgatgcccgacttcgtcaaactcgctgaagcgttcggggcggagggcatggtcatcgatcaccccgaccagctcaaagaaggcatcgaggcgctgatggagcgcgaccggccggtgatttgcgactttcatgtcgtccccgacgccaactgctacccgatggtgcccccgggcaaggccaaccaccagatggtcgggctgcccaggccgttgccgatgcagccgctcgaactcatctactgccccaactgcggcaccaaaaataccaccgccaaccgcttctgccccgagtgcggcaccaagctttag

SEQ ID NO: 82269 - protein, 596 aa, Gloeobacter violaceus PCC 7421
MQATGAFAVVDSLCCQGVRHIFGYPGGAILPVYDEIYKAEAEGRFQHFLVRHEQGAAHAADGYARATGRVGVCVATSGPGATNLVTGIATAHMDSVPMVAITGQVPRRSIGSDAFQEADILGITLPIVKHSYVIRNTGDIGRIFSEAFHIASSGRPGPVLIDVPKDVGQESFEYTPVQTTPKIPGYRPTTRGNPRQVAAAAKLILEADRPLLYVGGGAISAGAHAELMRLAELGLIPTTTTLMGKGAFPEDHPLAVGMLGMHGTAYANFAVTECDLLIAVGARFDDRVTGKLDEFAARARVIHIDIDPAEVGKNRGPEVPIVGDVKLVLQDLIKKLIEFQPRTRAWLERIERWKAEYPLEVPSDGTRLYPQEVMVAFRELATDAYYTTDVGQHQMWAAQFLKNGPRRWISSGGLGTMGYGFPAAIGVQVALPDEDVVCISGDASFQMNLQEIGTAVQYDLPVKAAIVNNGWQGMVRQWQEFFYDRRFSHSHMKPSMPDFVKLAEAFGAEGMVIDHPDQLKEGIEALMERDRPVICDFHVVPDANCYPMVPPGKANHQMVGLPRPLPMQPLELIYCPNCGTKNTTANRFCPECGTKL

SEQ ID NO: 82270 - DNA, 1647 bp, Photorhabdus luminescens subsp. laumondii TTO1
  CDS (1)..(1647): transl_table=11
atgaatggggcgcagtgggttgtaaaggcattacgaacgcaggggattgataaggtttttggctaccctggtggtacgatcatgccggtttatgatgctttgtacgatggtggtgtggagcatttgctttgtcggcatgaacagggggcagctatggctgcaatcggctatgcgagagccagtggtaagccgggagtttgtatcgctacatcgggaccgggagcaacaaacttaatcactggattagccgatgcattgttagattctgttcctattgttgctatcactggtcaggttggttctgaattgattggaactgatgccttccaagaagtcgatgttttaggtctctcccttgcttgtaccaaacacagtttcttagtggactcactggaagatttacctcaaattatggcggaagccttttctattgccactagtggtcgacctggcccagttttgattgatattcctaaagatattcagttgaaagaggggaattttgtaccacatttggtacccgttgaacaaaaggagccctgctcggaaagtgaattagaacaagcccggaaaatggttgcggctgcgacaaagccagtgttgtatgtcggtggtggagtagggatgtctcaagcagtttctgttctgcgagattttgttgtggaaacaggtatgccggttgcttctacgttgaaaggcttgggggctgccgattcagaacatccatgttatctgggaatgcttgggatgcatggttcgaaagcggccaatcttgccgttcagtcatgtgatttgttgattgctgtaggtgctcgttttgatgatcgtgtgactggcaaacttaatacttttgctccgtgtgcaaaaatcattcatctggatatcgatccggcagagttgggtaaattacgtcaggctcatgtgtcgttgctgggggatgtgaaggtattattgccccgtttgcaacagccattgtcaattatgccctggcaacaggaagttaagtatctgaaagctgaatatccttggtgttatgaccatcagggagagagtatctatgcgccttggttattgaagcaggtttcagatcgtaaaacatttaatacggttattactaccgatgttggacaacatcaaatgtggacagctcagcatatgacgtttgatgggcctgaaaatttcattacatctagtggattgggctcgatgggatttggtatccctgctgcaattggtgctcagattgctcgaccggaagatatggtgatttgtgtctctggagatggttctttcatgatgaatgtccaagaactggggacaattaaacgcaagcaattacccgtaaaaattttattgttggataaccagcgattgggaatggtgcggcaatggcaggagttgttttttgataagcgatatagcgaaacgacattaacagataaccccgattttgtcacattagcgaaagcttttgatattccggggcaacatatcacggataaatcacagattgatgaagcgctgaatgcattattcagcagtaagggcccctatttattacaggtatctattgaggaattagagaacgtttggccgttagttcctcccggtgcaagcaatgaaactatgttggagaaatcattatga

SEQ ID NO: 82271 - protein, 548 aa, Photorhabdus luminescens subsp. laumondii TTO1
MNGAQWVVKALRTQGIDKVFGYPGGTIMPVYDALYDGGVEHLLCRHEQGAAMAAIGYARASGKPGVCIATSGPGATNLITGLADALLDSVPIVAITGQVGSELIGTDAFQEVDVLGLSLACTKHSFLVDSLEDLPQIMAEAFSIATSGRPGPVLIDIPKDIQLKEGNFVPHLVPVEQKEPCSESELEQARKMVAAATKPVLYVGGGVGMSQAVSVLRDFVVETGMPVASTLKGLGAADSEHPCYLGMLGMHGSKAANLAVQSCDLLIAVGARFDDRVTGKLNTFAPCAKIIHLDIDPAELGKLRQAHVSLLGDVKVLLPRLQQPLSIMPWQQEVKYLKAEYPWCYDHQGESIYAPWLLKQVSDRKTFNTVITTDVGQHQMWTAQHMTFDGPENFITSSGLGSMGFGIPAAIGAQIARPEDMVICVSGDGSFMMNVQELGTIKRKQLPVKILLLDNQRLGMVRQWQELFFDKRYSETTLTDNPDFVTLAKAFDIPGQHITDKSQIDEALNALFSSKGPYLLQVSIEELENVWPLVPPGASNETMLEKSL

SEQ ID NO: 82272 - DNA, 1959 bp, Corynebacterium diphtheriae NCTC 13129
  CDS (1)..(1959): transl_table=11
atgttgcaacatgtcagtccccgcaattaccacaaggagcttgatgtcgtggcatcctccactcagcccaatcagcccacaccagcgacgttagcccgacgtgcgcaggtattaaagccggagcgaatgaccggtgcagacgcaatcgtgcgatcgttggaagaactcggaatcgacatggtctttggccttccaggcggcgctgttttgcctctttatgactcgttgtatgcatcgaccaaattgcgtcacgttcttgtacgtcatgaacaaggcgcaggtcatgccgcaactggatatgcacaagctactggaaaagtgggtgtgtgtattgcaacgtcgggtccaggtgcaacgaaccttgtaacgcctatcgcggatgcgcacttggattcggtgccacttgtcgctatcaccggacaggttgggcgctccctcttggggtctgatgctttccaagaagccgatattcgtggtattacgatgccggttactaagcacaacttcatggttacggatgtcaacatgattccgcaggcgatcgcagaggcattttatctggcggcttccggtcggccaggaccggtgcttgtcgacattcccaaggatattcagcaggctgagatcgacttccattggcctccaactattgatttgccaggttatcgtccggtgactactccgcatagtcgacctgttgaacaagcagccaagatgatttcacaagctcgtaggcctgttctatatgtcggtggtggcgttattaaggcgaatgcttctcaagaacttcaagcatttgctgaacacactggaattccagttgttactactttgatggcattgggtgcgttccctggctcgcatgagctcaatatgggcatgcctggaatgcacggaaccgttccagctgtgggagctttgcaaaagagcgatcttctcatcactatcggcgcgcgtttcgacgatcgtgtcacgggtgcactggcatcatttgctcctggcgcaaaagttattcacgctgatattgatcctgcggaaatcggcaagatcagagcagttgatgttccaattgttggtgacgctcaagaagttttgaccgcgttgcttaatgtctacaaagacttggatctgccacagcctcggcatgagcgttggctgcgatacctcaatggtttgaagagcaattatccgcgtggttgggaaaagtctgacgacggcatgattgagccgcaggcggttattagggcgcttgctaagacggttggtactgatgcgatttatgctgcaggtgttggacagcatcaaatgtggtctgcacagttccttgactttgaaaagccacgtacgtggctcaactctggtggcttgggcacgatgggttattcggttcccgcagccctaggtgctaaggctggttgcccagacaaagaagtttgggcaatcgatggtgatggttgcttccaaatgactaatcaagagcttgcgacggcagctgtggagggcatgccgatcaaagtagctcttattaataacggcaatctaggcatggtgcgccagtggcaaacgctcttctatgacggtaactattcaaataccaagctccgcaatcaggggcagtatatgccggacttcgtgatgctggcggaatctttgggctgtgcagctttccgtgtgacggaggagactgacatcgttccgacgattgaaaaagcacgagcgattaacgaccgccccgtggtgatcgattttattgttggtgaagatgcacaagtgtggccaatggttgcagcaggacattccaattctgacattgaatatgctcatgggctccgtccgcttttcgacggagaaagctctgctgctgagactccagaggatatcgacgatgttattgatgaggcaacgcttctcgcacttgaggcgcaaaaacgtcacctagaacctaaagaaaatatctag

SEQ ID NO: 82273 - protein, 652 aa, Corynebacterium diphtheriae NCTC 13129
MLQHVSPRNYHKELDVVASSTQPNQPTPATLARRAQVLKPERMTGADAIVRSLEELGIDMVFGLPGGAVLPLYDSLYASTKLRHVLVRHEQGAGHAATGYAQATGKVGVCIATSGPGATNLVTPIADAHLDSVPLVAITGQVGRSLLGSDAFQEADIRGITMPVTKHNFMVTDVNMIPQAIAEAFYLAASGRPGPVLVDIPKDIQQAEIDFHWPPTIDLPGYRPVTTPHSRPVEQAAKMISQARRPVLYVGGGVIKANASQELQAFAEHTGIPVVTTLMALGAFPGSHELNMGMPGMHGTVPAVGALQKSDLLITIGARFDDRVTGALASFAPGAKVIHADIDPAEIGKIRAVDVPIVGDAQEVLTALLNVYKDLDLPQPRHERWLRYLNGLKSNYPRGWEKSDDGMIEPQAVIRALAKTVGTDAIYAAGVGQHQMWSAQFLDFEKPRTWLNSGGLGTMGYSVPAALGAKAGCPDKEVWAIDGDGCFQMTNQELATAAVEGMPIKVALINNGNLGMVRQWQTLFYDGNYSNTKLRNQGQYMPDFVMLAESLGCAAFRVTEETDIVPTIEKARAINDRPVVIDFIVGEDAQVWPMVAAGHSNSDIEYAHGLRPLFDGESSAAETPEDIDDVIDEATLLALEAQKRHLEPKENI

SEQ ID NO: 82274 - DNA, 1779 bp, Rhodopseudomonas palustris CGA009
  CDS (1)..(1779): transl_table=11
atgagcgacagcaacagccacgatccgaaccagatgaccggtgcggcgatgatcgtccgcgcgatgaaggatcacggtgtcgagcacatcttcggctatccgggcggcgcggtacttccgatctacgacgagatcttccagcagtctgacgtccagcacatcctggtccggcacgagcagggcgccggccacgcggccgaaggctatgcgcgctcgaccggcaagccaggtgtggtgctggtgacctctggcccgggcgccaccaacatggtgacgccgctggccgacgcgttgatggattcgatcccgctggtgtgcatcaccggccaggtgccgacccatctgatcggcaacgacgccttccaggagtgtgacaccgttggcatcacccggccgtgcaccaagcacaactggctggtgcgccggatcgaggatctggccaaggtgctgcacgaggcgttctacgtcgcgacctccggccgtccgggcccggtggtggtcgacgtcccgaaggatgtgcagttcgccaccggcacctatcatccgccgcgcaaggccgacgtccacgtctcctacgtgccgaacaagaagggcgatcccgcccagatccgtaaggccgttgcgctgctggccaatgccaagcggccggtgatctattctggcggcggcgtgatcaactcgggccccgaagcgtcgcggctgctgcgtgagctggtggagatcaccgatttcccgatcacctcgacgctgatgggtctcggcgcgtatccggcctcgggcaagaactggctcggcatgctgggcatgcacggcacctacgaagccaacatgacgatgcacgattgcgacgtcatgctgtgcatcggcgcgcggttcgacgaccggatcaccggccgcaccgacgcgttcgcgccgaacgccaagaagatccacatcgatatcgatccgtcgtcgatcaacaagaacatccgggtcgacgtgccgatcatcggcgacgtcgccaccgtcctcgccgacctgctgagtgcgttcaaggccgaagccaagaagccggacatcaagccgtggtggcagcaggtcgcgacctggcgcgcacgcaattcgcttgcctataagaagaacaacgacgtcatcatgccgcaatacgcgatccagcggctgtacgaggcgacccgcggccgtgatacctacatcacgaccgaagtcggtcagcatcagatgtgggcggcgcagttctacggcttcgaacagccgaagcgctggatgacctcgggcggcctcggcaccatgggctacggcctgccggcggcgctcggcgtgcaggtggcgcatcgcgacagcctcgtcatcgacatcgccggcgacgcctcggtgcagatgacgatccaggagatggcgacggcggtgcagtacgagctgccgatcaagatcttcatcttgaacaaccagtacatgggcatggtgcgccagtggcagcagctgctgcacggcaaccggctgtcgcattcctacaccgaggcgatgcccgacttcgtcaagctggctgaagcttacggcgcggtcggcatgcaggttgtcaaaccgtcagatctcgacggcgcgatccaggacatgatcaaggtgaacaagccggtgctgttcgactgccgcgtcgccgcgctggagaactgcttcccgatgattccttcgggcaaggcgcacaacgaaatgctgttgccggccgaagccaccgacgaagccaccgcagccgccttcgctggcggcaaggcgctggtgtga

SEQ ID NO: 82275 - protein, 592 aa, Rhodopseudomonas palustris CGA009
MSDSNSHDPNQMTGAAMIVRAMKDHGVEHIFGYPGGAVLPIYDEIFQQSDVQHILVRHEQGAGHAAEGYARSTGKPGVVLVTSGPGATNMVTPLADALMDSIPLVCITGQVPTHLIGNDAFQECDTVGITRPCTKHNWLVRRIEDLAKVLHEAFYVATSGRPGPVVVDVPKDVQFATGTYHPPRKADVHVSYVPNKKGDPAQIRKAVALLANAKRPVIYSGGGVINSGPEASRLLRELVEITDFPITSTLMGLGAYPASGKNWLGMLGMHGTYEANMTMHDCDVMLCIGARFDDRITGRTDAFAPNAKKIHIDIDPSSINKNIRVDVPIIGDVATVLADLLSAFKAEAKKPDIKPWWQQVATWRARNSLAYKKNNDVIMPQYAIQRLYEATRGRDTYITTEVGQHQMWAAQFYGFEQPKRWMTSGGLGTMGYGLPAALGVQVAHRDSLVIDIAGDASVQMTIQEMATAVQYELPIKIFILNNQYMGMVRQWQQLLHGNRLSHSYTEAMPDFVKLAEAYGAVGMQVVKPSDLDGAIQDMIKVNKPVLFDCRVAALENCFPMIPSGKAHNEMLLPAEATDEATAAAFAGGKALV

SEQ ID NO: 82276 - DNA, 1803 bp, Rhodopseudomonas palustris CGA009
  CDS (1)..(1803): transl_table=11
gtgaagctctccgactacgtcatcgattttctggcgcggcggggcgtcacccatgtgttcggcatttccggcggcgccgcggtgcacatgttcgactccgcccagcgtcaccctgacgtcactccgatctttccccagcacgagcaggctgccgcgatggctgccgacggctacgcgcgcgccaccggcaggctcggcgtcgccatcaccacctcgggtcccggcgccaccaatctgctgaccggggtgtgctgcgcctactacgactccgtgccgacgctgatgatcaccgggcaggtcgcgacccatcggctgaagggcaagaaccagatccgtcagctcgggtttcaggagaccgacgtgacgtcgatcttcgccacggtgactaaatatgcggtacagatctccgaccccaccacgatccgttatcatctggagaaggcgtaccatctcgcgttcgaggggcggccgggttcggtgctgatcgatctgccggacgatctgcaacgcgccgagatcgatcccgacgcgttgccgggcttcacgccggagccggaggccgcatcgaatgatctcgacgccgagatcgcggcgctgctgccgctgattgcgcgggccaagcggccggtgctggtgctcggcggcgggctgtcgacgccgcggatcgggtcgatgctggatcacctcgtcgaccgcctcggcatgccggtgctgaccacctgggcggcgaccgatctgatcgcagccgaccatccgctgcgggtcgggccgttcggcgtctatgggccgcggctcggtaacttcacggtgcagaacgccgacctgatcctgtgcctcggcagccggctgtcgcagaacgtcaccggcggcatcctgccgtcgttcgcgcgcgaggcgacgatcgtgatggtcgacgccagccgcggcgagatggacaagttcgacgatcgcggcatccgcatcgcgacgcggatcgcagcgcggctcgacgccttcgtgccgaagctgctcgccgcgatcgaggcggcaccgccgcgcgaggcttggctgaacaccatcgggcattggcgcagcgcgttgccggatgatcggcctggccctgcgcccgacaatgccggcttcgtcgacgcctacgacttcatcgacaagttgagcgacgctgcgcccgccgacgaactgctctatgtcgacaccggcggcaacctgacctggacctgcaacggcttccgcatcaagcgcgggcaacggctgatctcggactggaacaacaccgcgatgggctacgcgctggcggcggcgatcggcgctgcggtgcaggcgagggggggcgtcagttgcatcatcggcgacggcggcctcatgctgtcgctcggcgagctggcgctgctcaagcggcacgaactgccggtgcggctgatgctgtttaataatcacggccatggcatccagaagcagacgctggagacctggctcgatggccactatgtcggcgtcgatgcgccgagcggcctgtcgttcgtcgacttccgcaaagttgccgaggcgatggatctgccagtggtcacgatcggccgcagcgccgacattgctagccagctccgcgacgtttatgcgcgcagaggcccggtgttctgcaacgtcgaaatcaacccggcgcagaaattgtacccggtgctgaagttcggcgcgccgctggagagccagctgccgtcgatcgacgatgagctgatcaagcgcgaaatgctgatcgcgccgtttgtccccggctccgcgccaaagcacagcggcggcgcgggcgtatag

SEQ ID NO: 82277 - protein, 600 aa, Rhodopseudomonas palustris CGA009
MKLSDYVIDFLARRGVTHVFGISGGAAVHMFDSAQRHPDVTPIFPQHEQAAAMAADGYARATGRLGVAITTSGPGATNLLTGVCCAYYDSVPTLMITGQVATHRLKGKNQIRQLGFQETDVTSIFATVTKYAVQISDPTTIRYHLEKAYHLAFEGRPGSVLIDLPDDLQRAEIDPDALPGFTPEPEAASNDLDAEIAALLPLIARAKRPVLVLGGGLSTPRIGSMLDHLVDRLGMPVLTTWAATDLIAADHPLRVGPFGVYGPRLGNFTVQNADLILCLGSRLSQNVTGGILPSFAREATIVMVDASRGEMDKFDDRGIRIATRIAARLDAFVPKLLAAIEAAPPREAWLNTIGHWRSALPDDRPGPAPDNAGFVDAYDFIDKLSDAAPADELLYVDTGGNLTWTCNGFRIKRGQRLISDWNNTAMGYALAAAIGAAVQARGGVSCIIGDGGLMLSLGELALLKRHELPVRLMLFNNHGHGIQKQTLETWLDGHYVGVDAPSGLSFVDFRKVAEAMDLPVVTIGRSADIASQLRDVYARRGPVFCNVEINPAQKLYPVLKFGAPLESQLPSIDDELIKREMLIAPFVPGSAPKHSGGAGV

SEQ ID NO: 82278 - DNA, 1869 bp, Mycobacterium avium subsp. paratuberculosis str. k10
  CDS (1)..(1869): transl_table=11
gtgagcgctcccaccaggcggcccgcccccgacgcacccggcgctgccggcatcgccccggccccgccggccccggccgcgaagcccgccgccggcaaaccgaaacgcattgggcccgaacaagttaccggcgcgcaatcggtgatccgatcgctggaggagctcggcgtcgaggtgatcttcggcattcccggcggcgcggtactgccggtctatgacccgctgttcgactccaagaagctgcggcacgtgctggtccgccacgagcagggcgccggtcacgccgccagcggctacgcgcacgccaccggcaaggtcggtgtctgcatggccacctccggtccgggcgccaccaacctggtcaccgcgctggccgacgcccagatggactcgattcccgtcgtcgccgtcaccggccaggtgggacgcacgctaatcggcaccgacgccttccaggaggccgacatctccggcatcaccatgccgatcaccaagcacaacttcctggttcgctccggcaacgagatcccgcaggtgcttgccgaggcgttccacatcgccgcctccggccgccccggcgcggtgctcgtcgacatccccaaggacgtgctgcagggccagtgcacgttcagctggccgccgcgcatccacctgcccgggtacaagccgaccaccaaaccgcacagccggcagatccgcgaagccgccaagctgatcgcggccgcccgcaaaccggtgctgtacgtgggcggcggtgtcatccgcggggaggccagcgagcagctgcgcgaactggccgagctgaccggcatcccggtggtgaccacgctgatggcccgcggcgcgttcccggacagccaccgtcagcacctgggcatgcccgggatgcacggcaccgtcgcggcggtggcggccctgcagcgcagcgacctgctgatcgcgctgggtacgcggttcgatgaccgggtgaccggcaagctggacaccttcgccccggaagccaaggtcatccacgccgacatcgacccggccgagatcggcaagaaccggcatgccgacgtgccgatcgtcggcgacgtcaaggccgtcatcgccgaactggtcgagatgctgcgccacgacggggcgcccggcaatctcgacatcgccgactggtgggcctacctcgacgacgtccagtccacctatccgttgagctacgggccgcagagcgacggcagcctcgggcccgagtacgtcatcgagaagctgggccagatcgctggccccgacgcggtgtacgtcgccggggtgggccagcaccagatgtgggcggcgcaattcatctcctacgagaagccgcgcacctggctcaactccggcggcctgggcaccatggggttcgccattccggccgccatgggggccaagatggctcgcccggaggccgaggtgtgggcgatcgacggcgacggctgtttccagatgaccaaccaggaactggccacctgcgccgtcgagggcattccgatcaaggtggcgctgatcaacaacggcaacctgggcatggtgcgccagtggcagaccctgttctacgaagagcggtattcgcaaacggatctggccacccactcgcaccgcatcccggacttcgtcaagctcgccgaggcgctgggctgcgtcggattgcgttgcgagcgtgaggaagacgtcgtcgacgtgatcaacgctgcccgggcgatcaacgaccggccggtggtgatcgacttcatcgtcggcgccgacgcgcaggtgtggccgatggtggccgccggcaccagcaacgacgagatccaggccgcccgcgggatccgcccgctgttcgacgacgagaccgaagggcacgcctga

SEQ ID NO: 82279 - protein, 622 aa, Mycobacterium avium subsp. paratuberculosis str. k10
MSAPTRRPAPDAPGAAGIAPAPPAPAAKPAAGKPKRIGPEQVTGAQSVIRSLEELGVEVIFGIPGGAVLPVYDPLFDSKKLRHVLVRHEQGAGHAASGYAHATGKVGVCMATSGPGATNLVTALADAQMDSIPVVAVTGQVGRTLIGTDAFQEADISGITMPITKHNFLVRSGNEIPQVLAEAFHIAASGRPGAVLVDIPKDVLQGQCTFSWPPRIHLPGYKPTTKPHSRQIREAAKLIAAARKPVLYVGGGVIRGEASEQLRELAELTGIPVVTTLMARGAFPDSHRQHLGMPGMHGTVAAVAALQRSDLLIALGTRFDDRVTGKLDTFAPEAKVIHADIDPAEIGKNRHADVPIVGDVKAVIAELVEMLRHDGAPGNLDIADWWAYLDDVQSTYPLSYGPQSDGSLGPEYVIEKLGQIAGPDAVYVAGVGQHQMWAAQFISYEKPRTWLNSGGLGTMGFAIPAAMGAKMARPEAEVWAIDGDGCFQMTNQELATCAVEGIPIKVALINNGNLGMVRQWQTLFYEERYSQTDLATHSHRIPDFVKLAEALGCVGLRCEREEDVVDVINAARAINDRPVVIDFIVGADAQVWPMVAAGTSNDEIQAARGIRPLFDDETEGHA

SEQ ID NO: 82280 - DNA, 1716 bp, Bacillus cereus ATCC 10987
  CDS (1)..(1716): transl_table=11
atgaagcagcagtatacagcgtatgagaagttacagtatgaagaaatgacaggcgctgggcacgtgattcaatgtttgaagaaattgggtgtaacgactgttttcggttatccgggtggagcgattttgccagtatacgatgcgttatacggaagtggtttgaagcacgttttaactcgtcatgaacaagctgccattcatgcggcagaaggatatgcgagagcttctggaaaggtcggggtagtctttgctacctctggcccaggggcgacgaatttagttacgggtttagcggatgcttatatggattcgattcctttagttgtcattacagggcaagttgcaaagtctttaattggtaaagatggatttcaagaagcggatgttgttggaatcacagtacctgttacgaagcataattaccaaattcgtgatgtgaatcatttatcacgcatcgtacaagaagctttttacatcgccgaaagcgggcggccggggccggtattaattgatattccaaaagatattcaaaatgaaaatgtaacaagtttttacaatgaagtgattgagattccagggtacaaactagagcctatgccagacagtatgaaactgaaagaggtagctaaagaaatttcaaaagcgaaacgcccacttctttatattggaggaggtgtcattcattcaggtggatctgatgaacttatcaaatttgcgagagaaaatcgtattccagtcgtgtcaactttaatgggactaggtgcatatccgccgggagattcattatttttaggaatgctcggtatgcatggaacgtacgctgcaaatatggcagtaacagaatgtgacttattacttgctttaggtgttcgctttgatgatcgtgtaacaggaaaattagaactcttttctccctattcaaaaaaggtacatattgatatagatccttcggagtttcataaaaatgtaactgtggaatatccagttgttggggatgtgaaaaaagcgttacacatgttgttacatatgccgatttgtacacagacggatgaatggcttacgaaaaccgaggaatggaaagcagaataccctctttcctataatcaaaaagaaagtgatttaaaaccgcagcatgttattagcttagtaagtgaattaacgaatggtgaagcgattgttacgacagaagtaggacagcatcaaatgtgggctgcgcatttttataaagcgaaaaatccacgaacttttctcacatctggcggactaggaacgatggggtttggtttcccggcggcaattggtgctcagcttgcgaaagaagaagaactcgtcatttgtattgcgggtgatgcttcttttcaaatgaatattcaagaactacaaacaattgctgaaaataacatccctgtaaaagtatttattataaacaataaatttttagggatggtaaggcaatggcaagaaatgttttatgaaaatcgtttatcagaatcaaaaattggatcgccagattttgtgaaagtggcagaagcttatggagtgaaggggttaagggctacaaattcaatagaggcgaaacaagtgatgttagaagcaattgctcatgaaggtcctgtcgtagttgatttttgtgtagaagaaggtgaaaacgtatttccgatggttccgccaaataaagggaataacgaaatgattatgaagaggtgggaagaatga

SEQ ID NO: 82281 - protein, 571 aa, Bacillus cereus ATCC 10987
MKQQYTAYEKLQYEEMTGAGHVIQCLKKLGVTTVFGYPGGAILPVYDALYGSGLKHVLTRHEQAAIHAAEGYARASGKVGVVFATSGPGATNLVTGLADAYMDSIPLVVITGQVAKSLIGKDGFQEADVVGITVPVTKHNYQIRDVNHLSRIVQEAFYIAESGRPGPVLIDIPKDIQNENVTSFYNEVIEIPGYKLEPMPDSMKLKEVAKEISKAKRPLLYIGGGVIHSGGSDELIKFARENRIPVVSTLMGLGAYPPGDSLFLGMLGMHGTYAANMAVTECDLLLALGVRFDDRVTGKLELFSPYSKKVHIDIDPSEFHKNVTVEYPVVGDVKKALHMLLHMPICTQTDEWLTKTEEWKAEYPLSYNQKESDLKPQHVISLVSELTNGEAIVTTEVGQHQMWAAHFYKAKNPRTFLTSGGLGTMGFGFPAAIGAQLAKEEELVICIAGDASFQMNIQELQTIAENNIPVKVFIINNKFLGMVRQWQEMFYENRLSESKIGSPDFVKVAEAYGVKGLRATNSIEAKQVMLEAIAHEGPVVVDFCVEEGENVFPMVPPNKGNNEMIMKRWEE

SEQ ID NO: 82282 - DNA, 2007 bp, Eremothecium gossypii
  CDS (1)..(2007)
atgttaaggagagtaaccgtaagacaactagctaacgtgcgggcgttggcacgagcgacacggccgttggcagtggcgcgagccttttctggggccgcagggcggctgggcgcggaagcgcaagaagcgcctaggaggcgggcgccggggccccgcggagagacggagccgcagggtgcagcgggcgcgcacgagatggaccactcgatgatcgggttcagcggcggagagatttttcacgagatgatgcggcgccataacgtggatacggtgtttgggtacccaggcggggccatcctgccggtgtacgatgccatatacaactcggacgcgttcaactttgtgctcccgaagcacgagcagggggcgggtcacatggcggagggctacgcgcgtgcttctgggaagccgggcgtcgtgttggtgacatcggggccgggggcgaccaacgtggtgacgccgatggcggatgcgctggccgacggagtaccgatggtggtcttcaccgggcaggtgcctaaagccgcaattggcacggatgcgttccaggaagccgatgtggtcggcatttcgcgctcgtgcaccaagtggaacgtgatggtgaatcacgtggaggagctcccgcggcgcatcaacgaagcttttgagattgcgacctctggtaggcccggcccggtgcttgtggacctcccgaaggacgtgaccgccgcgattttacgcagtcccatcccactggcctctgcgctaccgtcgacgaccctagcacagctcacacggcaggcggctgacatcgacggcgtgcgctcgcttgccgacgcatcgcggctcatcaatatggcacagaagccggtactctacgtgggtgcaggaatcctgaacagcactcgcggtccagagtttctgcgtgaactggctgaaaaggcacagatccccgtcacgacgacgttgcaagcgctgggtgcattcgaccaggaggattcgaagtccgtagatatgctgggcatgcacgggagtgcggctgccaatttgactgtgcagaatgcagacctgatcattgcgctgggcgcacggtttgatgaccgcgtgaccggaaacatcgctaagttcgccccggaggcccagcgggcggcccgtgaacagcgcggtgggatagtgcactttgagatctccccaaaaaatatcaacaaggtggttgacgctcaggtggcagtcgagggtgatgtgactgccaacctggaaaagctgctccccttgatcaagccggtcgctgagcgcaaagagtggctcggccagatcgcaagttggaagagcgagtatccatatgattactcgcgcgagacgcccggctcgcgcatcaagcctcagacagttatcactcggctctccgaaatcgcaaacgccaccggaaaggaggtcatcgtgacgaccggtgtaggtcagcaccaaatgtgggccgcccagcattggacgtggaagaaaccacgcacatttatcacatcaggcggcctcggtaccatgggctttggtctaccggcggccattggtgcccaggtagccaaacccgatgcgattgtcatcgacatcgatggcgacgcctcgctcaacatgaccttgatggagatgtccagcgcggtgcaggcgggcgccccagtaaagatattgttgttgaacaacgaagagcagggaatggtcactcaatggcagtctctattctacgagcatcgttattctcacacccatcagctaaatccggacttcgtcaagttggctgatgcaatggggttcaaagcaatgcgcctagaggcgcagtcggacatggagcccatgctgcaggagtttattaattgcaaggagcccgtgttactcgaagtggccgtcgagaagaaggttcccgtcctcccgatggtccctgccggtaaggccctgcatgagtttatctacttcgacccagaggtcgagcgacagcaagcggagcttcgcagcaggcgtacgggcgggaagcattag

SEQ ID NO: 82283 - protein, 668 aa, Eremothecium gossypii
MLRRVTVRQLANVRALARATRPLAVARAFSGAAGRLGAEAQEAPRRRAPGPRGETEPQGAAGAHEMDHSMIGFSGGEIFHEMMRRHNVDTVFGYPGGAILPVYDAIYNSDAFNFVLPKHEQGAGHMAEGYARASGKPGVVLVTSGPGATNVVTPMADALADGVPMVVFTGQVPKAAIGTDAFQEADVVGISRSCTKWNVMVNHVEELPRRINEAFEIATSGRPGPVLVDLPKDVTAAILRSPIPLASALPSTTLAQLTRQAADIDGVRSLADASRLINMAQKPVLYVGAGILNSTRGPEFLRELAEKAQIPVTTTLQALGAFDQEDSKSVDMLGMHGSAAANLTVQNADLIIALGARFDDRVTGNIAKFAPEAQRAAREQRGGIVHFEISPKNINKVVDAQVAVEGDVTANLEKLLPLIKPVAERKEWLGQIASWKSEYPYDYSRETPGSRIKPQTVITRLSEIANATGKEVIVTTGVGQHQMWAAQHWTWKKPRTFITSGGLGTMGFGLPAAIGAQVAKPDAIVIDIDGDASLNMTLMEMSSAVQAGAPVKILLLNNEEQGMVTQWQSLFYEHRYSHTHQLNPDFVKLADAMGFKAMRLEAQSDMEPMLQEFINCKEPVLLEVAVEKKVPVLPMVPAGKALHEFIYFDPEVERQQAELRSRRTGGKH

SEQ ID NO: 82284 - DNA, 1764 bp, Methanococcus maripaludis S2
  CDS (1)..(1764): transl_table=11
atgaaaggagcagaggctatgatgaaggccctagaagcagaaaatgtaaaagtcctttttggataccctgggggccaattacttcccttttacgacgcactctatcaaagtgaccttttacacattttaacaaggcacgaacaggctgcagcacacgcggctgatggatatgcaagagcaagtggcgatgtaggagtttgtgttgctacatctggtccaggtgctacaaaccttgttacaggagttgcaacggcacatgcagactcttctccagttgttgcattaactggacaggttccaacaaaattaattggaaatgatgcattccaagaaattgacgcacttggaatcttcatgccgattacaaagcacaacttccagattcaaaaaacaagcgaaattccaaaaatatttagaaaagcatttgaaattgcaaaaacgggaaggcccggtgcagttcatgttgatttgccaaaagatgttcaggatgatgatttagacttagaaaaatacccaattcctgctgaaattaatcttcaaggatataaaccaacgaaatttggacaccctttacagatcaaaaaagctgcagaattaatgaaaatcgcacaaagacctgttattatcgcaggcggcggggttcagattgcaaatgcaactcctgaacttataaaattatcagaatatgctcaaattccagtatgtactactttaatgggtaaaggcgttttccctgaagaacaccctctttcattaggtatggttgggatgcacggaacacaagcttcaaattattctgtttatgaaagcgatgttttaattgcaattggatgtaggttttcagatagaattaccggtgatctttcaagctttgcaccaaatacaaaggtaatccacatagatattgacccggcagagattggaaagaatgttggagtagatatcccaatagttggagatgcaaaagcaattttaaaagatattctgatccatttgatgaaaaaagaaatggtaaataaaacagaatggatggaaaatgttaaaaaacttcagaaaaagtccatgcctgtaatggaatttgacaacacgccgataaaacctcaaaaggttattaaagaaatgatggcagcacttagagaagttgatccaggtttaacaaacacggttcttactaccgatgtaggtcaaaatcagatgtggatggcacactatttccaaacaagcgctccaaaatctttcctttcctcaggaggtcagggtacaatgggctttggattccctgcggcaattggtgctaaatttgcaaggcctgatgcaaatgtaattgctgtaactggggacggtggatttttaatgaattcgcaggaacttgcaacaattgcagaatacgaaatacctgttatcgttgtgatatttgacaaccggacacttggaatggtttaccagtggcagaacctttattatggaaaaagacagtgtgcggtacaccttggggaaacacctgatttcttaaaacttgcagaaagctatggaatcggtgctttgagagttgaaaaacctgaagatattaatgaagctttcaaaactgcattaaacagtggaaaaccatatttactcgatatcataatcgacccgtcagaagcactgcatatggtacctcctggaggaaacatgacaaatatattattccctgaccgacaggagccaactccaaaagctcaatgctttagcgaaatgaaaaaaatacttagtcctaaggtctaa

SEQ ID NO: 82285 - protein, 587 aa, Methanococcus maripaludis S2
MKGAEAMMKALEAENVKVLFGYPGGQLLPFYDALYQSDLLHILTRHEQAAAHAADGYARASGDVGVCVATSGPGATNLVTGVATAHADSSPVVALTGQVPTKLIGNDAFQEIDALGIFMPITKHNFQIQKTSEIPKIFRKAFEIAKTGRPGAVHVDLPKDVQDDDLDLEKYPIPAEINLQGYKPTKFGHPLQIKKAAELMKIAQRPVIIAGGGVQIANATPELIKLSEYAQIPVCTTLMGKGVFPEEHPLSLGMVGMHGTQASNYSVYESDVLIAIGCRFSDRITGDLSSFAPNTKVIHIDIDPAEIGKNVGVDIPIVGDAKAILKDILIHLMKKEMVNKTEWMENVKKLQKKSMPVMEFDNTPIKPQKVIKEMMAALREVDPGLTNTVLTTDVGQNQMWMAHYFQTSAPKSFLSSGGQGTMGFGFPAAIGAKFARPDANVIAVTGDGGFLMNSQELATIAEYEIPVIVVIFDNRTLGMVYQWQNLYYGKRQCAVHLGETPDFLKLAESYGIGALRVEKPEDINEAFKTALNSGKPYLLDIIIDPSEALHMVPPGGNMTNILFPDRQEPTPKAQCFSEMKKILSPKV

SEQ ID NO: 82286 - DNA, 1833 bp, Neurospora crassa
  CDS (1)..(1833)
atggacgagtccttcatcggcaagaccggtggtgaaatcttccatgagatgatgctcagacacggcgttaagcacattttcggctatcctggcggtgccattctccccgtcttcgatgccatctacaactctccccatttcgatttcgtcctcccccgccacgaacaaggtgctggtcacatggctgagggttatgcccgtgcttctggcaagcccggtgtcgtcctcgtcacctccggtcccggtgccaccaacgtcgttacccccatggccgatgcccttgccgacggtactcccatggttgtcttctccggccaggtccccaccaccgccattggcagcgatgctttccaggaggccgacgtcattggtatttctagagcctgcaccaagtggaacgtcatggtgaagagtgtcgccgagcttccccgccgcattaacgaggccttcgagatcgctactagcggcagacctggtcccgtcctcgtcgatctccccaaggatatcaccgctggtatccttcgccgggccatccccaccgacaccgccatccccaccagccctagtgccgcctcccgcgctgccattgagctgagccgcaagcagctcgatgcctcgatccagcgtgttgccaagctcgtcaacattgccaagaagcccgtcatctacgccggccacggtgttgtccagtctaagggcggtcctgcgctcctccgcgccctttccgagaaggcctctatccccgtcaccaccaccctccacggtcttggtgctttcgatgagctcgatgaaaagtctcttcacatgctcggtatgcacggtgccgcctacgccaacatggccgtccaggaggctgatttgatcatctgcctgggtggccgtttcgacgaccgtgtcactcttaacctcaacaagtttgctcccgctgctaaggctgccgctgccgagggtcgcggtggcatcgtccacttcgagattcttcccaagaacatcaacaaggtcgtccaggctaccgaggctgtcgagggtgatgttgccaccaacattgagctcctcatccctcaggttgacgccaagaccatggccgaccgcaaggagtggttcggcaagatcaacgagtggaagtccaagtggcctctttccgactacgagcgcgccgagcgcaccggtctgatcaagccccagaccctcatcgaggagctcagcaagctcaccgagggccgcaaggagaacacctacattgccactggtgtcggccagcatcagatgtggaccgctcagcacttccgctggcgccacccccgtaccatgatcacctccggtggtctcggtaccatgggcttcggtctccccgccgccatcggcgccaaggttgccaagcccgatgctcttgtcattgacatcgacggcgacgcctccttcggcatgaccctcaccgagctctccaccgctgctcagttcaacattggcgtcaaggtcatcgtcctcaacaacgaggagcagggcatggtcacgcagtggcagaacctcttctacgacgaccgctactcgcacacccatcagaagaaccccgacttcgtcaagcttgctgatgccatgggcgtccagtctaagcgcatcatcaagcccgaggaggtcgtcgagggtctcaagtggctcatcgactcggagggccccgcccttctcgaggtcgtcactgacaagaaggttcccgtcctccctatggtccctgccggctgcggtctggatgagttcatcaccttcgaccaggagcgtgacaggaagcgtcgtgagctgatggtcaagcgtaccggtggtgtccacggtctttaa

SEQ ID NO: 82287 - protein, 610 aa, Neurospora crassa
MDESFIGKTGGEIFHEMMLRHGVKHIFGYPGGAILPVFDAIYNSPHFDFVLPRHEQGAGHMAEGYARASGKPGVVLVTSGPGATNVVTPMADALADGTPMVVFSGQVPTTAIGSDAFQEADVIGISRACTKWNVMVKSVAELPRRINEAFEIATSGRPGPVLVDLPKDITAGILRRAIPTDTAIPTSPSAASRAAIELSRKQLDASIQRVAKLVNIAKKPVIYAGHGVVQSKGGPALLRALSEKASIPVTTTLHGLGAFDELDEKSLHMLGMHGAAYANMAVQEADLIICLGGRFDDRVTLNLNKFAPAAKAAAAEGRGGIVHFEILPKNINKVVQATEAVEGDVATNIELLIPQVDAKTMADRKEWFGKINEWKSKWPLSDYERAERTGLIKPQTLIEELSKLTEGRKENTYIATGVGQHQMWTAQHFRWRHPRTMITSGGLGTMGFGLPAAIGAKVAKPDALVIDIDGDASFGMTLTELSTAAQFNIGVKVIVLNNEEQGMVTQWQNLFYDDRYSHTHQKNPDFVKLADAMGVQSKRIIKPEEVVEGLKWLIDSEGPALLEVVTDKKVPVLPMVPAGCGLDEFITFDQERDRKRRELMVKRTGGVHGL

SEQ ID NO: 82288 - DNA, 2049 bp, Magnaporthe grisea 70-15
  CDS (1)..(2049)
atgcttcgtactgttggccgcaaagccctgaggggctcatccaagggatgttcacgaaccatctcgactctcaagcccgccacggcaactattgccaagcccggcagcaggaccctttcgacgccagcgacggcaacagcaacagcacctcgaactaagcccagcgccagcttcaatgctcgccgcgatccccagcctctggtcaaccctcgctcaggtgaggcagacgaatcattcattggcaagacgggaggagagattttccacgagatgatgctgaggcaaaacgtcaagcacatcttcggttaccctggcggtgctatccttcccgtgttcgacgcgatctacaactcgaagcacatcgactttgttctgcccaagcatgagcaaggcgccggccacatggcagagggctatgctcgcgcttcaggcaaacccggcgttgttctcgtcacctccggccccggtgccacaaatgtcatcactcccatggccgacgctcttgccgacggtacacctctggttgtattctcaggacaggttgttacctctgctattggaagcgacgccttccaggaggccgacgtcataggcatctcccggtcttgcaccaagtggaacgtcatggttaagagcgttgacgagctcccgaggagaattaacgaggcctttgagattgccaccagtgggcgacctgggcctgtcttggtcgatctgcccaaggacgtcacggctagtgtgctgaggagggctatccccaccgagacctcgattccctctattagcgctgcagcacgggctgtccaagaggcaggccgaaagcagcttgagcactccatcaaacgcgtagccgatctcgtcaacattgccaagaagcccgtcatatatgccggccaaggtgtcattttgtcggaaggcggcgttgaacttctcaaggcgcttgccgacaaggcctcgattcctgtcaccaccactctgcatggtctgggagcctttgacgagctcgacgagaaggcactgcacatgcttggtatgcacggttcggcttatgccaacatgtccatgcaagaggccgatttgatcattgcccttggtggccgcttcgatgaccgtgtcactggcagcatccccaaatttgctcctgccgccaagcttgctgctgctgaaggccgcggaggtattgtccacttcgagattatgcccaagaacatcaacaaggtcgtccaagcaacagaggccattgagggcgacgttgcttcgaacttgaagctgttgctccccaagattgaacaacgatccatgaccgatcgcaaggagtggttcgaccagatcaaggagtggaaggagaagtggcctctgtcacattatgagagggccgagcgtagtggtctcatcaagcctcagactctgatcgaggagctgagcaacctgactgctgaccgcaaggacatgacctacatcacaaccggtgttggccagcaccaaatgtggacagcacaacatttcaggtggaggcacccacggtccatgatcacctctggcggtttgggtaccatgggatatggtctgccggcagcgattggcgccaaggttgctaggccagatgctttggtcattgacatcgatggcgatgcatcgttcaacatgactctgacagagctttcgacggcggcacagttcaacattggcgtcaaggtcattgtcttgaacaacgaggagcagggaatggtgacccaatggcagaacttgttctacgaggaccgctactcacatacacaccagcgcaacccagacttcatgaagctcgccgatgcaatggacgttcaacatcgccgtgtttcgaagcctgacgatgtcgttgatgctctgacgtggctgatcaacaccgacggccccgctctgctcgaggtgatgactgataagaaggttcctgttctgcccatggtgcccggaggtaacggcctgcacgagttcatcacgtttgatgccagcaaggataagcaacggagagagctgatgcgcgcgaggacgaacggcctgcacggttaa

SEQ ID NO: 82289 - protein, 682 aa, Magnaporthe grisea 70-15
MLRTVGRKALRGSSKGCSRTISTLKPATATIAKPGSRTLSTPATATATAPRTKPSASFNARRDPQPLVNPRSGEADESFIGKTGGEIFHEMMLRQNVKHIFGYPGGAILPVFDAIYNSKHIDFVLPKHEQGAGHMAEGYARASGKPGVVLVTSGPGATNVITPMADALADGTPLVVFSGQVVTSAIGSDAFQEADVIGISRSCTKWNVMVKSVDELPRRINEAFEIATSGRPGPVLVDLPKDVTASVLRRAIPTETSIPSISAAARAVQEAGRKQLEHSIKRVADLVNIAKKPVIYAGQGVILSEGGVELLKALADKASIPVTTTLHGLGAFDELDEKALHMLGMHGSAYANMSMQEADLIIALGGRFDDRVTGSIPKFAPAAKLAAAEGRGGIVHFEIMPKNINKVVQATEAIEGDVASNLKLLLPKIEQRSMTDRKEWFDQIKEWKEKWPLSHYERAERSGLIKPQTLIEELSNLTADRKDMTYITTGVGQHQMWTAQHFRWRHPRSMITSGGLGTMGYGLPAAIGAKVARPDALVIDIDGDASFNMTLTELSTAAQFNIGVKVIVLNNEEQGMVTQWQNLFYEDRYSHTHQRNPDFMKLADAMDVQHRRVSKPDDVVDALTWLINTDGPALLEVMTDKKVPVLPMVPGGNGLHEFITFDASKDKQRRELMRARTNGLHG

SEQ ID NO: 82290 - DNA, 2073 bp, Gibberella zeae PH-1
  CDS (1)..(2073)
atgctccgaagtcgccctacgagacaggctattcgcgcctttggccacgcgagggcccgaacaacgctgcccgcgacgcaaagaacaaaagccactgctaccacttctgccgcgcctcagactcgcccggtgcccagccctgccttcaacttggagcccgaatctcgccgtcatgttcagcctcttgtcaaccgatcaaatcccgagatggatgagtctttcattggaaagtccggtggcgagatctttcacgagatgatgctcagacacgatgtgaagcatatttttggctaccccggaggtgctatccttcccgtctttgacgctatctacaactcgaaacacttcgactttatcctgccccgacacgaacaaggtgccggccacatggcacaaggctacgcacgagccaccggtaagcctggtgttgtactcgtcacatcaggcccaggagcgaccaatgtcatcacacccatgcaagatgctctctcagacggcactcccatcgtggtctttactggacaggtcgtgacaagtgccatcggatcggacgcgttccaagagtgcgatactgtgggcattagcaggagtgcatgcaagtggaattgcatggttacaagcattgctgagctaccgcgacgaattaacgaggctttcgagattgctactagcggtcgtcctggtcccgttcttatcgatcttcctaaggatattacagccggaattcttcgaaaggctataccgacacaaactcgcctgccctctatcccaagcatggcttctcaaaccgccaaacaagtaatggagaagcagcttaacgcctccctgagtcgtgctgctgatcttatcaagatagccaagcagcctatcatttacgctggccagggcattatccagtctgaaggtggaactgagcttcttcgcgagctggccgacaagtgctctatccctgttacgacaaccctccagggtcttggcgcatttgatgagcgtgacgagaagtcactacaaatgcttggtatgcacggcatggcatatgccaacatgtcaatgcaggaggccgacctgattattgcccttggcgcgcgctttgacgatcgcgttgtcttaaatacttcaaaatttgctcctaatgccaaggccgcagcagctgagaagcgaggcggcattatccattttgatatcttgcccaagaacatcaacaaggtcattcaagcaactgaggccattgagggcgatgttgctactaacctcaagatgctcatgcctatgcttacacccacaagcatggagcaacgaagcggatggttcaacaagatttctgaatggaaggctaagtggcccctgtccaactatgagcactctgacgctccgggaggcagcggtctcattaagcctcagaccctgattgaagagctgagcgatctcacctctaaaattgacaagaagacaattatctccactggagtcggtcagcatcaaatgtgggtagcacagcactacttgtggagagagcctcgatcatttgtcacaagtggtggactaggcacgatgggctttggactgccaagtgcgatcggaattgcggtggcgaaaccagacgccctcgtgatcgacatcgacggcgatgcgtccttcaacatgaccctaacagagctctccaccgctgctcaatttaacatcggcgtcaaggttattattctcaacaacgaggagcaaggcatggttacccaatggcagaacctgttttacgaggatcgctatgcacacacccaccagaagaaccccgactttatcaagctagccgacgcaatgggcgtgcaggcgagaaaggtcaccaagccagatgacgttcgggctagcctcgagtggctcatcaacacagacggcccagctcttcttgaggttgttaccgacaagaaggtccctctcctgcctatggtaccagcaggcgctggtctccacgagttcttggtttatgacaaggcgttcgattacagagaaggacaaggctcgacgtcagctaatgcgcgagcgaaccagtggtcttcacggttcttgatcaaaaagtga

SEQ ID NO: 82291 - protein, 690 aa, Gibberella zeae PH-1
MLRSRPTRQAIRAFGHARARTTLPATQRTKATATTSAAPQTRPVPSPAFNLEPESRRHVQPLVNRSNPEMDESFIGKSGGEIFHEMMLRHDVKHIFGYPGGAILPVFDAIYNSKHFDFILPRHEQGAGHMAQGYARATGKPGVVLVTSGPGATNVITPMQDALSDGTPIVVFTGQVVTSAIGSDAFQECDTVGISRSACKWNCMVTSIAELPRRINEAFEIATSGRPGPVLIDLPKDITAGILRKAIPTQTRLPSIPSMASQTAKQVMEKQLNASLSRAADLIKIAKQPIIYAGQGIIQSEGGTELLRELADKCSIPVTTTLQGLGAFDERDEKSLQMLGMHGMAYANMSMQEADLIIALGARFDDRVVLNTSKFAPNAKAAAAEKRGGIIHFDILPKNINKVIQATEAIEGDVATNLKMLMPMLTPTSMEQRSGWFNKISEWKAKWPLSNYEHSDAPGGSGLIKPQTLIEELSDLTSKIDKKTIISTGVGQHQMWVAQHYLWREPRSFVTSGGLGTMGFGLPSAIGIAVAKPDALVIDIDGDASFNMTLTELSTAAQFNIGVKVIILNNEEQGMVTQWQNLFYEDRYAHTHQKNPDFIKLADAMGVQARKVTKPDDVRASLEWLINTDGPALLEVVTDKKVPLLPMVPAGAGLHEFLVYDKAFDYREGQGSTSANARANQWSSRFLIKK

SEQ ID NO: 82292 - DNA, 2211 bp, Ustilago maydis 521
  CDS (1)..(2211)
atgacaagcttcgccgtgcagtttgcacgccagcaaaggcatgctttccaggcagcctcaaaattttcggctgcttccacttcatccattgccgtctcggccgctgcttccacgtcgtacgcatctacaccttgtgccaccagggcattctccaccgccaggaacaacctgtctcgctctgcgcagctcgcaagatcgcaacgtagccagctagccctcacaagacacatctccacaaatcagcccaaggaacaggctgctgccgctgctcagaccgcggccagtgtccgtcccgagccttcgcctgcgttccagcagtctccccaaaacattgctcctctcgcttctagatacgatgccaacgctctcgatgagtcatttgttggtctctcgggtggtgccatctttcacgagatgatgctccgacacaacgtcaagcacgtctttggttaccccggtggcgctatccttcccgtctttgacgccatctacaactcgaagcactttgactttgtccttccacgaagagaggacggtgccggccacatggctgaaggctacgcccgtgttaccggcaagcccggtgtcattctcgtcacttcgggccccggtgccaccaacgtcatcacaccgatgcaggacgccatgagtgatggaacccccctggtcgtcttctgtggtcaggtcgcaacctctgccatcggctcggatgctttccaggaagccgatgtcgtcggcatttcgaggtcatgtacaaagtggaacgtcatggtcaaggacattgccgaactaccgcgtcgcatcaacgaggctttcaagatcgccacctctggccgtcctggtcccgttctcgtcgacctacccaaagacgtcacggctggtatccttcgccaggccatcccatacagccagacgcagcccaacatgatcaccaacctgcctagccgacaggttgcacgcaaccgtcggggcgccaccttccagcagagcgccaacctgcgctcctctgaacaggacatcctcacctctgagctgcaagaagccgctcgtctcattggtattgccaaacgacccatcatttatgccggtcagggtatcctctcttcccccgagggtcccaagctgcttgccaagctcgccaaggagcacaacattcctgttaccaccacactccagggtctgggtgccttcgacgagctcgactctctcagtctgcacatgctcggaatgcacggttcggcgtacgccaaccttgccatgcaagatgctgatctcatcatcgcgcttggcgctcgattcgatgaccgtgttacgggtaagatcgacaagttcgctcctcatgcccgtgcggctgcgcttgagaaccgcggtggtatcatccactttgaagtcatgcccaagaacatcaacaaggtggtccaggccacctgcgctattgagggtgatgtcgtcaccaacctcggcaagctgatgccttacctcaaaagcaacgctcccgacaggagcgagtggcaccagctcatcaagtcgtggaaggaggcttaccccttcacctatgagccatctaaggaaggagagcttatgaagcctcaggaagtgattgaagcccttgatgctgccgttgccgatcagaaggacaacgtcatcatctcgactggtgtcggacagcaccagatgtgggctgcacagcactaccgctggcgtcatcctcgcacctgggtgtcgtctggtggtctcggaaccatgggtttcggcctgccctcgtgcattggtgccaaggtcgctgctccggaaaagattgtcgttgacatcgatggcgatgcgtccttttccatgactgctatggagctcgccacagcagcccagtacaacatcggcgtcaaggtgcttgtgctcaacaacgagttccagggaatggtggtgcagtggcaagatctcttctacgagaaacgttactctcacaccgagatgcacaaccctgattttgtcaagctcgccgaaagtatgggcgtcaaggccatccgctgtgacacgatcgctgaactgccagccaagatgaaggagttcatcgagtatgacaacaacaagcccgtcctgttcgaggcaagaatcaccaagaacgagcacgtctatccattctgccccgccaacgccggtttgcacgagctgattgttcatcccagtctcaagcctgtacctaagaggagctaa

SEQ ID NO: 82293 - protein, 736 aa, Ustilago maydis 521
MTSFAVQFARQQRHAFQAASKFSAASTSSIAVSAAASTSYASTPCATRAFSTARNNLSRSAQLARSQRSQLALTRHISTNQPKEQAAAAAQTAASVRPEPSPAFQQSPQNIAPLASRYDANALDESFVGLSGGAIFHEMMLRHNVKHVFGYPGGAILPVFDAIYNSKHFDFVLPRREDGAGHMAEGYARVTGKPGVILVTSGPGATNVITPMQDAMSDGTPLVVFCGQVATSAIGSDAFQEADVVGISRSCTKWNVMVKDIAELPRRINEAFKIATSGRPGPVLVDLPKDVTAGILRQAIPYSQTQPNMITNLPSRQVARNRRGATFQQSANLRSSEQDILTSELQEAARLIGIAKRPIIYAGQGILSSPEGPKLLAKLAKEHNIPVTTTLQGLGAFDELDSLSLHMLGMHGSAYANLAMQDADLIIALGARFDDRVTGKIDKFAPHARAAALENRGGIIHFEVMPKNINKVVQATCAIEGDVVTNLGKLMPYLKSNAPDRSEWHQLIKSWKEAYPFTYEPSKEGELMKPQEVIEALDAAVADQKDNVIISTGVGQHQMWAAQHYRWRHPRTWVSSGGLGTMGFGLPSCIGAKVAAPEKIVVDIDGDASFSMTAMELATAAQYNIGVKVLVLNNEFQGMVVQWQDLFYEKRYSHTEMHNPDFVKLAESMGVKAIRCDTIAELPAKMKEFIEYDNNKPVLFEARITKNEHVYPFCPANAGLHELIVHPSLKPVPKRS

SEQ ID NO: 82294 - DNA, 2094 bp, Aspergillus nidulans FGSC A4
  CDS (1)..(2094)
atgatgcctttaagaccatcaaaaagcgccctgcgcactctgcattatcagaggtacattgcctctggacgaagagcctttgcttctgcggtctcgacgccccaccgcttttcgactcagaagcgcgaccagagcacagcaacggctactgcttcaacctcccgccctagacccagccctgccttcaaccaagagccaagccgcaatgaagtatcacctctccagaatcgacagcttcccgagctcgacgactcgtatggcattctcattcttttcgtccaaatattcgtcggactcagcggtggtgagatattccacgagatgatgctgcgcctgggtgtgaagcacgtttttggctaccctggaggtgccattcttcccgtcttcgacgcaatttacaactctaagcacttcgacttcatcctgcctcgacatgaacagggtgcgggccacatggcagaaggttatgctcgtgcttctgggaagcctggtgttgtccttgtcacttctggtcccggtgctaccaatgtcattactcccatgcaggacgccttctctgatggtacccccatggttgtcttctgtggtcaggttgtcactacctccatcggcacagactccttccaggaagccgacgtggttggtatctctagggcatgcaccaagtggaacgttatggtcaagtccgtcgccgaacttccccgccgtatccaagaagctttcgaaattgctactagcggtcgtcctggtcctgtcctcgtcgatcttcccaaggatatcaccgcaggtatcctccgtaaacccattcctatgcagagcactcttccttctcgcccgagcgccgcgactctggcggccaaggaattgagtgagaagcagcttcacagcaccatcaatcgcgtggcccgtctcgtcaacgtcgccaagaaacctgtactctacgttggtcagggtatcctcgaaaaccccgacggccccaaactcctgaaggagctggccgacaaggcttgcattcctgttactacaactttgcaaggtcttggcggctttgacgagctcgaccccaaatccctgcacatgcttggtatgcatggctctgcctatgcaaacttggctatgcaggaagccgatttgatcatcgcccttggtgctcgctttgatgatcgtgtgactggtagcatcgctaaatttgctccccaggctaagctcgctgcttcggaaaatcgtggtggtattgttcacttcgagatcatgccgaagaacatcaacaaggttgtgcaagcaaacgaggctgttgagggtgactgtgctgagaacattcgacacctccttcctcttgttgaacctgtctccgaaagaccagagtggtttgcccaaatcaatgactggaagacccggttcccgctctctctctacgagaaacagactcctgacggccccatcaagccgcaggctttgattgagaagctcagtgatcttactgctcacatgaaagaccgcactatcattaccactggtgttggacagcaccaaatgtgggccgcccagcacttccgttggcgccgtccccgctccatgatcacttctgggggtcttggtactatgggctacggcctgccggctgctattggtgccaaagttgcccgccctgactgccttgttatcgatatcgatggcgatgcctcctttaacatgactctcactgagcttaccactgctgcccagtttaacattggcatcaaggtccttctcttgaataacgaggagcagggcatggtgacccaatggcaaaacctgttctacgaggaccgctactcccacactcaccagaagaaccctgatttcgtgcgtcttgctgaggctatgggtgttgctgccgagcgctgcaccaagccctcagaagtggagtccaagctgaagtggctgatcgagagtgatggacctgccttgctcgaggtattcaccgaccgtaaggtgcccgtgttaccaatggttcctggtggtagcggcctgcacgagttcctcgttttcgacgaagccaaggaccgtgagaggagggctttaatgaagaaaaggaaccctaacggcgtttaa

SEQ ID NO: 82295 - protein, 697 aa, Aspergillus nidulans FGSC A4
MMPLRPSKSALRTLHYQRYIASGRRAFASAVSTPHRFSTQKRDQSTATATASTSRPRPSPAFNQEPSRNEVSPLQNRQLPELDDSYGILILFVQIFVGLSGGEIFHEMMLRLGVKHVFGYPGGAILPVFDAIYNSKHFDFILPRHEQGAGHMAEGYARASGKPGVVLVTSGPGATNVITPMQDAFSDGTPMVVFCGQVVTTSIGTDSFQEADVVGISRACTKWNVMVKSVAELPRRIQEAFEIATSGRPGPVLVDLPKDITAGILRKPIPMQSTLPSRPSAATLAAKELSEKQLHSTINRVARLVNVAKKPVLYVGQGILENPDGPKLLKELADKACIPVTTTLQGLGGFDELDPKSLHMLGMHGSAYANLAMQEADLIIALGARFDDRVTGSIAKFAPQAKLAASENRGGIVHFEIMPKNINKVVQANEAVEGDCAENIRHLLPLVEPVSERPEWFAQINDWKTRFPLSLYEKQTPDGPIKPQALIEKLSDLTAHMKDRTIITTGVGQHQMWAAQHFRWRRPRSMITSGGLGTMGYGLPAAIGAKVARPDCLVIDIDGDASFNMTLTELTTAAQFNIGIKVLLLNNEEQGMVTQWQNLFYEDRYSHTHQKNPDFVRLAEAMGVAAERCTKPSEVESKLKWLIESDGPALLEVFTDRKVPVLPMVPGGSGLHEFLVFDEAKDRERRALMKKRNPNGV

SEQ ID NO: 82296 - DNA, 2034 bp, Candida glabrata CBS138
  CDS (1)..(2034)
atgacgagaagagggctaacggatccaatgatacgtattagtggggtagtagcgagagcatgccgtcgtagtgcggcgtatcaggtttgcaagtacagtgtgcgggcggttcccaggccggagccctcgccgagtttcaatgttgatcccgatacagcggctgctaataccgggagtggtgtgaagttgagttctaagctgaagaatgtggcgacgcagaagatggacaactcgtttgtgggtctgaccggtgggcagattttcaacgagatgatggcgcgcaacaatgtggacactgtgtttgggtaccctggtggtgcgatcttgccggtgtacgatgcgatccacaactccgacaagttcaagtttgtgttgcctaagcacgagcaaggtgcgggccacatggccgagggttacgcaagggcctccggtaagccaggtgtcgtgttggttacttcgggtcctggtgccacgaacgttgtgactcccatggccgatgcgctggctgacggtattcctatggttgtgtttacgggccaagtgcccaccactgccattggtaccgatgcgttccaagaagccgacattgttggtatctccagatcctgtacaaaatggaacgtgatggtgaagaacgtagcggagctgccactgagaatcaacgaggccttccagattgccacgagcggcagacccggcccagtgttggtggacttgccaaaggacgtcacagccgccatcctgagaacaccaatcccagttaagagcaccctgccatcaaccgcattgcaacagttgactgcaggtgtccaggaccaattcgttattgaaaacatcaagaaatctgccgacttgataaatatcgccaagaatccagtcctttacgtcggtggtggtatcctgaacaatgtcgatgggccaagattggtcaaagagctaagtgagcgtgcgcagatcccagttaccactactttacaaggtttgggtgcattcgaccaagaagatccaaagtctctagacatgctgggtatgcatggttgtgccactgcaaaccttgccgtccagaactccgacttgatcatcgccgtcggtgccagattcgacgaccgtgtcaccggtaacatcactaagtttgcaccagaagcaagaaaggccgcattggaaggtagaggtggtatcattcactttgaaatcactccaaagaacataaataaagtcgtagaagcacaagtggcagtagaaggtgacgctgcttccaacttatccaagttgatcccattggtattcccagtgaaggaaagaccagaatggttcgaaaagattaataagtggaagaaggaattcccatacagttactccctagagactccaggttctagaatcaaaccacaaactgccattgccaagttgtcaaagattgccaatgctaccagcaaggaagttattgttacaaccggtgtcggccaacatcaaatgtgggctgctcaacactggacatggaagaacccacgtactttcatcacttctggtggtctaggtaccatgggttacggtttgccatctgctatcggtgcccaagtcgctaagccagacgccttagtcattgacattgacggtgatgcttctttcaacatgtccttacaggaactaagttctgctgtgcaagctaatgctcctgtaaaaattctagtgctaaacaacgaagagcaaggtatggtcacccaatggcaatctctattctacgagcatcgttactcacacacacatcaattgaacccagatttcgtaaaacttgcggaggcaatgggtatgaagggtatgagagtgaaagaccaagccgagcttgaaaagactctaaaagagtttgttgactaccagggtccagtcttgcttgaagtcgaagtagagaagaaggtgccagtcttgccaatggtcccagccggtaagggtttacacgaatttattaactacgacccagaaatggaaagggaacagaacgaactacgtcacaagcgtaccggtggtaagcattaa

SEQ ID NO: 82297 - protein, 677 aa, Candida glabrata CBS138
MTRRGLTDPMIRISGVVARACRRSAAYQVCKYSVRAVPRPEPSPSFNVDPDTAAANTGSGVKLSSKLKNVATQKMDNSFVGLTGGQIFNEMMARNNVDTVFGYPGGAILPVYDAIHNSDKFKFVLPKHEQGAGHMAEGYARASGKPGVVLVTSGPGATNVVTPMADALADGIPMVVFTGQVPTTAIGTDAFQEADIVGISRSCTKWNVMVKNVAELPLRINEAFQIATSGRPGPVLVDLPKDVTAAILRTPIPVKSTLPSTALQQLTAGVQDQFVIENIKKSADLINIAKNPVLYVGGGILNNVDGPRLVKELSERAQIPVTTTLQGLGAFDQEDPKSLDMLGMHGCATANLAVQNSDLIIAVGARFDDRVTGNITKFAPEARKAALEGRGGIIHFEITPKNINKVVEAQVAVEGDAASNLSKLIPLVFPVKERPEWFEKINKWKKEFPYSYSLETPGSRIKPQTAIAKLSKIANATSKEVIVTTGVGQHQMWAAQHWTWKNPRTFITSGGLGTMGYGLPSAIGAQVAKPDALVIDIDGDASFNMSLQELSSAVQANAPVKILVLNNEEQGMVTQWQSLFYEHRYSHTHQLNPDFVKLAEAMGMKGMRVKDQAELEKTLKEFVDYQGPVLLEVEVEKKVPVLPMVPAGKGLHEFINYDPEMEREQNELRHKRTGGKH

SEQ ID NO: 82298 - DNA, 2076 bp, Kluyveromyces lactis NRRL Y-1140
  CDS (1)..(2076)
atgctcagtcagaggtttgtaacgcgggctttggccagacgtgcttttggtaagacatgcttgaaattaggaagtgcaagtgcaagtgcaagtaacgctgcttctgctgctgccggtgaggctagtagcaggccacagcctgctcctagctttaacgctgatatagctggtggttcttctggcggtgccagaagaaaccagatcccattgtcgaagagatcgagaatcgcagacaagaatactggtgtcaacattcaaaaccagatggatgattcgttcattggaatgaccggtggtgagatcttccacgagatgatgcaacgtcacaacgtcgacaccgtttttggataccctggtggtgcgattttgcccgtgtacgacgcaatctacaactcagataaattcacttttgttctaccaaaacatgaacaaggtgcaggtcacatggcagagggatacgcaagagcctcagggaaaccaggtgttgttttggtgacttcaggtccaggtgcgactaatgtggtgactcctatggcagatgcattggcagacggtgtgccgttggtggtgtttacaggtcaagtggccacgtcagctatcggaacagatgctttccaagaagcagatgtggttggtatctctagatcttgtaccaaatggaacgtgatggtgaaaaccattgaggaactgcctcgtagaatcaacgaagcgtttgaaatcgcaacttccggtagaccgggccccgttttggtggatttaccaaaggacgtgacggcggcggtgctaagaaacccaattccaatgaagtctattctaccatctgatactctaaatcagttgactcaaagagtcgtcgatgagttcactttggaaaacattagcagggctgctgacttgatcaacagggctaagaagcctttgctatacgtgggtgctggtattctaggcagcgaaatgggtcctcaatacttgaagcaactaagtgacagagctcagatcccagtcaccacgactctacaaggtcttggtgcgttcaaccaagaagatcataaatctttggatatggtcggtatgcacggtaatgctgcagccaacttggccatccaaaacgccgatttgatcattgcattgggtgccagatttgacgatcgtgtcactctgaatatttccaaatttgctccagaggctagaaaggctgctctagagaaacgtggtggtatcgttcatttcgaaatctccccaaagaatatcaacaaggttgtcgaagccgaggtcgctgtcgaaggtgatgtgactcgtaacttggaaaaattgttgccattggtcgaatctgttcctgaaagaccagaatggtccgctcaagtggctaaatggaaacaagaatacccatacgcgtaccaaaaggagactccaggttctaagattaaacctcaaaccgttatctccaagttgtccgatttggtcttgaaatccggtagaccagccatcgtcaccactggtgtcggtcaacatcaaatgtgggctgctcaacactggacttggaaaagtccaagatctttcatcacttccggtggtcttggtaccatgggttacggtctaccagctgctatcggtgctcaagtcgccagacctgacgctatcgtcatcgatatcgacggtgatgcctctttcaacatgactctgatggaattgtcctccgctgttcaagctcgtacaccagtcaaggtcttgttgctaaataacgaggaacaaggtatggttacccaatggcaatctctcttctacgaacaccgttactcgcatacccatcaactgaatccagatttcgttaaattggccgaagctatgggtctgaaggctctcagactctcgaaacaagaggacactgacgccatcttgaaagaattcgttgactacgagggcccaatcttattggaagtgcaaatcgaaaagaaggttcctgtcttgccaatggtcccaaccggtaagggtctacacgaattcatcaactttgatccagaagtagaaaaggaacaaaacgaactacgtcacaaacgtactagtggtaaatattga

SEQ ID NO: 82299 - protein, 691 aa, Kluyveromyces lactis NRRL Y-1140
MLSQRFVTRALARRAFGKTCLKLGSASASASNAASAAAGEASSRPQPAPSFNADIAGGSSGGARRNQIPLSKRSRIADKNTGVNIQNQMDDSFIGMTGGEIFHEMMQRHNVDTVFGYPGGAILPVYDAIYNSDKFTFVLPKHEQGAGHMAEGYARASGKPGVVLVTSGPGATNVVTPMADALADGVPLVVFTGQVATSAIGTDAFQEADVVGISRSCTKWNVMVKTIEELPRRINEAFEIATSGRPGPVLVDLPKDVTAAVLRNPIPMKSILPSDTLNQLTQRVVDEFTLENISRAADLINRAKKPLLYVGAGILGSEMGPQYLKQLSDRAQIPVTTTLQGLGAFNQEDHKSLDMVGMHGNAAANLAIQNADLIIALGARFDDRVTLNISKFAPEARKAALEKRGGIVHFEISPKNINKVVEAEVAVEGDVTRNLEKLLPLVESVPERPEWSAQVAKWKQEYPYAYQKETPGSKIKPQTVISKLSDLVLKSGRPAIVTTGVGQHQMWAAQHWTWKSPRSFITSGGLGTMGYGLPAAIGAQVARPDAIVIDIDGDASFNMTLMELSSAVQARTPVKVLLLNNEEQGMVTQWQSLFYEHRYSHTHQLNPDFVKLAEAMGLKALRLSKQEDTDAILKEFVDYEGPILLEVQIEKKVPVLPMVPTGKGLHEFINFDPEVEKEQNELRHKRTSGKY

SEQ ID NO: 82300 - DNA, 2025 bp, Debaryomyces hansenii CBS767
  CDS (1)..(2025)
atgattgctcgtaatataaaggccacatcttgccaaagagcctttagaatggctagtagccaagttagatgtatgaataagactagctttctgaaagcaactatgagtgctagttcaagacctacgccggccccttcattcgatcaacaagatccaagcagcggagccactgagttaaagaaaaacgttgtaagaaagagtcaatatccaatcatggatgactcatttattgggttaactggtggtgagatcttccatgaaatgatgttgagacacaaggttgataccgtttttgggtatgctggaggtgccattttacctgttttcgacgctatctacaactctgataaattcaattttgttttaccaagacacgaacaaggtgctggacacatggctgaaggttatgctagagcatgcgggaagccaggtgttgtgttggttacttcaggaccaggtgccacgaatgttattacaccaatgaccgatgccttggctgatggtattccattggttgttttcactggtcaggttccaaccactgcaattggaaccgattcattccaagaagccgatgttattggtatttctagatcttgtaccaaatggaatgtcatggttaagaatattgctgaattaccaagacgtataaacgaagcttttgaaattgctacttcgggaagaccaggtccagtcttggttgatttaccaaaggatgttactgcaggtatcttaagagaatccatcccaataaatactaccttaccatcaaatgctttaactcaaatcactaagaaggttgctactgaattcaccatggaaagtatcagaaggtctgcacaactcttgaatatcgccaagaaaccaattctttacgttggtaatggtattttaaaccacgaacaaggtccagcattattaaaagagttagccgacaaagcatgtattcctgtcacaactactatccaaggtttaggtgcttttgatcaaagagatccaaaatctttagatatgttaggtatgcatggtagcgctgctgcaaacactgccatgcaaaatgctgatttaatcattgccttaggtgcaaggtttgacgatagagttactggtaatgttagcaaatttgctcctgctgctaaattagctgcttctgaaaacagaggtggtatcattcattttgaaatctctccaaagaacataaataaggttgtcgaagcaactgaggctgttgaaggtgatgttaccaacaacttgagcaagtttattccattagtggatgctgttaaagaaagaccagaatggatgggtgaagtccaaacatggaaagaaaagtacccatacgcttaccaattggaaaccccaggttcattaatcaaacctcaaactcttatcagagaaatctcaaaacaatcttctacatatggaaaggacgtttacgttacaactggtgtcggtcaacatcaaatgtgggccgctcaacatttcacatggaccaagccaagaactatgatcacatcgggtggtttaggtactatgggttacggtttaccagccgctattggtgcccaagttgccaagccagatgctatggttatcgatattgatggtgatgcttcattcaatatgactttgactgaattatcctcggcggttcaagctaacgcaccaattaaggtttgtgtcttgaataacgaagaacagggtatggttactcaatggcaatcattgttctacgaacacagatattctcacacccatcaatccaatccaaacttcatgaaattagctgatgccatgggtgttaagggtattaagatttctactcaagaagaattagttagtggtatcaaggaattcttagactacgcaggtcctgtcttattagaagttattgttgaaaagaaggttcctgttttaccaatggttccaggtggtaatgcattagatgacttcattattttcgatgctgatgttgaaagaaaagaaaatgaattaagaaatcaaagaaccggtggtaaacattga

SEQ ID NO: 82301 - protein, 674 aa, Debaryomyces hansenii CBS767
MIARNIKATSCQRAFRMASSQVRCMNKTSFLKATMSASSRPTPAPSFDQQDPSSGATELKKNVVRKSQYPIMDDSFIGLTGGEIFHEMMLRHKVDTVFGYAGGAILPVFDAIYNSDKFNFVLPRHEQGAGHMAEGYARACGKPGVVLVTSGPGATNVITPMTDALADGIPLVVFTGQVPTTAIGTDSFQEADVIGISRSCTKWNVMVKNIAELPRRINEAFEIATSGRPGPVLVDLPKDVTAGILRESIPINTTLPSNALTQITKKVATEFTMESIRRSAQLLNIAKKPILYVGNGILNHEQGPALLKELADKACIPVTTTIQGLGAFDQRDPKSLDMLGMHGSAAANTAMQNADLIIALGARFDDRVTGNVSKFAPAAKLAASENRGGIIHFEISPKNINKVVEATEAVEGDVTNNLSKFIPLVDAVKERPEWMGEVQTWKEKYPYAYQLETPGSLIKPQTLIREISKQSSTYGKDVYVTTGVGQHQMWAAQHFTWTKPRTMITSGGLGTMGYGLPAAIGAQVAKPDAMVIDIDGDASFNMTLTELSSAVQANAPIKVCVLNNEEQGMVTQWQSLFYEHRYSHTHQSNPNFMKLADAMGVKGIKISTQEELVSGIKEFLDYAGPVLLEVIVEKKVPVLPMVPGGNALDDFIIFDADVERKENELRNQRTGGKH

SEQ ID NO: 82302 - DNA, 1935 bp, Oryza sativa (japonica cultivar-group)
  CDS (1)..(1935)
atggctacgaccgccgcggccgcggccgccgccctgtccgccgccgcgacggccaagaccggccgtaagaaccaccagcgacaccacgtccttcccgctcgaggccgggtgggggcggcggcggtcaggtgctcggcggtgtccccggtcaccccgccgtccccggcgccgccggccacgccgctccggccgtgggggccggccgagccccgcaagggcgcggacatcctcgtggaggcgctggagcggtgcggcgtcagcgacgtgttcgcctacccgggcggcgcgtccatggagatccaccaggcgctgacgcgctccccggtcatcaccaaccacctcttccgccacgagcagggcgaggcgttcgcggcgtccgggtacgcgcgcgcgtccggccgcgtcggggtctgcgtcgccacctccggccccggggcaaccaacctcgtgtccgcgctcgccgacgcgctgctcgactccgtcccgatggtcgccatcacgggccaggtcccccgccgcatgatcggcaccgacgccttccaggagacgcccatagtcgaggtcacccgctccatcaccaagcacaattaccttgtccttgatgtggaggacatcccccgcgtcatacaggaagccttcttcctcgcgtcctcgggccgtcctggcccggtgctggtcgacatccccaaggacatccagcagcagatggccgtgccggtctgggacacctcgatgaatctaccagggtacatcgcacgcctgcccaagccacccgcgacagaattgcttgagcaggtcttgcgtctggttggcgagtcacggcgcccgattctctatgtcggtggtggctgctctgcatctggtgacgaattgcgctggtttgttgagctgactggtatcccagttacaaccactctgatgggcctcggcaatttccccagtgacgacccgttgtccctgcgcatgcttgggatgcatggcacggtgtacgcaaattatgccgtggataaggctgacctgttgcttgcgtttggtgtgcggtttgatgatcgtgtgacagggaaaattgaggcttttgcaagcagggccaagattgtgcacattgacattgatccagcagagattggaaagaacaagcaaccacatgtgtcaatttgcgcagatgttaagcttgctttacagggcttgaatgctctgctacaacagagcacaacaaagacaagttctgattttagtgcatggcacaatgagttggaccagcagaagagggagtttcctctggggtacaaaacttttggtgaagagatcccaccgcaatatgccattcaggtgctggatgagctgacgaaaggtgaggcaatcatcgctactggtgttgggcagcaccagatgtgggcggcacaatattacacctacaagcggccacggcagtggctgtcttcggctggtctgggcgcaatgggatttgggctgcctgctgcagctggtgcttctgtggctaacccaggtgtcacagttgttgatattgatggggatggtagcttcctcatgaacattcaggagctggcattgatccgcattgagaacctccctgtgaaggtgatggtgttgaacaaccaacatttgggtatggtggtgcaatgggaggataggttttacaaggcgaatagggcgcatacatacttgggcaacccggaatgtgagagcgagatatatccagattttgtgactattgctaaggggttcaatattcctgcagtccgtgtaacaaagaagagtgaagtccgtgccgccatcaagaagatgctcgagactccagggccatacttgttggatatcatcgtcccgcaccaggagcatgtgctgcctatgatcccaagtgggggcgcattcaaggacatgatcctggatggtgatggcaggactgtgtattaa

SEQ ID NO: 82303 - protein, 644 aa, Oryza sativa (japonica cultivar-group)
MATTAAAAAAALSAAATAKTGRKNHQRHHVLPARGRVGAAAVRCSAVSPVTPPSPAPPATPLRPWGPAEPRKGADILVEALERCGVSDVFAYPGGASMEIHQALTRSPVITNHLFRHEQGEAFAASGYARASGRVGVCVATSGPGATNLVSALADALLDSVPMVAITGQVPRRMIGTDAFQETPIVEVTRSITKHNYLVLDVEDIPRVIQEAFFLASSGRPGPVLVDIPKDIQQQMAVPVWDTSMNLPGYIARLPKPPATELLEQVLRLVGESRRPILYVGGGCSASGDELRWFVELTGIPVTTTLMGLGNFPSDDPLSLRMLGMHGTVYANYAVDKADLLLAFGVRFDDRVTGKIEAFASRAKIVHIDIDPAEIGKNKQPHVSICADVKLALQGLNALLQQSTTKTSSDFSAWHNELDQQKREFPLGYKTFGEEIPPQYAIQVLDELTKGEAIIATGVGQHQMWAAQYYTYKRPRQWLSSAGLGAMGFGLPAAAGASVANPGVTVVDIDGDGSFLMNIQELALIRIENLPVKVMVLNNQHLGMVVQWEDRFYKANRAHTYLGNPECESEIYPDFVTIAKGFNIPAVRVTKKSEVRAAIKKMLETPGPYLLDIIVPHQEHVLPMIPSGGAFKDMILDGDGRTVY

SEQ ID NO: 82304 - DNA, 1992 bp, Oryza sativa (japonica cultivar-group)
  CDS (1)..(1992)
atggctgccgccgccgccgccgcctcactctccgtctccgacgccgccgctaagctgcccaaaccgggagggcaagtgcaacggcgacgcgacagggatcgtccacgcgtggatgctgccgcctgcacccgcgacagccgccgtcccacgcgcgagaggtgctcgacgacggtgtccctcgccgcgaccgcgaccgcgacaacggccacgcccgtgcgcgcgccggtccggacgcgggcgcccatggggcagcggaagggcgcggacatcgtcgtcgaggcgctggagcggtgcggcgtccgcgacgtgttcgagtacccgggcggcgcgtcaatggagatccaccaggcgctgacgcggtcgccggtgatccgcaaccacctgctccgccacgagcagggggaggccttcgcggcgtccgggtacgcgcgctcgtcggggcggccgggcgtctgcgtcgccacctccggcccgggcgccaccaacctcgtgtccgcgctcgccgacgcccacctcgactccgtcccgctcgtcgccatcacggggcaggccccgcgccgcatgatcggcaccgacgcgttccaggagacgcccatcgtcgagttcacccgctccatcaccaagcacaactacctaatcctcgacgtcgacgacatcccccgcgtcatcaacgaggccttcttcctcgcgtccacgggtcgccccggcccggtgctcgtcgacatccccaaggacatccagcagcagatggccgtgccgtcctgggacgcgccgatgcgcctcccggggtacatctcccggctgccgaagccgccggccgccaacctgctcgacgaagtcatccgcctcgtcggcgacgccgagaggcccgtcctctacgtcggcggcgggtgctccgcgtcgggctacgagctgcggcgcttcgtggagctgacgggcatcccggtgacgaccaccctcatgggcatcgggaacttccccagcgacgacccgctctcgctgcggatgctcgggatgcatggcactgtgtacgccaactacgccgtcgacaacgccgacctcctcctcgcgctcggcgtgcgcttcgacgaccgcgtcaccggcaaagtcgaggcgttcgcgagcagggccaagatcgtgcacgtcgacatcgacccgtcggagctcgggaagaacaagcagccgcacgtctccatctgcgccgacgtcaagctcgccctgcagggcatgaacgcgatgctggaagaacagagcgccgccgccgcgcgcaagaacctcgatttcagcgcgtggcgctcggagctggagaagaagaaggtcgagttcccactgggctacagaacgttcggcgaggagatcccgccgcagtacgccatccaggtgctcgacgaggtcaccaacggggaggccatcgtcgccacgggcgtcgggcagcaccagatgtgggcgacgcagcactacacctacaggaggcccaggcagtggctctcgtccgccgggctgggcgccatgggcttcggcctgcctgccgccgccggcgccgcggtggccaacccgggcgccaccgtggtcgacatcgacggcgacggcagcctcctgatgaacatccaggagctcgccatggtccgcgtcgaggacctgccggtgaaggtgatggtgctgaacaaccagcacctgggcatggtggtgcagtgggaggacaggttctacgacgccaacagggcgcacacctacctcggcaacccggcggcgaacggcggcggcgaggtgtacccggacttcgtgacgatcgccggaggcttcggcatcccggcggcccgcgtgacgaggaagggcgaggtccgcgccgccgtcgaggagatgatggcggcgccggggccgtacctgctggacgtcgtcgtgcctcaccaggagcacgtgctgccgatgatccccagcaatggcgctttcaaggacattatcgtcgacggtgatggccggagttcgtattag

SEQ ID NO: 82305 - protein, 663 aa, Oryza sativa (japonica cultivar-group)
MAAAAAAASLSVSDAAAKLPKPGGQVQRRRDRDRPRVDAAACTRDSRRPTRERCSTTVSLAATATATTATPVRAPVRTRAPMGQRKGADIVVEALERCGVRDVFEYPGGASMEIHQALTRSPVIRNHLLRHEQGEAFAASGYARSSGRPGVCVATSGPGATNLVSALADAHLDSVPLVAITGQAPRRMIGTDAFQETPIVEFTRSITKHNYLILDVDDIPRVINEAFFLASTGRPGPVLVDIPKDIQQQMAVPSWDAPMRLPGYISRLPKPPAANLLDEVIRLVGDAERPVLYVGGGCSASGYELRRFVELTGIPVTTTLMGIGNFPSDDPLSLRMLGMHGTVYANYAVDNADLLLALGVRFDDRVTGKVEAFASRAKIVHVDIDPSELGKNKQPHVSICADVKLALQGMNAMLEEQSAAAARKNLDFSAWRSELEKKKVEFPLGYRTFGEEIPPQYAIQVLDEVTNGEAIVATGVGQHQMWATQHYTYRRPRQWLSSAGLGAMGFGLPAAAGAAVANPGATVVDIDGDGSLLMNIQELAMVRVEDLPVKVMVLNNQHLGMVVQWEDRFYDANRAHTYLGNPAANGGGEVYPDFVTIAGGFGIPAARVTRKGEVRAAVEEMMAAPGPYLLDVVVPHQEHVLPMIPSNGAFKDIIVDGDGRSSY

SEQ ID NO: 82306 - DNA, 2046 bp, Yarrowia lipolytica CLIB99
  CDS (1)..(2046)
atgcaatcgcgactcgcccgacgggccactaacctggccagaatctccagatccaagtattctcttggtctgcgatatgtttccaacacaaaagcccctgctgcccagccggcaactgctgaacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagtggcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaa

SEQ ID NO: 82307 - protein, 681 aa, Yarrowia lipolytica CLIB99
MQSRLARRATNLARISRSKYSLGLRYVSNTKAPAAQPATAERSQPAPHFQGTVGKPPILKKAEAANADMDESFIGMSGGEIFHEMMLRHNVDTVFGYPGGAILPVFDAIHNSEYFNFVLPRHEQGAGHMAEGYARASGKPGVVLVTSGPGATNVITPMQDALSDGTPMVVFTGQVLTSVIGTDAFQEADVVGISRSCTKWNVMVKNVAELPRRINEAFEIATSGRPGPVLVDLPKDVTAAILREPIPTKSTIPSHSLTNLTSAAATEFQKQAIQRAANLINQSKKPVLYVGQGILGSEEGPKLLKELAEKAEIPVTTTLQGLGAFDERDPKSLHMLGMHGSGYANMAMQNADCIIALGARFDDRVTGSIPKFAPEARAAALEGRGGIVHFEIQAKNINKVVQATEAVEGDVTESVRQLIPLINKVSAAERAPWTETIQSWKQQFPFLFEAEGEDGVIKPQSVIALLSDLTENNKDKTIITTGVGQHQMWTAQHFRWRHPRTMITSGGLGTMGYGLPAAIGAKVARPDCDVIDIDGDASFNMTLTELSTAVQFNIGVKAIVLNNEEQGMVTQWQSLFYENRYCHTHQKNPDFMKLAESMGMKGIRITHIDQLEAGLKEMLAYKGPVLVEVVVDKKIPVLPMVPAGKALHEFLVYDADAEAASRPDRLKNAPAPHVHQTTFEN

SEQ ID NO: 82308 - DNA, 2157 bp, Cryptococcus neoformans var. neoformans JEC21
  CDS (1)..(2157)
atgcttacacgccaatctcgtcttctcagacgcatccctcccccgaacgcagtccttcagtcgggcctccaaagaagacacaggtccactgaccgttattccaacaacatccacacgtcttccactcaaaacgccccagctcccgtgtacgatgctcccatccgcgagaaaggtatgactatcgaggccaaggagcgtgtccgggcccatgccaggaaaattcaaagcagcgcttctactgctgctgcaagtcctgctgtcagacctcaacctgcccaacactttcaggcagcgcctcagcccatgcctgctaatacgcctcgttttgaaagcgacggccaggtaaagaacgggttggactactcatttatcggtctctccggtggccaaatcttccaagagatgatgcttcgtcacgacgtaaagcaggtctttggttatcccggcggcgccattcttcctgtctttgacgccatctataactcccctcacttcgatttcgttcttccaagacacgagcagggtgctggccacatggcggaaggctacgctcgcgtttctggcaaaccaggtgttgtccttgtcacttctggtcctggcgctaccaatgtcattaccccgatgcaagatgccttgagtgacggtgtgcctatggttgtcttctgtggtcaggtcgccacgaacctgattggttccgatgctttccaagaagccgatgtcgtcggtatttctagaagttgcacaaagtggaacgttatggtcaaagacatcgctgagctcccgagaagaatcaacgaagctttcaagattgctaccaccggccgtcctggccccgttttggttgatcttcccaaggatgtgaccgctgctatcctccggacaccaatccccgctaaatctgctcaacctggtcactctccttaccttccttccaatcctctcaacccgtcatctcaaccgtccgacccccttccaggcgatgccgatttgattacagaggctgcgcagatgatcaacaaggctaagagacccattatcttcgccggtaacggtgtcctttcgtcccctgaaggccctaaacttctcaaggagctctctgacaaggggaggattcctgtgaccaccactcttcagggtctgggagccttcgacgagagagacgagaagagtttacacatgatcggtatgcatgggtctgcatacgccaactttgcgatgcaagaggcggacgtgctgattgccttgggagtgagatttgatgatcgtgtgacagggaaggttgataccttcgctcccgctgccaaagctgctgctgctgagggccgaggtggtatcattcacttcgaaatccaacccaaaaacatcaataagattgttgaggcccagattcctgtgctcggcgatgtcgttgcctctcttgcagagcttgtccctcaaattgaagccgtcgaccgatctgcctggattggccgatgcaaggctactaaggaaaggtaccccttcacatacactcctagccaggagggccagaagttgaagccccaagaggttgttcaggagcttgaccgacaggctgaagctctcggcaaggagaagtttatcatctcgactggtgttggtcaacatcaaatgtgggcctgtcagtactaccgatggactgagcctcgttcgtgggtctcttctggtggtcttggtactatgggctttggtcttccctcagctatcggcgccaaggttgccgctcctgaaaagtatgtgatagacatcgacggtgatgcaagcttttccatgactgccatggagctagccactgcaagccagtacgacatcggtgtcaaggtattgttgttcaacaatgaattccaagggatggttgagcaatggcaagaccttttctacgaaaaccgatactcccatacccgaatgaccaaccccgacttcgttaagctctcagagtctatgggaaccaaaggactcaggtgcacgaagctcgaagatctgcctcgaatgatgaaggagttcctggagtacgatggcaagaggcctatcgtacttgaatgtctcgtttctagcgaacacgtatatcctatgattcctgcaggcaaagccttacatgagcagcttctccaccctcttcttcgaaacggctctgagtaa

SEQ ID NO: 82309 - protein, 718 aa, Cryptococcus neoformans var. neoformans JEC21
MLTRQSRLLRRIPPPNAVLQSGLQRRHRSTDRYSNNIHTSSTQNAPAPVYDAPIREKGMTIEAKERVRAHARKIQSSASTAAASPAVRPQPAQHFQAAPQPMPANTPRFESDGQVKNGLDYSFIGLSGGQIFQEMMLRHDVKQVFGYPGGAILPVFDAIYNSPHFDFVLPRHEQGAGHMAEGYARVSGKPGVVLVTSGPGATNVITPMQDALSDGVPMVVFCGQVATNLIGSDAFQEADVVGISRSCTKWNVMVKDIAELPRRINEAFKIATTGRPGPVLVDLPKDVTAAILRTPIPAKSAQPGHSPYLPSNPLNPSSQPSDPLPGDADLITEAAQMINKAKRPIIFAGNGVLSSPEGPKLLKELSDKGRIPVTTTLQGLGAFDERDEKSLHMIGMHGSAYANFAMQEADVLIALGVRFDDRVTGKVDTFAPAAKAAAAEGRGGIIHFEIQPKNINKIVEAQIPVLGDVVASLAELVPQIEAVDRSAWIGRCKATKERYPFTYTPSQEGQKLKPQEVVQELDRQAEALGKEKFIISTGVGQHQMWACQYYRWTEPRSWVSSGGLGTMGFGLPSAIGAKVAAPEKYVIDIDGDASFSMTAMELATASQYDIGVKVLLFNNEFQGMVEQWQDLFYENRYSHTRMTNPDFVKLSESMGTKGLRCTKLEDLPRMMKEFLEYDGKRPIVLECLVSSEHVYPMIPAGKALHEQLLHPLLRNGSE

SEQ ID NO: 82310 - DNA, 1683 bp, Leptospira interrogans serovar Copenhageni str. Fiocruz L1-130
  CDS (1)..(1683): transl_table=11
atgaatttaaacggagctgaacttatgattcggtttttggaatttgcaggagtcgaaattgtttccggaattccagggggagctagtcttcccatctacgatgcgttatacgaaagtaaaattcgacatattcttgctagacacgaacaaggtgctggttttatagccggtgggatggcaagagcaaacggaaaacccggagtttgttttgcttcttcgggaccaggagttactaacttaattactgcggttgcagacgcgaaaatggattctattcctttgatcgtaatcaccgggcaggttccggtttctatgatcggcaccgacgcatttcaggaaattgatactttcagtttgtctgttccgattactaaaagaagttatctagtgaaaaaaattgaggatttgattcaaatccttcctcaggcttggaagactgctattgaaggtaggccaggtccggtttggattgacgttcctaaagatgtggcttctgctaagattgattgggatatttccagagaaaaagaaatttggaatattcaaaaaatagaatttaaagatacgattgatctagaatggaaaaaaacttttaaggaactattatcgaaagctaaaaaaccagtattttatatcggtggaggtttaaaccgtcctttggcggcagagttgttctgtattcttttggaaaaactaaactttcctaccgtttctacgttaatgggattggggatttgtccatatgaacatcctagatttttaggaatgttggggatgcacggctctagagcagccaatctcgttttggaagaagcagatttattggttgctttgggcgttcgttttgatgatcgagccactggtaaattgaatgagttttgtcctaatgctaagatagtccatgtagacatagacgcaacagaaatcggtaaattaaaaaatcctaatctttttttaaaacacggcgttgagaattttatcacccagattttggaagaggacttgtcttctgaacacttgtcttcggaggaatggttgaatcaggttcaaactctcaaaactttatatggattttctatacctaaagagaatcaaattttacatccggtttcgattttacaaagtatctcgaacattctaggtgaaaaggcaatcattactactgacgtaggtcaacatcaaatgtgggtggctcaatattatccttttcgaaagcaaggttcttttttgacttcgggtggtttaggaacaatgggttttggattaccggccgccattggggcggcgctcgtttttccggaaaaaagaatcgtttgtatttcgggagacggatcgattttaatgaatattcaggaattagatactcttagagaattgaatttagacgtaactattcttttgataaacaacggacatcttggtttggtgagacaacagcaggaattgtttttttcctccagattttccgcatccaaatttgtaatacccgctaactttataaaaattgcatcttcttttggaattccatcttttgagttgtcgaatgaatgttctcaagttgaaattctggaacaagctttgatccgaaaaggaccatcctttgttttgcttcaggtagagcccgatctacaagttcttcccatggttcctccaggaaaggcaaaccgtgaaatgatttattaa

SEQ ID NO: 82311 - protein, 560 aa, Leptospira interrogans serovar Copenhageni str. Fiocruz L1-130
MNLNGAELMIRFLEFAGVEIVSGIPGGASLPIYDALYESKIRHILARHEQGAGFIAGGMARANGKPGVCFASSGPGVTNLITAVADAKMDSIPLIVITGQVPVSMIGTDAFQEIDTFSLSVPITKRSYLVKKIEDLIQILPQAWKTAIEGRPGPVWIDVPKDVASAKIDWDISREKEIWNIQKIEFKDTIDLEWKKTFKELLSKAKKPVFYIGGGLNRPLAAELFCILLEKLNFPTVSTLMGLGICPYEHPRFLGMLGMHGSRAANLVLEEADLLVALGVRFDDRATGKLNEFCPNAKIVHVDIDATEIGKLKNPNLFLKHGVENFITQILEEDLSSEHLSSEEWLNQVQTLKTLYGFSIPKENQILHPVSILQSISNILGEKAIITTDVGQHQMWVAQYYPFRKQGSFLTSGGLGTMGFGLPAAIGAALVFPEKRIVCISGDGSILMNIQELDTLRELNLDVTILLINNGHLGLVRQQQELFFSSRFSASKFVIPANFIKIASSFGIPSFELSNECSQVEILEQALIRKGPSFVLLQVEPDLQVLPMVPPGKANREMIY

SEQ ID NO: 82312 - DNA, 1692 bp, Desulfovibrio vulgaris subsp. vulgaris str. Hildenborough
  CDS (1)..(1692): transl_table=11
atgcaactgaacggggcccagatcctgctcgaatgtctcaagaaggaaggcgtggacgtcttcttcggctaccccggcggggctgtcatcgacatctatgacgagattccccgccaccccgaattgcaccacgtgctggtgcgccatgagcaggcagcggtccatgcggcagacggttacgccagagcctcgggcaaggtgggcgtctgcctcgtgacatccggtcccggtgccaccaacaccgtcaccggtatcgccacagcctatagcgactccatcccggtggtcatccttaccgggcaggtgccaacgccgctcatcggcaatgacgccttccaggaagtggacatcgtgggtatcacgcgtccgtgcaccaagcacaactatctcgtgcgcgacgtgaaggaactcgcaacggtcgtgcgtcaggccttctaccttgcccgtacgggcaggccgggccccgttcttgtcgaccttcccaaggacgtcatgcaggcgaagacggatttcgtctggcctgaagacgtgtccatgcgaagctacaacccgacgtacaagcccaacctcaaccagattcgccgggctgccgacgccttcttcgaggccgaacgccctctgcttttcgtaggcggcggcgtggtcatgtccgacgccagcgaggaactcggctggtttgcgcgcaccttgcgtattcccgtggcttcaacgctcatggggcttggcgcctttccgggcgatgaccccctgtggcttgggatgctggggatgcacggcacctatgccgccaacaaggccgtcaacaatgccgacctcatcgtggcggtgggggcgcgtttcgacgaccgcgtgacggggcgcctgtcagccttcgcctcgaaggcacgcatcatccacatcgacatcgacccgacgtccatccgcaagaatgttcaggtgggcattccggtcgtgggcgattgccggcagtcgctcgccaacatacgcgagatactcgtgccgcgccttgaggagaaggactggggggcggcccatgcgcgctggctcgagcagcttgcctcgtggcgtgtcgaacagccgctcggcttttcgcgcgaggggggcatcaagccccagcaggtcatcgaacagcttttcgccatcactcgcggtgacgccatcatcaccacggaggtggggcagaaccagatgtggacggcgcagttctacactttccgcaagccgcgtacgctcatcacctcgggtggactcggtaccatggggtacggttttcccgcggccataggggcgcagttcgcctttccggacaagcttgtcgtcgacgtggcgggagacggttccatccagatgaacatccaggaactcgccacggcggtatgcaacaagctgccggtgaagatactcatcctcaacaatggctatctgggcatggtgcgccagtggcaggagcttttctaccagcgcaactactgttccacatgcatggatgcgcagcctgatttcgtgaagctggccgaagcctacggggctgaaggctatcgcatcaccgaggtggaaagccttgaatccaccctgcgcgaggcccttgcgtcgccgcatccggccatcatcgatgtccgcgtcgaacgtgaggagaatgtctaccccatggtgcccgcaggcgcggcgctcgatgaaatgctgctggtgtag

SEQ ID NO: 82313 - protein, 563 aa, Desulfovibrio vulgaris subsp. vulgaris str. Hildenborough
MQLNGAQILLECLKKEGVDVFFGYPGGAVIDIYDEIPRHPELHHVLVRHEQAAVHAADGYARASGKVGVCLVTSGPGATNTVTGIATAYSDSIPVVILTGQVPTPLIGNDAFQEVDIVGITRPCTKHNYLVRDVKELATVVRQAFYLARTGRPGPVLVDLPKDVMQAKTDFVWPEDVSMRSYNPTYKPNLNQIRRAADAFFEAERPLLFVGGGVVMSDASEELGWFARTLRIPVASTLMGLGAFPGDDPLWLGMLGMHGTYAANKAVNNADLIVAVGARFDDRVTGRLSAFASKARIIHIDIDPTSIRKNVQVGIPVVGDCRQSLANIREILVPRLEEKDWGAAHARWLEQLASWRVEQPLGFSREGGIKPQQVIEQLFAITRGDAIITTEVGQNQMWTAQFYTFRKPRTLITSGGLGTMGYGFPAAIGAQFAFPDKLVVDVAGDGSIQMNIQELATAVCNKLPVKILILNNGYLGMVRQWQELFYQRNYCSTCMDAQPDFVKLAEAYGAEGYRITEVESLESTLREALASPHPAIIDVRVEREENVYPMVPAGAALDEMLLV

SEQ ID NO: 82314 - DNA, 1722 bp, Picrophilus torridus DSM 9790
  CDS (1)..(1722): transl_table=11
atgggatcacgtttgatagttgaatcgcttaagaagcagggtgttaaggatatatttggcatacctggattatacaacatgcctgtgtacgatgcttttttggaggacgttgagagcggtcagttaaggcacatactgatgcggcatgagcaggctgccgcccatgctgccgatgcatatgcaagggccaccggatttcctggtgtttgcactgcaacatccggccctggcgtaacaaaccttgttacaggactaataacagcataccaggattcatcgccggttgttgcaataacaggccaggttaacagttcatcaataggaaagatgtcattccaggaatccgacacaccgggaataatgtttcctgtaacaaaatacaccgtgcagctaagatctgttgatgagataccgttctggatagaaaaggcattttacatagcatccaccggcaggcccggccctgtggttgtcgatataccaagggatttacagaacacaaagatagatgatttaaaatcattaaacaggaaattgaattataaaccattcaggacaatagttgacaaagagaagatatcaaaggcattatcccttcttttaaatgctgaaagacccataatgcttgttggtaccggcgtggcctggtcaggtgccaccgatgaggtgataaaattatcaaaaatgcttggaatgcctgttgtatcaacgcttccaggtaaatcatcaatgcctgccgattatccgctttatttgggtgcaatgggttattacggaaaggctgaagcgagcatggctgcccttgagagcgatgtcatgcttgttgtcggggcaaggctcagtgatagaacgttcacatcgtataatgagatggcagagaccggcaaaaagttcatagaaataaatatagaccccggggacttcatgaagggcataaagccagatgtaggcatacagggcgattcaaagctgatattaaaagagatgataaaaaatatacctgagcacgcattaaaacataaaaacgaatggacaaaaagggtaagggagcttaaggattactatgaaaaattctattatatagaggatagaaaattaaaaccgtttaagatattaaaaacaataagggaatctcttccaagggatgcaataatgacaacaggtgttggccagcaccagatgtgggcagaggtcttctgggaaaatcttgaaccaaggtcattcttttcatcaaccggcatgggaaccatgggctttggattgcctgcagccataggtgccaaggttggcaggcctgacaaaatagttgtcgattttgatggagacggctcttttttgatgacaggaaataatcttgcagttgccgttgattataatatacctgttatagcaatagtaaatgataacagaacccttgggcttgtgaggcaggttcaggacatgttccagaataaacgtatagttggtgttgactatggaaattctccggatcttgttaaatacgctgaggcctttggtgcccttggctttgatgttgaaaattatgatgatataaaaaatgccataaaaactgcaataaaggaggatgtgcctgcggttataagggttcctgtcgataaagaggagctggcgcttccgacgctaccgcctggcggtaaattaagggagatgatagtaagtgatccaagaaaaaagaataatggtgatagcaagctaccgtga

SEQ ID NO: 82315 - protein, 573 aa, Picrophilus torridus DSM 9790
MGSRLIVESLKKQGVKDIFGIPGLYNMPVYDAFLEDVESGQLRHILMRHEQAAAHAADAYARATGFPGVCTATSGPGVTNLVTGLITAYQDSSPVVAITGQVNSSSIGKMSFQESDTPGIMFPVTKYTVQLRSVDEIPFWIEKAFYIASTGRPGPVVVDIPRDLQNTKIDDLKSLNRKLNYKPFRTIVDKEKISKALSLLLNAERPIMLVGTGVAWSGATDEVIKLSKMLGMPVVSTLPGKSSMPADYPLYLGAMGYYGKAEASMAALESDVMLVVGARLSDRTFTSYNEMAETGKKFIEINIDPGDFMKGIKPDVGIQGDSKLILKEMIKNIPEHALKHKNEWTKRVRELKDYYEKFYYIEDRKLKPFKILKTIRESLPRDAIMTTGVGQHQMWAEVFWENLEPRSFFSSTGMGTMGFGLPAAIGAKVGRPDKIVVDFDGDGSFLMTGNNLAVAVDYNIPVIAIVNDNRTLGLVRQVQDMFQNKRIVGVDYGNSPDLVKYAEAFGALGFDVENYDDIKNAIKTAIKEDVPAVIRVPVDKEELALPTLPPGGKLREMIVSDPRKKNNGDSKLP

SEQ ID NO: 82316 - DNA, 1800 bp, Bartonella henselae str. Houston-1
  CDS (1)..(1800): transl_table=11
atgacaaatcatccaagaatgcaagagagtgcgaacggaaaaaaaatgttgggcgctgaaatggtggttcaagctcttattgatcaaggggttaaacatctatttggttatcctggtggggctgtccttcctatttttgatgtactttatcaacaggattcactgcagcatattttggtgcgtcatgaacaagcagcaggtcatgctgctgaaggttatgcacgcagcacagggaaggtcggcgttatgcttgtgacttctggtccaggggcaacgaacgctgtaacacctttgcaagatgcacttatggattctattcctcttgtttgtttttctggtcaggtgtcaacaactgtgattggaacaaatggtttccaagaggctgatacagttggtattacaaagtcctgtacgaaacaaaattggttggttaaagatgtaaatgatcttgccgctatcattcatgaagcttttgctgttgctcaatcaggacgtccagggccagttttggttgatattcctaaggatatacaattagcttcaggtgtttatagagcgcctcaagttttggtatctaggcatttttctccacagttggaaaggaatattgaggctattgaatgtgctgtttctcttttagaagaagcaaaacgtcctgttatttattctggtggtggtgttatttcatcaggtcttcaagctgtacagcttttgcgtgatttggttcaattgggagattttccgattacttcaacactcatgggacttggtgcttatccggcttctggtaaaaattggcttggaatgcttggaatgcatggaacttatgaagctaatatggccatgcatgattgtgatgttatgctggctgttggggcacggtttgatgatcgtatcactgggcggcttgatgcatttgcacctcatgcgcgcattattcatattgatgttgatccttcttctatcaataagatcgtaaaagtggaagttccaattattggcgatgtggctgatgttttaggagatatgatgcaatgtttgcatagacagcaaccaatctttaagagtgaaggccgtgatgcgtggtggaagcaaattgattgctggagagctcgtaattcattagcataccctaagaaaaaagatattattatgccacaatacgctcttgaacgactttatgctcttactaaagatgtgaatgcttatattacgactgatgttgggcagcatcagatgtgggctgcacaatattatcactttgatgagccaaaccattggatgacttctggtggtcttggaactatgggttatggtttgcctgctgctattggggtacaaatcgcacatcctgatgcatttgttgtatgtatttctggtgatgcttcaattcaaatgaatatccaagaactcgcaacggcaatgcagtataacacaccagtgaaaatttttattttgaataatcagtatatgggtatggtccgccagtggcagcagttgttgcatggtaatcgtctttctcattcttacaccgaatcaatgcctgactttgtgaaattggcacaagcttatggagggattggtattcattgttccaaaccggatgaacttgatgataaaatacagcaaatgattgactgtgacaaaccagttctcttcgattgccgggttgataatttagaaaattgttttccaatgatcccatctgggtgtgcacataatgatatgctattacctgacgaggctcatgatgaagcagttgccaatgctatttccgctgaaggacaatgtttggtttaa

SEQ ID NO: 82317 - protein, 599 aa, Bartonella henselae str. Houston-1
MTNHPRMQESANGKKMLGAEMVVQALIDQGVKHLFGYPGGAVLPIFDVLYQQDSLQHILVRHEQAAGHAAEGYARSTGKVGVMLVTSGPGATNAVTPLQDALMDSIPLVCFSGQVSTTVIGTNGFQEADTVGITKSCTKQNWLVKDVNDLAAIIHEAFAVAQSGRPGPVLVDIPKDIQLASGVYRAPQVLVSRHFSPQLERNIEAIECAVSLLEEAKRPVIYSGGGVISSGLQAVQLLRDLVQLGDFPITSTLMGLGAYPASGKNWLGMLGMHGTYEANMAMHDCDVMLAVGARFDDRITGRLDAFAPHARIIHIDVDPSSINKIVKVEVPIIGDVADVLGDMMQCLHRQQPIFKSEGRDAWWKQIDCWRARNSLAYPKKKDIIMPQYALERLYALTKDVNAYITTDVGQHQMWAAQYYHFDEPNHWMTSGGLGTMGYGLPAAIGVQIAHPDAFVVCISGDASIQMNIQELATAMQYNTPVKIFILNNQYMGMVRQWQQLLHGNRLSHSYTESMPDFVKLAQAYGGIGIHCSKPDELDDKIQQMIDCDKPVLFDCRVDNLENCFPMIPSGCAHNDMLLPDEAHDEAVANAISAEGQCLV

SEQ ID NO: 82318 - DNA, 1770 bp, Staphylococcus aureus subsp. aureus MRSA252
  CDS (1)..(1770): transl_table=11
atgtctaaaactcaacatgaagtaaaccaaaatattgaccctttaaaaatggctgaatcacttgaacctgaacaactaaatgaaaaaactttaaatgacatgcgttcaggatcagaagtgctagtagaagctctacttaaagaaaatgtggattatttattcggttatcctggtggtgccgtactacctttatacgacacattttatgatggtaaaatcaaacatattttagcaagacacgaacaaggtgctgttcatgctgcagaaggttatgcacgtgtatctggtaaaacaggcgtcgttgtagttacaagcggtccaggtgcaactaatgtaatgacaggtattacggatgcacattgcgactctttaccactagttgtattcactggacaagttgctacaccaggcattggtaaagatgcattccaagaagcggatattctatctatgacttcaccaattacaaaacaaaattatcaagtgaaacgtgttgaagatatccctaaaatcgtacacgaagctttccatgtagctaattctggacgcaaaggtcctgtagtgattgattttccaaaagatatgggtgttttagctacaaatgtggatttatgcgacgaaatcaatattccaggttatgaagttgttacagaaccagaaaataaagacattgacactttcatctcacttttaaaagaagcgaaaaagcctgtcgtattagccggcgcaggtattaatcaatcaaaatcaaatcaattattaacacagtttgttaataaacatcaaatcccaacagttactactttactaggtctaggtgctgtaccttatgaggatacactatttttaggtatgggaggtatgcatggttcttatgctagtaacatggcattaactgagtgtgatttactcattaatttaggtagccgcttcgatgatagattagcaagcaaacctgatgcctttgcacctaacgccaaaattgtacatgtagatattgatccttcagaaatcaataaagttattcatgtagatttaggtattattgcagactgtaaaagatttttagaatgtttaaatgataaaaatgttaagactatagaacacagtgactgggttaaacattgtcaaaataataagcagaaacatccatttaaacttggtgaagaagatcaagtattttgtaagccacaacaaacaatcgaatatatcggcaaaattacaaatggtgaagcaattgttactacagacgtgggacaacatcaaatgtgggcagctcaattttatccatttaaaaatcacggacaatgggttacaagcggtggtttaggaacaatgggattcggtattccttcgtcaattggtgccaaattagctaatcctgataaaacagtcgtatgcttcgtcggtgacggtggtttccaaatgacaaaccaagaaatggcactattacccgaatatggtttagatgtcaaaatcgtactaatcaataatggaacattaggtatggttaaacaatggcaagataagttctttaatcaacgcttctcacactcagtatttaatggtcaacctgattttatgaaaatggcagaagcatatggcgtcaaaggtttcttaatcgataagccagaacaactggaagaacaattagatacagcgtttgcttatcaagggccagctttaattgaggttcgtatttcccctactgaagctgtaaacccaatggttccaagtggcaaatcaaatcatgaaatggagggcttataa

SEQ ID NO: 82319 - protein, 589 aa, Staphylococcus aureus subsp. aureus MRSA252
MSKTQHEVNQNIDPLKMAESLEPEQLNEKTLNDMRSGSEVLVEALLKENVDYLFGYPGGAVLPLYDTFYDGKIKHILARHEQGAVHAAEGYARVSGKTGVVVVTSGPGATNVMTGITDAHCDSLPLVVFTGQVATPGIGKDAFQEADILSMTSPITKQNYQVKRVEDIPKIVHEAFHVANSGRKGPVVIDFPKDMGVLATNVDLCDEINIPGYEVVTEPENKDIDTFISLLKEAKKPVVLAGAGINQSKSNQLLTQFVNKHQIPTVTTLLGLGAVPYEDTLFLGMGGMHGSYASNMALTECDLLINLGSRFDDRLASKPDAFAPNAKIVHVDIDPSEINKVIHVDLGIIADCKRFLECLNDKNVKTIEHSDWVKHCQNNKQKHPFKLGEEDQVFCKPQQTIEYIGKITNGEAIVTTDVGQHQMWAAQFYPFKNHGQWVTSGGLGTMGFGIPSSIGAKLANPDKTVVCFVGDGGFQMTNQEMALLPEYGLDVKIVLINNGTLGMVKQWQDKFFNQRFSHSVFNGQPDFMKMAEAYGVKGFLIDKPEQLEEQLDTAFAYQGPALIEVRISPTEAVNPMVPSGKSNHEMEGL

SEQ ID NO: 82320 - DNA, 1725 bp, Acinetobacter sp. ADP1
  CDS (1)..(1725): transl_table=11
ttggaacttttatctggtggtgaaatgctcgttcgcgcactcgcggatgagggcgttgagcacgtttttggatacccaggcggcgcagttttacatatttatgatgcgctttttcaacaagacaaaatcaatcattatcttgtacgtcatgagcaagctgctggtcatatggctgatgcttattcacgtgtcacaggtaaaacgggtgttgtgcttgttacgtctggcccaggggcaaccaataccgtaactccaattgcaactgcatatatggactcgattccgatggtcatcttatcgggtcaggttgcttcacatctgattggtgaagatgcctttcaggaaacagatatggtcggaatctccagaccaatcgtaaagcatagtttccaagtccgccatgcaagcgaaattcctgcaattattaaaaaagcattttatatcgcatcctctggccgtcctggccctgtcgtgattgatattccaaaggatgcaaccaatccagcagaaaagtttgcctatgaatatccagaaaaggtaaaactacgctcttatcaaccgccttcgcgtggccattcgggtcaaattcgtaaggctgtcgacgagcttctgactgcaaaacgtccaatgatctatacgggcggtggtgtagtgcagggtaatgcctctgaattgctgactgagcttgcccatctgctgggtttccctgtaaccaataccttgatgggactgggtggctttccaggggatgatccgcaatttgtaggcatgcttggtatgcatggtacttatgaagccaatatggcgatgcataatgctgatgtgatcttggcaattggtgcgcgttttgatgaccgtgtgaccaataatcctgcgaaattttgtcaaaatgccaaagtcatccatgtggatatcgatccagctgcgatttctaaaaccatcatggcgcatatcccaattgtaggtgctgttcagcctgttcttcaggaaatgttgacacagttaaagcaattgaatgtttctaagccaaatccagaagcgattagcgcgtggtgggatcagattaatgaatggcgtaaagttcatggtctgcaatatcaagctggtcaggatggcattatgaagcctcaacaagtggttgaagctttatataaagcaacagatggcaatgcgattatcacctcggatgtagggcagcatcaaatgtttggcgcgctgtattacaagtacaagcgtccgcgtcagtggatcaactcgggtggtcttggcaccatgggcgttggtttgccgtatgcgatggcagccaaactggcttgtccagaccaacaagtcgtctgtatcacgggtgaagcctcaattcagatgtgtattcaggaattatcaacctgtaagcaatatggcttaaacgttaagattctgtgcctcaataaccgtgcactgggaatggtcaaacagtggcaagacatgaactatgaaggacgtcattcaagttcttatgtagaatcattgcctgattttgccaaattgatggaagcttatggccatgtcggaatccagattgaccataccgatgagcttgagtctaaactcgcagaagcgatggccattaatgataaatgtgtatttatcaatgtgatggttgatcgtactgaacatgtgtatccaatgttgattgctgggcaatcgatgaaagatatgtggttagggaaaggggagcgtacataa

SEQ ID NO: 82321 - protein, 574 aa, Acinetobacter sp. ADP1
MELLSGGEMLVRALADEGVEHVFGYPGGAVLHIYDALFQQDKINHYLVRHEQAAGHMADAYSRVTGKTGVVLVTSGPGATNTVTPIATAYMDSIPMVILSGQVASHLIGEDAFQETDMVGISRPIVKHSFQVRHASEIPAIIKKAFYIASSGRPGPVVIDIPKDATNPAEKFAYEYPEKVKLRSYQPPSRGHSGQIRKAVDELLTAKRPMIYTGGGVVQGNASELLTELAHLLGFPVTNTLMGLGGFPGDDPQFVGMLGMHGTYEANMAMHNADVILAIGARFDDRVTNNPAKFCQNAKVIHVDIDPAAISKTIMAHIPIVGAVQPVLQEMLTQLKQLNVSKPNPEAISAWWDQINEWRKVHGLQYQAGQDGIMKPQQVVEALYKATDGNAIITSDVGQHQMFGALYYKYKRPRQWINSGGLGTMGVGLPYAMAAKLACPDQQVVCITGEASIQMCIQELSTCKQYGLNVKILCLNNRALGMVKQWQDMNYEGRHSSSYVESLPDFAKLMEAYGHVGIQIDHTDELESKLAEAMAINDKCVFINVMVDRTEHVYPMLIAGQSMKDMWLGKGERT

SEQ ID NO: 82322 - DNA, 1719 bp, Erwinia carotovora subsp. atroseptica SCRI1043
  CDS (1)..(1719)
atggagatgttgtcaggcgccgaaatggtggtccgatcgttgatcgatcagggcgtaaaacatgtgttcggttatccgggcggtgcggtgctggatatttacgacgccctgcatacggttggcggtatcgaacatattttggtgcggcatgagcaaggtgcggtacatatggcggatggctatgcgcgtgcgacgggtgaggtcggcgtcgtgctggtcacctccggtcctggtgcgacaaacgccatcaccggtatcgctactgcgtatatggactccattcctatggtggtgttgtccggtcaggtggccacctcgctgattggctatgattcctttcaggaatgcgacacggtgggaatttcccgccctatcgtaaagcatagctttctggtcaagaaagctgaagatgtcccgacgatcctgaaaaaagccttttatctggcatcaaccggacgtccggggccggtggtcgtcgatctaccaaaagacatcatgagtccggcgaataaactgccgtacgtttatcccgaaagcgtcagcatgcgctcctatagcccaacggttcaagggcacaaaggtcagattcgccgtgcgttgcaaaccctgctggcggcagaaaagccgattatctacagtggtggtggcgtgattaacgcagagtgtcacgaagagctgctgacgcttgcggaaaaactgaacctgccagtgacaacctccctaatggggctgggcggattccctggaacgcaccgtcagtgcctcggcatgctgggaatgcacgggacgtatgaagccaacctagctatgcataacgctgatgtgattttcgccgtaggggtgcgcttcgacgaccgtacgacgaacaatctggcgaagtactgtccgaatgcgacggtattgcatattgatatcgatcctgcgtcgatttccaaaacggtaaacgcggatatccctatcgttggcgatgccaaacaggtactaagcctgatgctggagttgctggcacaggatggcgcacagcagcagtttgatgcgctacgtgactggtggcaaggtatcgagcagtggcgtgggcgtcactgcctgaaatacaacaccgaaagcgacaagattaaaccgcaggcggtgattgaaacgctgcatcggctgaccgaaggtaaagcgtatgtggcatcggatgtcggccagcatcagatgtttgctgcactgtattatcctttcgatttgccgcgccgttgggtgaactccggtggactgggcacgatgggctttggcttgcctgcggcattgggcattaagctcgcgctaccggaagaaacggtaatttgcgtaacgggtgacggcagcattcagatgaatattcaggagctctctacagcactgcaatatgatctgccggttgtggtgatcaacctgaacaaccgtttcctcggcatggtgaagcagtggcaggacatgatttattctggccgccattccagttcttatatggaatcgttaccggatttcgtcaagctggctgaagcgtacggtcacgtcgggatttctatcgatacgccggacgaactggaaagtaagctgtctcaagcactggcgcagaaagatcgtctggtatttgttgatatcaacatcgatagcagcgagcatgtttaccctatgcagattcgcggcggggcgatggatgaaatgtggttgagcaaaacggagaggacctga

SEQ ID NO: 82323 - protein, 572 aa, Erwinia carotovora subsp. atroseptica SCRI1043
MEMLSGAEMVVRSLIDQGVKHVFGYPGGAVLDIYDALHTVGGIEHILVRHEQGAVHMADGYARATGEVGVVLVTSGPGATNAITGIATAYMDSIPMVVLSGQVATSLIGYDSFQECDTVGISRPIVKHSFLVKKAEDVPTILKKAFYLASTGRPGPVVVDLPKDIMSPANKLPYVYPESVSMRSYSPTVQGHKGQIRRALQTLLAAEKPIIYSGGGVINAECHEELLTLAEKLNLPVTTSLMGLGGFPGTHRQCLGMLGMHGTYEANLAMHNADVIFAVGVRFDDRTTNNLAKYCPNATVLHIDIDPASISKTVNADIPIVGDAKQVLSLMLELLAQDGAQQQFDALRDWWQGIEQWRGRHCLKYNTESDKIKPQAVIETLHRLTEGKAYVASDVGQHQMFAALYYPFDLPRRWVNSGGLGTMGFGLPAALGIKLALPEETVICVTGDGSIQMNIQELSTALQYDLPVVVINLNNRFLGMVKQWQDMIYSGRHSSSYMESLPDFVKLAEAYGHVGISIDTPDELESKLSQALAQKDRLVFVDINIDSSEHVYPMQIRGGAMDEMWLSKTERT

SEQ ID NO: 82324 - DNA, 1665 bp, Erwinia carotovora subsp. atroseptica SCRI1043
  CDS (1)..(1665)
atgcgttatacaggcgctcagttgattgttcggctgctcgaacagcagggtatcaccaccgtagcgggcattcccggcggcgcggcactgccgttatatgatgctcttagccaaagtcagactatccgccatgttcttgcccgccacgagcaaggcgcgggatttatggcacaaggcatggcgcgagccagcggacgcgctgcggtttgtatggcgtccagcggcccaggggcgaccaacctgattactgccatcgccgatgccaaactggattcaatcccgctggtgtgcatcaccggtcaggtgccttccagcatgatcggcaccgatgcgtttcaggaagtcgacacttacggcatctccattcccgtcaccaaacataactatctggttcgtgatatcaacgaactgccgcgcgtgatcccagaagcctttcgcatcgcgcaatcgggccgtcccggcccggtgtggatcgatattccaaaagatattcagaacgcgaccattgagttgagcgaactgccagacattttccctctcgatacgccaccgactattgctcagcaggaaattgaacgggctgcggccatgattaacgcagcccagcgtccgattctctatctgggtggcggaattattagcggtgtcgcacacgaacaagcggttcaactggcggaacgcgctagcctgccaactaccatgacgctgatggctctgggtgctatgcccgtagatcatccgctgtcgctcggtatgttggggatgcacgccgcacgatcaaccaatctgatcttagaacaggcggatttgttaattgtgctgggtgcgcgttttgacgatcgtgccattggtaaagcggaacaattctgcccacaggccagcatcattcacatcgatattgatccggccgagttaggcaagatccgccagccgcacgtggcgatcaatgccgatgtcgccgaggtgctggatcatctgctgccacatatcaccccacagcagcgtggcgtatggcgtgcaaccgttagcgggctgcaacaggaatttccgttcagcatgccgaatgctgacgacccattaagccattatggactggttcaggccacggcgcaggcgctgacggatgatgccatcatcacgaccgatgtcggccaacaccagatgtgggtcgctcagtcttacccactgcgtcgtccgcgccagtggctgacatccggcgggtttggcacgatgggctttggcttgcctgcggcgattggcgcagcgctggccgaaccggatcgcaccgtggtgtgtttctcgggtgatggcagcctgatgatgaatattcaggaaatggcgaccgcggcagaagaagggctcaacgtaaaaatcgtcctgatgaacaatcagtcactcggtctggttcaccagcagcaggatatgtttttccagcagcgtatcttcgccgccgattaccgctacaacaccaattttctcgccattgccgcaggtttcggctttgcaacctgcgatctgaatgcggcagccgacccgcaggccgcgttgaaagaagcgctcaatcaacccggtccagcgttgatccacgtacgcattgacgccaatgaaaaagttttccccatcgtgccaccgggcgcagcgaacatcgatatgatcggagattaa

SEQ ID NO: 82325 - protein, 554 aa, Erwinia carotovora subsp. atroseptica SCRI1043
MRYTGAQLIVRLLEQQGITTVAGIPGGAALPLYDALSQSQTIRHVLARHEQGAGFMAQGMARASGRAAVCMASSGPGATNLITAIADAKLDSIPLVCITGQVPSSMIGTDAFQEVDTYGISIPVTKHNYLVRDINELPRVIPEAFRIAQSGRPGPVWIDIPKDIQNATIELSELPDIFPLDTPPTIAQQEIERAAAMINAAQRPILYLGGGIISGVAHEQAVQLAERASLPTTMTLMALGAMPVDHPLSLGMLGMHAARSTNLILEQADLLIVLGARFDDRAIGKAEQFCPQASIIHIDIDPAELGKIRQPHVAINADVAEVLDHLLPHITPQQRGVWRATVSGLQQEFPFSMPNADDPLSHYGLVQATAQALTDDAIITTDVGQHQMWVAQSYPLRRPRQWLTSGGFGTMGFGLPAAIGAALAEPDRTVVCFSGDGSLMMNIQEMATAAEEGLNVKIVLMNNQSLGLVHQQQDMFFQQRIFAADYRYNTNFLAIAAGFGFATCDLNAAADPQAALKEALNQPGPALIHVRIDANEKVFPIVPPGAANIDMIGD

SEQ ID NO: 82326 - DNA, 1647 bp, Erwinia carotovora subsp. atroseptica SCRI1043
  CDS (1)..(1647)
atgaatggagcacagtgggtggtgcaagcgttgcgagcacagggagtggaaaccgtttttggttatccgggcggcgcgataatgccagtctatgatgcactttatgacggcggcgtaaaacacctgctgtgtcgccatgagcaaggcgcagcaatggcagcgattggttatgctcgcgcgacgggtaaggtgggcgtttgtatcgcgacatctggccccggtgcgaccaacctgatcaccggtttggccgatgcactgctggattcggtgcctgtggtggcgatcaccggacaggtggggtcagcgctgattggcaccgacgcttttcaggagatcgacgtattagggttgtcgttggcctgtacgaaacacagttttctggttgagtctctcgaatcattgccggaagtgatggcagaagcgttcgcgattgccaacagcggtcgccctggccctgttctggttgatatcccaaaagatattcagctggctgtcggcgatttcatcccgaactttgcacccgttgctaacgatgtcgatttccctgagcaagatattacgctggcgtacgctctgttggcgaaagcacaaaaaccggtgctgtacgttggcggtggtgtcggtatggcgaatgcagttccggcgctgcgtgaatttctgaatgtgacggatatcccttcggtttctacgctgaaagggctgggtgccgtggatgccaatcatccctattacctcggaatgattggtatgcacggcacgaaggcggcgaacctgattgtgcaggagtgcgatctgttaatcgcagtcggggcccgttttgatgaccgcgtgaccggcaaactgaatgccttcgcgcctcatgccagtgttattcacatggacatcgacccagcagagctgagtaaattgcgccatgctaatgtcgcactgcaaggcgatctgaaggcggtattacctgcgctgcaacagccactgaacgtcagcgcgtggcgtcagcagtccaccatgatgaaggcggaatatccgtggcgttatgaccaccctggccaggcgatttatgcgcctgctctgttgaaaacgatctccgaaagaatggatgcggataccgtagtcacgaccgatgtgggccagcaccaaatgtgggctgcacagcatatgacgttcagccgccctgagaatttcatcacctccagtggtctcggtacgatgggctttggcgtaccggctgcggtaggtgctcaggtagcacgtccagacgacatggttatctgtatttcaggtgacggctctttcatgatgaacgttcaggaattgggcaccatcaagcgaaaacggctgccgttgaagatcgtgttgctggataaccaacggttaggcatggtacgccagtggcagcagttattctttgatgagcgctacagtgaaaccgacctctccgataaccctgacttcctgacgctggcaagtgcgtttgatatccccggccagcgcatcacccgtaaagaccaaattgatgtcgcgctggatgccctgtttaacagcgaaggaccctatttactgcacgtctcgatcgacgaatatgaaaatgtctggccgctggttccgccgggcgcgggcaatgaaacgatgcttgataaaaccaagtaa

SEQ ID NO: 82327 - protein, 548 aa, Erwinia carotovora subsp. atroseptica SCRI1043
MNGAQWVVQALRAQGVETVFGYPGGAIMPVYDALYDGGVKHLLCRHEQGAAMAAIGYARATGKVGVCIATSGPGATNLITGLADALLDSVPVVAITGQVGSALIGTDAFQEIDVLGLSLACTKHSFLVESLESLPEVMAEAFAIANSGRPGPVLVDIPKDIQLAVGDFIPNFAPVANDVDFPEQDITLAYALLAKAQKPVLYVGGGVGMANAVPALREFLNVTDIPSVSTLKGLGAVDANHPYYLGMIGMHGTKAANLIVQECDLLIAVGARFDDRVTGKLNAFAPHASVIHMDIDPAELSKLRHANVALQGDLKAVLPALQQPLNVSAWRQQSTMMKAEYPWRYDHPGQAIYAPALLKTISERMDADTVVTTDVGQHQMWAAQHMTFSRPENFITSSGLGTMGFGVPAAVGAQVARPDDMVICISGDGSFMMNVQELGTIKRKRLPLKIVLLDNQRLGMVRQWQQLFFDERYSETDLSDNPDFLTLASAFDIPGQRITRKDQIDVALDALFNSEGPYLLHVSIDEYENVWPLVPPGAGNETMLDKTK

SEQ ID NO: 82328 - DNA, 1821 bp, Leifsonia xyli subsp. xyli str. CTCB07
  CDS (1)..(1821): transl_table=11
atgtcctcggatgcgaaccacacgaccgcgtcgcccagcacggtggcgctctccgcgtcgaccggcacagcggcgcccgaacaactgaccggctccgagtcggtcgtccgcaccctcgagctcctcggcgtcaccgatgtcttcggactccccggcggcgccatcctgccgatctacgacgcgatcatggactcggacacgatccgtcacatcctggtccggcacgaacagggcggtggccacgcggccgaagggtacgctgccgcctcgaacaaggtcggcgtcgcaatggcgacctccggccccggtgcgacgaacctcgtcacggcgatcatggacgcccacatggactcggttccggtggtgttcatcaccggccaggtcttctccacgctgatgggcacggacgccttccaggaggcggacatcgtcggcatcaccatgccgatcaccaagcactccttcctcgtcaagagcgccgaggagatcccggtgacgatcgcggcggcgtaccacatcgccggcaccggccgtcccggcccggtgctggtcgacatcaccaaagacgcccagcagagcagagcaccgttcgtgtggccgcttaaggtcgacctgccgggctaccggccggtcaccaaggcacatggcaaacagatcctcgcggcggcgcagctgcttgccgaggccaagaagcccatcctgtacgtgggcgggggcgtcatccgctcacgcgcctcgcaggagctgctcgagctcgccgagaccaccggcttgccggtcacgaccacgctcatggcccgcggggccttccccgacactcatgcgcagcatctggggatgccggggatgcacgggacggtcccggccgtcctcgccctgcaggagtcggatctcatcgtgtcgctcggcgcgcggttcgacgaccgtgtgaccggcaaaaccagcctgttcgctcctcacgcgaagatcgtccacgtcgacgtcgaccccgccgagatctccaagatccgcgtcgccgacgtccccatcgtcggcgacgccaaagaggtcatcgtcggtctgaccgtggcctaccgggacgtcgctaaggacggcgaacccgacctcgccgagtggtggacctacctgaacggcctccgtgaggagttccccctcgggttcacgcccaccagcgacggcctcctggccccgcagcacatcatccagcgcatcggcgagctgacgggaccggaggcgatctacgccgccggtgtcggccagcaccagatgtgggccgcgcagttcatcaagtacgagcgtcccaactcgtggctgaactcgggcggcgcgggcaccatgggctactccgtgcctgccgcgatgggagcgaaggtcgcccagcccgactgcgtcgtgtgggcgatcgacggcgacggttgcttccagatgaccaaccaggagctcgccacctgcacgatcaacgacatcccgatcaaagtggcgatcatcaacaactcgtcgctcgggatggtgcggcagtggcagacgctgttctacgacggccgctactccaacaccgacctcaacaccgggcacgacactgtgcgggtccctgatttcgtgactctggccgaggcgtacggcgctctcggcatccgcgtcacgaaagaagacgaggtggacgacgccatcaggctcgccctcgagacgaacgaccgcccggtcgtcatcgacttcgtcgtcagcgccgacgcgatggtgtggccgatggtccctcagggcgtcagcaacagctatgtccagtacgcccgcgaccacagcccgtccttcggagaggagtga

SEQ ID NO: 82329 - protein, 606 aa, Leifsonia xyli subsp. xyli str. CTCB07
MSSDANHTTASPSTVALSASTGTAAPEQLTGSESVVRTLELLGVTDVFGLPGGAILPIYDAIMDSDTIRHILVRHEQGGGHAAEGYAAASNKVGVAMATSGPGATNLVTAIMDAHMDSVPVVFITGQVFSTLMGTDAFQEADIVGITMPITKHSFLVKSAEEIPVTIAAAYHIAGTGRPGPVLVDITKDAQQSRAPFVWPLKVDLPGYRPVTKAHGKQILAAAQLLAEAKKPILYVGGGVIRSRASQELLELAETTGLPVTTTLMARGAFPDTHAQHLGMPGMHGTVPAVLALQESDLIVSLGARFDDRVTGKTSLFAPHAKIVHVDVDPAEISKIRVADVPIVGDAKEVIVGLTVAYRDVAKDGEPDLAEWWTYLNGLREEFPLGFTPTSDGLLAPQHIIQRIGELTGPEAIYAAGVGQHQMWAAQFIKYERPNSWLNSGGAGTMGYSVPAAMGAKVAQPDCVVWAIDGDGCFQMTNQELATCTINDIPIKVAIINNSSLGMVRQWQTLFYDGRYSNTDLNTGHDTVRVPDFVTLAEAYGALGIRVTKEDEVDDAIRLALETNDRPVVIDFVVSADAMVWPMVPQGVSNSYVQYARDHSPSFGEE

SEQ ID NO: 82330 - DNA, 1791 bp, Gracilaria tenuistipitata var. liui
  CDS (1)..(1791): transl_table=11
atgaatataaattctaattctgatttaagagaagttacgggtgcctttgcacttatggatagtctaattaaaaacgatgtaaaatatgtttttggttatcctggcggtgctatattacctatttatgatgaactctataagtgggaaaatcaaggattgattacacatattctatgtcgtcatgaacagggtgcttctcatgctgcagatggttatgctagatctactggaaaagttggtgtatgttttgctacgtctggtccaggagctactaatcttgtttctggtattgctacagcgcaattagattctgttcccctagttttaataacaggtcaagttgctagatcttttataggaacagatgcttttcaagaggtagatatttttggtattacattacctatagtgaaacattcttatgtagttagagattctcgagatatgtctcgaatagtttctgaagctttttatattgctcaacatggtagaccaggccctgttttaattgatatacctaaagatgttggtctagaaaaatttttttatcaacctattaatcctggtgatattaatttattaggttgtcgtcctttcatgaaaccaaaagataatcagattattaaaattttaaatctattgtatgaatctagtcagcctttactttatgttggagggggttctataatttctggtgctcatgatgtaataaagcagtttgcttaccgttttcaaatacctatatgtactactttaatgggaaaaggtatcattgatgaaagtgataatttatgtttaggtatgctgggtatgcatggcacagcttatgccaattttgcagttagtgaatgtgacttgttaattgctctaggtgctagatttgacgatagggttacaggcaaattagatgaatttgcatgtaatgctaaagtcatacatattgatattgatcctgctgaaataggtaaaaatcgtgttcctcaagttgctattttaggtgatgttaagcaagttatggtacaaattttaagttatctagataatagctctaattttgtttttaattctcaacagacttattcttggaaggatagaatttctatgtggagagatcaatatcctttgttaattccaaagcatgtgactaatttatcaccgcaagaagttattttttatttatctcgtattcagactaatgcctattttactactgatgttggtcaacatcagatgtgggcagctcaatttgtaagtgtcttaccaagacattggatgtctagttctggtttaggtactatggggtatggacttcctgctgctataggtgttcaagtagctcatccttctgaagctgtaatatgtattagtggagatgctagttttcaaatgaatcttcaggagcttgctacaatttctcagtataatttacctataaaaatcattattattaataataaatggcagggtatggttagacaatggcaacaagctttttatggagagaggtattctcattctaatatggaaaaaggtgctcctgattttgttttgttagctcaatcttttggtattctaggattagaattggaacatagatatgatatgaataaagtcttacatcgttttgtgaatcatgatggtccgtgtttattgaattgtaaagttagagaagaagaaaattgctatcctatggtagcgcctggtaaaagtaattctcaaatgataggtatatctaaaccaataaaaaataaaaattcttcaatattaaaattggagacagatagcctttaa

SEQ ID NO: 82331 - protein, 596 aa, Gracilaria tenuistipitata var. liui
MNINSNSDLREVTGAFALMDSLIKNDVKYVFGYPGGAILPIYDELYKWENQGLITHILCRHEQGASHAADGYARSTGKVGVCFATSGPGATNLVSGIATAQLDSVPLVLITGQVARSFIGTDAFQEVDIFGITLPIVKHSYVVRDSRDMSRIVSEAFYIAQHGRPGPVLIDIPKDVGLEKFFYQPINPGDINLLGCRPFMKPKDNQIIKILNLLYESSQPLLYVGGGSIISGAHDVIKQFAYRFQIPICTTLMGKGIIDESDNLCLGMLGMHGTAYANFAVSECDLLIALGARFDDRVTGKLDEFACNAKVIHIDIDPAEIGKNRVPQVAILGDVKQVMVQILSYLDNSSNFVFNSQQTYSWKDRISMWRDQYPLLIPKHVTNLSPQEVIFYLSRIQTNAYFTTDVGQHQMWAAQFVSVLPRHWMSSSGLGTMGYGLPAAIGVQVAHPSEAVICISGDASFQMNLQELATISQYNLPIKIIIINNKWQGMVRQWQQAFYGERYSHSNMEKGAPDFVLLAQSFGILGLELEHRYDMNKVLHRFVNHDGPCLLNCKVREEENCYPMVAPGKSNSQMIGISKPIKNKNSSILKLETDSL

SEQ ID NO: 82332 - DNA, 1839 bp, Desulfotalea psychrophila LSv54
  CDS (1)..(1839): transl_table=11
ttgacagagccacctactccatatatactttgttgttccagctttaaatatggcaataagaaaaaccacgaactccatagagttttggttttatgtactaatgaaaatgtttcaactattcaagggaatggattaatgggtaaaataaccggatcccgggctattgtacaatgtctcaaagaagaaggcgttcaaactatttttggttatcccggaggagctgtcattgatctttatgacgccctaatggatagcactgacattgagcatgttcttgtccgtcacgagcagggcgctgttcatgcagccgatgcctttgctcgagttacaggtgaagttggcgttgccctgctcacctctggccctggcgccaccaacggcgttacaggtatcgcaacagcatatcttgactcaatcccacttgtggtactcacaggtcaagtcccccgtgcccttattggcaacgatgcctttcaagaagtcgatattgttggtatcactcgcccatgcaccaagcataactacctggtgagcaagccggaagacctcgtccccgtactgcgcgaggcatttcatgtggccaagacaggacgacctggccccgtactggttgatttgccaaaggatattctcgccacacttattgattatccacaaattgcgcctatcaaactggacagctaccaaccaaactacaagccacatcaaggccagataaccaaggcatgtaagcttctcatgcaggcaaaaaagcctgtcctctacgtgggtggtggagttattctctccaactcacacaaagagctctctgctctggctgaaaagttacagatacctgtcaccatgaccttaatgggcctcggagcatttcccgggagccatgatctctccatgggcatgcttggtatgcacggcagctataccgccaatatggccgttgccgaaagcgacctcctcattgccgtgggtgccagatttgatgaccgcgtgactggtaaacttgaagattttgccagcaaggcaaaaatcatccatgtggatatcgatcccacctccatcagtaaaaatgttaaggtcgacgtacccattgtagccgattgcctcgcagctctcacagccatcaacgactggcttgaaaagtgccctgaagaggagattgcagaacgaagggacgctcacaaaccatggatcgacaccgtccataattggaccaaagaacaccccatgcgctataactctaacggcagtgagataaagccacagtttgttgtcgaaaccattgaccgactgaccaagggggaggctattatcaccaccgaggtagggcaaaatcagatgtgggcagcccagttctacaaatttaaccacccccgccattttgttacctcaggcggcctgggaaccatgggctttggcctgcctgctgccatcggcgcccaaatggcctttcctgataaaatagtcatcgatattgcaggcgatggttctatccagatgaacatccaggagctggccacagcaagacaaaacaactgtaatgttaagattgttattctgaacaacggctatctgggcatggttcgtcaatggcaggaactcttttacgataaacgctacgcctcaactgtaatggatgttgcccccgattttgtcaaactcgctgaggcatacggtgcagtagggctacgagccaccaaaaaagaagaggttgaatctgtacttgccgaaggtcttgccaccgacaatgttgttattatggaatttttagttgctccagaggaaggggtatacccgatggttcccgcaggaaaagcaaatactgaaatgcttcttgtataa

SEQ ID NO: 82333 - protein, 612 aa, Desulfotalea psychrophila LSv54
MTEPPTPYILCCSSFKYGNKKNHELHRVLVLCTNENVSTIQGNGLMGKITGSRAIVQCLKEEGVQTIFGYPGGAVIDLYDALMDSTDIEHVLVRHEQGAVHAADAFARVTGEVGVALLTSGPGATNGVTGIATAYLDSIPLVVLTGQVPRALIGNDAFQEVDIVGITRPCTKHNYLVSKPEDLVPVLREAFHVAKTGRPGPVLVDLPKDILATLIDYPQIAPIKLDSYQPNYKPHQGQITKACKLLMQAKKPVLYVGGGVILSNSHKELSALAEKLQIPVTMTLMGLGAFPGSHDLSMGMLGMHGSYTANMAVAESDLLIAVGARFDDRVTGKLEDFASKAKIIHVDIDPTSISKNVKVDVPIVADCLAALTAINDWLEKCPEEEIAERRDAHKPWIDTVHNWTKEHPMRYNSNGSEIKPQFVVETIDRLTKGEAIITTEVGQNQMWAAQFYKFNHPRHFVTSGGLGTMGFGLPAAIGAQMAFPDKIVIDIAGDGSIQMNIQELATARQNNCNVKIVILNNGYLGMVRQWQELFYDKRYASTVMDVAPDFVKLAEAYGAVGLRATKKEEVESVLAEGLATDNVVIMEFLVAPEEGVYPMVPAGKANTEMLLV

SEQ ID NO: 82334 - DNA, 1716 bp, Symbiobacterium thermophilum IAM 14863
  CDS (1)..(1716): transl_table=11
atggagatgcaggcggcccgcgccctgatgcgggcattggaggcggagggggtcgaggtcatcttcggctaccccggcggggcgagtctgtacatctacgacgccctctatgacagccccatccaccacgtgctgacccggcacgagcagggggcgatccacgcggccgaggggtacgcccgggccacgggcaaggtcggggtggtgctggccacctccggccccggcgcgaccaacctggtgaccggcctgtgcgatgccatgatggactcgaccccgatcgtggccatcacggggcaggtgacccgttcgctcatcggccgggacgcgttccaggaagccgacgtcacgggcataacgatgcccgtcacgaagcacaactacctggtgacggacccgaacgacctgctccgggtggtgcgcgaggccttctacatcgcccgcaccggccggcccggaccggtcctgatcgacatccccaaggacgtgaccaacgcccaggtgcgctgggagtacccgcccaggatccacctgccgggctaccgggtgccgcgggaggccagcccggaggcggtggcggcggccgccgaggccatccggtccgcgcggcagccggtcctgatctgcggcggcggcgtggtctcgtccccggacgccaccggaccgttccggaccttggctgagcggatggacgccccggtggtggagacgctgatggggctcggcggcttccccatggaccatccgctgtgcctggggcttgtgggcatgcacgggacctttgccgccaaccgggcggtggccaactccgacctggtgatcgcctgcgggatgcgctttgacgaccgggtgaccggcatggcctcccggtttgcgcccaaggcccggatcatccacatcgacatcgaccccgcggagatgtccaagaacctgacggcgcacatcccgctggtgggcgactgcggcctggtgctcgcgcagctcaacgaggccctgggcgactggtcccagaccctccccgagtggcgggcgcaggtgcaggggtggcaggagcagttcccgctctggggcgtgcgccggggcgaggagatcgccaccgacccggacggggtgccgaagccgcagcaggtgatccaggcggtgcaggcggccttcgggccggaggccgtggtcgccaccgacgtcggccagcaccagatgtgggcggcgcactactgcacccgtacggagccccggacgtggctttcctccagcgggctgggcacgatgggcttcggccttccggcggccatcggcgccgcgatcggtcgccccgaccgggacgtggtgctcatcaccggcgacggctcgttccagatgtgcatccaggagctggccactgtggtccaggagcgggtgccggtcaagatcgtcctgctcaacaacggctacctgggcatggtgcgccagtggcaggagatgttctacaagggccggtacaaggaggtcgacctgcggccgggcatgccggatttcgtgaagctggccgaggcatatggcatcaaggggctgcgggtgcggcggctcggcgagctggaaggggccgtggccgaggcccgggcgcaccagggtccggtgctgctggaggtcgtggtggaggaggaagagaacgtcttcccgatcgtgccgcccggtggggccaacaccgaggcgctgttgcccggggcggggcgctga

SEQ ID NO: 82335 - protein, 571 aa, Symbiobacterium thermophilum IAM 14863
MEMQAARALMRALEAEGVEVIFGYPGGASLYIYDALYDSPIHHVLTRHEQGAIHAAEGYARATGKVGVVLATSGPGATNLVTGLCDAMMDSTPIVAITGQVTRSLIGRDAFQEADVTGITMPVTKHNYLVTDPNDLLRVVREAFYIARTGRPGPVLIDIPKDVTNAQVRWEYPPRIHLPGYRVPREASPEAVAAAAEAIRSARQPVLICGGGVVSSPDATGPFRTLAERMDAPVVETLMGLGGFPMDHPLCLGLVGMHGTFAANRAVANSDLVIACGMRFDDRVTGMASRFAPKARIIHIDIDPAEMSKNLTAHIPLVGDCGLVLAQLNEALGDWSQTLPEWRAQVQGWQEQFPLWGVRRGEEIATDPDGVPKPQQVIQAVQAAFGPEAVVATDVGQHQMWAAHYCTRTEPRTWLSSSGLGTMGFGLPAAIGAAIGRPDRDVVLITGDGSFQMCIQELATVVQERVPVKIVLLNNGYLGMVRQWQEMFYKGRYKEVDLRPGMPDFVKLAEAYGIKGLRVRRLGELEGAVAEARAHQGPVLLEVVVEEEENVFPIVPPGGANTEALLPGAGR

SEQ ID NO: 82336 - DNA, 1725 bp, Mannheimia succiniciproducens MBEL55E
  CDS (1)..(1725): transl_table=11
gtgaaaatgaaaaaattatctggtgcggaaatggttgtgcagtcattgcgtgatcaaggcgttaaatatttgttcggctatccgggcggttcggttttagacatttatgacgcgattcatactttaggcggaatcgaacacgtactggttcgtcatgaacaagccgcggtgcacatggcggacggttacgcccgttcaaccggtgaggtggggtgcgtattagtaacttcaggcccgggttcaactaacgcggtaacaggtattttaaccgcttataccgattcggtgcctctcgttattattaccggtcaggtgcgttccaatttaattggtaccgatgctttccaggaatgcgacactatcggcttaacccgtccggttgttaaacacagttttatggttaaacatgcggaagatattccggaaaccattaaaaaagcgttttatattgcgtcttccggtcgcccgggtccggtagttattgatattccgaaagatgtggtcaaccctgccaataaatatacttacgaatatccgaaagaagtaagcttgcgttcttataacccgaatgtacaaggacacaaaggccaaatcaaaaaagcgttgaaagcgttattggtggcgaaaaaaccggtattatttatcggcggcggtgtaattatcggcaacagcagcgaaaaattaacccaatttgcccagttgcttaatttgccggtgacttcctcattaatgggcttgggcggttatcccggcacggataaacaattcctcggtatgctgggtatgcacggaacttaccaagccaacatggcaatgcacaatgcggatttaattttaggtatcggcgtacgttttgacgaccgtaccaccaataatgtagagaaatattgtccgcatgcaaaagtgatccacgtggatatcgacccgacatccatttctaaaaatatcgcggcggatattccgattgtaggtagcgtggataatgtattaaccgaatttttatctttactggaagatgacaatttatcaaaatcacaatcggatttaacggaatggtggaaacaaattgatgaatggaaggcgaaaaaatgtctggaattcgaccgcacttctcaagcgattaaaccgcaagccgtggttgaagcgatttatcgtttaaccaaaggtgaggcttatattgcttccgatgtaggccagcaccaaatgtttgccgcattgcattatccgtttgataagcctcgtcattggatcaattccggcggcgcaggtacaatgggattcggtttgccggcggcgatcgggacgaaattcgcccatccggacagccgggttgtgtgtattaccggtgacggtagtattcaaatgaatattcaagagctttcaaccgcaaaacaatatggtacgccgattgtgattgtaagtctgaacaatcgcttcttaggcatggtaaaacaatggcaggatttgatttattcgggccgtcattcacaggtttatatgaattcgttacctgattttgccaaattggcggaagcttacggtcatgtagggattcaaatcaatacggcagacgagttagaggaaaaactgactcaagcctttgcggttaaagataaattagtgtttgtcgatgtacttgtggatgccacggaaaatgtatatccaatgcaaattacaggcggcggaatgaatgaaatgcttttaggtaaaccagcggagaaataa

SEQ ID NO: 82337 - protein, 574 aa, Mannheimia succiniciproducens MBEL55E
MKMKKLSGAEMVVQSLRDQGVKYLFGYPGGSVLDIYDAIHTLGGIEHVLVRHEQAAVHMADGYARSTGEVGCVLVTSGPGSTNAVTGILTAYTDSVPLVIITGQVRSNLIGTDAFQECDTIGLTRPVVKHSFMVKHAEDIPETIKKAFYIASSGRPGPVVIDIPKDVVNPANKYTYEYPKEVSLRSYNPNVQGHKGQIKKALKALLVAKKPVLFIGGGVIIGNSSEKLTQFAQLLNLPVTSSLMGLGGYPGTDKQFLGMLGMHGTYQANMAMHNADLILGIGVRFDDRTTNNVEKYCPHAKVIHVDIDPTSISKNIAADIPIVGSVDNVLTEFLSLLEDDNLSKSQSDLTEWWKQIDEWKAKKCLEFDRTSQAIKPQAVVEAIYRLTKGEAYIASDVGQHQMFAALHYPFDKPRHWINSGGAGTMGFGLPAAIGTKFAHPDSRVVCITGDGSIQMNIQELSTAKQYGTPIVIVSLNNRFLGMVKQWQDLIYSGRHSQVYMNSLPDFAKLAEAYGHVGIQINTADELEEKLTQAFAVKDKLVFVDVLVDATENVYPMQITGGGMNEMLLGKPAEK

SEQ ID NO: 82338 - DNA, 1653 bp, Mannheimia succiniciproducens MBEL55E
  CDS (1)..(1653): transl_table=11
atgaacggagcaaacttagttacagaatgcctaaaagcccataatgtagacaccgtgtttggttatcccggcggtgccattatgccggtatatgacgccttatacgattgtggtattaaccatcttttatgtcgtaatgagcaaggtgcggcgatggcggctatcggttatgcgagatccaccggcaagaccggcgtatgtatcgccacttcaggccccggtgcaaccaacttaattaccggtttgggcgacgccttaatggattccattcctctggtggcgattaccgggcaggtagccgcgccgttaatcggtaccgatgcatttcaggaagcggatgtgctggggttatctctcgcctgtacgaaacacagttttatcgtacagaatattgaagaattacctgaaatttttgccaaagcctttaaaatcgcacaaagcggccgtccgggacctgttttgattgatattcctaaagatgtgcaattcgctgaaactttacttcaacctattgtttattctgttgaaaaaccgaccgcactttccgctaagagtttggaaaaagccgtcgaattgctgaaaaatgcaaaacgcccggtggcttatatcggcggcggtgtaggcatggcaaaagcggtgccggcattgcatgaatttttaaccgcaacccgaattccgacaatttgcacattaaaaggattaggtgccgtgccagcggataacccttattatatgggcatgatcggtatgcacggtacgaaagcggctaattacgcaacacaagaggcggatttgctgttggtgttaggtgcgcgatttgacgatcgcgtaacgggtaaattaagcagttttgccaccgaagcgaaggtgattcatgcggatattgacgttgcggaaattaacaaattacgccgtgccgatgtggcgttatgcggcgatctcgagcaggcgctcaaagctttgagttttgccttggatatcgagccttggcgtgcggacgttcaacgtttaaaacgggattttgactgggattacggtgaaaacgaaggcgaaggggatattaatccgctgtttttattaaaccgcgtttcccgtttgaaagcggaaaatgccattgtggtcaccgatgtggggcaacaccaaatgtgggcggctcaacatatgagctttggcaagccggagaattttattacgtcggcgggtttcggtaccatgggattcggtttgccggtggccattggtgcacaaaaagcccgcccccgggatcaggttattttagtaaccggcgacggttcgatcatgatgaacattcaggagttgggctcaatcaaacgggcgaaaacgccgattaagattttattattggacaaccaacgtctcggcatggtgcgtcagtggcagtctttattctttcacggtcgtcacagttcgacaattttagacgataacccggattttgtgaccctggcgtccgctttcggtataagaggggaacgtatagaaaaagccggtgaagtaaacgaagcgttggatcgtttctttgcaagccaagaggcttatttgctgcatgtttgtgtgcatgaagacgaaaacgtatggccgcttgtgccaccgggcgcctgtaatgtagaaatgatcgaagaaatgagctaa

SEQ ID NO: 82339 - protein, 550 aa, Mannheimia succiniciproducens MBEL55E
MNGANLVTECLKAHNVDTVFGYPGGAIMPVYDALYDCGINHLLCRNEQGAAMAAIGYARSTGKTGVCIATSGPGATNLITGLGDALMDSIPLVAITGQVAAPLIGTDAFQEADVLGLSLACTKHSFIVQNIEELPEIFAKAFKIAQSGRPGPVLIDIPKDVQFAETLLQPIVYSVEKPTALSAKSLEKAVELLKNAKRPVAYIGGGVGMAKAVPALHEFLTATRIPTICTLKGLGAVPADNPYYMGMIGMHGTKAANYATQEADLLLVLGARFDDRVTGKLSSFATEAKVIHADIDVAEINKLRRADVALCGDLEQALKALSFALDIEPWRADVQRLKRDFDWDYGENEGEGDINPLFLLNRVSRLKAENAIVVTDVGQHQMWAAQHMSFGKPENFITSAGFGTMGFGLPVAIGAQKARPRDQVILVTGDGSIMMNIQELGSIKRAKTPIKILLLDNQRLGMVRQWQSLFFHGRHSSTILDDNPDFVTLASAFGIRGERIEKAGEVNEALDRFFASQEAYLLHVCVHEDENVWPLVPPGACNVEMIEEMS

SEQ ID NO: 82340 - DNA, 1722 bp, Bacillus licheniformis ATCC 14580
  CDS (1)..(1722): transl_table=11
atggcaaacaaaaccgcaggaaaaatagctgcagaactgctgaaggaatggaacattgatcatgtttacggcatgccgggcgacagcgtcaacgaatttatcgatgaattgcggcatgaagaaaacagcctccgcttcattcaagtgcgtcatgaagaaaccgctgctctcgctgccgcagccgatgcaaagctgacaggcaaaatcggcgtctgcctttcgatagcgggcccgggcgccgttcatctgctgaacggcttgtatgatgcgaaagctgacggggcgcctgtgcttgcgattacaggacaggtgtcttcggatgaaatcgggagagattattttcaggagatcggtcttgaacgaatgtttgaggatgtggctctctttaatcagcaggtgcattcggctgaagccctgccagatcttttgaatcaggcgatccgtaccgcatacagccaaaaaggggccgccgttctgagcgtatccgatgatctgtttgcagaaaagattaagcggaagccggtttatacgtctgcgctttatatcgaaggcgatcttgaaccgaagaaaagccagctgatgcagtgtgcacaattgattaaccaggcaaaaaaaccggtgattttagcgggacggggaatgaaatcggcgagagacgagctgctcgagtttgcagataaagcggccgctccgatcattgtcacactcccagcgaaaggggtcgtacctgatcggcacccgcatatgctcgggaacctcggacacatcggcacaaagcctgcatatgaagcgatggaggaaagcgatctgttgatcatgctggggacttcatttccgtaccgcgattatctgccggaagatgccccggctattcagcttgacaacaatccggcgaaaatcggcaaacggtatcctgtcaccgccggccttgtctgcgatgcgaaaaaagggctttttgaactgacgaaaacaattgaacggaaatcgaaccgcgcatttttggaaagctgtatacaacatatgaggaagtggcgttatgaagttgaaaaagacgaacaggtagcgacagagccgctgaagcctcagcaggtgattgcaagacttgaggacgcggtcgcagatgatgcggttctgtccgttgacgtcggaaatgtgacggtttggacggcgcgccattttaatatgaccaatcaggattttttgatatcaagctggcttggcacgatgggatgcggtcttccaggcgcgatttctgcaaagctttcccatccggaacgccaggttgtagccgtgtgcggagacggcggtttcagcatgtctatgcacgattttccgactgctgtcaaatacgaactgcccattgttgttgtgattttaaataatcagaacttgggaatgattcaatatgaacagcaggaaaaagggcatgttaattatgcgacggcgctcgaaaacgtcgattatgccaagtttgccgaagcctgcggcgggaagggcttcagcgtgacaaagcacgaagagcttattcctgctttgaaaagcgcctttcattcacaaaagccgtcgattatcgatgtggcaattgaagacgaaccgcctcttccgggaaaaatatcctatacacaagctgtaaactacagcaaatatatgatcaaaaaactagttgagaaaaaagagctcgacttgccgccgctgaaaaaaagtttaaaaaggattttttag

SEQ ID NO: 82341 - protein, 573 aa, Bacillus licheniformis ATCC 14580
MANKTAGKIAAELLKEWNIDHVYGMPGDSVNEFIDELRHEENSLRFIQVRHEETAALAAAADAKLTGKIGVCLSIAGPGAVHLLNGLYDAKADGAPVLAITGQVSSDEIGRDYFQEIGLERMFEDVALFNQQVHSAEALPDLLNQAIRTAYSQKGAAVLSVSDDLFAEKIKRKPVYTSALYIEGDLEPKKSQLMQCAQLINQAKKPVILAGRGMKSARDELLEFADKAAAPIIVTLPAKGVVPDRHPHMLGNLGHIGTKPAYEAMEESDLLIMLGTSFPYRDYLPEDAPAIQLDNNPAKIGKRYPVTAGLVCDAKKGLFELTKTIERKSNRAFLESCIQHMRKWRYEVEKDEQVATEPLKPQQVIARLEDAVADDAVLSVDVGNVTVWTARHFNMTNQDFLISSWLGTMGCGLPGAISAKLSHPERQVVAVCGDGGFSMSMHDFPTAVKYELPIVVVILNNQNLGMIQYEQQEKGHVNYATALENVDYAKFAEACGGKGFSVTKHEELIPALKSAFHSQKPSIIDVAIEDEPPLPGKISYTQAVNYSKYMIKKLVEKKELDLPPLKKSLKRIF

SEQ ID NO: 82342 - DNA, 1725 bp, Bacillus licheniformis ATCC 14580
  CDS (1)..(1725): transl_table=11
atggggacgaatgtacagttggatgctgaaaatgcccaatgtacacaaacaatggcaggggcgtcaatgctgatcgaggctttaaaacaggaaaatgttgaagtgatctacgggtatccgggcggtgcggtcctgccgatttatgacaaactctacggatcgggaatgtttcatgtgctgacgcgccatgaacaaggcgccatccacgcagccgaaggatatgcaaggatttccgggaaaccgggtgtcgtcatcgctacatccggaccgggagcgaccaaccttgtaacgggtctggccgacgcgatgatcgattcattgcctctcgtcgtattcaccggtcaggttgcgacatcggttatcggatctgacgcattccaagaagcggacgtcatcggaattacgatgccgattacaaagcacagctaccaggtacgcaatgccgaagatttgccgagaattattaaagaagcattccatatcgcaacaacaggaagaccgggccccgttttaatcgatattcctaaagacatcgccgttgtagaaggagaattccgctatgaccacgacattcaccttccgggctatcagccgacgaaggaaccgaattatctgcagatcagaaagcttgtggaagcggtcagtgcagcgaaaaagccggttattttagcgggtgcgggcgtcttgcacgggaaagcgtcagaagaattaaaaaattatgtcgaacagcagcagattccggtggcacatacgctgttaggcttgggaggatttccggccgatcatccgcttttcctcgggatggccggaatgcacggaacgtatgcggccaacatggctctgtatgaaagcgatctgttaatcagcatcggtgccaggtttgatgaccgggtcacagggaacttgaagcattttgcaaaatatgcgaaagtcgctcacattgacatcgatccggctgaaatcggcaaaaacgttcatacgcacattccggttgtcggcgacagcaagcttgtactgacggagctgatcaagcaaaacggcaagccgagcgcttctgatgagtggaaaaagcagcttgcggcatggaaaaccgaatatccgctctggtatgaagaaaatgaaacagaaggattcaaaccgcagaagctgatcgaatatatccaccgctatacaaagggcgaagctattgtaacaacagacgtcggacagcaccaaatgtgggccgcgcaattttatcagttccaaaaagccgacagatgggtcacttccggcgggctcggcacaatgggcttcggacttccggcggcaatcggagcacagcttgcggataaggatgcgacggttgtatcgatactcggcgacggaggattccagatgacgctgcaggagctgtctgttattcacgatctgaaccttccgatcaaggtcgtggtcttaaacaaccgctgcctcggaatggtccggcaatggcaggaaatcttttacgatgagcgctattcgcactccaagttcacatcacagcctgatttcatcaagctgtctgaagcttacggcatcaaaggcgtccgaatcacatccgaagaagaagcggaagaaaagctggaagcggcgctaacgtcgaatgaaccgatggtcattgatgttcaagttgcacaagctgaaaaagtatttccaatggttgcgcctggaaaagggctgcacgaaatggtgggggtgaaaccttga

SEQ ID NO: 82343 - protein, 574 aa, Bacillus licheniformis ATCC 14580
MGTNVQLDAENAQCTQTMAGASMLIEALKQENVEVIYGYPGGAVLPIYDKLYGSGMFHVLTRHEQGAIHAAEGYARISGKPGVVIATSGPGATNLVTGLADAMIDSLPLVVFTGQVATSVIGSDAFQEADVIGITMPITKHSYQVRNAEDLPRIIKEAFHIATTGRPGPVLIDIPKDIAVVEGEFRYDHDIHLPGYQPTKEPNYLQIRKLVEAVSAAKKPVILAGAGVLHGKASEELKNYVEQQQIPVAHTLLGLGGFPADHPLFLGMAGMHGTYAANMALYESDLLISIGARFDDRVTGNLKHFAKYAKVAHIDIDPAEIGKNVHTHIPVVGDSKLVLTELIKQNGKPSASDEWKKQLAAWKTEYPLWYEENETEGFKPQKLIEYIHRYTKGEAIVTTDVGQHQMWAAQFYQFQKADRWVTSGGLGTMGFGLPAAIGAQLADKDATVVSILGDGGFQMTLQELSVIHDLNLPIKVVVLNNRCLGMVRQWQEIFYDERYSHSKFTSQPDFIKLSEAYGIKGVRITSEEEAEEKLEAALTSNEPMVIDVQVAQAEKVFPMVAPGKGLHEMVGVKP

SEQ ID NO: 82344 - DNA, 1698 bp, Bacteroides fragilis YCH46
  CDS (1)..(1698): transl_table=11
atgagtaaagatataatttcaggcggtgaagcattaatgcgttctttggaatatcatggtgtaaagacgatctttggttatcccggaggatctatcatgcccgtattcgatgccttatacgatcatagagagactttgaatcatattttggttcgccacgaacaaggggcggcacatgcggctcagggatttgcccgtgcttcgggtgaggtcggagtttgcctggtgacgagcggccccggtgctaccaataccataaccggtattgcggatgcaatgatcgacagtacaccgattgtagtcattgccggacaggtgggaacagcttttttggggacagatgcttttcaggaggtcgacttggtaggcatcacgcagccaattacaaaatggagttatcagatccgtcgtgccgaagatgtgccatgggcggtggcccgcgccttttatatagcgaaaagcggacgcccgggaccggtagtgctcgactttgcaaaaaatgcccaggtggagaaagccgaatatatgcctgcgaaactcgatttcatacgcagttacgtgcctgtacccgagactgacccggaggccgtgaaagcggctgccgaattaattaacggtgcagagcgcccgttggtattggtggggcaaggtgtggaactgggcaacgcacaacaggaattgcgtgctttcatcgaaaaggcagatatgcccgccggatgtacgttgttgggactgtcggctttgccgaccgagcatcctttgaacaaaggtatgctgggaatgcacggtaatctcggaccgaatatgaacactaataaatgtgatgtcctgattgctgtcgggatgcgttttgacgaccgtgtgaccggaaacctggctacgtacgccaagcaggcgaaagtgattcattttgatatcgatccggctgaaattaataagaatgtacatgcggatgtagcggttctgggtaactgtaaagagacgctctctgctgttacggcattgctgcagcccaacgagcataaagaatggctggatagtttcctgccttatgaacaggtggaagaagaaaaggtaatccgtccggaattgcatccgatgggagatacgctttcgatgggggaagtggtgcgtgcggtaagcgatgcaaccaatcatgaagcgatattggtgaccgatgtcggtcaaaaccagatgatgtctgcccgatactttaaatattcaaaagaccggagtatgattacttccggaggacttggtaccatgggattcgggttgccggctgctatcggtgcaacctttggccgaccggaccgtacggtttgtgtatttatgggtgacggtggtctgcaaatgaacattcaggagttgggaaccattatggaacagaaggcaccggttaaaattatcgtattaaacaataatttcctgggcaatgtacgccaatggcaggcaatgttcttcaaccgtaaatactcgttcacacccatgctgaatcccgattatattaagattgcttctgcttatgatataccggccaaaagagtctttacccgtgaagaactggctgatgcgattgacgagatgattgcgacagacggtccgttcctgttggaagcttgtgtgattgaagagggaaatgtgttgccgatgacccctccgggaggttcagttaaccagatgttgttggaatgctaa

SEQ ID NO: 82345 - protein, 565 aa, Bacteroides fragilis YCH46
MSKDIISGGEALMRSLEYHGVKTIFGYPGGSIMPVFDALYDHRETLNHILVRHEQGAAHAAQGFARASGEVGVCLVTSGPGATNTITGIADAMIDSTPIVVIAGQVGTAFLGTDAFQEVDLVGITQPITKWSYQIRRAEDVPWAVARAFYIAKSGRPGPVVLDFAKNAQVEKAEYMPAKLDFIRSYVPVPETDPEAVKAAAELINGAERPLVLVGQGVELGNAQQELRAFIEKADMPAGCTLLGLSALPTEHPLNKGMLGMHGNLGPNMNTNKCDVLIAVGMRFDDRVTGNLATYAKQAKVIHFDIDPAEINKNVHADVAVLGNCKETLSAVTALLQPNEHKEWLDSFLPYEQVEEEKVIRPELHPMGDTLSMGEVVRAVSDATNHEAILVTDVGQNQMMSARYFKYSKDRSMITSGGLGTMGFGLPAAIGATFGRPDRTVCVFMGDGGLQMNIQELGTIMEQKAPVKIIVLNNNFLGNVRQWQAMFFNRKYSFTPMLNPDYIKIASAYDIPAKRVFTREELADAIDEMIATDGPFLLEACVIEEGNVLPMTPPGGSVNQMLLEC

SEQ ID NO: 82346 - DNA, 1764 bp, Burkholderia pseudomallei K96243
  CDS (1)..(1764): transl_table=11
atgaacatgcccagcgcggaattctccacgtcggaatccctttcccctcagaaaaccggctccatcggcgccaccgtgctcatgaaggcactggccgacgagaacgtcgaattcatctggggctaccctggcggctcggtcctctacatctacgacgagctgtacaagcaagacaagattcaacacgtgctcgtgcgccacgagcaggccgccgtgcacgccgcggacgcgtactcgcgctcgacgggcaaggtcggcgtgtgtctcgtcacatccggcccgggcgtgacgaacgcggtgacgggcatcgccaccgcctacatggattcgatcccgctcgtcgtgatcagcggccaggtgccgaccgcggcgatcggccaggacgcgttccaggagtgcgataccgtcggcatcacgcggccgtgcgtgaagcacaatttcctcgtgaaggacgtgcgcgagctcgcgcaaaccgtcaagaaggcgttctacatcgcgcgtaccggccggcccggtccggtcctcatcgacatcccgaaggacatctcgaagacgccgtgcgagtacgagcccgtcaagaacgtgtcgctgcgctcgtacaacccggtcacgaaaggccattcggggcagatccgcaaggcggtgtcgctgctgctgtccgcgaagcgtccgtacatctacacgggcggcggcatcatcctcgccgacgcgtcgcgcgagctgaaccagttcgccgacctgctcggctatcccgtcacgaacacgctgatgggcctcggcggctatcgctcgtcggacaggaaattcctcggcatgctcggcatgcacggcacctacgaagcgaacatggcgatgcagcactgcgacgtgttgatcgcgatcggcgcgcgcttcgacgaccgcgtgatcggcgatccggcgcacttcgcgtcgcgcccgcgcaagatcatccatatcgacatcgatccgtcgtcgatctcgaagcgcgtgaaggtcgacatcccgatcgtcggcgacgtgaaggaagtgctcaaggagctgatcgagcagttgcagacggccgagcacggcccggacgccgacgcgctcgcgcagtggtggaaggaaatcgaaggctggcgcgggacggattgcctgaagtacgaccgcgcgagcgagatcatcaagccgcaatacgtcgtcgagaagctctgggagctcaccgacggcaacgcgttcgtttgctcggacgtcggccagcaccagatgtgggccgcgcagttctaccgcttcaacaagccgcgccgctggatcaactcgggcggcctcggcacgatgggcttcggcctgcccgccgcgatgggcgtcaagatggcgcacccggacgacgacgtcgtctgcatcacgggcgagggctcgatccagatgtgcatccaggagctgtcgacctgcaagcagtacgacactccggtgaagatcatttcgctgaacaaccgctacctcggcatggtccgccaatggcagcagatcgaatacagcaagcgctattcgcattcgtacatggatgcgctgcccgatttcgtgaagctcgcgcaggcgtacggccatatcgggatgcgcatcgaaaaatccgcggacgtcgagccggcgctcaaggaagcgctgagcctgaaggaccgcaccgtgtttctcgacttccagaccgaccccaccgagaacgtctggccgatggtccaggccggcaagggcatcaccgagatgctgctcggatcggaagatctgtaa

SEQ ID NO: 82347 - protein, 587 aa, Burkholderia pseudomallei K96243
MNMPSAEFSTSESLSPQKTGSIGATVLMKALADENVEFIWGYPGGSVLYIYDELYKQDKIQHVLVRHEQAAVHAADAYSRSTGKVGVCLVTSGPGVTNAVTGIATAYMDSIPLVVISGQVPTAAIGQDAFQECDTVGITRPCVKHNFLVKDVRELAQTVKKAFYIARTGRPGPVLIDIPKDISKTPCEYEPVKNVSLRSYNPVTKGHSGQIRKAVSLLLSAKRPYIYTGGGIILADASRELNQFADLLGYPVTNTLMGLGGYRSSDRKFLGMLGMHGTYEANMAMQHCDVLIAIGARFDDRVIGDPAHFASRPRKIIHIDIDPSSISKRVKVDIPIVGDVKEVLKELIEQLQTAEHGPDADALAQWWKEIEGWRGTDCLKYDRASEIIKPQYVVEKLWELTDGNAFVCSDVGQHQMWAAQFYRFNKPRRWINSGGLGTMGFGLPAAMGVKMAHPDDDVVCITGEGSIQMCIQELSTCKQYDTPVKIISLNNRYLGMVRQWQQIEYSKRYSHSYMDALPDFVKLAQAYGHIGMRIEKSADVEPALKEALSLKDRTVFLDFQTDPTENVWPMVQAGKGITEMLLGSEDL

SEQ ID NO: 82348 - DNA, 1713 bp, Burkholderia pseudomallei K96243
  CDS (1)..(1713): transl_table=11
atgaaagcctcaaacgccatcgcccgatttctcgccgcgcacgacgttcgacattgtttcgagctcgtcggcggaatgatcacgcatctgctcgacagcttcgcggaaagcgggcgctttcaaatcgtgtcgatgcatcacgagcaggccgccgcctttgcggcggagggcgtcgcgcggcgctacatggggcgcaaggtggccgtcgcgctgggcacgagcggcccgggcgcgacgaatctgatcacgggcatcggcagttgctggctggattccgttccgtgcgtgttcatcaccgggcaagtcaatacgcacgagctgaaaggcgagcgggcgatacggcagcagggtttccaggagctcgacatcgtgccgatggtgcgctcgatcaccaagcatgcggtgcaagtcagcgacgcgaacgaactgctgccggcgctgcacggcgcgctgtccgcggcgctgtccggccggcagggccccgtcctcatcgacattccgaacgacgtgcagcgcgccgagatcgcggacgccgctgtcgatcgatggctgggcgagccgttgcgcatccgcgatcgatgcgagcccggcgatcgcgacatcgacgcgctgcgcgagctgtgccgctcgtcctcgcggccgctcgtgtgcttcggcggcggcgcgcgctgggcgccgtcgatgcccgcatggatcgccgcattggaggacgcgcggattccctacgtcagcaccttgatgggacacgagcgcgtgcccgccggcgcgcactatttcaacatgatcggcgcgtacggcaatcgggaagcgaactgggccgtgcagcactgcgatctgctgatcgtgatcggcgcgcgtctcgacgtgcgccagaccggcgcggacgtcggcgatttcgcgcgtcatgcgcgggtcattcagatcgacatcgatcccgctcagttgaacaaccgcatcaaggtcgagcaggccttgtgctgtgacgcggaatcgttctttcggcggtttgccgtgcggcgcgatacgttcgccggcatccggccggattgggcggaccagctcgccacgctgagaacggcgcatgcccgcaacgagtacccggactggaacatcagccccggcgtcgtgttcgcgcgcctgaacgaggcgatggccggcaaggcggttcactacgtgtgcgacgtgggcaatcatcaaatgtgggccgcgcagggccttcggctgggcgcgacccaagccgtccactacagcggcggcatgggcgcgatgggtttcgcgctgccgaccgcgatcggcatcgcgtgcagcggcgacggcggcggcaagaccgtcgtgatcacgggcgacggcagcctgcaggtgaacgtgcaggagctcgatacgctgagccggctgcaactcgatgtggccatcgtggtgatgaacaattattcgctcggcatggtcaagaattttcaggacatgtatttcgacggcaagaacatctcgaccaagcaaggctatagctgcccgtcgttcgtcgcgctcgcgcgcgcctatggcatcgagagcatgacggtcgccgcgccggccgagctgcaacgggcgatcgaccgggtggcgggctcgcgccggccgttgctcgtcgaaatcgcgatgccggaggcgacggagtgtcggccccggctcgccttcggccgaaagctcgacgatcagtatccgaaactcgattaa

SEQ ID NO: 82349 - protein, 570 aa, Burkholderia pseudomallei K96243
MKASNAIARFLAAHDVRHCFELVGGMITHLLDSFAESGRFQIVSMHHEQAAAFAAEGVARRYMGRKVAVALGTSGPGATNLITGIGSCWLDSVPCVFITGQVNTHELKGERAIRQQGFQELDIVPMVRSITKHAVQVSDANELLPALHGALSAALSGRQGPVLIDIPNDVQRAEIADAAVDRWLGEPLRIRDRCEPGDRDIDALRELCRSSSRPLVCFGGGARWAPSMPAWIAALEDARIPYVSTLMGHERVPAGAHYFNMIGAYGNREANWAVQHCDLLIVIGARLDVRQTGADVGDFARHARVIQIDIDPAQLNNRIKVEQALCCDAESFFRRFAVRRDTFAGIRPDWADQLATLRTAHARNEYPDWNISPGVVFARLNEAMAGKAVHYVCDVGNHQMWAAQGLRLGATQAVHYSGGMGAMGFALPTAIGIACSGDGGGKTVVITGDGSLQVNVQELDTLSRLQLDVAIVVMNNYSLGMVKNFQDMYFDGKNISTKQGYSCPSFVALARAYGIESMTVAAPAELQRAIDRVAGSRRPLLVEIAMPEATECRPRLAFGRKLDDQYPKLD

SEQ ID NO: 82350 - DNA, 1662 bp, Methylococcus capsulatus str. Bath
  CDS (1)..(1662): transl_table=11
atgcgtgaaacgatacctccccgcaccggcgccgacctgctggtcgactccctccaggcgctgggcgtcgaatacgtcttcggcgtgcccggcggcgcgatactcccgatcctgaacgtgctggccgaccgcggcccgcgcttcatcgtttgccgggacgaaaccggcgccgccttcatggcccagtcctggggccggatcaccggccggcccggcgtggtgctcaccacctccggccccggcctcatcaacgccgtctgtggcgtcgctaccgccacagaggaccgcgacccgctggtcgtcatcaccggccaggtgccgcgggccgtgcaattcaagcagagccacatgaacctggattcggtcggcctgttcgcgccgatcaccaaatggagcgtcgaggtcgaggaaccgaataccgtatcggaaatcctggtcaacgccttccgcaccgcgcagacgccgtgcgccggagccgtccacgtctcggtaccgaacgacatgctcaccgcgccggtcaccgcgcaggccctggcgccggccgaacccgccgtctggggaacggccccggccgccgtcgtcgaacgcgcggcgtccctgctgaacgatgccaaagccccggccatcctgctcggattgcgggccagcacacctggagcggcggcggcggtccggcgtttcctggagcggcatccgctgccggtggcgatgaccttcgaagccgccggcaccctgtcccgcgatctggtcgatcagttcgtcggccgggtcggctacgtgctcaaccagccgggcgacgaggtgctgcgccaagccgatctggtactcacgatcggctacgacccgatcgaatacgaaccttccgcctggatctcaccgcagtcgcaggcgatccacctggatgccctgcccgccgccgtcgaccgggcctaccaccctgccgccgaactggtcggcgacatcgccgccaacctggccgcgctcggcagcctgctccgaatcgaggatcgagccggacgccccgccgtcgccgcggcgcggcggcgtctgctggaggagcaagcccgcggcgcagcactgaccggtatgccgatccaccccttgcgcttcattcacgaccttcgggccacgctggacgacgaggcgacggtgacctgcgacgtcggcgcccacgagatctggatggcccgctacttcttctgctacgccccgcgtcacctgctgttcagcatgggccaccagaccatgggcgtcgccctgccctgggccatcggcgcggccctggcccggcccggcaagaaagtggtttcggtatccggcgacggctccttcctcatgacctgcatggaactggaaaccgcggtgcgcctcaaactgccgatcgtgcacatcgtctggaaagacggcggctacaacctgatccacagcctgcagatgcgcgactatgggcgcagcttcggcgccgagttcggccccaccgacttcgtcaaactggcggaggccttcggcgcgatcgggtaccggatcgagtccgcggacgggatcgtccctgtgctgaaccgggcgctcgcggccgacgcgccggtgctgatcgaagtgcccatcgactacagcgacaacgtccacctggtcgaggcgatcgacgcctcggcgcagcactga

SEQ ID NO: 82351 - protein, 553 aa, Methylococcus capsulatus str. Bath
MRETIPPRTGADLLVDSLQALGVEYVFGVPGGAILPILNVLADRGPRFIVCRDETGAAFMAQSWGRITGRPGVVLTTSGPGLINAVCGVATATEDRDPLVVITGQVPRAVQFKQSHMNLDSVGLFAPITKWSVEVEEPNTVSEILVNAFRTAQTPCAGAVHVSVPNDMLTAPVTAQALAPAEPAVWGTAPAAVVERAASLLNDAKAPAILLGLRASTPGAAAAVRRFLERHPLPVAMTFEAAGTLSRDLVDQFVGRVGYVLNQPGDEVLRQADLVLTIGYDPIEYEPSAWISPQSQAIHLDALPAAVDRAYHPAAELVGDIAANLAALGSLLRIEDRAGRPAVAAARRRLLEEQARGAALTGMPIHPLRFIHDLRATLDDEATVTCDVGAHEIWMARYFFCYAPRHLLFSMGHQTMGVALPWAIGAALARPGKKVVSVSGDGSFLMTCMELETAVRLKLPIVHIVWKDGGYNLIHSLQMRDYGRSFGAEFGPTDFVKLAEAFGAIGYRIESADGIVPVLNRALAADAPVLIEVPIDYSDNVHLVEAIDASAQH

SEQ ID NO: 82352 - DNA, 1731 bp, Methylococcus capsulatus str. Bath
  CDS (1)..(1731): transl_table=11
gtggaactcagcggtgcggaaatcgtcgtccaatgccttaaagacgagggtgtggaatacatcttcggctatccgggcggtgcagtactgcatatttacgatgcgctgttcaaacaggacgatgtaaagcacatcctggtgcgccacgaacagggcgcgacccacgcggcggacggttacgcccgctccaccggcaaacccggcgtggtcctggtgacttcgggccccggtgcgaccaatgccgtcaccggcatcgccaccgcctacatggattcgatcccgctggtggtcatcacgggccaggtgcccctgcccgtcatcggcagcgacgccttccaggaggccgacatcgtcggtatcactcggccgtgcgtgaagcacaacttcctggtcaaggacatccacaagctggccgaaactttcaagaaggccttctacatcgcgaccacgggacgcccggggcccgtcgtgatcgacatccccaaggatgtcaccgatccgaacgtcaagattccctacgagtatccacgcagcgtatcgctgaggtcctacaatccttcggtgaaggggcatccgatccagatcaagaaggcggtggagctcatgctgtcggctcgccgcccgatgatctacagcggcggcggcgtcatcctcggcaatgccgcggacgaactgaccacgctgacgcggctgctcgacttccccatcaccaacaccctgatgggtctgggcggctaccccgccaccgaccgccagttcgtcggcatgctgggcatgcacggcacctacgaggccaacatggcgatgcacgactgcgacgtgctgctcgccgtgggcgcccgcttcgatgaccgcgtcaccggcaagatcgccgaattctgtcccggcgccaaaatcatccacatcgacgtcgacccggcctcgatctccaaaacggtcaaagtggacatccccatcgtcggcgacgtcgcgccggtgctggccgacatgatcgagctgatcaagacttccggccgcacccccgatgccgaggcgctgaaggcctggtgggcaaggatcgaccagtggcgcagcctcgactgcctgcgctacgaccgcagcagcgacaggatcaagccgcagttcgtcatcgaacagttatgggaactgacgcggggcgacgccttcgtggcctccgacgtcggtcagcaccagatgtgggcggcccaatactacaaattcgacaagccgcgccgctgggtcaattccggcggcctgggcacgatgggcttcggactgccggccgccatcggcatcaaattggcgcatccgcaggaagaggtcatctgcatcaccggcgaagcgagcatccagatgtgcatccaggaactggccaccgccttgcagtaccgcaccccggtcaagatcgtcaacctgaacaacggctacatgggcatggtgcgacaatggcaggaattcatctatgaaagccgctattcgcattcctacctggagactctgccggacttcgtcaaactggcggaggcctacggtcacgtcggcatgcgcatcgacagaccggccgacgtgcgcccggccctggaagaagccctgaaactcaaggaccgcaccgtgttcatggatttcctcaccgatcccaccgaaaacgtctaccccatggtcgaatccggcaaggcccatcacgagatgcggctggcgcccggtactgcggttgacagggagctcgcctga

SEQ ID NO: 82353 - protein, 576 aa, Methylococcus capsulatus str. Bath
MELSGAEIVVQCLKDEGVEYIFGYPGGAVLHIYDALFKQDDVKHILVRHEQGATHAADGYARSTGKPGVVLVTSGPGATNAVTGIATAYMDSIPLVVITGQVPLPVIGSDAFQEADIVGITRPCVKHNFLVKDIHKLAETFKKAFYIATTGRPGPVVIDIPKDVTDPNVKIPYEYPRSVSLRSYNPSVKGHPIQIKKAVELMLSARRPMIYSGGGVILGNAADELTTLTRLLDFPITNTLMGLGGYPATDRQFVGMLGMHGTYEANMAMHDCDVLLAVGARFDDRVTGKIAEFCPGAKIIHIDVDPASISKTVKVDIPIVGDVAPVLADMIELIKTSGRTPDAEALKAWWARIDQWRSLDCLRYDRSSDRIKPQFVIEQLWELTRGDAFVASDVGQHQMWAAQYYKFDKPRRWVNSGGLGTMGFGLPAAIGIKLAHPQEEVICITGEASIQMCIQELATALQYRTPVKIVNLNNGYMGMVRQWQEFIYESRYSHSYLETLPDFVKLAEAYGHVGMRIDRPADVRPALEEALKLKDRTVFMDFLTDPTENVYPMVESGKAHHEMRLAPGTAVDRELA

SEQ ID NO: 82354 - DNA, 1866 bp, Nocardia farcinica IFM 10152
  CDS (1)..(1866): transl_table=11
gtgtccgcggcgcatcagaaggagattcccgtgacccccgccgccccgccgtccgcccgccccgaaacaccctgcccgccgccggtttccccgccccgcaccgaacggctgaccggcgcgcaggccgtggtgcgctcgctcgaagaactcggtgtcgaggtcgtcttcggcatccccggcggcgcgatcctgccggtctacgatccgctgctggactcgcgccggatccggcacgtgctggtgcgccacgaacagggcgcgggccacgccgccaccggctacgcccaggccaccggccgcgtcggcgtctgcctggccacctcgggccccggcgccaccaacctggtgacgccgctggccgacgcccacgccgactcggtgccggtcgtggccatcaccggccaggtgccgttgccgatgatgggcaccgacgccttccaggaagccgacatcaccggtatcgtcgcgccgatcaccaagcacaccgcgctcgtcacccatgccgccgacatcccgcgggtgctcgccgaggccttccacctggcggcgtccggccgccccggcgcggtgctcgtcgacatccccaaggacgtgctgcgcgccaccaccctcttcacctggccgccccggctcgacctgcccggctatcggccggtgaccgaaccgaacgcccgccagatccgcgccgcgctggccctgatcgcccgcgcgcaggcaccggtgctctacgtcggcggcggcgtgatcaaagcgaacgcgagcaggcggctgcgcgccttcgccgaggcgaccggcatccccgtcgtcaccacgctgatggccaggggcgcgttcccggacagccaccggcagcatctcggcatgcccggcatgcacggtaccgtcgcggcggtgggcgcgctgcagaagagcgacctggtcatcgcgctcggcgcccgcttcgacgatcgggtgaccggagacccggcctccttcgccccgcacgccgctgtggtgcacgccgacatcgacccggccgagatcggcaagatccggcacgcggaggtgcccatcgtcggcgactgcgacgccgtcctcgccgcgctgctggcggcactgcccgacgtgccgcgcccggacctgaccgcgtggtgggccgaactggaccggctgcggcgcacctacccgctgggcttcgaccggcccgccgacggagcgctggccccgcagcacgtcatccgtgcgctgggccgcgcggccgggccggaggcggtctactgcgcgggcgtcgggcagcaccagatgtgggcggcgcagttcctggagttcgagaaaccgcgcagctggctcaattccggtggcatgggcacgatgggctacgccgtccccgccgcgctcggcgccaagctcggcaggccggaggcggaggtctgggccatcgacggcgacggctgcttccagatgaccaatcaggaactggcgaccgccgcgatcgagggcatcccgatcaaggtcgcggtgatcgacaacggtcatctcggcatgatccggcagtggcagcacctgttctacgaggagcggtactcccagagcgagctggccacccactcccggcgggtgcccgacttcgccctgctggccgaggcgttggggtgcgtgggcctgcggtgcgagcgcgaggccgacgtggatgcggtgatcgcggcggcccgtgccgtgcgggaccggccggtcgtcatcgatttcgtcgtcggcgcggacgcgcaggtgtggccgatgatcgaggccggcgcgggcaacgacctgatcatggcggcccgtgacctgcgcccgctgttcgacgacagcgaggatcccggcccaccgcaggcgcccgcgcgcgggtga

SEQ ID NO: 82355 - protein, 621 aa, Nocardia farcinica IFM 10152
MSAAHQKEIPVTPAAPPSARPETPCPPPVSPPRTERLTGAQAVVRSLEELGVEVVFGIPGGAILPVYDPLLDSRRIRHVLVRHEQGAGHAATGYAQATGRVGVCLATSGPGATNLVTPLADAHADSVPVVAITGQVPLPMMGTDAFQEADITGIVAPITKHTALVTHAADIPRVLAEAFHLAASGRPGAVLVDIPKDVLRATTLFTWPPRLDLPGYRPVTEPNARQIRAALALIARAQAPVLYVGGGVIKANASRRLRAFAEATGIPVVTTLMARGAFPDSHRQHLGMPGMHGTVAAVGALQKSDLVIALGARFDDRVTGDPASFAPHAAVVHADIDPAEIGKIRHAEVPIVGDCDAVLAALLAALPDVPRPDLTAWWAELDRLRRTYPLGFDRPADGALAPQHVIRALGRAAGPEAVYCAGVGQHQMWAAQFLEFEKPRSWLNSGGMGTMGYAVPAALGAKLGRPEAEVWAIDGDGCFQMTNQELATAAIEGIPIKVAVIDNGHLGMIRQWQHLFYEERYSQSELATHSRRVPDFALLAEALGCVGLRCEREADVDAVIAAARAVRDRPVVIDFVVGADAQVWPMIEAGAGNDLIMAARDLRPLFDDSEDPGPPQAPARG

SEQ ID NO: 82356 - DNA, 1719 bp, Photobacterium profundum SS9
  CDS (1)..(1719): transl_table=11
atggaaatgttgtctggcgcagacatgatcgttcgttcaatgatcgatcaaggcgtaaagcatatcttcggataccctggtggttcagtacttgatatttacgatgctctgcatgagaagagtgatatcgaacacgtactcgtccgccatgagcaagccgctgtacacatggcagatggttatgctcgagctacaggtgatgtgggtgtagtactcgttacatcaggtcctggtgcgacgaatgcaatcactggtattgcgacggcctacatggattctatccctatggttgttttttctggtcaggttatgagtaacttgattggtaatgatgccttccaagaatgtgacatggtgggtatttctcgtcctgttgtgaagcacagctttttaattaaaaaagctcaagatatccctgagatcatcaaaaaagctttttatatcgcttctagcggtcgccctggtcctgttgttatcgatatccctaaagatatgctgaatccagcggaaacctacccttatcaatacccagaatcgattgcgatgcgttcgtataacccaacaacgcaagggcacaaaggtcagattaaacgtggtctaaaagcactcttatctgcgaagaagcctgttctgtacgtcggtggcggtgctgttatctctgaatgtgatcagcaaatcttaaaattagcagaatcgttgaatcttccggttgttaatacactgatggggttaggcgcatttccggggacgcataaaaattgtcttggtatgttaggtatgcacggcacatacgaagccaatatggcaatgcataatgcggatttgatctttggtattggtgttcgttttgatgatcgaaccaccaacaatgttgataaatattgtccaaatgccacgatcatgcacatcgatatcgacccatcttctatttcaaaaaccattgcggtggatattccgattgtaggctctgctgaaacggttctagattgcatgcttaaaatgctcgatgagcaagaaagcagtaatgaccaagaggcgatagcgagttggtgggcagatcttgagtcatggcgttcacgtaagtgtttaagttatgaaaccaataacgaacgtattaagcctcagcaggttattgaatcgctttataagttaacaaatggcgatgcatatgttgcctctgatgttggtcagcaccagatgtttgctgcattgtattatccttttgataaaccacgtcgttggattaattcgggcggcctcggcaccatgggctttggtcttcctgctgccatgggggtgaaatttgccttacctgatgcagaagtcgtttgtgtgactggtgacggcagtattcagatgaatattcaagagttatcaacggcacttcagtatgatatccctgttaaaatcattaacttaaataaccgctttcttggtatggttaagcagtggcaagatatgatttatcaaggtcgtcattcacattcgtacatggattcagtgcctgattttgctgcaatcgcagaagcttacggacatgttggggtgcgtatttcagatccagcgaaactggatagtgagctggaaaaagcgctagccatgaaagataagctggtgttcgttgatattagtattgatgaaaccgagcatgtatatccaatgttgatccgtggtggttcaatgagcgaaatgtggttaagcaaaacggagagaacataa

SEQ ID NO: 82357 - protein, 572 aa, Photobacterium profundum SS9
MEMLSGADMIVRSMIDQGVKHIFGYPGGSVLDIYDALHEKSDIEHVLVRHEQAAVHMADGYARATGDVGVVLVTSGPGATNAITGIATAYMDSIPMVVFSGQVMSNLIGNDAFQECDMVGISRPVVKHSFLIKKAQDIPEIIKKAFYIASSGRPGPVVIDIPKDMLNPAETYPYQYPESIAMRSYNPTTQGHKGQIKRGLKALLSAKKPVLYVGGGAVISECDQQILKLAESLNLPVVNTLMGLGAFPGTHKNCLGMLGMHGTYEANMAMHNADLIFGIGVRFDDRTTNNVDKYCPNATIMHIDIDPSSISKTIAVDIPIVGSAETVLDCMLKMLDEQESSNDQEAIASWWADLESWRSRKCLSYETNNERIKPQQVIESLYKLTNGDAYVASDVGQHQMFAALYYPFDKPRRWINSGGLGTMGFGLPAAMGVKFALPDAEVVCVTGDGSIQMNIQELSTALQYDIPVKIINLNNRFLGMVKQWQDMIYQGRHSHSYMDSVPDFAAIAEAYGHVGVRISDPAKLDSELEKALAMKDKLVFVDISIDETEHVYPMLIRGGSMSEMWLSKTERT

SEQ ID NO: 82358 - DNA, 1788 bp, Photobacterium profundum SS9
  CDS (1)..(1788): transl_table=11
atggagttcagtatggcgagaatgacagcaatagaagcagcagtagaagtattaaagcgtgaaggggtagacattgcttttggtgtacctggcgcagcaattaaccctatgtatgcggcgatgaaaaaattgggtggaattgatcacgtattggctcgacatgtcgaaggtgcttctcatatggctgaaggctatacgagaaccagccaaggcaatattggtgtctgtattggtacatctggccctgctggaaccgatatgatcacagggttatattctgcctctgcggattcgattccaattctttgtattacggggcaagcaccacgtgctcgactgcataaagaagattttcaagcggtagatattgaatcaatcgcaaagccagtcactaagtgggcaacaacagtattagagccagctcaagtgccgcgtgcatttcaaaaagcatttcatttaatgcgttcagggcgacctggacctgttttgattgatctaccgattgatgtgcagctaacagaaattgaattcgatattgatagctacgagccacttgatgcctacaagccaaccgcgagtcgcgctcaagttgaaaaagcaatcaccatgctgaacgatgctagcaatccggtgattgtatcgggtggtggggtgattaatgcgggggcatctgcactcttacagcaatttgcagaaattaccggcattccggttattcctacgctgatgggctgggggtcaatacctgataatcatgaactaatggcgggtatggtgggcctacaaacggcacaccgttatggtaatgccaccttgctaggttctgattttgtgttgggcattggtaaccgctgggcaaaccgtcataccggttcagtcgatgtgtataccgaaggtcgtaagttcgttcatatcgatattgaaccaactcagattgggcgtgttttctgccctgatcttggcattgtttctgatgccaaagctgcattggaactgttggtcgaggtggcgcgtgaatggaagcaagccggcaaattaaaagatcgtagcgactgggcgggtgagtgccagcaccgtaagtcgaccatgttacgtaaaacgcatttcgatgaagtgccaatgaaaccgatgcgtgtttatgaagaaatgaacaaagcatttgatgaagatacctgctacgtaagcaccattggtctatctcagattgctgcggctcagttcctccatgtttataagccgcgccattggatcaactgtggtcaggcaggccctttagggtggacaattcctgctgctttgggtatacgtgctgctgatccagaccgtccgattgtagcgatatcgggtgattacgatttccaatttatgattgaagaactggctgtaggggcacaatttaaattgccttacatccatgtcgtcgtgaacaactcgtaccttggtttgatacgccaagcacagcgtcagttcgatattgattactgtgttcagctggcattcgataaccaaaatgcgccagaacttgaagggtatggtgtcgaccatgtcgcggttgttgaaggtttagggtgtaaagccattcgagtgcgtgatcctgatcaagtaggtaatgcatttgctcaagccaaagagctaatggctaagcacaaagtgccagttgtcgttgaaatcatgctagagcgtgttaccaatatttcaatgggcgtcgagataaacggtattaacgaatttgaaccgttagccgaaggcagtgctgatgcaccgactgcgattacgtttaaccaatag

SEQ ID NO: 82359 - protein, 595 aa, Photobacterium profundum SS9
MEFSMARMTAIEAAVEVLKREGVDIAFGVPGAAINPMYAAMKKLGGIDHVLARHVEGASHMAEGYTRTSQGNIGVCIGTSGPAGTDMITGLYSASADSIPILCITGQAPRARLHKEDFQAVDIESIAKPVTKWATTVLEPAQVPRAFQKAFHLMRSGRPGPVLIDLPIDVQLTEIEFDIDSYEPLDAYKPTASRAQVEKAITMLNDASNPVIVSGGGVINAGASALLQQFAEITGIPVIPTLMGWGSIPDNHELMAGMVGLQTAHRYGNATLLGSDFVLGIGNRWANRHTGSVDVYTEGRKFVHIDIEPTQIGRVFCPDLGIVSDAKAALELLVEVAREWKQAGKLKDRSDWAGECQHRKSTMLRKTHFDEVPMKPMRVYEEMNKAFDEDTCYVSTIGLSQIAAAQFLHVYKPRHWINCGQAGPLGWTIPAALGIRAADPDRPIVAISGDYDFQFMIEELAVGAQFKLPYIHVVVNNSYLGLIRQAQRQFDIDYCVQLAFDNQNAPELEGYGVDHVAVVEGLGCKAIRVRDPDQVGNAFAQAKELMAKHKVPVVVEIMLERVTNISMGVEINGINEFEPLAEGSADAPTAITFNQ

SEQ ID NO: 82360 - DNA, 1647 bp, Photobacterium profundum SS9
  CDS (1)..(1647): transl_table=11
atgacaggggcagagttagttgtacacgcgctgcagcagcaagggataaccacgatatttggttatcctggtggcgcaattatgccaatctatgacgcactctatgatggtggcgtcgaacacattctttgccgtcatgagcagggtgctgcaatggctgcgattggtatggctagagccactcaagatgttgctgtatgcatggcgacatccggtccaggtgccactaatctggtaacaggattagccgatgcttttcttgattcagtacctatggttgcgattactggacaggtagccagctcgcatattggcaccgatgccttccaagaaatggatgtgattggcatgtcattgtcttgtaccaaacacagctaccttgttaccgacattaatgatctcgcacccacattagctgaagcgtttattgttgccaaagcaggtcgacctggcccggttattgttgatatagccaaagacgtacaactcgcccaagcgcctgttgaattgctgccgtttattgaagagccaagcattcctgttgcaacaccagaatctatcgctaaagctcagtgccttctagccgcaagccagcgtccagtattgtatgttggtggtggtgttcaaatcgctaaagcaaccgacaccgtacgtacttttctaaaactaaacccaatgccagcagtgagtacactgaaagggctgggcacagtagagcgtcacgccccccattatttaggcatgctgggtatgcacggcactaaggcggcgaatttagtcgttcaagagtctgatttattgattgtagtgggtgcccgctttgatgatcgcgtaaccggcaagcttgatactttcgcaccgcacgcaaaagtcattcaccttgacattgatgcctctgaatttaataaattacgcatcgcaaacgcgccattacgcggtgatgtcaatgtgatcttgccgcaattagaattgtcacaagacatctctgcttgggtacaacacagtgaaacattacgttctgatttcaaatggcgttataaccaccctggcgatctgatttatgcaccactactgatgaagcagttatccgatatgatgcccgacagctcggtgatttcgacggatgtcggccaacatcagatgtgggcagcacaacacattcaacctcgtgaaccacaaaattacatcacgtctgccggcctaggtacgatgggctttggcttacccgctgcgatgggggcgaaagtcgccagaccaaacgatgaatctatcctaatatcgggtgatggttcattcatgatgaatgttcaagagcttggcacgttaaagcgtaagcaaattccagtaaaaatggtgctgatcaataaccaacgcctcggcatggtaagacagtggcaatcgctgttttttaatgaacgccacagtgaaacgatcttagatgacaatcctgactttgtcgtattagccagtgcgtttggtattccaggcaaaacaatcaccaagaaagaagaagtagagccggcgctaagagaaatgctcgcaagtaaaaccgcttatttgctgcatgtacttatctctgaagaagaaaatgtatggccattagtgccacccggtgctgcaaatcaagatatgctggagaatacctaa

SEQ ID NO: 82361 - protein, 548 aa, Photobacterium profundum SS9
MTGAELVVHALQQQGITTIFGYPGGAIMPIYDALYDGGVEHILCRHEQGAAMAAIGMARATQDVAVCMATSGPGATNLVTGLADAFLDSVPMVAITGQVASSHIGTDAFQEMDVIGMSLSCTKHSYLVTDINDLAPTLAEAFIVAKAGRPGPVIVDIAKDVQLAQAPVELLPFIEEPSIPVATPESIAKAQCLLAASQRPVLYVGGGVQIAKATDTVRTFLKLNPMPAVSTLKGLGTVERHAPHYLGMLGMHGTKAANLVVQESDLLIVVGARFDDRVTGKLDTFAPHAKVIHLDIDASEFNKLRIANAPLRGDVNVILPQLELSQDISAWVQHSETLRSDFKWRYNHPGDLIYAPLLMKQLSDMMPDSSVISTDVGQHQMWAAQHIQPREPQNYITSAGLGTMGFGLPAAMGAKVARPNDESILISGDGSFMMNVQELGTLKRKQIPVKMVLINNQRLGMVRQWQSLFFNERHSETILDDNPDFVVLASAFGIPGKTITKKEEVEPALREMLASKTAYLLHVLISEEENVWPLVPPGAANQDMLENT

SEQ ID NO: 82362 - DNA, 1758 bp, Haloarcula marismortui ATCC 43049
  CDS (1)..(1758): transl_table=11
atgagcgagcgcgcatccgtccccaaggaagaggaagaaacagaaccagaaaccgaacaggagccggtcacaacgggcgcgcagtcggttattcgcgcgctcgaaaacgccgagaccgattacgtcttcggcgttcagggcggtgcaatcatgcccgtctacgacgcgctgtacgactccgatatcaaccacgtcacgatggcccacgaacagggggcctcacacgcggcggacgcgtacggcgtcgtcaccggcgaccccggcgtctgtttcgccacgtccggccccggggcgacgaacctcgtgaccggcatcgccgacgccaacatggactcggacccggtcatcgcgctgaccggccaggtcccgacggaattcgtcggcaacgatgcgttccaggagacggacacggtgggcatcacccagccgatcacgaaggagagctacttcgctgccgactcagacactgtcggcgacgatgtcagcgaagcgttcgcgctcgctgacgccggccggcagggaccgacgctggtcgacctgccgaaggacgtgactcagggcgaaaccgaggttgaacccggctcccccgagacgccggagacctacgaggtgccggaggaggccgacgacgaaaacgtccaggaggccgcagaagctctagccgaagccgaccgcccggtcatcctctcgggtggcggcgtcatcaaggcagacgcatcgagtgcgctccgtgagttcgcaaaggagtacgagattccggtcatcacgacgatgcccggcatcggctccttccccgaggaccacgaactctcgcttgagtgggccgggatgcacggcaccggctacgccaacatggcgattagcaacaccgactgcatgctggccatcgggacgcgcttcgacgaccgcctgaccggcggcgtcgactcttttgcccccgacgcggaggtcatccacgtcgacatcgacccggccgaaatcagcaagaacgtctacgctgactacccactcatcggagacgcccggaacgtgctccggcagctgttcgacgcgatgccgcgtgcgccggacgccgacgagtggcgcgaccagtgccagacctggaaagatgagtacccgatggactacgacacgcccgacgacgagccgctgaagccgcagtacgtcgtcgagcagttctcggagatgacgccggacgacactatcgtctgtaccggcgtcggccagcaccagatgtgggcctcccagttctgggagtacaccgagccccggacgtgggtgtcgtcccacggtctcgggacgatggggtacggcgtgccagccgccatcggtgccaaactcgccgcgccggaccaggaggtcgtctgcttcgacggcgacggctcgttcctgatgaccgtgcagggcctgtcggtcgcggtgcgtgagcaactcgatatcacctacgtcgtcctgaacaacgaggcggtcgggatggtccgccagtggcaggacggcttctacgagggccgccggatggcctccgagtacccgtggatcccacagttcgacaagctcgccgaggccttcggcgcacgcgggttcacgctcgaatcctacgacaatgtcgaggagacgatacaggaagcacgcgactacgacgggccgagcgtcatcgacgctcacatcgaccccggggagaacgtcttcccgatggtcccaagcggcggtgacaacggccagttcgcgctcaacgaagaccatctggacatgatctaa

SEQ ID NO: 82363 - protein, 585 aa, Haloarcula marismortui ATCC 43049
MSERASVPKEEEETEPETEQEPVTTGAQSVIRALENAETDYVFGVQGGAIMPVYDALYDSDINHVTMAHEQGASHAADAYGVVTGDPGVCFATSGPGATNLVTGIADANMDSDPVIALTGQVPTEFVGNDAFQETDTVGITQPITKESYFAADSDTVGDDVSEAFALADAGRQGPTLVDLPKDVTQGETEVEPGSPETPETYEVPEEADDENVQEAAEALAEADRPVILSGGGVIKADASSALREFAKEYEIPVITTMPGIGSFPEDHELSLEWAGMHGTGYANMAISNTDCMLAIGTRFDDRLTGGVDSFAPDAEVIHVDIDPAEISKNVYADYPLIGDARNVLRQLFDAMPRAPDADEWRDQCQTWKDEYPMDYDTPDDEPLKPQYVVEQFSEMTPDDTIVCTGVGQHQMWASQFWEYTEPRTWVSSHGLGTMGYGVPAAIGAKLAAPDQEVVCFDGDGSFLMTVQGLSVAVREQLDITYVVLNNEAVGMVRQWQDGFYEGRRMASEYPWIPQFDKLAEAFGARGFTLESYDNVEETIQEARDYDGPSVIDAHIDPGENVFPMVPSGGDNGQFALNEDHLDMI

SEQ ID NO: 82364 - DNA, 1683 bp, Streptococcus thermophilus LMG 18311
  CDS (1)..(1683): transl_table=11
gtgttcatgtcagaagaaaagcaattgtatggtgcagatttagtggttgatagtttgatcaaccatgatgttgagtatgtctttgggattccaggcgcaaaaatcgatagggtttttgataccttggaagataagggacctgaattgattgttgcccgtcatgagcaaaatgctgcttttatggctcaaggtgttggacgtattactgggaaaccaggtgtagtattggtaacatctggtccaggtgtctccaatttggctactggtttggtaacagcgacggatgaaggagaccctgttcttgctattggtggtcaggttaagcgtgcagatctcttgaaacgtgcccaccaatcaatgaataacgttgctatgcttgagccaattaccaaatatgctgctgaagtacatgatgctaacaccctttctgaaacggttgctaatgcctatcgtcacgctaagtcagggaaaccaggtgcaagcttcatttcaattcctcaagacgtgacggatgctccggtcagtgttaaggctattaagcctatgacagatccaaaacttggttcagcatctgtttctgatattaactatctagcacaagccattaaaaatgcagtgttgccagtctttcttttggggaatggtgcctcatcagaagccgtaacttactctattcgccaaattttgaagcatgttaaattgccagttgttgaaactttccaaggtgccggtatcgtgtcacgtgaccttgaagaagatactttctttggtcgtgtaggtcttttccgtaaccaacccggagacatgttgcttaaaaaatccgacttagttattgccattggttatgatccaatcgaatatgaagcacgtaactggaatgctgaaatttcagcacgtatcatcgttattgatgtcgagccggccgaggtggacacttacttccaaccggaacgtgaattgattggtaatgtagaagcgagcttagacttgcttttgcccgctattcaaggttataaattgcctgaaggtgcggttgaatatcttaaaggtttgaaaaacaatgttgttgaggatgttaagtttgaccgtcagcctgatgaaggtacggtgcatccgctagatttcatcgaaaatttgcaagaacacacagatgatgatatgactgttacgtttgatgttggtagtcactatatttggatggcacgttatctcaaatcgtatgaaccacgtcatttgcttttctcaaatgggatgcaaacgataggtattgctattacatgggctatctctgcagcattggttcgtcctaagacaaaagtgatttctgtatctggtgatggtggtttcctcttctcagcacaagaattggaaacagcagttcgtttgaaattgccaattgtccatattatctggaacgatggtcattacaatatggtggaattccaggaagaaatgaagtacggtcgttcatctggggttgactttggtcctgtagattttgtaaaatatgctgagagctttggagccaaaggttatcgtgcaacaagtaaagcagcgtttgctagcttgcttcaagaggctttgactcaggctgtagatggaccagtccttattgatgttccaattgactataaagataacattaaactcggcgaaactattttgccagatgaattttactaa

SEQ ID NO: 82365 - protein, 560 aa, Streptococcus thermophilus LMG 18311
MFMSEEKQLYGADLVVDSLINHDVEYVFGIPGAKIDRVFDTLEDKGPELIVARHEQNAAFMAQGVGRITGKPGVVLVTSGPGVSNLATGLVTATDEGDPVLAIGGQVKRADLLKRAHQSMNNVAMLEPITKYAAEVHDANTLSETVANAYRHAKSGKPGASFISIPQDVTDAPVSVKAIKPMTDPKLGSASVSDINYLAQAIKNAVLPVFLLGNGASSEAVTYSIRQILKHVKLPVVETFQGAGIVSRDLEEDTFFGRVGLFRNQPGDMLLKKSDLVIAIGYDPIEYEARNWNAEISARIIVIDVEPAEVDTYFQPERELIGNVEASLDLLLPAIQGYKLPEGAVEYLKGLKNNVVEDVKFDRQPDEGTVHPLDFIENLQEHTDDDMTVTFDVGSHYIWMARYLKSYEPRHLLFSNGMQTIGIAITWAISAALVRPKTKVISVSGDGGFLFSAQELETAVRLKLPIVHIIWNDGHYNMVEFQEEMKYGRSSGVDFGPVDFVKYAESFGAKGYRATSKAAFASLLQEALTQAVDGPVLIDVPIDYKDNIKLGETILPDEFY

SEQ ID NO: 82366 - DNA, 1689 bp, Thermus thermophilus HB8
  CDS (1)..(1689): transl_table=11
atgaagggagcggaggcacttttaagggcgctggagcgggaaggggtggaggtgatcttcggccacccgggcggggcgatcatgcccacctacgacgccctctacgacagccccatccgccacatcctggtgcggcacgagcagggcggggtccatgcggccaccgcctacgcccgcgcctcaggccgggtgggggtggtcatggccacctcgggccccggggccctgaacctggtcacgggcctcgcggacgccatgatggactccaccccggtggtggccatcaccgggaacgtcccccgggccctcatcggcaccgacgccttccaggaggcggacgtcaccggggttaccatgcccatcaccaagcacaactacctggtccaggacgtgaacgagatcccccgggtggtgaaggaggccttccacatcgccgccaccggccgccccggccccgtgctcattgacatccccaaggacgtgcagcttgcggagttcacggggagctttgacgtgaagctggacctccccgggtacaagcccaccctgaaggggcaccccaagcagattgagagggccctggacgccctggagaaggcggagcgccccgtcctcatggtggggggtggggcgcagcacgcccacgccgagctcctcgccttcgccgagaagacggggcttcccgtgatcaccaccctcatgggcctcggggccttccccgggaaccaccccttgtggctcgggatgccggggatgcacggcaccgtggccgccaaccgggccatccaccacgcggacgtgatcctcgccatcggcctccgctttgacgaccgggtcacgggcaaggtctcccgcttcgccccccacgcccacaccatcatccacgtggacatagaccccgccgagatcggcaaggtggtgcgcacccacatccccatcgtgggggactcgaggctcgtcctcaaggagctcctcaagggggcgaaggccttgaggcttgccgcctggtggcgggagctcgaggagtggcgcacccgctaccccttgcgctacaggcccaagccccacctgcagagccaggaggtgatccgggccttctacgaggccacgggaggacacgccatcgtcaccacgggggtggggcagcaccagatgttcgccgcccagttcttccccgtgacgaggccgaggagcttcctcaccagtgggggcctcggcaccatgggggtggggcttcccttcgccatcggggccaagatcgcccgccctgaggagctcgtcattgactttgacggggacggctccttccagatgaccctgcaggagctggccacggtggtgaagtacaagctggacgtgaaggtcgtcatcctgaacaacggctacctgggcatggtgcgccagtggcaggacctcttccacgccaagcgctacagcgaggtctacctggcggactccaaccccgacttcgcccgcctcgccgaggcctacgggatcaagggggtgagggtggagcggaaggaggacctcatgaagggggtggaggccgtcctgaacgccgacggccccgtggtggccgagttcaaggtctaccaggaggagggggtcttccccatgatccccgccgggggcgcggccgaggacatgatcctcgagcctcccgaggagaaggaggaggtgggggcgtga

SEQ ID NO: 82367 - protein, 562 aa, Thermus thermophilus HB8
MKGAEALLRALEREGVEVIFGHPGGAIMPTYDALYDSPIRHILVRHEQGGVHAATAYARASGRVGVVMATSGPGALNLVTGLADAMMDSTPVVAITGNVPRALIGTDAFQEADVTGVTMPITKHNYLVQDVNEIPRVVKEAFHIAATGRPGPVLIDIPKDVQLAEFTGSFDVKLDLPGYKPTLKGHPKQIERALDALEKAERPVLMVGGGAQHAHAELLAFAEKTGLPVITTLMGLGAFPGNHPLWLGMPGMHGTVAANRAIHHADVILAIGLRFDDRVTGKVSRFAPHAHTIIHVDIDPAEIGKVVRTHIPIVGDSRLVLKELLKGAKALRLAAWWRELEEWRTRYPLRYRPKPHLQSQEVIRAFYEATGGHAIVTTGVGQHQMFAAQFFPVTRPRSFLTSGGLGTMGVGLPFAIGAKIARPEELVIDFDGDGSFQMTLQELATVVKYKLDVKVVILNNGYLGMVRQWQDLFHAKRYSEVYLADSNPDFARLAEAYGIKGVRVERKEDLMKGVEAVLNADGPVVAEFKVYQEEGVFPMIPAGGAAEDMILEPPEEKEEVGA

SEQ ID NO: 82368 - DNA, 1656 bp, Geobacillus kaustophilus HTA426
  CDS (1)..(1656): transl_table=11
atgaagagaacgatgcgtcacatcacggtggctcaagccatcgtcgaatgtttcaaacaggaacaaatccgttatgtgtttggtgtgccgggggaaagttatttgcccctgcttgatgccatctatgatgagccatccatcgagttcatctccgcccgccatgaagggggtgcttcctttatggcggaagggtatgcgaaagcgtcgcggaagtgcggcgtcgtgctggctacaagggcggttggcggggcgaacttaacgatcggcgtccataccgccaggcaagattccactccgatggtcgtgtttttggggcaagtgaacagccgcttcctaggacgtgaaggatttcaggaagtcgatatggaagcgttttttcgtccgatcgccaaatgggtggtcgaaattcgcgaagccgagcgggtgccagagctggtgcaacgggcgtttcgcaccgcgaaaacagggcggcccggccccgtcgtcgtttcactgccagaagatgtattttccaaaacgataacggaagcagtgatggccgagacctatgtgccgaagccggccccaaggcaagaggatatacggaatataaaggagcggctcgagcgcgccaaacggccgctcgtgattgccggcggcggcgtcaaatggtcgggagccgagcagctgctgcgcttatgggcggaaaagtatgcacttccagtcatggcggcgttccggaggcatgatgtgtttccccacaaccatccgtgctatgtcggccacctaggcctagggacgccgaaagaggtcatggaaacggctgagcaggccgatgtggtgattgcgttggggacgcggctgtcggaagtgacgacgcaagattaccgtttgctatctccaacgcagacgctgattcatatcgatattgacagcgatgggctcggaaaagtgtatgcaccggatatcgcggtttgggctgactgtcgggaagcgctgtcccgtttgctcgatatcgcggtgcagccgtcttggcaggaatgggcggctgaacggagggaacggtacgaacaaacggccgcgctgccgcttgaaaaacgaactctccatgaagcggtcatggcgagtttaggtcaccatttgccgaaaaatgcggtcattacgaacgatgctgggaatttcgccggttggcttcacgcctttttcccgtttggggatgggcacacgtacatcggcccgacgtcaggagcgatgggatatggcatgccggctgccattggcgcgaaactggcctttcccgaccggaccgtcgtttctttatccggggatggcggctttatgatgacggtgcaggagttggaaacggccgctcgatacgatattccgatcattagcattgtgtttaacaatcatatgtacggcaccatccgcatgcatcaagaattgcagtttccggggcgggtcatcggcaccgatttaggccgcgtgtcgtttgcccggttggcagaatgcttgaacagctgcggattccaagtgcagacggaacaacagttcacggaagcgcttctgttggcgcttgaagccaagaagccgacggtgattgaagtgttgaccgatccgaaccacatttcggtggcggcaacgatccaagacttgcgggccaagaggaagtcctga

SEQ ID NO: 82369 - protein, 551 aa, Geobacillus kaustophilus HTA426
MKRTMRHITVAQAIVECFKQEQIRYVFGVPGESYLPLLDAIYDEPSIEFISARHEGGASFMAEGYAKASRKCGVVLATRAVGGANLTIGVHTARQDSTPMVVFLGQVNSRFLGREGFQEVDMEAFFRPIAKWVVEIREAERVPELVQRAFRTAKTGRPGPVVVSLPEDVFSKTITEAVMAETYVPKPAPRQEDIRNIKERLERAKRPLVIAGGGVKWSGAEQLLRLWAEKYALPVMAAFRRHDVFPHNHPCYVGHLGLGTPKEVMETAEQADVVIALGTRLSEVTTQDYRLLSPTQTLIHIDIDSDGLGKVYAPDIAVWADCREALSRLLDIAVQPSWQEWAAERRERYEQTAALPLEKRTLHEAVMASLGHHLPKNAVITNDAGNFAGWLHAFFPFGDGHTYIGPTSGAMGYGMPAAIGAKLAFPDRTVVSLSGDGGFMMTVQELETAARYDIPIISIVFNNHMYGTIRMHQELQFPGRVIGTDLGRVSFARLAECLNSCGFQVQTEQQFTEALLLALEAKKPTVIEVLTDPNHISVAATIQDLRAKRKS

SEQ ID NO: 82370 - DNA, 1791 bp, Geobacillus kaustophilus HTA426
  CDS (1)..(1791): transl_table=11
gtgggcggaaaggttttttatatggatgacaaatcacagggaggatcgacgatgacaaaaatgaaagtcgaggaacaagaaaaagcgaggacgaaggcgagaatgagcgggtcgctgatgctcattgaagcgctcaaggaagaaaaagtcgaagtcatcttcggctatccggggggggcggtgctcccgctgtatgacgagttgtataaagccggcgtgttccacgtgctgacgcggcatgagcaaggggccatccatgcggcggaaggatatgcgcgcatttctggaaaaccaggggtcgtcatcgccacctccggcccgggagcgaccaacatcgtcaccgggttgaccgacgcgatgatggattcgctgccgctcgtcgtctttaccgggcaagtggccacgagcgtcatcggctcggatgcgtttcaggaggcggacgttgtcggcattacgatgccgattacgaaacacaactaccaagtgcgcgacatcagcgagctgccgagaatcattaaagaggcgtttcacattgcgacgaccgggcgccccggaccggtgttgatcgatattccaaaagacattacgacggccgaaggggagtttgattacgatcaagacgttcatttgcctggctatcagccgacgacgcagccgaaccattggcaaatccgccggcttgtcgaggcggtcagccaatcaaagcggccggtcattttagccggcgctggcatcttgcacgccaatgcgtccaatgaattgcggcaatacgccgaacagcaaaacattccggtcattcatacgctccttggccttggcggtttcccggccgaccatccgctgtttttaggcatggccggcatgcacggtacgtatacggcgaatatggcgctgtgtgaatgcgatttgctcatcaacatcggcgcccgcttcgatgaccgggtcaccggcaatttaaaatatttcgcgccgaaagcgaccgtcgcccatatcgacatcgatccggcggaaatcggcaaaaacgtgccgacgaaaattccaatcgtcagcgatgcaaaagccgccttgcaagagctgatcgcccagcaaggcaagccggcggacacggcggcgtggctcacgcagcttgatgaatggaagcggcgcttcccgctccattatgagccggaagccggcacgatcaaaccgcaaaaactgatcgagatgatctatgaaatgacaaacggcgaggcgatcgtgacgacggacgtcggccagcatcaaatgtgggcggcgcaatattacaagttcaaccggccgcaccggtgggtgacgtccggggggctcggcacgatgggcttcgggcttccggcagcgatcggcgcccagctcgccgatcggagcgctacggtcgtttcgatcgtcggcgacggcggcttccaaatgacgttccaagaactgtcggtcatccaggagctacggctgccgatcaaaatcgtcatcgtcaacaaccaggcgctcggcatggtgcggcaatggcaggagctgttctatgacaaacggtactcccattcgctcattccgaaccagccggatttcgtcaagcttgccgaagcatacgggatgccaggtctgcgggcgaagacggaggcggaagcggccgaagtgttaaaacaagcgtttgcgatggatgggccggtgctgcttgatttccatgtccgcgccgacgagaacgtctatccgatggtggcgcccggcaaagggcttcatgaaatggtgggggtgaaagcatgcgaagaatcatcacgatga

SEQ ID NO: 82371 - protein, 596 aa, Geobacillus kaustophilus HTA426
MGGKVFYMDDKSQGGSTMTKMKVEEQEKARTKARMSGSLMLIEALKEEKVEVIFGYPGGAVLPLYDELYKAGVFHVLTRHEQGAIHAAEGYARISGKPGVVIATSGPGATNIVTGLTDAMMDSLPLVVFTGQVATSVIGSDAFQEADVVGITMPITKHNYQVRDISELPRIIKEAFHIATTGRPGPVLIDIPKDITTAEGEFDYDQDVHLPGYQPTTQPNHWQIRRLVEAVSQSKRPVILAGAGILHANASNELRQYAEQQNIPVIHTLLGLGGFPADHPLFLGMAGMHGTYTANMALCECDLLINIGARFDDRVTGNLKYFAPKATVAHIDIDPAEIGKNVPTKIPIVSDAKAALQELIAQQGKPADTAAWLTQLDEWKRRFPLHYEPEAGTIKPQKLIEMIYEMTNGEAIVTTDVGQHQMWAAQYYKFNRPHRWVTSGGLGTMGFGLPAAIGAQLADRSATVVSIVGDGGFQMTFQELSVIQELRLPIKIVIVNNQALGMVRQWQELFYDKRYSHSLIPNQPDFVKLAEAYGMPGLRAKTEAEAAEVLKQAFAMDGPVLLDFHVRADENVYPMVAPGKGLHEMVGVKACEESSR

SEQ ID NO: 82372 - DNA, 1659 bp, Idiomarina loihiensis L2TR
  CDS (1)..(1659): transl_table=11
gtgaaagcatccgatttattcgtaaaagcacttgaaaacgagggtgtgaagtacattttcggcattcccggcgaagaaaacctggacttacttgagtcgctctcaaaatccagcattgagctaattttaacccgccacgaacagggcgcaggtttcatggccgccacttatggtcgcctgaccggcaaacccggggtgtgcctttccaccttaggcccgggggcaaccaacttggttacaccggtggcctacgcgcaactcggcgctatgcctatggttgtcattactggacaaaaacccataaaggaacgtcatcagggtcaattccagatcattgatgtggtcgacatgatgactcccattaccaaatacactcaggcgattattagcgccagcagtattccggcgcacatccgtgaggcttttcgtcgcgctgaagatgaacgccccggcgcttctcacctggagctctcagatgatatcagtcgcgaagaggtcagcagccttccgatagaagccagtcattcgcgccgccccattaccgagcataaatcggtccgccacgtgctggaactactgcgcgaagcaaaacacccggtactgttgataggggctgcggccaatcggaaaattacagcaaaaatgctgcgcgcatttgtcgataaaaccggtattccttttattaccacgcaaatgggtaagggtgttattaacgaagaccacccacgctggcttggtaatgcggcggtttccgacggcgattacccgcaccgcgccatcgaaaaatctgacctgattcttaatgtcggtcacgacgtggtggaaaagccgccctttatgatgaaaaccggcgacaacgacaaccgtaaagtggtgcacattaactttcagggtgcccaggttgattcggtttactttcctcatgccagcatgatcggcgatattggtaacagtatctggcagttaaaagaagggattgagccgcaaagtcactgggatttcaactttatgctgaaagttcgcgatcacatgcgcgaccataccgatgaaggcgctcatgacggcagctttccggtgttaccccagcgtctggtagaagatgtgcgtgaagctatgccagatgacggtgtcattgcactggataacggcatctacaaaatttggtttgcacgtaattacccggctcgtcagccaaatacggtactactggataatgcccttgcctcaatgggtgcaggcttaccatcggccatggccgcgaagctggttaatccggaaaagaaagtcatggcaatatgcggtgacggcggttttatgatgaactctcaggagcttgaaactgctgtgcgcatggggctggatatcgttgtcgttatcttaaatgacagcggctatggcatgatcaagtggaaacagcagcatatgaaactgagcgactacggcttagatttcaataacccggattttgtgaaatatgcagagtcttacggcgctaacggttaccgtttagataaaaccgaaaacttgataccgctgttaaaagactgcctgaacaaacccggcgtacaccttattgatgtacccgtgaactattcacaaaatgaccgactgctgaacgaggaaatccccgaacgcagccgcgccattaaagatatttaa

SEQ ID NO: 82373 - protein, 552 aa, Idiomarina loihiensis L2TR
MKASDLFVKALENEGVKYIFGIPGEENLDLLESLSKSSIELILTRHEQGAGFMAATYGRLTGKPGVCLSTLGPGATNLVTPVAYAQLGAMPMVVITGQKPIKERHQGQFQIIDVVDMMTPITKYTQAIISASSIPAHIREAFRRAEDERPGASHLELSDDISREEVSSLPIEASHSRRPITEHKSVRHVLELLREAKHPVLLIGAAANRKITAKMLRAFVDKTGIPFITTQMGKGVINEDHPRWLGNAAVSDGDYPHRAIEKSDLILNVGHDVVEKPPFMMKTGDNDNRKVVHINFQGAQVDSVYFPHASMIGDIGNSIWQLKEGIEPQSHWDFNFMLKVRDHMRDHTDEGAHDGSFPVLPQRLVEDVREAMPDDGVIALDNGIYKIWFARNYPARQPNTVLLDNALASMGAGLPSAMAAKLVNPEKKVMAICGDGGFMMNSQELETAVRMGLDIVVVILNDSGYGMIKWKQQHMKLSDYGLDFNNPDFVKYAESYGANGYRLDKTENLIPLLKDCLNKPGVHLIDVPVNYSQNDRLLNEEIPERSRAIKDI

SEQ ID NO: 82374 - DNA, 1668 bp, Azoarcus sp. EbN1
  CDS (1)..(1668): transl_table=11
atgattcagatgaccggcgccgaactgatcctgcgcttgcttgaacggcagggcatacgcaccgttgccggtattcccggcggcgctatcctgccgctctacgatgcgctgtcgggtagcaagctgattcgccacgtgctcgcccgtcatgaacagggagccgggttcatcgcccaggggatggccagggtgtcgggccgcccggaggtgtgctttgcctcgagcggccccggtgcgacgaacctggttacggcgatcgccgacgcgcatctggattcgattcccatggtggcgatcaccgggcaggtgccgctttcgatgatcggcaccgacgccttccaggaagccgacatctacggcatgacggtgccggtcacgaagcataatttcctcgtgcgctcggcagccgaattgctggaggtgattcccgacgcgtttcgcctcgcgatgtccgggcgtcccggcccggtgctgatcgacatcccgaaggatgtgcagacccaggtcgtgagcttcgatgcgtttccgctgccggccatcccgaatgccgcgcccgcaagcgatccggacgcgatcgaggaggcggcacgactcatcaatgctgcggaacgcccggtgttgtatgtcggcggcggcgtgattcattccggcgcagcgcagcaaatcgtcatgctcgccgagcgtgccggcttgccgaccacgatgacgttgatggcgctgggcgtgatgccgatcgaccacccgctttcgctcggcatgctggggatgcatggcgcgcgctacacgaatttcatcctcgaagaatcggacctgctgatctgcgtcggtgcgcgcttcgacgaccgggcgatcggcaaggcggcgcaattctgcccgcgggcgaagatcgtgcatatcgacatcgatccgtccgaactgcacaagatcaggaacgcgcatgtcgcgatcaatggggatgtcggcgtggttctcgacgcgctgttgccgcgggtgaacatcaggctgcgcaagcgctggctgtcacatgtcggcagcctcaaaagccgttttccgctgcacatgccgaggctggaggatccgcgcagcccctatggtctcgttcaggcggtcgcctgtgcggtgagtgatgaggcagtggtcaccaccgacgtcgggcagcaccagatgtgggttgcccaggcttatccgtttcgccggccccgtcagtggctgacctccggcgggttcgggacgatgggattcggcttgccggtggcggtcggcgcagcgctggcagctcccgcgcgaacggtcatctgcttcaccggtgatggcagcttcaagatgaacatccaggaactcgcgacgctcgccgaagaagggctcaacgtgaagatcgtgctgatgaacaacaactcgctcgggctggtgtatcagcagcagagcctgttctacggtaaacgggtgttcgcgtcgaagtaccagggcgcaccggattttctgaaaattgccgagggcttcggcatcgacggcgtcgatctcgatacggtccggaacccccgcgcggcgcttgcccaggcgctgaacgccccggggccgtgcctgatccacgcatcgatcgactgcgaggaattcgtctatccgatggtgcctccaggcggtgcgaacaccgaaatgatcggaggctga

SEQ ID NO: 82375 - protein, 555 aa, Azoarcus sp. EbN1
MIQMTGAELILRLLERQGIRTVAGIPGGAILPLYDALSGSKLIRHVLARHEQGAGFIAQGMARVSGRPEVCFASSGPGATNLVTAIADAHLDSIPMVAITGQVPLSMIGTDAFQEADIYGMTVPVTKHNFLVRSAAELLEVIPDAFRLAMSGRPGPVLIDIPKDVQTQVVSFDAFPLPAIPNAAPASDPDAIEEAARLINAAERPVLYVGGGVIHSGAAQQIVMLAERAGLPTTMTLMALGVMPIDHPLSLGMLGMHGARYTNFILEESDLLICVGARFDDRAIGKAAQFCPRAKIVHIDIDPSELHKIRNAHVAINGDVGVVLDALLPRVNIRLRKRWLSHVGSLKSRFPLHMPRLEDPRSPYGLVQAVACAVSDEAVVTTDVGQHQMWVAQAYPFRRPRQWLTSGGFGTMGFGLPVAVGAALAAPARTVICFTGDGSFKMNIQELATLAEEGLNVKIVLMNNNSLGLVYQQQSLFYGKRVFASKYQGAPDFLKIAEGFGIDGVDLDTVRNPRAALAQALNAPGPCLIHASIDCEEFVYPMVPPGGANTEMIGG

SEQ ID NO: 82376 - DNA, 1710 bp, Azoarcus sp. EbN1
  CDS (1)..(1710): transl_table=11
atggtgctgactggtgcggaaattgtaatcaggtgtcttcaggaagaaaaggtcgaatacgtgttcggctaccctggcggcgccgtcctcttcatctacgatgcacttttcaaccaggacaaggtacgccacgtactggtgcgccacgaacaggccgcagtgcacgcagccgacggctttgcccgcagcaccgaaaccgtcggcgtcgcgctggtgacttccggccccggcgccaccaacgcgatcaccggcatcgccaccgcctattgcgactcgatcccgatggtgatcatcagcggccaggttccgaccgccgcgatcggacaggacgcattccaggaagtcgacactgtcggcatcacgcgcccgtgcgtcaagcacaactacctcgtcaaggatgtccgcgacatcgcgacgacgatcaagaaggcgttctacctcgccaagaccggccgtccggggccggtgctggtcgacatccccaaggatgtctcgatgcacaaatgcgaattcgagtacccgaaagaggtctcgatgcgttcgtacaatccggtgctcaagggccaccaggggcagatccgcaaagccgtgcagctgctgctcgaagccaagcgcccgatgatctacaccggcggcggtgtcgtgctgtcggatgcggccgaacagctcaccaaactcacccgcctgctcgggttcccgatcaccaacacgctgatgggtctgggcggctacccggcgagcgaccgccagtaccttggcatgcccggcatgcacggcacctacgaagccaacatggcgatgcattacagcgacgtgctgctcgccatcggcgcgcgcttcgacgatcgcgtcatcggtgatccggccaatttcgccgaggagccgcgcaagatcatccacgtcgacatcgatccgtcgtcgatctcgaagcgcgtccgcgtcgatgtcccgatcgtcggcgatgtcaaggaagtactcgaagagatgatccggcagatcgaagcctcgtccgcccgcccggacgtcgaaaccgtcggcacgtggtggaagcaggttgacgaatggcgccgccgcgagtgcatgaagttcaagaactcggacgagatcatcaagccgcagttcgtgatccagaagctatgggaagtgaccggcggcgacgccttcatcacatccgacgtcggccagcatcagatgtgggcctcgcagtactaccgcttcgacaagccgcgccgctggctcaactccggcggcctcggcacgatgggcgtcggcctgccgtacgctatgggtgcgcagctcgcgcaccccgggtcccaggtcgcatgcgtcaccggcgaagcgtcgatccagatgaacatccaggaattgtcgacgtgcaagcagttccggctgccgatcaagatcgtgaacctgaacaaccgctacctcggcatggtccgccagtggcagcagctcttccacggcgagcgctactccgagtcctacatggattcgctgcccgatttcgcgaagctcgccgaatcctacggtcacgtcggcttcaggatcgaaaagccggctgacgtggaaggcgcgctgcgtgaagctttcggccgcaagaacgacctggtgtttctcgacttccagatcgaccagaccgaaaacgtttaccccatggttcagggcggcaagggtctcaccgagatgatcctgtccgccgaagacctgtaa

SEQ ID NO: 82377 - protein, 569 aa, Azoarcus sp. EbN1
MVLTGAEIVIRCLQEEKVEYVFGYPGGAVLFIYDALFNQDKVRHVLVRHEQAAVHAADGFARSTETVGVALVTSGPGATNAITGIATAYCDSIPMVIISGQVPTAAIGQDAFQEVDTVGITRPCVKHNYLVKDVRDIATTIKKAFYLAKTGRPGPVLVDIPKDVSMHKCEFEYPKEVSMRSYNPVLKGHQGQIRKAVQLLLEAKRPMIYTGGGVVLSDAAEQLTKLTRLLGFPITNTLMGLGGYPASDRQYLGMPGMHGTYEANMAMHYSDVLLAIGARFDDRVIGDPANFAEEPRKIIHVDIDPSSISKRVRVDVPIVGDVKEVLEEMIRQIEASSARPDVETVGTWWKQVDEWRRRECMKFKNSDEIIKPQFVIQKLWEVTGGDAFITSDVGQHQMWASQYYRFDKPRRWLNSGGLGTMGVGLPYAMGAQLAHPGSQVACVTGEASIQMNIQELSTCKQFRLPIKIVNLNNRYLGMVRQWQQLFHGERYSESYMDSLPDFAKLAESYGHVGFRIEKPADVEGALREAFGRKNDLVFLDFQIDQTENVYPMVQGGKGLTEMILSAEDL

SEQ ID NO: 82378 - DNA, 1662 bp, Zymomonas mobilis subsp. mobilis ZM4
  CDS (1)..(1662): transl_table=11
atgtctgatacaaagtctacggtggcgaagctgttagttaaatgccttgaagccgaaggcgtcgaatatgtttttggtatcccgggtgaagaaaatatccgtcttattgatgccatggcggattcttctatccgtttcatcctggttcgccatgaacaaggtgcatcctttatggcggatatgtatggtcgcctaactggcaaggccggtgtttgcaccgcaaccttggggcccggtgccatcaatcttttactaggcgttgccgatgctcaaaccgatagcactcctatggttgccatcagtgcgcaagtcggccttaaccgtatttataaagagtctcatcaatatattgaccttcagggcatgtttgcccctgttaccaaatggtcagacacgatcctgacgccagcatccgtgccagaaatgatgcggaaagcctttgaccttgcccaaagagaacgccctggtgcggtttatctagcagtaccacaggatttagaagaatctgatgtctctgcggatttaaagccaatcaccgtccatccggttcacacaacagcaccagatcctgatcaggtagctgccacgattgatttgattaagaaggcaaagcagccaatcattctggcgggtcacggcgttgcgcgcagccatgcctcaaaacagctcattgaattgtctgaacttttaaacgttccggttgcaactacttttatggcaaaaggtgtcattcctgatcgccaccccaatgctctgggtgttgctggctttatgcgccgcgactatgaaaattttgcgtttgatgcagctgatgtcattttgtcagttggatatgaattgcaggaatttgcaccttcaaaaatcaatcctaatcacgacaaaaagattgtccatatccatcactttgctgaagatatcgatgcagcttatccggtagccattgctattgaagcggatatcgacaaatctttggatgcgttgattgatggattgaagaaaacaactttcccgaaattcgacaatcatgccaaaattaaacagatcaaaaaagaagaattagacgggaatgcggatgatcagagcttcccgctgaaaccacagcggattatctctgatatcagaaaagctatgggcgatgatgatatcgttctggctgatacaggcgctatcaaaatgtggatggctcgcctctatccgacccagaagccttcgacttgtttaatttcaaatggtctctctacgatggcctttgcgctaccaggtgctttggctgctaaacttgcctgccctgaccggaaagttctcgctgtaatgggcgacggctcattcctgatgaattcacaggaaattgaaacagctatccgcgaaaatattccgctggttgtgctgatctgggtcgatgacgcttatggtcttattaaatggaaaatggatctggaaataaagcatcaccgggatgtggactttaccaatcctgattttgttcaatatgcagaaagtttcggggctaaaggctacgaaatcaaaagtgccgatatgttgttacctgtcattgaaaaagcattagccgatgatggtgtgtctatcatcgcttgcccagtagactacgcagaaaacaacaaattgaccgataaattaggtgatctgacgatcacaatctaa

SEQ ID NO: 82379 - protein, 553 aa, Zymomonas mobilis subsp. mobilis ZM4
MSDTKSTVAKLLVKCLEAEGVEYVFGIPGEENIRLIDAMADSSIRFILVRHEQGASFMADMYGRLTGKAGVCTATLGPGAINLLLGVADAQTDSTPMVAISAQVGLNRIYKESHQYIDLQGMFAPVTKWSDTILTPASVPEMMRKAFDLAQRERPGAVYLAVPQDLEESDVSADLKPITVHPVHTTAPDPDQVAATIDLIKKAKQPIILAGHGVARSHASKQLIELSELLNVPVATTFMAKGVIPDRHPNALGVAGFMRRDYENFAFDAADVILSVGYELQEFAPSKINPNHDKKIVHIHHFAEDIDAAYPVAIAIEADIDKSLDALIDGLKKTTFPKFDNHAKIKQIKKEELDGNADDQSFPLKPQRIISDIRKAMGDDDIVLADTGAIKMWMARLYPTQKPSTCLISNGLSTMAFALPGALAAKLACPDRKVLAVMGDGSFLMNSQEIETAIRENIPLVVLIWVDDAYGLIKWKMDLEIKHHRDVDFTNPDFVQYAESFGAKGYEIKSADMLLPVIEKALADDGVSIIACPVDYAENNKLTDKLGDLTITI

SEQ ID NO: 82380 - DNA, 1788 bp, Zymomonas mobilis subsp. mobilis ZM4
  CDS (1)..(1788): transl_table=11
atgtgtcgccaactcagcggcgccgccattgttcttgaaacactcaaggatatgggtgtcgatctgatcttcggctatcccggcggagcagttctccccatttacgatgccctttatcaggatgaaggcatccggcatattctggctcgccaagaaggcggggctgtccatgcagcagaaggctatgcgcggtcgaccggaaaacccggtgttgttatagtgacttcaggtccgggggcgacaaatgccgttaccggcatcgctgatgccatgcttgattccattccgttggttgttttttctggtcaggtcgccacgaatttaatcggaaccgatgctttccaagaggcggataccatcggcattacccgccattgcaccaagcataactatctggttcgcgacccgaaggatttagctcagacgattgtcgaggccttccatctggcgacctccggtcgtccgggaccggtggttattgaccttccgaaaaatgttcagacggcggttatcgactatatcaaaccggatcctaacaagcggatgcatcgcggttatcgtccgcgtgttaaagcggatccagtcgaaattaccaacgctcttgatatgattgccaaggcaaagcgtccggttttctatactggtggcggcgttatcaattctggtcccgatgccagcaaagccttgcgtgaattggccgacttgacgggtgttccggtaacctcaaccctgatgggcttgggcgcatttccagcctcttcccagcaatggttgggtatgcttggtatgcacggcacttacgaagccaattttgccatgcatgacgctgatttagtagttgcccttggcagccgctttgatgatcgtgtgacatgtcgggttgatagcttttcacctcattccaagaaaatccatgtcgatattgatcgttcttcgatcaaccgtatcatccatgtggacttaccgattgtgggtgatgtcggatcagtcatgcaggacatggtcgcgctttggaaagaaaagcattaccagatgcaggatatttcggcatggtgggtgcagattgatgaatggcgcgccaaacaatgcctgaattttaccaagcagggtaacgagatcatgccgcagcaggctatccgtagcctgtgggaagccacaaagggtaagaatccgatcgtctcgacagaagtcggacagcatcagatgtggaccgcccaatatttcggttttgactctcccaatcatttcctgacttcaggtggtttgggaacgatgggctatggtttcccgtctattattggcgcgcaggtcggtaatccagacagcctctgcatgacgattgctggtgaagcctctttccagatgaatattcaggaaatggctacggttgctcaatatcgtttgccggtgaaaattttcatcttgaataaccgtttcatgggcatggtgcgtcagtggcaagatttgctttatgatcatcgccggtcacaaagctattcagaagcactgcctgattttgtcgctttggccaaggcttatggctggaatgcgcttaaaattgagaagccttcccagcttgaagatggcatcaaaacgatgttggaaacgccggggcctgtcttggttgattgtcaggttgctcaattagcgaattgtttgcccatggtgccgccgggagccggccagactgaaatgattttggaatcggatatcaccgataaccatgtcaagaagccggaatataccccttccgctgcgccttcgtctgcgaccaccattcgcggttaa

SEQ ID NO: 82381 - protein, 595 aa, Zymomonas mobilis subsp. mobilis ZM4
MCRQLSGAAIVLETLKDMGVDLIFGYPGGAVLPIYDALYQDEGIRHILARQEGGAVHAAEGYARSTGKPGVVIVTSGPGATNAVTGIADAMLDSIPLVVFSGQVATNLIGTDAFQEADTIGITRHCTKHNYLVRDPKDLAQTIVEAFHLATSGRPGPVVIDLPKNVQTAVIDYIKPDPNKRMHRGYRPRVKADPVEITNALDMIAKAKRPVFYTGGGVINSGPDASKALRELADLTGVPVTSTLMGLGAFPASSQQWLGMLGMHGTYEANFAMHDADLVVALGSRFDDRVTCRVDSFSPHSKKIHVDIDRSSINRIIHVDLPIVGDVGSVMQDMVALWKEKHYQMQDISAWWVQIDEWRAKQCLNFTKQGNEIMPQQAIRSLWEATKGKNPIVSTEVGQHQMWTAQYFGFDSPNHFLTSGGLGTMGYGFPSIIGAQVGNPDSLCMTIAGEASFQMNIQEMATVAQYRLPVKIFILNNRFMGMVRQWQDLLYDHRRSQSYSEALPDFVALAKAYGWNALKIEKPSQLEDGIKTMLETPGPVLVDCQVAQLANCLPMVPPGAGQTEMILESDITDNHVKKPEYTPSAAPSSATTIRG

SEQ ID NO: 82382 - DNA, 1752 bp, Silicibacter pomeroyi DSS-3
  CDS (1)..(1752): transl_table=11
atgacacgtgagatgaccggcgcaaagatggtggtccaggccctcaaggatcagggcgtggatacggtattcggctatccgggcggcgccgtcctgccgatctatgacgagatctttctgcaaaacgacatccgccacatcctggtgcggcacgaacagggcgcagtgcacgcggccgaaggatatgcccgctcgaccggcaagcccggcgttgtgctggtgacctcgggccccggcgccaccaacgcggtgaccggtctgaccgatgcgcttctggactcgatcccgctggtggtgctgaccggacaggtgccgaccttcatgatcggctcggacgccttccaggaagccgacaccgtgggtatcacccgcccctgcaccaagcataactggctggtcaaggaaaccgacaagctggccaagaccatccacgaggggttccacgtggccacctcggggcggcccggcccggtgctgatcgacatccccaaggacgtgcagttcgcaaccggccagtaccagggccccaagggcctgacatcccattacaacccgcccgtcaagggcgacatggaggagatcaccgagctggtcgccgccatcgaaaaggccaagcgcccggtgttctataccggtggtggcgtgatcaactcgggtccggcggccagccagctgctgcgcgagctggtggatgcgaccggctttccgatcacctcgaccctgatgggtctgggcgcctacccggcctcgggcaagaactggctgggcatgctgggcatgcacgggctttacgaggcgaacatggccatgcatggctgtgacctgatgatcaatatcggcgcccggttcgacgaccggatcaccggccgcatcgacgcgttcagcccgaaatcgaagaaggcccatatcgacatcgaccccagctcgatcaacaaggtgatccgggtcgatatccccatcgtcggcgatgtgggtcatgtgctggaagacatcctgaaggtctggaaagcgcgcgggcgcaagaccaatgccgaagcagtgcagaaatggcaggcccagatcaccgaatggcgcaaggtgagctgcctgacctacaagccctcggaaaagaccatcaagccgcaatacgcgctggagcgtctggaggcgctgaccaaggggcgtgaccgctatgtctgtaccgaggtcggccagcaccagatgtgggcggcgcaatacctgggctttgaggacccgaaccgttggatgacctccggtggcctgggcaccatgggctatggcttccccgcctcgatcggcgtgcagatggcgcatcccgacgctctggtgatcaacgtggcgggagaggcgtcgtggctgatgaacatgcaggaaatgggcaccgccgtgcagtaccgtctgccggtgaaacagttcatcctcaacaacgaacgtctgggcatggtgcgccagtggcaggaactgctgcatggcgagcgctattcgcaatcctggtccgaggcgctgcccgatttcgtgaaactggccgaggcttttggcgccaagggcatcctgtgcaaggaccccgccgatctggacgatgcgatcatggagatgctgaactatgacgggccggtgatcttcgattgccttgtcgaaaagcacgagaactgcttcccgatgatcccgtcgggcaaggcgcataacgagatgctgctgggcgatgccgagacccagggcgtgatccaggccggcggcgcggtcctcgtctga

SEQ ID NO: 82383 - protein, 583 aa, Silicibacter pomeroyi DSS-3
MTREMTGAKMVVQALKDQGVDTVFGYPGGAVLPIYDEIFLQNDIRHILVRHEQGAVHAAEGYARSTGKPGVVLVTSGPGATNAVTGLTDALLDSIPLVVLTGQVPTFMIGSDAFQEADTVGITRPCTKHNWLVKETDKLAKTIHEGFHVATSGRPGPVLIDIPKDVQFATGQYQGPKGLTSHYNPPVKGDMEEITELVAAIEKAKRPVFYTGGGVINSGPAASQLLRELVDATGFPITSTLMGLGAYPASGKNWLGMLGMHGLYEANMAMHGCDLMINIGARFDDRITGRIDAFSPKSKKAHIDIDPSSINKVIRVDIPIVGDVGHVLEDILKVWKARGRKTNAEAVQKWQAQITEWRKVSCLTYKPSEKTIKPQYALERLEALTKGRDRYVCTEVGQHQMWAAQYLGFEDPNRWMTSGGLGTMGYGFPASIGVQMAHPDALVINVAGEASWLMNMQEMGTAVQYRLPVKQFILNNERLGMVRQWQELLHGERYSQSWSEALPDFVKLAEAFGAKGILCKDPADLDDAIMEMLNYDGPVIFDCLVEKHENCFPMIPSGKAHNEMLLGDAETQGVIQAGGAVLV

SEQ ID NO: 82384 - DNA, 1839 bp, Synechococcus elongatus PCC 6301
  CDS (1)..(1839): transl_table=11
gtgcaactgcagacggtcaccattcaacagcgtgcgaccggtgcttatgcgctgattgatagtctctgtcagcacggagttaagcacatctttggctatccaggtggggcaatcctgcccatctacgacgagctgcatcgggctgaggcggctggccgtgttcaacatattttggtacgccacgagcagggtgcagtccatgcggcagatgcctactcgcgagccacgggtgaagtcggggtttgctttgcgacttctggtcctggtgcaaccaatctcgtaaccgggattgctacggcccagatggactcgatcccgatggtggtggtgacggggcaggtgcctcgcacggcgatcggaaccgacgctttccaagagacagacatctacggcatcacgctaccaatcgtcaaacactcctacgtggtgcgcgatccacgggacatggcgcggattgtggcggaagccttccacattgcccaatcgggtcgtcctggccctgtcttgatcgatgtgcccaaggatgtcggcactgaggaatttgattatgtgcctgtggctccgggggatattcgactgccgggctatcgtccgacaactcggggcaacccacgtcagattgctcaggcgatcgctcttgtgagagtagcccgtcggcccttgctctacgttggtggcggcgcaattacggccggcgcccatgcggagctgcgggcctttgcagagcgcttccaactgccggtaacaacgactctgatgggcaaaggggcctttgatgagcggcaccccttggcgcttggcatgctggggatgcacggcacggcctatgccaacttcgccgtcagcgaatgtgatctgctgattgcggtgggtgcccgctttgacgatcgtgtcacgggcaaactggatgagttcgcctccaaagcgcaagttattcacgttgatatcgatccggccgaagtcggtaaaaaccgcgtgccggaagtgccaatcgtgggcgatgtccgccaggtgctgaatgagcttctggcgcgtgccgaagagcaaatcagcgccgatgatgcgactcgaactcagccttggctcgatcgcattgcctactggaagcgggaatatcctctgcagattccctactacgctgatgtgctctcaccccaacaagtgattcacagtttgggagaagcagcaccggatgcttacttcaccacggatgtgggtcagcaccaaatgtgggctgctcagttcatcaagaatggtccccgtcgttggatctctagtgcaggtctcggtacgatgggctttggtatgccggccgctatgggagcacaaatggctctgccggatgacaccgtcatctgtgtggctggggatgccagcatcctgatgaatattcaggagctggggaccctagcgcagtacaacatcccgatcaaggtcgttgttgtcaataatggctggcaggggatggtgcgccagtggcaagaagcgttctacgacgagcgctattccaactccaacatggagcggggcatgcccgactttgtgaaactggcagaagcctttggtatcaaagggatgcgcgttagtcatccagacgagctgcaagcagcgatcgctgaaatgttggcctttgatgggccggtgttcttggatgcgatcgtcaagagggatgaaaactgttatccgatggtgccctctggtcacagcaatgcgcagatgctgggcttgcccaaggacccgacgctggatttggatttggcgatcgcgacctgttcgagctgcggcgcgaaaaccctgcccagccacaagttctgtccggactgcggcgctaagctctag

SEQ ID NO: 82385 - protein, 612 aa, Synechococcus elongatus PCC 6301
MQLQTVTIQQRATGAYALIDSLCQHGVKHIFGYPGGAILPIYDELHRAEAAGRVQHILVRHEQGAVHAADAYSRATGEVGVCFATSGPGATNLVTGIATAQMDSIPMVVVTGQVPRTAIGTDAFQETDIYGITLPIVKHSYVVRDPRDMARIVAEAFHIAQSGRPGPVLIDVPKDVGTEEFDYVPVAPGDIRLPGYRPTTRGNPRQIAQAIALVRVARRPLLYVGGGAITAGAHAELRAFAERFQLPVTTTLMGKGAFDERHPLALGMLGMHGTAYANFAVSECDLLIAVGARFDDRVTGKLDEFASKAQVIHVDIDPAEVGKNRVPEVPIVGDVRQVLNELLARAEEQISADDATRTQPWLDRIAYWKREYPLQIPYYADVLSPQQVIHSLGEAAPDAYFTTDVGQHQMWAAQFIKNGPRRWISSAGLGTMGFGMPAAMGAQMALPDDTVICVAGDASILMNIQELGTLAQYNIPIKVVVVNNGWQGMVRQWQEAFYDERYSNSNMERGMPDFVKLAEAFGIKGMRVSHPDELQAAIAEMLAFDGPVFLDAIVKRDENCYPMVPSGHSNAQMLGLPKDPTLDLDLAIATCSSCGAKTLPSHKFCPDCGAKL

SEQ ID NO: 82386 - DNA, 1731 bp, Bacillus clausii KSM-K16
  CDS (1)..(1731): transl_table=11
atgatccattccaatgaagcggcaacgccacaagccgctgaaaacaagcaggctgtttgcacaggttctgagattttattaaaagcacttgccagcgaaggagtcgaagtcatttttggctatccaggcggagcgattttaccaacatacgatgagatttataaattaggaatgaaccatattctagcccgccatgaacaaggcgcaatccacgcggctgaagggtatgcgcgcattacccaaaagccaggcgtctgcatcgtcacttcgggaccaggagcaacaaatgtcgttacaggcattgcggatgcgatgatggattcgctgccaatggtcgtcatcaccggccaagtggctacaaaagtgattggtaccgatgctttccaggaagccgatatgcttggcattacaatgccgatcacgaagcataattttcaaatccgttccatagaagaactagcgcaaacagtcaaagaagcgtttcatattgcggtaagcgggcggccgggacccgtattgattgatttgccgaaagatatttcggaaaaactgggaatctttgattatgaggaacctgtccatttgcctggctaccaaccaaccgttaaaccgaataagcagcaaattcgcaagcttctggataagtttaaagaagcgaagcggccagtcctgcttgtcggcgctggtgtcctccatgcacaagcaagtgaggaattaactgcatttgctcgtaaatttcaaatccctgtcgctcaaacattgcttggactaggcgcttttcctggcgaagaggaattgcatctcgggatggccggcatgcatggaacatatgctgcaaacatggcgctccacaaatcagactttttgatcaacattggctctcgttttgatgacagattaactggtgcccttgaacattttgctccggaggcatgtattgcccatatcgacattgatcctgctgaaattggcaaaaacgttcatgtcgaaattccggtagtaggggatgcaaaagaggcgttagcgatgctagtgaaaggaagcggggctatagatgagcacgacgagtggcgcaaacaagttagcgactggaaacgagattatccgctgtggtttcatcgcgacggggaagttattaagccacaggagctgatccaaaaactgtatgaacatacaaagggtgaggcgattgttacgacggacgtcggccagcatcaaatgtggacggcgcaacattttaagtttaacaaaccaaatcgctggattacatcaggtggtcttggcactatgggattcgggtttccagcggcaattggggcgcaaattgctgaaccggaattgccggtattggcgattactggtgacgcaggctttcagatgacgcttcaagaaatgtcgattttgcaagaactggatttgcccgtcaaaattgtgattgtcaacaatgcttcccttggaatggtacggcaatggcaacaacgttttcatggcgagcgctattcccattcgcttttcccaatccagcctaactttgctaagctcgctgaagcttataacattaaagcggtaaaggtcgacaaactgtcgatgctggacgaagcgattgctgaaacattggcgcatccaggcccggtattgttggaagtgtgtgtcgccaaagaagaaaacgtctacccgatggtttgcccaggcacaggtcaccactgtatggaaggagtagagccatcatga

SEQ ID NO: 82387 - protein, 576 aa, Bacillus clausii KSM-K16
MIHSNEAATPQAAENKQAVCTGSEILLKALASEGVEVIFGYPGGAILPTYDEIYKLGMNHILARHEQGAIHAAEGYARITQKPGVCIVTSGPGATNVVTGIADAMMDSLPMVVITGQVATKVIGTDAFQEADMLGITMPITKHNFQIRSIEELAQTVKEAFHIAVSGRPGPVLIDLPKDISEKLGIFDYEEPVHLPGYQPTVKPNKQQIRKLLDKFKEAKRPVLLVGAGVLHAQASEELTAFARKFQIPVAQTLLGLGAFPGEEELHLGMAGMHGTYAANMALHKSDFLINIGSRFDDRLTGALEHFAPEACIAHIDIDPAEIGKNVHVEIPVVGDAKEALAMLVKGSGAIDEHDEWRKQVSDWKRDYPLWFHRDGEVIKPQELIQKLYEHTKGEAIVTTDVGQHQMWTAQHFKFNKPNRWITSGGLGTMGFGFPAAIGAQIAEPELPVLAITGDAGFQMTLQEMSILQELDLPVKIVIVNNASLGMVRQWQQRFHGERYSHSLFPIQPNFAKLAEAYNIKAVKVDKLSMLDEAIAETLAHPGPVLLEVCVAKEENVYPMVCPGTGHHCMEGVEPS

SEQ ID NO: 82388 - DNA, 1701 bp, Campylobacter jejuni RM1221
  CDS (1)..(1701): transl_table=11
atgaaagagttaagcggttcggcaatgatttgcgaggctttaaaagaagaaaatgttaaaattgtttttggttatcctggaggcgctgcgcttaatatttatgatgaaatttacaatcaaaagtattttaaacatattttagtgcgtcatgaacaagcggctttgcatgctgctgatgcttacgcaagaatgagcggagaagtgggcgtagctatagttacaagcggaccaggttttacaaatactattacaggtctagctacggcttatagcgattctatccctttggtgttgatttcagggcaggtggcaaattctcttattggtacagatgcttttcaagaaattgatgcagtaggcatttcaagaccttgtgtaaagcataattatttagttacttgtatagaagagtttccacgcattttaaaagaggctttttatatagcaagaagtggtagacctgggcctgtgcatatagatgtgccaaaagacgtaagtgcaactttgggactttgggaatactctaaagaaatttccatgaagacttataagcccgtttataagggtaactcaaagcaaattaaaaaatttgcagagcttttaaaagaagcaaaaagacctttgttttacttaggtggaggttgcatcagttctaatgcaagcgagcaaatcagagagcttataaaatttacaaaaattccagcagttgaaactttgatggcgcttggaactttaagaagtgatgatgtttttaatcttaaaatggcaggcatgcatggaagctatgctgctaatatggctttaagtgagtgcgatttgcttgtgagtgtaggagcgagatttgatgataggattacaggaaaaacaagtgaatttgctaaacatgcgactatagttcatgttgatattgatcctagttctatttcaaagattatcaatgcgcattatcctatagtaggagatattaaagaagttcttaaagagcttttagaagagcttaaaaaggaaaatttcaacacaacttttaaagaatggcacgaaactttaaagcgttataatgaactttatccgctttcttatgaagatagcaatgagattttaaaaccgcaatgggtgattgaagaatgtgcgaaaatggctccagatgcaaggattattactgatgtgggtcagcatcaaatgtgggtggcacagttttatccttttaattatccaagacaacttgcaacaagcggagggcaaggaactatgggatattctttacctgctgctttgggtgcaaagcttgctgtgggtgaagaagtggtgattaatttcgtaggcgatggatcggttttaatgaatatccaagagcttatgactgcttatgagtatggtataaaaactataaatattattttaaataatgcctttttaggtatggtaagacaatggcaaagtatgttttataaagagcatttttcacaaactgatttaagcactcagcctgattttatcaaaatagctcaaggttttggttgtgaaggttatgaaatttcaaacaaagaagaattcattcaagcttttagccaagctttaaaaagtgataaaacctctcttttaaatgtaaaaattgatcgctttgaagatgttttacctatggtgcctgcaggaggtgcgatttataatatgattttaccaaaggcaaaggatagacaatga

SEQ ID NO: 82389 - protein, 566 aa, Campylobacter jejuni RM1221
MKELSGSAMICEALKEENVKIVFGYPGGAALNIYDEIYNQKYFKHILVRHEQAALHAADAYARMSGEVGVAIVTSGPGFTNTITGLATAYSDSIPLVLISGQVANSLIGTDAFQEIDAVGISRPCVKHNYLVTCIEEFPRILKEAFYIARSGRPGPVHIDVPKDVSATLGLWEYSKEISMKTYKPVYKGNSKQIKKFAELLKEAKRPLFYLGGGCISSNASEQIRELIKFTKIPAVETLMALGTLRSDDVFNLKMAGMHGSYAANMALSECDLLVSVGARFDDRITGKTSEFAKHATIVHVDIDPSSISKIINAHYPIVGDIKEVLKELLEELKKENFNTTFKEWHETLKRYNELYPLSYEDSNEILKPQWVIEECAKMAPDARIITDVGQHQMWVAQFYPFNYPRQLATSGGQGTMGYSLPAALGAKLAVGEEVVINFVGDGSVLMNIQELMTAYEYGIKTINIILNNAFLGMVRQWQSMFYKEHFSQTDLSTQPDFIKIAQGFGCEGYEISNKEEFIQAFSQALKSDKTSLLNVKIDRFEDVLPMVPAGGAIYNMILPKAKDRQ

SEQ ID NO: 82390 - DNA, 1710 bp, Dehalococcoides ethenogenes 195
  CDS (1)..(1710): transl_table=11
atgaaattgactggcgcccagatagtatgtgaaagtctgctcaaagaaggggcagatgtaatcttcgggtatccgggtggagtactcttgcctctgtatgatactttcccccagtaccccgccttaaggcatattttgacccggcatgaacagggtgccgcccatgctgccgatggttttgccagagtaaccggcaaagtaggtgtctgcctggctacgtctggccctggtgctaccaacctgattaccggcattgccaatgcctacatggattccatacctatggtagctataaccggccaggttacccgtaaccttatcggcaaagatgcttttcaggagattgatattaccggcatcactttgcctattaccaagcagaattatctggtaaccagggcaagtgcactggctgacactataaaagaagctttctatttagcccgaaccggacgccccggcccggtgctgatagatatacccaaagacgtatttattgagcaggcagagtttgaataccctgatgaacctgatttgcccggctacaaacccgttataaagggcaatctgatgcagatacaaaaggcggccaagctgatagaaaccgctgagaaaccggtgattattgccggacacggggtaaacatttccggtgctaatgaagaactgaaaaccctggcggaaaactgtcagctgcctgttattaccactttgctgggtgtcagcagtttccccgaagaccatatactaagctacggtatgctgggtatgcacggcatggcttatgccaatatggctgttgcggccactgacctgatagtggctatcggtatgcgttttgatgaccgggttaccggtaagctgagcgcatttgctccccatgccagtgttattcatatagatatagacccggctgaaataggtaaaaatatacgggttgacgtgcctatagtgggtgacgttaaaaccgtacttaaatcactcaacaaacaggtagaatgtgtccagcactctgagtggctgaggcagctggaaaactggcgcagagagcacccgccgctctccatacggcatactgaccttatcctgccccagtatatagtccagcagataagcgaagctaccagcggcaacgccattgtggttaccggggtgggacagcaccagatgtgggctgcccagcactatacatatatccgccccaattctctggtgacttccggcggtctgggcactatgggttttgacctgccggctgctttgggtgctaaagtcggctgtcctgacgaaactgtctggtgcattgccggggacggcggattccagatgaatatgcaggaactggccacaatagttcaggaaagggctgcggtaaaaatagcggtcttcaataacggctatctgggtatggttcgccagtggcaggacttgttctataacaaaaattacgtggctactcctttgggctgccctgattttataaaaatagccgaagcctatgatataccggctctaaacgttaaacgcaaggaagaggtccggccggctattgaacaggctatggccaccgaaggacctttccttataaactttataattgaacctgaagaaaacgtatatcccatggttcctcccggcgccgctctccacgaagtactggaagaacctaagaaagaggtgagtgcatgtccccgacgaagcataccatag

SEQ ID NO: 82391 - protein, 569 aa, Dehalococcoides ethenogenes 195
MKLTGAQIVCESLLKEGADVIFGYPGGVLLPLYDTFPQYPALRHILTRHEQGAAHAADGFARVTGKVGVCLATSGPGATNLITGIANAYMDSIPMVAITGQVTRNLIGKDAFQEIDITGITLPITKQNYLVTRASALADTIKEAFYLARTGRPGPVLIDIPKDVFIEQAEFEYPDEPDLPGYKPVIKGNLMQIQKAAKLIETAEKPVIIAGHGVNISGANEELKTLAENCQLPVITTLLGVSSFPEDHILSYGMLGMHGMAYANMAVAATDLIVAIGMRFDDRVTGKLSAFAPHASVIHIDIDPAEIGKNIRVDVPIVGDVKTVLKSLNKQVECVQHSEWLRQLENWRREHPPLSIRHTDLILPQYIVQQISEATSGNAIVVTGVGQHQMWAAQHYTYIRPNSLVTSGGLGTMGFDLPAALGAKVGCPDETVWCIAGDGGFQMNMQELATIVQERAAVKIAVFNNGYLGMVRQWQDLFYNKNYVATPLGCPDFIKIAEAYDIPALNVKRKEEVRPAIEQAMATEGPFLINFIIEPEENVYPMVPPGAALHEVLEEPKKEVSACPRRSIP

SEQ ID NO: 82392 - DNA, 1770 bp, Staphylococcus aureus subsp. aureus COL
  CDS (1)..(1770): transl_table=11
atgtctaaaactcaacatgaagtaaaccaaaatattgaccctttaaaaatggctgaatcacttgaacctgaacaactaaatgaaaaaactttaaatgatatgcgttcaggatcagaagtgctagtagaagctctacttaaagaaaatgtggattatttattcggttatcctggtggtgccgtactacctttatatgacacgttttatgatggtaaaatcaaacatattttagcaagacacgaacaaggtgctgttcatgctgcagaaggttatgcacgtgtatctggtaaaactggcgtcgttgtagttacaagcggtccaggtgcaactaatgtaatgacaggtattacggatgcacattgcgactctttacctctagttgtattcactggacaagttgctacaccaggcattggtaaagatgcattccaagaagcggatattctatctatgacttcaccaattacaaaacaaaattatcaagtgaaacgtgttgaagatatccctaaaatcgtacacgaagctttccatgtagctaattctggacgcaaaggtcctgtagtgattgattttccaaaagatatgggtgttttagctacaaatgtggatttatgcgacgaaatcaatattccaggttatgaagttgttacagaaccagaaaataaagacattgacactttcatctcacttttaaaagaagcgaaaaagcctgtcgtattagccggcgcaggtattaatcaatcaaaatcaaatcaattattaacacagtttgttaataaacatcaaatcccaacagttactactttactaggtctaggtgctgtaccttatgaggatacactatttttaggtatgggaggaatgcatggttcttatgctagtaacatggcattaactgagtgtgatttactcattaatttaggtagccgcttcgatgatagattagcaagcaaacctgatgcctttgcacctaacgccaaaattgtacatgtagatattgatccttcagaaatcaataaagttattcatgtagatttaggtattattgcagactgtaaaagatttttagaatgtttaaatgataaaaatgttgagactatagaacacagtgactgggttaaacattgtcaaaataataagcagaaacacccatttaaacttggtgaagaagatcaagtattttgtaagccacaacaaacaatcgaatatatcggcaaaattacaaatggtgaagcaattgttactacagacgtgggacaacatcaaatgtgggcagctcaattttatccatttaaaaatcacggacaatgggttacaagcggtggtttaggaacaatgggattcggtattccttcgtcaattggtgccaaattagctaatcctgataaaacagtcgtatgtttcgtcggtgacggtggtttccaaatgacaaaccaagaaatggcacttttacccgaatatggtttagatgtcaaaatcgtactaatcaataatggaacattaggtatggttaaacaatggcaagataagttctttaatcaacgcttctcacactcagtatttaatggtcaacctgattttatgaaaatggcagaagcatatggcgtcaaaggtttcttaatcgataagccagaacaactggaagaacaattagatgcagcgtttgcttatcaaggaccagctttaattgaggttcgtatttcccctactgaagctgtaaccccaatggttccgagtggcaaatcaaatcatgaaatggagggcttataa

SEQ ID NO: 82393 - protein, 589 aa, Staphylococcus aureus subsp. aureus COL
MSKTQHEVNQNIDPLKMAESLEPEQLNEKTLNDMRSGSEVLVEALLKENVDYLFGYPGGAVLPLYDTFYDGKIKHILARHEQGAVHAAEGYARVSGKTGVVVVTSGPGATNVMTGITDAHCDSLPLVVFTGQVATPGIGKDAFQEADILSMTSPITKQNYQVKRVEDIPKIVHEAFHVANSGRKGPVVIDFPKDMGVLATNVDLCDEINIPGYEVVTEPENKDIDTFISLLKEAKKPVVLAGAGINQSKSNQLLTQFVNKHQIPTVTTLLGLGAVPYEDTLFLGMGGMHGSYASNMALTECDLLINLGSRFDDRLASKPDAFAPNAKIVHVDIDPSEINKVIHVDLGIIADCKRFLECLNDKNVETIEHSDWVKHCQNNKQKHPFKLGEEDQVFCKPQQTIEYIGKITNGEAIVTTDVGQHQMWAAQFYPFKNHGQWVTSGGLGTMGFGIPSSIGAKLANPDKTVVCFVGDGGFQMTNQEMALLPEYGLDVKIVLINNGTLGMVKQWQDKFFNQRFSHSVFNGQPDFMKMAEAYGVKGFLIDKPEQLEEQLDAAFAYQGPALIEVRISPTEAVTPMVPSGKSNHEMEGL

SEQ ID NO: 82394 - DNA, 1665 bp, Staphylococcus epidermidis RP62A
  CDS (1)..(1665): transl_table=11
atggcggaaaaacaatattctgcagcacaaatggtaattgatactttaaaaaataatggagttgagtatgtatttggtattccaggtgcgaaaatcgactacttatttaatgcactagaggatgacgatattgaattagtcgttacgcgtcatgaacaaaacgcagcgatgattgcacaaggtattggtcgtttaacaggaaaaccaggtgtggctattactacaagtggcccaggggtaagtaacttaactactggtttattaactgcaacttctgaaggtgaccctgtattagctatcggtggtcaagttaaaagaaatgacttattacgtttaacacatcaaagtattgataacgcatcattacttagatcctcaactaaatatagtgcagaagtacaagatccagaatcactatcagaggttattacgaatgcaatgcgtacagccacttcaggtaaaaatggagcgagctttatcagtattccacaagatgttatttcatcacctgtcaaagctgatgcaatttcattatgtcaaaaaccacatcttggtgtaccttcagaacaagaaattaatgaagtgattgaggctattaaaaattctaaattcccagtattattagctggaatgagaagttcaagccaagctgaaacagaagctattcgccgtttagttcaaaaaacaaatttacctgttgttgaaacattccaaggtgccggcgtaattagtcgcgaattagaaaatcacttcttcggtcgtgttggtttatttagaaaccaagtgggtgacgaattacttagaaaaagtgatttagttatcacaatcggttatgaccctattgaatatgaagcaagtaactggaataaagaattagatactaaaatcatcaatgtcgatgaagaacatgctgaaatcactaattacatgcaaccagttaaagagttaatcggaaacattgcaggtacaatagatatgatttctgaacatgtaaatgaaccatttattaatcaagatcatttagatgaacttgaaaaattaagaggcgaaatcacagaagcaactggaattaaagcaactcacaaagaaggtgtgatgcacccagttgaaatcattgaaacaatgcaaaaagttttaactgatgatactactgtaactgtagatgtgggaagccattacatttggatggctcgtaaatacagaagttacaatcctagacatttactatttagtaacggtatgcaaactctaggtgttgcacttccatgggctatttcagctgcacttgtacgtccaaatacacaagttgtttctgtagctggagacggtggtttcctattctcaggacaagaattagaaactgcagtacgtaaaaacttaaatatcattcaattaatttggaatgatggtcgttataacatggttgaattccaagaagaaatgaaatataaacgctcttcaggtgtagaatttggaccagttgattatgtaaaatatgcagaatcatttggcgctaaaggattacgtgtgactaatcaagaagaattagaggcagcacttaaagagggttacgaaactgatggaccagtattaattgatatcccagttaactatgcagataatgttaaattatctacaaatatgttaccaaatgctttaaattaa

SEQ ID NO: 82395 - protein, 554 aa, Staphylococcus epidermidis RP62A
MAEKQYSAAQMVIDTLKNNGVEYVFGIPGAKIDYLFNALEDDDIELVVTRHEQNAAMIAQGIGRLTGKPGVAITTSGPGVSNLTTGLLTATSEGDPVLAIGGQVKRNDLLRLTHQSIDNASLLRSSTKYSAEVQDPESLSEVITNAMRTATSGKNGASFISIPQDVISSPVKADAISLCQKPHLGVPSEQEINEVIEAIKNSKFPVLLAGMRSSSQAETEAIRRLVQKTNLPVVETFQGAGVISRELENHFFGRVGLFRNQVGDELLRKSDLVITIGYDPIEYEASNWNKELDTKIINVDEEHAEITNYMQPVKELIGNIAGTIDMISEHVNEPFINQDHLDELEKLRGEITEATGIKATHKEGVMHPVEIIETMQKVLTDDTTVTVDVGSHYIWMARKYRSYNPRHLLFSNGMQTLGVALPWAISAALVRPNTQVVSVAGDGGFLFSGQELETAVRKNLNIIQLIWNDGRYNMVEFQEEMKYKRSSGVEFGPVDYVKYAESFGAKGLRVTNQEELEAALKEGYETDGPVLIDIPVNYADNVKLSTNMLPNALN

SEQ ID NO: 82396 - DNA, 1794 bp, Gluconobacter oxydans 621H
  CDS (1)..(1794): transl_table=11
gtgacggctgctgaaagagacgcaggaacaggcaatgaggcgctgaatggcgcggaggtgcttctgcgcgttctcgatgaagagggtgtggaggtcatattcggatatccgggtggtgctgtccttccgatttacgatgctctcttcaagcaggaccgtatccgccacgttcttgtccgccatgagcaggctgccgttcacgctgccgaggcctatgcgcgttcgacgggcaaggtcggtgtggtgctggtgacgtcgggtccgggtgcgaccaatgccgtgaccgggctggtggatgcgctgatggattccatcccgcttgtctgcctgtcgggtcaggtgccgaccaagctgatcggcaatgatgcgttccaggaagctgatacgacgggcatcacgcgccctgcgaccaagcacaattatctcgtgcgggagccgggaacgctggcacagaccgtgcgtgaggcgttcgaggttgcgcgttcgggccgtccggggccggttctggtggatctgcccaaggatattacggttggcaaggcaccgctgacgaagcctgcgctgtcgcggctgcagcgtctgagccatcagggcggtccggatgcggaggcgatcgcgcggaccgtcgaggcgatgaagacggccaagcgcccgcttttctatacgggcggtggcatcatcaattccgggccggaagcgtcagagctgctgcgtcgtctggcgcgcaagaccggtttcccggtgacgtccacactgatggggctgggcgcgtttccgtctcccgatccgcagttcctcggcatgctgggcatgcatggttcggtggaggccaacatggctacgcatggctgtgatctgctgatcgcgctgggctcgcgcttcgatgaccgcgtgacggggcgggtggatgcgttctcgcccaattcgttcaaggtgcatgctgacatcgatccgagccagatcgacaagatcgtgccggtggatgtgcggattgaaggcgatgtgcgcgatacgctcgaagcactgctggaagcctggggtgatacgccggcgccggatctgtccacctggtggaaccagatcgcctcctggcgcagtgtggatggcttcggctttacgcaggacatggacccgtcggccatcatccgtccgcagcatgctatccgccgtctgtacgtactagccaaggagacggggcgtgacacgttcgtgtccaccgaggtcgggcagcatcagatgtgggcggcgcagcacttccagttcgacaagccgaaccgctggctgacgtcgggtggtctggggacgatgggttatggtctgccggcagcggtgggtgcgcaggtggcgcatccggatgcactggtgatcgatatcgccggtgaggcgtccacgctcatgaacatccaggaactggggacgattgcgcagtatcgcctgccggtgaagatcttcatcctgaacaaccactatatgggcatggtccgtcagtggcaggaactgcttcacgggtcgcgctattcgcagtcctacagcgaggcgctgccggatttcgtaaagctggccgaagcgttccatgcgaccggaatgcgggcgacgcatgtgggtgagctggatgacgtgatccgccggatgctggcgcatgatgggccggttgtggccgatatctgtgtggcggaaggcgagaactgctatccgatgatcccgtcgggggcggcgcacaaccagatgctgctgggtccggatcaggattccgaagcggcgggactgaccgaagaaggaaagatgctggtctga

SEQ ID NO: 82397 - protein, 597 aa, Gluconobacter oxydans 621H
MTAAERDAGTGNEALNGAEVLLRVLDEEGVEVIFGYPGGAVLPIYDALFKQDRIRHVLVRHEQAAVHAAEAYARSTGKVGVVLVTSGPGATNAVTGLVDALMDSIPLVCLSGQVPTKLIGNDAFQEADTTGITRPATKHNYLVREPGTLAQTVREAFEVARSGRPGPVLVDLPKDITVGKAPLTKPALSRLQRLSHQGGPDAEAIARTVEAMKTAKRPLFYTGGGIINSGPEASELLRRLARKTGFPVTSTLMGLGAFPSPDPQFLGMLGMHGSVEANMATHGCDLLIALGSRFDDRVTGRVDAFSPNSFKVHADIDPSQIDKIVPVDVRIEGDVRDTLEALLEAWGDTPAPDLSTWWNQIASWRSVDGFGFTQDMDPSAIIRPQHAIRRLYVLAKETGRDTFVSTEVGQHQMWAAQHFQFDKPNRWLTSGGLGTMGYGLPAAVGAQVAHPDALVIDIAGEASTLMNIQELGTIAQYRLPVKIFILNNHYMGMVRQWQELLHGSRYSQSYSEALPDFVKLAEAFHATGMRATHVGELDDVIRRMLAHDGPVVADICVAEGENCYPMIPSGAAHNQMLLGPDQDSEAAGLTEEGKMLV

SEQ ID NO: 82398 - DNA, 1722 bp, Vibrio fischeri ES114
  CDS (1)..(1722): transl_table=11
atggaaatgttatctggttcagagatgatcgtacaatctctgattgatgaaggtgttgaacacatatttggctaccctggtggctctgtgttggatatatatgatgcgttgcacatgaaaagtgatgtgattcagcatgtacttgtaagacatgagcaagcagctacgcatatggctgatggctatgcaagagcaacaggaaagccaggtgtcgttcttgtgtgttctggtcctggtgctaccaataccattacgggtatcgctaccgcttatatggactcaataccaatggttgttctttctggtaacgttcctactaatatgatcggtaacgatgctttccaagagtgtgacatggttggagtctctcgacctgtagtcaagcacagcttcttagttaagaaagccgaagatatccctgaaacccttaaaaaagccttttatattgcttctactggccgtccaggtcccgtggttattgatatcccgaaagatgtaatgaaccctgctattaagttttcatatcaataccctgaatccatgaagatgcgttcgtataatccaacaacatctggtcataaaggacagattaaaaaaggattaaaaacattattagaggctaagaagcctgttttgtatgttggcggtggcgcgataatttcttctgcagaaaaacaaatactaaaattagctgagactcttaatttacctgttgtaagtaccttgatgggattgggagcttttcctggcactcataaaaatgcacttggcatgttaggtatgcatggtaagtatgaagctaatatggctatgcataacgcagatcttatttttggtgttggggttcgttttgatgatagaaccaccaataacttagaaaaatactgcccgaacgccacgatcatgcatatcgacattgatccctcgtcgatttcaaagaatgttcgagttgatgttccaattgttggctctgcggagattgttcttgattctatgcttaagctgttagtggagcagggaggaacaaacgatgaggcagccttagcaacatggtgggaagaaattggagtttggcaagagcgtaattgcttggcttatgaaacctctcctgatcgtattaaaccacagcaggttatcgaaacgcttcataaattaaccaatggtgatgcttatgtcgcttccgatgttggacagcatcagatgtttgctgctttgtattacccatttaataagccacgtcgttggattaattctggtggactaggaaccatggggttcggtttaccagcagctctaggggttaaatttactcatcctgatgaagtggtggtttgtgtgactggtgatggcagtattcagatgaatattcaggagctatctaccgcattgcaatacgatatccctgtgaaaatcattaatttgaataaccgtttcttaggaatggtgaagcagtggcaagatattatttaccaaggtcgccattccaattcttatatgagttcagttcctgattttgccgcaattgctgaggcatatggtcatgtaggaattcgtattaatcaccctgatgagctggagtcaggtctagagaaggctctttctctaaaagatcgccttgtgtttgtggatattaatgttgatgaaacagagcacgtttacccaatgcaaattaaaggggaagcaatggataaaatgtggctaagtaaaacggagagaacctaa

SEQ ID NO: 82399 - protein, 573 aa, Vibrio fischeri ES114
MEMLSGSEMIVQSLIDEGVEHIFGYPGGSVLDIYDALHMKSDVIQHVLVRHEQAATHMADGYARATGKPGVVLVCSGPGATNTITGIATAYMDSIPMVVLSGNVPTNMIGNDAFQECDMVGVSRPVVKHSFLVKKAEDIPETLKKAFYIASTGRPGPVVIDIPKDVMNPAIKFSYQYPESMKMRSYNPTTSGHKGQIKKGLKTLLEAKKPVLYVGGGAIISSAEKQILKLAETLNLPVVSTLMGLGAFPGTHKNALGMLGMHGKYEANMAMHNADLIFGVGVRFDDRTTNNLEKYCPNATIMHIDIDPSSISKNVRVDVPIVGSAEIVLDSMLKLLVEQGGTNDEAALATWWEEIGVWQERNCLAYETSPDRIKPQQVIETLHKLTNGDAYVASDVGQHQMFAALYYPFNKPRRWINSGGLGTMGFGLPAALGVKFTHPDEVVVCVTGDGSIQMNIQELSTALQYDIPVKIINLNNRFLGMVKQWQDIIYQGRHSNSYMSSVPDFAAIAEAYGHVGIRINHPDELESGLEKALSLKDRLVFVDINVDETEHVYPMQIKGEAMDKMWLSKTERT

SEQ ID NO: 82400 - DNA, 1707 bp, Vibrio fischeri ES114
  CDS (1)..(1707): transl_table=11
atgggggcacatgatgtgcgagagaaaacagacaaccactcacgcagggagcgaaagagtatgaatggctcacagttagtagtaaaagccttaagagacgaaggaattgaaaccgtctttggttatcctggtggggctatcatgcctatttatgatgcattatatgatggtggcgttgagcacatattatgtcgtcatgaacaaggtgcagcaatggctgcaataggaatggcaagagcaagcaaagatgttgctgtatgccttgcaacatcaggtccaggagcaacaaacctaattacgggtcttgctgatgccatgttagattccattcctcttgttgctatcacaggtcaagtggcgagtaatttaatcggtactgatgctttccaagaaatggatgtcatcggtatgtctctctcatgtactaaacacagttatttggttactgatatcaatgaacttgcacctgtgattgctgaagcatttgaggtagcaaaatcaggacgtcccggccctgtattaattgatatagccaaagacgtacaactcgctgaagctcctgttacttctcttccatattttgaagcacctagtatccctgttgttgttcctgaagctattgaagcggctgaggcattactaagagccagcaacaaaccggtattgtatgtgggtggcggtgttcaactggcacacgcaaccgactctgttcgtgattttttaaccaataatccgatgccttcagtaagtacattaaaaggtttaggttcaataggaagacacgatccccattatcttggaatggtaggtatgcacggcactaaagctgccaacctaattgttcaagaatctgatttacttattgttgttggtgctcgttttgatgatcgtgtgacaggaaaattagaaagctttgctcctcatgcgaaagtaatccatatcgatattgatgcagcagaattcaataagcttcgccacgctcattcaacactacgcggtgacataaaggttatccttcctcaattgaaactagagcaggaccttaccccttggttagaacatgtttcttctcttcgctctgaatttaaatggcgctacgatcacccgggtgaattaatttatgcccctctgctactaaagcaactttctgacatgatgccagacagcgctatcgtatcgacagatgtaggccaacatcaaatgtgggcagctcaacatatccaacctcgagctcctgaaaattacctcacttccgcaggtcttggcaccatggggttcggtttacccgctgcaatgggagcaaaagtggctcgtcctgatgatcaatctattctgatttcaggtgatggttctttcatgatgaatgtacaagaactcggtacgattaagcgtaaacaaatccctgtgaagatggttcttattaacaaccaacgtttaggcatggttcgccaatggcaatctttgttttttgatggccgccacagtgaaaccattcttgatgataatcctgattttgttgctcttgctgccgcctttggtattcctggaaaaaccatcacaataaaagaagaagtagaacccgctttaaaagaaatgcttgaaagcgacacggcttatctgctgcatgttcttatttcagaagaagaaaacgtatggcctttggttccgccaggcgctgcaaaccaagatatggtggagggagaataa

SEQ ID NO: 82401 - protein, 568 aa, Vibrio fischeri ES114
MGAHDVREKTDNHSRRERKSMNGSQLVVKALRDEGIETVFGYPGGAIMPIYDALYDGGVEHILCRHEQGAAMAAIGMARASKDVAVCLATSGPGATNLITGLADAMLDSIPLVAITGQVASNLIGTDAFQEMDVIGMSLSCTKHSYLVTDINELAPVIAEAFEVAKSGRPGPVLIDIAKDVQLAEAPVTSLPYFEAPSIPVVVPEAIEAAEALLRASNKPVLYVGGGVQLAHATDSVRDFLTNNPMPSVSTLKGLGSIGRHDPHYLGMVGMHGTKAANLIVQESDLLIVVGARFDDRVTGKLESFAPHAKVIHIDIDAAEFNKLRHAHSTLRGDIKVILPQLKLEQDLTPWLEHVSSLRSEFKWRYDHPGELIYAPLLLKQLSDMMPDSAIVSTDVGQHQMWAAQHIQPRAPENYLTSAGLGTMGFGLPAAMGAKVARPDDQSILISGDGSFMMNVQELGTIKRKQIPVKMVLINNQRLGMVRQWQSLFFDGRHSETILDDNPDFVALAAAFGIPGKTITIKEEVEPALKEMLESDTAYLLHVLISEEENVWPLVPPGAANQDMVEGE

SEQ ID NO: 82402 - DNA, 1788 bp, Magnetospirillum magnetotacticum MS-1
  CDS (1)..(1788)
atggaggagtcgatgagcggcgaggtcatgaccggggcccagatggtcatccgggcgttccaggatcagggggtggacaccctgttcggttatccgggcggtgccgtgcttccgatctacgacgcgctcttcgacgagaccacgattcagcacgtgctggtgcgccacgagcagggcgccgtccacgcggcggagggctatgcccgctccagcggcaaggtcggcgtcgtcctcgtcacctccggccccggcgccaccaacatcatcaccggcctgaccgacgcgatgctggattcgatcccgctcgtcgccgtcacgggccaagttccgacgcacctgatcggctccgacgcgttccaggaatgcgatacggtcggcatcacgcgccactgcaccaagcacaactacctcgtgaaatcgatcgaggacctgccgcgcatcctgcacgaggcgttctacgtcgcgagccacggccgtcccggcccggtcgtcatcgatctgccgaaggacgtgcagttcgccaccggcgtctacagccggccgacgcagaacgggcacaagacctacaacccgccggtcaagggcgattccgagaagatccgcgcggcgatcgagctgatggcgggtgcgcgccggccggtcttctataccggcggcggcgtcatcaattcgggcccggaagcttcccgcctcctgcgtgagctggtcgccgagaccggcttcccggtcacctcgacgctgatgggtctgggtgccttcccagcctccgacgacaagttcctcgggatgctgggcatgcacggcacctacgaggccaacctcgcgatgcacgattgcgacgtgatgatctgcatcggcgcgcgcttcgacgaccgcatcaccggccgcctcgatgccttcgcgccctactcgaagaagatccacgtcgatgtcgacgcctcctcgatcaacaaggtcgtgaaggtcgatgtcggcatcctcggcgactgcgcggcggtgctggaggagatgctcgcccagtggcgcgcgctgccgaagcagcccgacaagggacgcatggaggattggttcaacaagatcagccgctggaagtcgcgcgactgcctcgcctactggccgtccggcacgatcatcaagccgcaatacgcggtgcagcgcctctacgaggcctgcaaggatcgcaagaccttcgtcaccaccgaggtcggccagcaccagatgtgggcggcgcagtacttcaagttcgatgagccgaaccgctggatgacctccggcggcctcggcaccatgggctacggcctgcccgccgccatcggcacgcagctcgccaacccggacgggctcgtcatcgacatcgcgggtgaagcctcgatcctgatgaacatgcaggaattgtcgacggcggtgcagtaccgtctgccggtcaagatcttcatcctgaacaacgagtacatgggcatggtgcgccagtggcaggagctgctgcacggctcgcgctactcgcagagctactcggagagcctgccggacttcgtgaagctggccgaggcctacggcgccaagggcatccgctgcgagaagcccggcgaactcgacgccgcgatccaggagatgctggcctatgacggcccggtgatcttcgattgcgtggtcgacaagaccgagaactgcttcccgatgattccctcgggcaaggcgcataacgagatgctgctgtcggactatctcggcgagaccggggtggaactcggcgacgtcatctcggccgaaggcaagatgctggtctga

SEQ ID NO: 82403 - protein, 595 aa, Magnetospirillum magnetotacticum MS-1
MEESMSGEVMTGAQMVIRAFQDQGVDTLFGYPGGAVLPIYDALFDETTIQHVLVRHEQGAVHAAEGYARSSGKVGVVLVTSGPGATNIITGLTDAMLDSIPLVAVTGQVPTHLIGSDAFQECDTVGITRHCTKHNYLVKSIEDLPRILHEAFYVASHGRPGPVVIDLPKDVQFATGVYSRPTQNGHKTYNPPVKGDSEKIRAAIELMAGARRPVFYTGGGVINSGPEASRLLRELVAETGFPVTSTLMGLGAFPASDDKFLGMLGMHGTYEANLAMHDCDVMICIGARFDDRITGRLDAFAPYSKKIHVDVDASSINKVVKVDVGILGDCAAVLEEMLAQWRALPKQPDKGRMEDWFNKISRWKSRDCLAYWPSGTIIKPQYAVQRLYEACKDRKTFVTTEVGQHQMWAAQYFKFDEPNRWMTSGGLGTMGYGLPAAIGTQLANPDGLVIDIAGEASILMNMQELSTAVQYRLPVKIFILNNEYMGMVRQWQELLHGSRYSQSYSESLPDFVKLAEAYGAKGIRCEKPGELDAAIQEMLAYDGPVIFDCVVDKTENCFPMIPSGKAHNEMLLSDYLGETGVELGDVISAEGKMLV

SEQ ID NO: 82404 - DNA, 1605 bp, Desulfitobacterium hafniense DCB-2
  CDS (1)..(1605): n means a or g or c or t/u
atgtttgggtatcccggcggagctgttttgcccatctatgatgccctgatcaacagcccgatccggcatctgctgccccggcatgagcagactgccattcatgccgccgacgcctttgcccgggtcagcggcaaagtaggggtttgcctggccacttccgggccgggagcaacgaatttagtcacagggattgccaatgcctatatggattccnatacccgttgtgatnacttaaccgggcaagtccccaccagccttttggggacggattccttccaagaggtggatatcacagggattacccttcccatcaccaaacattcttatcttgtcaaggacccgcggcagatcccgcggattgtcaaggaagctttttatattgccagcacaggacgtcccggccccgtcttaatcgacttgcccaaaaacgttctggccgcaacggatgtccgcccggccccggcggaattgaatctgaaaagctataaatactttaccaaggggaatgccgggcagatcgaagaagcagcccgggtcatcgcccaatcccagcggccggttctctatgccgggggaggagtgatcacggccggagccagtgaaatccttcagcaagtcgtggaaagggccaaccttccggtggtcactaccctgatggggataggaagcctgcccacaaaccaccccaatgttttggggatggtagggatgcacggaaccgtgacggcaaattatgcagtagatgattgtgatctgctgattgctataggggtccgcttcgacgaccgggtcaccagcggtttaggccatcgttttgccacgaaagccaaaatcattcatatcgacattgatcccgccgaaatcggcaaagttgcaagaaccaaggtccccattgtcggcaatgccaaattggttttggaagagcttctctctaaagtcagcaaaccggaaatttctccttggtgggagcaaatccgcttgtggcaggaagaaaaactcaagaccgataatcccaatcttaatcctcaggtgattattgagaccctgggcgaaattgccggagaagaaaccatcgtcaccaccgatgtgggccagcatcagatgtgggctgcccaaggctatccggttccagctccccggcattttatcaccagcggcggtctgggcaccatgggttttggattgccggcagccctcggagctcaagtcgctgctcctgaaagcaccgtttttctggttacaggggacggctccttccagatgagcattcaggagctggctaccgcagtacaataccagcttccggtaaagattatcctcatgaataacggggttttaggtatggtgcgccagctgcagatggtcttttgcgatgagcgttatagtcagattcagcttaccgccaaccctgattttatcaagattgccgaagcttacggcattcgcggaattcgcgttacggagacttccgaagtccgcaacgctctcttggaagctattaatcatcccggtccggttctcatggatttcattatatccgaagatgaagtggtctccccgatggttcccccagggaagggactcacagaaatgttggggtggtga

SEQ ID NO: 82405 - protein, 534 aa, Desulfitobacterium hafniense DCB-2
  misc_feature (72)..(72): Xaa can be Asn or Asp or His or Tyr
  misc_feature (77)..(77): Xaa can be Asn or His or Asp or Tyr
MFGYPGGAVLPIYDALINSPIRHLLPRHEQTAIHAADAFARVSGKVGVCLATSGPGATNLVTGIANAYMDSXTRCDXLTGQVPTSLLGTDSFQEVDITGITLPITKHSYLVKDPRQIPRIVKEAFYIASTGRPGPVLIDLPKNVLAATDVRPAPAELNLKSYKYFTKGNAGQIEEAARVIAQSQRPVLYAGGGVITAGASEILQQVVERANLPVVTTLMGIGSLPTNHPNVLGMVGMHGTVTANYAVDDCDLLIAIGVRFDDRVTSGLGHRFATKAKIIHIDIDPAEIGKVARTKVPIVGNAKLVLEELLSKVSKPEISPWWEQIRLWQEEKLKTDNPNLNPQVIIETLGEIAGEETIVTTDVGQHQMWAAQGYPVPAPRHFITSGGLGTMGFGLPAALGAQVAAPESTVFLVTGDGSFQMSIQELATAVQYQLPVKIILMNNGVLGMVRQLQMVFCDERYSQIQLTANPDFIKIAEAYGIRGIRVTETSEVRNALLEAINHPGPVLMDFIISEDEVVSPMVPPGKGLTEMLGW

SEQ ID NO: 82406 - DNA, 1776 bp, Desulfitobacterium hafniense DCB-2
  CDS (1)..(1776)
atggccttatggggaaacgagacaaatgacacccgcttgactgaatctttggcggccggtcgggtaagaatgactggagcccaattcctggctgctttcttagcgaagaagggggtttcccaaatctatggcattcctggtgcggctattctgcctttctacgatgccgttcgtgaactcaatatggaatcctataatgtccgccatgaacaggcagccatctttatggctgacggctattcacgggccacaggaaaggtaggcgtgtgcgccgccacctccggaccgggcgccaccaactttctaacaggtttatacagtgcctacagcgattccgtccctctgctggccctgaccggccaggttcccacttccctgatcggcaaagactctttccaggaggcccctatggttgaaatggcccgcccagtgaccaaggccgcttacctggtggagaaggcgggggaccttccccggattctcaaggaaggatgggagttggccaccacaggaaaaaaaggccccatcttgctggatctccctttggatgtccaaaagggccttgtggaagtggattggagtgaattcgattttagcccaccccagccccccaggcaggagattgcccaagatacattgaatacaatattgtccatgctctatgaagccaaaactcctaccctgctggcaggcggcggcattgttcagggcaacgcagcggaactgctgcgggaaacggccgagcttctccagattcccgtagtgtcctccttaatgggcaaggatgcctttcctaatgatcatcccctctatggagggttggtgggcacgatgtgccaaactcccctgggcaataaaaccatcctggagtccgaccttattatcaatttgggaggccgcttcgatggccgggggacaggagacagccaacggttccagtcgggacgaaaagtcgtccatgtgaatctggataatagagagctttcccgccatatctctaccgaacttgccgtagcagcggatataagggacttcctggaacacttcctcgcctttctgcgggataagggtttcattcctacccctcaggcccggcaacgaattctcgacttacaagaggagcgcatccgcttggcccgccgcacgaagttcgacacccttcccctcaagccccagcaagccattgctgaggtacgggaggccatggcccgggatggaattctcaccttggattgcggcatcagccagatctgggctacccagctttttgaagcctatgttccccgctccttcctgattaccggccgggcgggaaccatgggatggggattgggagctgcactgggagccaagcttgcatatcctgaccggcaagtggttaatcttctaggggatgccagtcttggcatgtctttgcaggaactggctacggccgccaaacacaatattcccgtggtggtggtggtcctcaacaactccttattcggactgatccgtcagcagcaaaatctgctctttgagcagcgctgtatttccaccgatcttgagtatgaaaaccatgtgcaaggtcattcccgcggcttggactttgtggccacagcacggggaatgggagtagaagcggaattagtcgacggaccggatcaaattcagggagctctggcgcgtgctttcagccaaaaccgcccttacttgattgaggttctcgtggatcctctggcccaatgttccgtttcccttgacggaacactcaccggtgtcttggaacttgaatga

SEQ ID NO: 82407 - protein, 591 aa, Desulfitobacterium hafniense DCB-2
MALWGNETNDTRLTESLAAGRVRMTGAQFLAAFLAKKGVSQIYGIPGAAILPFYDAVRELNMESYNVRHEQAAIFMADGYSRATGKVGVCAATSGPGATNFLTGLYSAYSDSVPLLALTGQVPTSLIGKDSFQEAPMVEMARPVTKAAYLVEKAGDLPRILKEGWELATTGKKGPILLDLPLDVQKGLVEVDWSEFDFSPPQPPRQEIAQDTLNTILSMLYEAKTPTLLAGGGIVQGNAAELLRETAELLQIPVVSSLMGKDAFPNDHPLYGGLVGTMCQTPLGNKTILESDLIINLGGRFDGRGTGDSQRFQSGRKVVHVNLDNRELSRHISTELAVAADIRDFLEHFLAFLRDKGFIPTPQARQRILDLQEERIRLARRTKFDTLPLKPQQAIAEVREAMARDGILTLDCGISQIWATQLFEAYVPRSFLITGRAGTMGWGLGAALGAKLAYPDRQVVNLLGDASLGMSLQELATAAKHNIPVVVVVLNNSLFGLIRQQQNLLFEQRCISTDLEYENHVQGHSRGLDFVATARGMGVEAELVDGPDQIQGALARAFSQNRPYLIEVLVDPLAQCSVSLDGTLTGVLELE

SEQ ID NO: 82408 - DNA, 1644 bp, Nostoc punctiforme PCC 73102
  CDS (1)..(1644)
atgaatacagcagaattattggtgcagtgcctagaaaatgaaggagtgcaatatatttttggactccctggcgaagaaaacctgcacgttttggaagcgctaaaacattcttcgatcaaatttattacgactcgtcatgaacaaggtgcagcattcatggccgatgtctacggacgcttaacaggaaaagccggagtgtgtctttctactcttggccctggggcaaccaacttgatgactggggtagcagatgctaacctcgatggtgcgcccttggtggcaattactggtcaagtgggaacagatagaatgcacatcgaatcccatcaatatttagatttggtggcaatgtttgcacctgttaccaagtggaataagcagattgtgcgaccgagtattacaccagaagtagtgcggaaagcatttaagcgatcgcaatctgaaaaacccggtgcagttcacatcgatttaccagaaaatattgctgccatgcccgtcgaaggcaaacctttgcgtaaggataatagcgaaaaaacttatgcatcttttgctagcattcgggcagcagcagccgcaatttgccaagcagttaacccattaatcttagtcggaaatggggcaattcgcgctcaagcaagtgatgccgtaacccaatttgccacattactgaatatacctgttgccaatactttcatgggtaaaggtgtgattccctacacacatcaattggctttgtggtcagtcggattacagcaaagagacttcattacctgcggttttgataacacagatttagtaattgccatcggctatgatttgattgagttttctccgaaaaaatggaatcggaatggtgaaattccgattgtgcatattggggtaagtccggcggaaattgatagtagttatattcctaacgccgaagtcgtgggagatatttcagattccctctatgaaattttaaaattagcagacagacaaggtaaacccgatccttttgctattagcttaagatcagatattcgggctgattatgaacagtatgcccatgatgacggatttcccattaagccacaaaagttaatttatgatttacggcaagtgatgggcccagatgatatcgtcatctctgatgttggcgcacataagatgtggatggctcgtcattatcattgccatagccccaatacttgcataatttccaacggcttcgcggctatgggtattgctattcctggcgcattagcagcaaaactcgttcatcctaaacgcaaagtcgttgctgtaacaggtgatggcggctttatgatgaattctcaagaattagaaacagccttacgcgtaggtacaccttttgtcaccataattttcaatgatggtggctatggattaattgagtggaagcaagaaaatcactttggcaaaggaaactcatcttttgtgcattttagtaatcctgattttgttaaatacgctgaaagcatgggtttaaaagggtaccgagttgaatcggctttagatttaattcccactctgaaagaagccctcgctcaagatgtacccgccgtgatagattgtcccgtagattatcgggaaaatcaccgcttcagtcaaaaagctggcgagttgagttgtgcggtgtaa

SEQ ID NO: 82409 - protein, 547 aa, Nostoc punctiforme PCC 73102
MNTAELLVQCLENEGVQYIFGLPGEENLHVLEALKHSSIKFITTRHEQGAAFMADVYGRLTGKAGVCLSTLGPGATNLMTGVADANLDGAPLVAITGQVGTDRMHIESHQYLDLVAMFAPVTKWNKQIVRPSITPEVVRKAFKRSQSEKPGAVHIDLPENIAAMPVEGKPLRKDNSEKTYASFASIRAAAAAICQAVNPLILVGNGAIRAQASDAVTQFATLLNIPVANTFMGKGVIPYTHQLALWSVGLQQRDFITCGFDNTDLVIAIGYDLIEFSPKKWNRNGEIPIVHIGVSPAEIDSSYIPNAEVVGDISDSLYEILKLADRQGKPDPFAISLRSDIRADYEQYAHDDGFPIKPQKLIYDLRQVMGPDDIVISDVGAHKMWMARHYHCHSPNTCIISNGFAAMGIAIPGALAAKLVHPKRKVVAVTGDGGFMMNSQELETALRVGTPFVTIIFNDGGYGLIEWKQENHFGKGNSSFVHFSNPDFVKYAESMGLKGYRVESALDLIPTLKEALAQDVPAVIDCPVDYRENHRFSQKAGELSCAV

SEQ ID NO: 82410 - DNA, 1689 bp, Desulfovibrio desulfuricans G20
  CDS (1)..(1689)
atggagtcgagcggggcccggatcctgttggagtgtcttaaaaaggaaggcgttgatgtcattttcggctaccccggcggggccgtgatcgacatttacgacgaacttccccggcatgacctgcgtcatgtgctggtgcgccacgaacaggccgcagtacatgccgcggacggttatgcccgtgcttccggtcgagtgggggtctgtctggtcacttcgggacccggcgccaccaataccgtgaccggaatcgctacagcgtactgcgactccattcctctggtggtgctaaccggacaggtgccgcgtgcgctgataggcaatgacgcttttcaggaagtggatatagtgggcattacgcgtccctgcaccaagcataattatctggtgaaggaactgagcgacttgccgcgtattatccgcgaagctttttatcttgcccgttccggcaggccgggtcccgttcttgtcgacctgccaaaagatatcatggtagcccgtgcagagtttcagattcctgaagaagtcaagctgcgcagctacaacccgacatacagaccgaatcttaaccagctgcgcagagcggcggaactggttctttctgccagacggccgctgctgttcgccggtggcggggttgtggggtccgatgccagcgaagagcttggctggctggcccgcacgttgcagattccggtaacttcaagtctgatggggcttggttcttttcccggtgacgacccgctctttctgggcatgctgggtatgcacggcacctttgccgccaacaaggcggtgaatagctgtgacgtgcttattgccgccggtgcgcgctttgacgacagagtgacaggaaagctttcggcttttgccgccggtgccaagattatccacatagacatcgaccccacatccatcagaaaaaatgtgggcgtagaggtgcctgtggtgggcgactgccgtatggcgcttgctggcatgcgcgagattctttcggcccgctttgaagagaacattcccgtaccccgctggactgagtggcttgccacggtgcacgattgggcgcagagtcatcctctggggtatgtgccttctgaaggtattaaaccgcagcaggttgtggaaactgttttcggtattaccagaggcgagtgtattgtcaccaccgaggtggggcagaaccagatgtgggccgcacagtttttcaaataccgtaaaccgcgcacgctgctgacttccggcggactaggcaccatgggatacggttttccggcggctataggtgcgcagatggcgtttccggggcatctggtgattgattttgcgggcgacggttccattcagatgaatattcaggaactggccacagcggtttgtaacaagctgccggttaaaataattattctgaacaacggctatctgggtatggtgcgccagtggcaggagttgttctatcagcgtaattactgttcaacctgcatggaggcccagcctgattttgtgaaactggctgaagcctacggagcggaagggtaccgcatcacagcacaggctgatcttgagccggtgttgcggcaggccctgcaaagcccggctccggctattgttgatgtgcgcgtggagcgcgaggaaaatgtctatcccatggttccggccggtgcggcgctggacgagatgctgcttgtgtag

SEQ ID NO: 82411 - protein, 562 aa, Desulfovibrio desulfuricans G20
MESSGARILLECLKKEGVDVIFGYPGGAVIDIYDELPRHDLRHVLVRHEQAAVHAADGYARASGRVGVCLVTSGPGATNTVTGIATAYCDSIPLVVLTGQVPRALIGNDAFQEVDIVGITRPCTKHNYLVKELSDLPRIIREAFYLARSGRPGPVLVDLPKDIMVARAEFQIPEEVKLRSYNPTYRPNLNQLRRAAELVLSARRPLLFAGGGVVGSDASEELGWLARTLQIPVTSSLMGLGSFPGDDPLFLGMLGMHGTFAANKAVNSCDVLIAAGARFDDRVTGKLSAFAAGAKIIHIDIDPTSIRKNVGVEVPVVGDCRMALAGMREILSARFEENIPVPRWTEWLATVHDWAQSHPLGYVPSEGIKPQQVVETVFGITRGECIVTTEVGQNQMWAAQFFKYRKPRTLLTSGGLGTMGYGFPAAIGAQMAFPGHLVIDFAGDGSIQMNIQELATAVCNKLPVKIIILNNGYLGMVRQWQELFYQRNYCSTCMEAQPDFVKLAEAYGAEGYRITAQADLEPVLRQALQSPAPAIVDVRVEREENVYPMVPAGAALDEMLLV

SEQ ID NO: 82412 - DNA, 1653 bp, Actinobacillus pleuropneumoniae serovar 1 str. 4074
  CDS (1)..(1653)
atgaatggtgcaaatttggtcatagaaagcctcaaagcgcacggagtgactacccttttcggttatccgggcggtgcaatcatgcctacctacgatgcgatttacgactcgggattagatcacttattagtacgcaacgaacaaggtgcggcgatggcggctatcggttacgctcgtgcgaccggtaaagtcggcgtttgtatcgcaacatccggccccggcgcaaccaatttaattaccggcttgggcgatgcggcgttagattcgattccggtcgtcgcaattaccggacaagtggcaagtcatttaatcggtaccgatgcgttccaagaatcagacgtattaggcttatctctcgcttgtaccaaacacagctttatcgtgcaaaatatcgaagaattaccggaaatcatcgcacgtgccttccaaatcgcgcaaaggggtcgccccggtccggtattagtggatattccgcgcgatattcaacttgcactgacctcagcaaaacctatcgtttatgaaaaacaagcggttgaagcgcaaaatcaagacttattaaacgaagcgaaaacattgctggcaaatgccaaacgtccggtactttatgtcgggggcggtgtcggtatggctggcggtgtgcaagcggtcagaaatttcctaaaagtcacaaatattccgtccgtatcaacattaaaaggattaggcacaattaccattgatgatccgctttatatgggtatgattggtatgcacggtactaaagcggcaaactacgcagtacaagaatgtgatcttttaatcgcatgcggtgcgcgttttgacgaccgtgtaaccggtaaattggatactttcgccccacacgctaaagtgattcatattgatattgatattgccgagattaataaattacgcaaagtggaagttgcgctacgaggcgatttagttgaagcggttaatacattagcgcaaccgctagatattgatccttggcgtgaagacgtaaaacgcttaaaagcggatttggatttccaatatgttgataatgcgggcgaaggcgatattaatgcgaaagcgttactgaatacgctttctcagcgtaaaccgaaaaatgcgattattactaccgatgtcggtcagcaccaaatgtggtcggcacaacatttacaacatttcgccccggaaaacttcatcacttcggcaggtttcggctcgatgggcttcggtttaccggctgcggttggtgcggttaaggctcgtccgcaagatccggtgattttagttaccggtgacggttcgattatgatgaatatccaagaattaggtacgcttaaacgcggtcatttaccggttaagatcgtgttattggataaccaacgtttaggtatggtgcgtcaatggcaatcgctgttcttccacggtcgccacagtaatactattttagacgacaatcctgatttcgtcgtattagcttcagcattcggtattcaaggtgaacgaatcgaaaaagcaagtgaagtatccgatgcgttagatcgtttactcaatgctaaaggagcttatctattacacgtttgtattccggaagaagataacgtatggccgcttgtgccgccgggtgcgtgtaatgcggatatgctggatgatgagatttag

SEQ ID NO: 82413 - protein, 550 aa, Actinobacillus pleuropneumoniae serovar 1 str. 4074
MNGANLVIESLKAHGVTTLFGYPGGAIMPTYDAIYDSGLDHLLVRNEQGAAMAAIGYARATGKVGVCIATSGPGATNLITGLGDAALDSIPVVAITGQVASHLIGTDAFQESDVLGLSLACTKHSFIVQNIEELPEIIARAFQIAQRGRPGPVLVDIPRDIQLALTSAKPIVYEKQAVEAQNQDLLNEAKTLLANAKRPVLYVGGGVGMAGGVQAVRNFLKVTNIPSVSTLKGLGTITIDDPLYMGMIGMHGTKAANYAVQECDLLIACGARFDDRVTGKLDTFAPHAKVIHIDIDIAEINKLRKVEVALRGDLVEAVNTLAQPLDIDPWREDVKRLKADLDFQYVDNAGEGDINAKALLNTLSQRKPKNAIITTDVGQHQMWSAQHLQHFAPENFITSAGFGSMGFGLPAAVGAVKARPQDPVILVTGDGSIMMNIQELGTLKRGHLPVKIVLLDNQRLGMVRQWQSLFFHGRHSNTILDDNPDFVVLASAFGIQGERIEKASEVSDALDRLLNAKGAYLLHVCIPEEDNVWPLVPPGACNADMLDDEI

SEQ ID NO: 82414 - DNA, 1635 bp, Methanococcoides burtonii DSM 6242
  CDS (1)..(1635)
atgaaaggaagcgaactgtttgtcaagtgcctggaaaacgagggagtgaaatatatttttggtatcccgggagaagaaacactggatctcatggagtccctttcgagatcggacattgaattcattgtggtaaggcatgaacaatccgcagcattcatggcggatgtgtgcggacggctaacaggcagacccggcgtatgcctgcccactctgggtccgggagctaccaacctcatgaccggagtggcggatgcccatcttgacagagcaccccttgtggccattaccggccagggttcccttgacagggcatataaggaatcccaccaatttctggatgttgcaggaatgttcagcaggataacttcctggaatgcgactgtgaccgctgccaaccagatcccggaactgatagggaaagcctttgatatcgccacggatgtacccggagctgctcatattgaactgcctgaggatgtatccactcaggagaccgatgcactgccccttgagaaaaaagaatactcccattcgtgcagctttgatgagaaggaattgcataaggccatcgaacttatctcgggtgcgaccaagcctttaatcattgccggaaacggcgtgattcgcgagaatgcttcccttgagctggaacagtttgtggatgcagccaatatcggcgttgttaccactttcatggggaaaggtgcaattcccgcagacaatgatcattttataggttccatgggaatgtccgaaaaggattacatcatatgcggtctgaacgctgcagacgtggtaattgccattggattcgattccgtggaatacagcccggaccactggaacatggaccattcaaagagtatcattcatgttcagaacaggcatcctgaaatagagaccagctatatcccggaatgtgcactcctgggcacacttaagacaaccctccgtgcaatgacctctgcagttaccccgcaggagttccctgaccattataggaatatcaaggcttccatggaagacgaattacttcgctacaaggatgaccccacattcccggtaaaaccccagcgcattctctgggaggtcagaaagaaactggatcgcgaggatatactggtcagcgacgtgggtgctcacaagctctggataggaagactgtatctagcacttgcccctaacaccgtactgatgtcgaacggcctagcttccatgggatttggcctacctgccggcatagcagcctgccttatacatcctgaaaagaaagtcgtaacgattgcaggagatgccggcatccttatgaatatccaggacctggaaaccgctgtgagactgaactgcgatcttgtgatcattatttttgacgatgcatcctacggtcttatcgaatgggaaagcaatactaaattcggagagtctttcggcacctctttcaagaacccggacttcgtgggactagcaaacagttttggtgccaaaggaatacgcataaacagcgctgacggacttggtgatgccctgcaatccgcctttaaggaaggaggcgtctggttgatcgacgttccagttgattattcagagaatatgaaacttacaacaatactggaaggcaagtattgtactgtttaa

SEQ ID NO: 82415 - protein, 544 aa, Methanococcoides burtonii DSM 6242
MKGSELFVKCLENEGVKYIFGIPGEETLDLMESLSRSDIEFIVVRHEQSAAFMADVCGRLTGRPGVCLPTLGPGATNLMTGVADAHLDRAPLVAITGQGSLDRAYKESHQFLDVAGMFSRITSWNATVTAANQIPELIGKAFDIATDVPGAAHIELPEDVSTQETDALPLEKKEYSHSCSFDEKELHKAIELISGATKPLIIAGNGVIRENASLELEQFVDAANIGVVTTFMGKGAIPADNDHFIGSMGMSEKDYIICGLNAADVVIAIGFDSVEYSPDHWNMDHSKSIIHVQNRHPEIETSYIPECALLGTLKTTLRAMTSAVTPQEFPDHYRNIKASMEDELLRYKDDPTFPVKPQRILWEVRKKLDREDILVSDVGAHKLWIGRLYLALAPNTVLMSNGLASMGFGLPAGIAACLIHPEKKVVTIAGDAGILMNIQDLETAVRLNCDLVIIIFDDASYGLIEWESNTKFGESFGTSFKNPDFVGLANSFGAKGIRINSADGLGDALQSAFKEGGVWLIDVPVDYSENMKLTTILEGKYCTV

SEQ ID NO: 82416 - DNA, 1692 bp, Methanococcoides burtonii DSM 6242
  CDS (1)..(1692)
atgaccggaaaagcagaaagaatgacaggcgcaagagcatttgtcgagtgcctgtatcgggaaaatgttgaagttatttttggatatccgggtggcgtgctgctccatatctatgatgaactttatgatgcacatctgcaccatctactcgtcagacacgagcaggcagcagtccatgcagccgaaggatacgcaagagccacaggtaaagtaggggtgtgcctcgcgacatcaggcccgggagcaacgaaccttgtaacaggtattgcaaacgcatacatggattcagttccaatggtagcattcaccggacaagtaccaagctcaatgataggtaatgatgccttccaggaagctaacattactggcattacaatgcctataacaaaacacaattacctcgtacaggatgtaaaggacctgccaaggatcatcaaagaagcattccatattgcttccacaggcagacccggaccagtgctcatagatcttccaaaggatattaccacagacgaaattgattttgtataccctgacacagtcgaactgcgtggatataagccaacattcaaaggcaatgcacagcaaataaagagagctgcagccgtccttaaagatgcaaaaagacctgtgatctatgccggaggcggtgtgatcggatctgaaggaagcaaagagctgctggcatttgccgagaagctcaaagcacctgttacgacgacacttaccggtatcggaggatttccgaacgataatgaactttatctcggaatgcctggaatgcacggtacgaaatatgcgaactatgcaattcaggaaagcgatgttctcatagcagtaggcgtacgtttcgatgacagagtaaccggaaagacaacatctttcgcaccaaacgcaacagttatccacattgatatcgaccctgcggaaatatcaaagatcataaaggtagatgtccccatagtcggtgatgcaaagcagatcctgggtgcactgcttaaacatgtttccgaatgcgataccaaagaatggctagacaaaattgctacatggaagagggatttcccattgttctatgtaaacagagatgatgtcatcaagccacagtatatactcgaacagataaatgaagtatgtcctgatgcgatcatcgtcaccgaggtcggacaacaccagatgtgggctgcccagtattttaactacaccgaaccacgtacattcatatcctcaggtggactcggaacaatgggctatggatttccggcagctatcggtgccaagatcggcagacccgacaaggtcgtattcgatgtttcaggtgacggttcatttcagatgaactcacaggaaatggcaaccattgtccagaacaatatcccaataatcattgcaattttcaacaatggttatcttggaatggtcagacaatggcaggcattgttcttcgaacaccgctattcacacaccaccattgagaacagtgttgacttcgtcaagctggcagaagcatacggtgcaatgggaatacgcgtaacaaagccatccgaagtgaaagctgccatcgaaaaagcggttgaggccaatgcgccggtacttatcgatttcatcatcgagcgtgaggagaatgtatcccctatggtcccggcaggtgctgcaataaacgaaatactcgatctggaggacatacaatga

SEQ ID NO: 82417 - protein, 563 aa, Methanococcoides burtonii DSM 6242
MTGKAERMTGARAFVECLYRENVEVIFGYPGGVLLHIYDELYDAHLHHLLVRHEQAAVHAAEGYARATGKVGVCLATSGPGATNLVTGIANAYMDSVPMVAFTGQVPSSMIGNDAFQEANITGITMPITKHNYLVQDVKDLPRIIKEAFHIASTGRPGPVLIDLPKDITTDEIDFVYPDTVELRGYKPTFKGNAQQIKRAAAVLKDAKRPVIYAGGGVIGSEGSKELLAFAEKLKAPVTTTLTGIGGFPNDNELYLGMPGMHGTKYANYAIQESDVLIAVGVRFDDRVTGKTTSFAPNATVIHIDIDPAEISKIIKVDVPIVGDAKQILGALLKHVSECDTKEWLDKIATWKRDFPLFYVNRDDVIKPQYILEQINEVCPDAIIVTEVGQHQMWAAQYFNYTEPRTFISSGGLGTMGYGFPAAIGAKIGRPDKVVFDVSGDGSFQMNSQEMATIVQNNIPIIIAIFNNGYLGMVRQWQALFFEHRYSHTTIENSVDFVKLAEAYGAMGIRVTKPSEVKAAIEKAVEANAPVLIDFIIEREENVSPMVPAGAAINEILDLEDIQ

SEQ ID NO: 82418 - DNA, 1671 bp, Dechloromonas aromatica RCB
  CDS (1)..(1671)
atgactgaaactctcaccggcgcgcagatcaccgttcgcctgctcgaacgccaaggcattcgtaccgttgccggtattcccggcggcgccatcctgccaatctacgatgccctcggccaatcaagcgccatccaccatgtactggcccgccacgaacagggggccggcttcatggcccagggcatggcccgctctaccggcctgcccgctgtctgcctagcgtcctccggcccaggcgcgaccaacctgctgacggccattgccgatgccaagctcgattcgatcccgttggttgccatcaccggccaagtgccgaaggcgatgattggtaccgatgcttttcaggaggtcgacacttacggactctccattccgatcaccaaacacaactttctcgtctcctcccccgaggaattgctggcggtgattccccgcgccttcgaaattgccacctcaggccgccccggcccggtgctggtcgacatcccgaaagatgtacaaacccaggcgatcgaaattggcgaatggccagagcctggtcgcgcccagccaatcactccgacagacccggcgttgatcgcgcaggctacagcaatgatcaatgctgccgaacgcccgattctttatctcggtggtggcgttgtgcattccggcgcagcaaggacggcagtcgatctcgccgaaaaatccaatttaccgaccgtcatgaccttgatggcactcggcaccatgccggtcgatcacccgctgtcgctcggcatgctgggcatgcacgctgcccgttacaccaacctcgcacttgaagaatgcgaccttctgatcgccgtcggcgcccgcttcgatgaccgtgccaccggcaaggtggccgccttttgtccccaggcgaaaattatccatatcgatatcgacccggctgaactggacaagatcaagactgctcatctcggcatcgctgctgatgtccaggaagcgctcacgcagctactaccggccgtagctgacaacgaccgacaagtctgggtggatcgtaacaataccttgaaggcagaatttcctttcgagatgccgggactcgacaacccgcgctctcactttggcttgattcgcaccgtcgccgcctgcctggacaatgaagccactgtcaccaccgacgtcggccagcaccagatgtgggttgcccaagcctacccgctgcgccggccacgccagtggctgacttctggcgggctgggcaccatgggctttggtgtaccagcggccatcggcgccgctctggctgaaccgcagcgcaccgtggtctgcttcaccggcgacggttcgatcctgatgaacatccaggaactggtcaccgccgccgaggaaaacgtgaacgtgaaaattgtgctcatggacaacgcaacgctcggtctggtgcaccagcagcagacactgttctacggcgaaagactgttcgcctcgcaattcaaatcctcgccggacttcatcaagatcgcacaaggtttcggtatcgcagcggtcgacctcgatctggccgccaacccttgtgcagccctgatggaagccatcgctcgccccggcccctgcctaatccacgccagtatcgatgccgagcagaaggtctaccccatggtgccaccgggtgccgccaaccgtgacatgattggagcctga

SEQ ID NO: 82419 - protein, 556 aa, Dechloromonas aromatica RCB
MTETLTGAQITVRLLERQGIRTVAGIPGGAILPIYDALGQSSAIHHVLARHEQGAGFMAQGMARSTGLPAVCLASSGPGATNLLTAIADAKLDSIPLVAITGQVPKAMIGTDAFQEVDTYGLSIPITKHNFLVSSPEELLAVIPRAFEIATSGRPGPVLVDIPKDVQTQAIEIGEWPEPGRAQPITPTDPALIAQATAMINAAERPILYLGGGVVHSGAARTAVDLAEKSNLPTVMTLMALGTMPVDHPLSLGMLGMHAARYTNLALEECDLLIAVGARFDDRATGKVAAFCPQAKIIHIDIDPAELDKIKTAHLGIAADVQEALTQLLPAVADNDRQVWVDRNNTLKAEFPFEMPGLDNPRSHFGLIRTVAACLDNEATVTTDVGQHQMWVAQAYPLRRPRQWLTSGGLGTMGFGVPAAIGAALAEPQRTVVCFTGDGSILMNIQELVTAAEENVNVKIVLMDNATLGLVHQQQTLFYGERLFASQFKSSPDFIKIAQGFGIAAVDLDLAANPCAALMEAIARPGPCLIHASIDAEQKVYPMVPPGAANRDMIGA

SEQ ID NO: 82420 - DNA, 1722 bp, Haemophilus influenzae R2866
  CDS (1)..(1722)
atgaagaagttatctggcgcagagatggtggttcaatctttacgtgatgaaggcgtagagtatgtatttggttatcccggaggcgcggtattagatatttatgatgcaattcatacgctgggtggtattgaacatattttagttcgccacgaacaagccgcggtgcatatggcggatggttacgcacgttcaacgggtaaagttggatgtgtgctagtgacttcggggcctggtgcaacaaatgctatcactggtattttaacggcttataccgattctgtgcctatggttatcatttcgggtcaggttatgagcaatttaattggcagtgatgctttccaagaatgtgatatgctgggcatttctcgtcccgttgtgaagcatagctttattgtcaaaaaggcggaagatattccatctactttgaaaaaagccttttatattgcatctacgggtcgtccaggccctgttgttgtggatattccaaaagacactgtaaatcctaattttaaatatccttatgaataccctgaatatgtcgagttacgttcttataatcccacagtaaatggacacaaaggtcaaattaaaaaagcgttaaaagcacttttagtggcgaagaaaccaatactttttgtcggtggtggtgcaatcactgctgaatgtagtgagcagttaattcagtttgcacaacgtttaaatttacccgtgacttcctcattaatgggattgggtgcttatccaagtacggataaacaattcttaggtatgttgggtatgcatggtactttagaagcgaatacggcaatgcacgaaagtgatcttattttgggggttggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggttttggttttcctgcggcacttggtgtgaaattagctcatcctgaaggaactgttgtttgcgttactggcgatggtagtattcaaatgaatattcaagagctttctaccgcaacacaatatggcattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggtgcaatgaatgaaatgattttaagtaaacctcaagaggagacaaactaa

SEQ ID NO: 82421 - protein, 573 aa, Haemophilus influenzae R2866
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGVGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 82422 - DNA, 1704 bp, Ralstonia eutropha JMP134
  CDS (1)..(1704)
atgatcggtgcggaaatcctcgttcatgcacttgccgaagaaggcgttgaatacgtctggggttatcccggcggcgcagtgctgtatatctacgacgagcttcacaagcaaaagaaattcgagcacatcctggtgcgccacgagcaggccgcggtccatgccgcagacggctatgcacgggcaaccggcaaggtgggcgtcgccctggtgacctcgggtcccggcgtgaccaatgccgtcacgggcattgccaccgcgtacctcgattcgatcccgatggtggtgatcaccggcaacgtgccgacccacgcgatcggccaggatgccttccaggaatgcgacaccgtcgggattacgcgcccgatcgtcaagcacaacttcctggtgaaggacgtgcgcgatctcgcctcgaccatcaagaaggccttctacattgcttcgaccggccgtccgggcccggtggtcgtggacatccccaaggatgtttcgcgcaacacctgcaagtacgagtacccgaagtcgcttgacatgcgctcgtacaacccggtcaacaagggccactcgggccagatccgcaaggccgtggcgctgctgcagggcgccgagcgtccgtacatctacgccggcggcggcgtggtgctggccaacgccagcgaggaactgcgccagctcgcggccctcacgggccacccggtcacaaacaccctgatgggcctgggctcgttccccggcaccagcaagcagttcgtcggcatgcttggcatgcacggcacgtatgaagccaacatggccatgcagaactgcgacgtgctgattgccatcggtgcgcgtttcgatgaccgcgtgatcggcaacccgtcgcacttcacctcgcaggcgcgcaagatcgtccatatcgatatcgacccgtcgtcgatctcgaagcgcgtcaaggtggatatccccatcgtcggcaacgtcaaggacgtgctgcaggaactgatcgcgcagctgcaggccagcgacgtcaagcccaagcgcgaggcgctcgccaagtggtgggagcagatcgagcaatggcgttcggtggactgcctcaagtacgaccgcagctccgagatcatcaagccgcaatacgtagtcgagaagatctgggaactgaccaagggcgatgcgttcatctgctccgacgtcggccagcaccagatgtgggccgcgcagttctacaagttcaacgagccgcgccgctggatcaactcgggcggcttgggcacgatgggcgtaggcctgccgtacgcaatgggcatcaagaaggcgtttccggagaaggaagtcgtcaccatcaccggtgagggctcgatccagatgtgtatccaggaactgtcgacctgcctgcagttcgacacccccgtcaagatctgctcgctcaacaacggctacctcggcatggtgcgccagtggcaggaaatcgagtacgacaaccgctactcgcattcctacatgaatgcgctgcccgacttcgtgaaactggctgaggcctatggccacgtcggcatgcgtgtggaaaagacgtccgacgtcgagccggcgctgcgcgaggccttccgcctgaaggaccgtaccgtgttcctggacttccagaccgatcccactgaaaacgtctggccgatggtccaggcgggcaagggcatttcggaaatgctgctcggcgcggaggacctgtaa

SEQ ID NO: 82423 - protein, 567 aa, Ralstonia eutropha JMP134
MIGAEILVHALAEEGVEYVWGYPGGAVLYIYDELHKQKKFEHILVRHEQAAVHAADGYARATGKVGVALVTSGPGVTNAVTGIATAYLDSIPMVVITGNVPTHAIGQDAFQECDTVGITRPIVKHNFLVKDVRDLASTIKKAFYIASTGRPGPVVVDIPKDVSRNTCKYEYPKSLDMRSYNPVNKGHSGQIRKAVALLQGAERPYIYAGGGVVLANASEELRQLAALTGHPVTNTLMGLGSFPGTSKQFVGMLGMHGTYEANMAMQNCDVLIAIGARFDDRVIGNPSHFTSQARKIVHIDIDPSSISKRVKVDIPIVGNVKDVLQELIAQLQASDVKPKREALAKWWEQIEQWRSVDCLKYDRSSEIIKPQYVVEKIWELTKGDAFICSDVGQHQMWAAQFYKFNEPRRWINSGGLGTMGVGLPYAMGIKKAFPEKEVVTITGEGSIQMCIQELSTCLQFDTPVKICSLNNGYLGMVRQWQEIEYDNRYSHSYMNALPDFVKLAEAYGHVGMRVEKTSDVEPALREAFRLKDRTVFLDFQTDPTENVWPMVQAGKGISEMLLGAEDL

SEQ ID NO: 82424 - DNA, 1707 bp, Methylobacillus flagellatus KT
  CDS (1)..(1707)
atggaattatctggcgcagaaatcgtcattcgctgcttgcaggaagaaaacgtcaaatacgttttcggctatcctggcggcgcagtgctcaatatttatgatgaaatattcaaacaggacaagttcaagcacattcttgtccggcatgagcaagccgctgtccacgcggcagacgcctattctcgcgccacgggtgaggtcggggtcgccctggtgacatccggccctggtgccaccaatgccattaccggcattgccactgcccatatggactccatccccttggtcgtcattagcggccaggcgcctacgcctgccattggccaggatgccttccaggaagtggacatgatcggcatctcacggccctgcgtgaagcacaacttcctggtcaaggacgtgaaagacatcgctcccaccatcaagaaggcattcttcattgccgcgactggccgtcccggcccagtggtcgtcgacatccccaaggatattactgcgcacctcggccattatgaatatcccgagagtgtagagatgcgctcctacacgcctatcctcaagggacactctggccagatcaagaaggccatcaagctcatgctcgaagctaagcgccccatgctgtataccggcggcggcgtagtgctcggcgatgcctcggagcagctgatcaagctcgcacgcagactgggcttccccgttaccaataccctgatgggattgggcggctatcctgctacggacaagcagttcgtcggcatgctcggcatgcacggcactctggaagccaatatggcgatgcagaactgtgacgtgctggttgccatcggcgcgcgctttgacgaccgcgtcatcggcaatccgcagcacttctacaacaaggaccgcaccatcatccatgtcgatgtggatccttcctctatctccaagcgcgtcaaggtggatgtgcccatcgtcggccacgtgcagtccgtgctggccgaaatgaacgacttgctggacgccgaaacccgcgcacccgacgctgccgcgctcaaggcctggtggacgcagatcgaggaatggcgtggccgcaactgcctgggctacaaccgcaacagcgagatcatcaagccgcagttcgtcatcgaaaaattgtgggaagtcaccaagggcgaggcctatgtaacgtccgacgtcggccagcaccagatgtgggccgcgcaatattacaagttcgacaagccgcgccgctggatcaactcgggcggcctgggcaccatgggcgtcggcctgccctacgccatgggcgtgcagtttgccgatcccaaagccaaagtcgcctgtattaccggcgagggcagtatccagatgaacatccaggagctgtcgacctgcaagcaattccacctgccgatcaaggtgatcctgctcaacaaccgctatctgggcatggtgcgccaatggcagcaattcttctacgaaaaccgctattcggaatcctacatggacagcctgccggatttcgtcaagcttgcagagtcctacggccatgtcggcatgaacatcgagaagcctgccgacgttgaaggcgccctgaccgaggcattcaacctcacggacaggtttgtcttcatgaacttcatcaccgaccagaacgagaacgtgttcccaatggtgccgaacggcaagggcttgtctgaaatcatcctggctgaagacctgtaa

SEQ ID NO: 82425 - protein, 568 aa, Methylobacillus flagellatus KT
MELSGAEIVIRCLQEENVKYVFGYPGGAVLNIYDEIFKQDKFKHILVRHEQAAVHAADAYSRATGEVGVALVTSGPGATNAITGIATAHMDSIPLVVISGQAPTPAIGQDAFQEVDMIGISRPCVKHNFLVKDVKDIAPTIKKAFFIAATGRPGPVVVDIPKDITAHLGHYEYPESVEMRSYTPILKGHSGQIKKAIKLMLEAKRPMLYTGGGVVLGDASEQLIKLARRLGFPVTNTLMGLGGYPATDKQFVGMLGMHGTLEANMAMQNCDVLVAIGARFDDRVIGNPQHFYNKDRTIIHVDVDPSSISKRVKVDVPIVGHVQSVLAEMNDLLDAETRAPDAAALKAWWTQIEEWRGRNCLGYNRNSEIIKPQFVIEKLWEVTKGEAYVTSDVGQHQMWAAQYYKFDKPRRWINSGGLGTMGVGLPYAMGVQFADPKAKVACITGEGSIQMNIQELSTCKQFHLPIKVILLNNRYLGMVRQWQQFFYENRYSESYMDSLPDFVKLAESYGHVGMNIEKPADVEGALTEAFNLTDRFVFMNFITDQNENVFPMVPNGKGLSEIILAEDL

SEQ ID NO: 82426 - DNA, 1626 bp, Exiguobacterium sp. 255-15
  CDS (1)..(1626)
atgaacgcggcggaacggtttgtccagtgtctggaagcggaaggcgtaacccatatcttcggtgtgcccggtgaagagaacatcacgctgctcgaagccataagtaaatcggatatcacgttcatcacgacacgtcatgagacgaacgccgccttcatggcgtcgatgttcggtcggttaagcggacgtcccggtgtctgtctgtcgacgctcggtcccggcgcgaccaacatgatgacggggatcgcaagcgcgacaatggatcactcccctgtcgtcgccatcaccggacaaggtgcgacgtggcgccagcataaagcgtcccatcaaatgtttgatttggtcgagatgtaccggccgattaccaaatccagcacatcgattgtttccggcgaagtcatttcagaagtcgttcgtcaggctttcgcaaaggctgtttccgaaaagcccggttcgacccatctgtcgttcccggaagatattgcgaaggccgatgtcgatgccaaaatgtcctttttacaggacagtcccccgacttttctgcatccgacatccgtggctgatagtgatgtcctgttacgaatcgaacaggcagaacgtccggtcgtgattgccggattcggaatcaaccgcagcggggcgacagaggctttccgcgctttcgccgaacgattgggggctcccgtcgtcgagacgatgatgggaaaaggcgccttgtcttcgttacacgagctggccgcccatacgatcggcttgccgaacgctgattacaatcaacggattcttgatcaaagcgatttaattatcgcggtcggctacgatatcacggaactgccaccttcgaaatggaatccggaacggacacctgttttgcacattgataccaatccgcatgaaattgatcaattttatccggttgttgcaaatttgatcggctcgatcccggatattctgcacctgctttcggaaagcattccgaatcgtgcctggaccggctggcaacaggaccgcgaccgcttgcggcaagaaatccaggcgacgtattccctcgctctcccgctccatcctcaaagcatcgtacgtgaactcgagcaggcaaccggcgaggacggcatgattttttccgatgtcggagcgcataaaatatggctcggacgacattttcagacgacccgtcccaatcaattgttcatctctaacgggttttcttcgatgggctacggcttgtcgagtgcgattgccgctaaactgttgcatccggaacaacgtgtcctctgcgcttcaggagacggtgcctttttaatgaacggccaggatctcgagacggctgtccggctcaagttgccgatcgtcgtcatcatttggcgcgacggtacctacgggttgattgaatggaaacaacagcaagcttacggtcgtgcaccttatatcgaattcgacaatccggatctcgttcaactggctaccgcctttggtgcactgggtctgcgtgtcggggaacacggtactctatccagttgtctcgaacaggcttttctgagtgacggacccgttttaattgactgtccggtcgattacagggaaaatctgaagttaagtgaccgtctacggacttatggaggctga

SEQ ID NO: 82427 - protein, 541 aa, Exiguobacterium sp. 255-15
MNAAERFVQCLEAEGVTHIFGVPGEENITLLEAISKSDITFITTRHETNAAFMASMFGRLSGRPGVCLSTLGPGATNMMTGIASATMDHSPVVAITGQGATWRQHKASHQMFDLVEMYRPITKSSTSIVSGEVISEVVRQAFAKAVSEKPGSTHLSFPEDIAKADVDAKMSFLQDSPPTFLHPTSVADSDVLLRIEQAERPVVIAGFGINRSGATEAFRAFAERLGAPVVETMMGKGALSSLHELAAHTIGLPNADYNQRILDQSDLIIAVGYDITELPPSKWNPERTPVLHIDTNPHEIDQFYPVVANLIGSIPDILHLLSESIPNRAWTGWQQDRDRLRQEIQATYSLALPLHPQSIVRELEQATGEDGMIFSDVGAHKIWLGRHFQTTRPNQLFISNGFSSMGYGLSSAIAAKLLHPEQRVLCASGDGAFLMNGQDLETAVRLKLPIVVIIWRDGTYGLIEWKQQQAYGRAPYIEFDNPDLVQLATAFGALGLRVGEHGTLSSCLEQAFLSDGPVLIDCPVDYRENLKLSDRLRTYGG

SEQ ID NO: 82428 - DNA, 1752 bp, Rubrobacter xylanophilus DSM 9941
  CDS (1)..(1752)
atggcccggatgggcgtgatggacgcggtggtgaaggtgctcgaggacgagggcgtcgaggtggccttcggggtcccgggggcggcgatcctgccgctgtacaaggccctcagcaagtcccgccggataaggcactactccgtgcggcacgaggagggcggcacgcacgcggccgacgggtacgcgcgggtcacgggcagggtcggggtcaacatcgggaccagcggccccgccggcactaacatgatcacgggcctctacaccgcgatggccgactccatcccgatggtctgcatcaccgggcaggcccccacgggcgtgctgcacaaggaggccttccaggcggtggacatcgtggagatcgcccgcccggtgaccaagtgggccgtgcaggtcaaagagcccgcccagctcgtctggaccttccgggaggcgttccggatcgcgcgggagggacgcccgggcccggtgctcgtggacctgccgctcgacgttcagaggtcccccctcgaggtggacttcgacccccgccgcgacggcccgctccccttcgagaggccggcgcccggctccggggccatccgcgaggcgctcgccatgatcctcgccgccgagcgccccatcctcatgcccggcggcggggtcatcctcgccggcgcctcggaggagctcgtcgagctcgccgagtacctgcaggtccccgtgagccccacctacatggggaagggcgctatcccggaggaccaccccctctacatggggaccgtcggcatccagaccagccagcgctacgccaacgccctcttcctggagagcgacctggtcgtcgggatcggcaaccgctgggccgagcgccacaccggagacctcgacgtctaccgggggaacaggaagttcgtgcacatagacatagacccccgccagatcgggcgcgtcttcccgccggacctcggcatcgtctccgacgcgaagctcgccctccgggccctcctcgaggcggcctgggccaccaccccgccgcgcgagcccggaccctgggtgcggcgggtggaggagctgcgctccacgctgctgcgcagggacgacttcgacagcgcgcccgtaaagccccagcgcgtcttccgggagctgaacgagttcttcgacgaggacaccatcttcgtgaccgccatcgggctctaccagatcttctccggccagttccagaagacctacaggccccgccactacctgtgctgcgggcaggcgggcccgctgggctgggaggtcccggcctgcctcggggccaagctcggccggcccgagaagctcgtcgtcggcgtggtgggcgactactccttccagttcctcatggaggaggtcgccgtcgccgcccagtaccgcgtcccctacgtcctggtgatgatcaacaacgcctacatgggcctgatccggcagggcgagctgccctacggcatgaacttcgcggtcgacctcggctacagcggccccgagagcgagtacggcatagaccacgtgggtatcatggaggccatgggggccctgggacgccgggtgaggcggcccgaggagataagggacgccctccgctgggcggtgcgcgccagcgaggagcggcgcgtgccggcgctcgtggaggtgatggtcgagcgggagaccaacgcggcgatgggcccctccatagacaagatccgggagtacgagccggtgttggaccgcctcccggcggcccaggcggcggaagggagctag

SEQ ID NO: 82429 - protein, 583 aa, Rubrobacter xylanophilus DSM 9941
MARMGVMDAVVKVLEDEGVEVAFGVPGAAILPLYKALSKSRRIRHYSVRHEEGGTHAADGYARVTGRVGVNIGTSGPAGTNMITGLYTAMADSIPMVCITGQAPTGVLHKEAFQAVDIVEIARPVTKWAVQVKEPAQLVWTFREAFRIAREGRPGPVLVDLPLDVQRSPLEVDFDPRRDGPLPFERPAPGSGAIREALAMILAAERPILMPGGGVILAGASEELVELAEYLQVPVSPTYMGKGAIPEDHPLYMGTVGIQTSQRYANALFLESDLVVGIGNRWAERHTGDLDVYRGNRKFVHIDIDPRQIGRVFPPDLGIVSDAKLALRALLEAAWATTPPREPGPWVRRVEELRSTLLRRDDFDSAPVKPQRVFRELNEFFDEDTIFVTAIGLYQIFSGQFQKTYRPRHYLCCGQAGPLGWEVPACLGAKLGRPEKLVVGVVGDYSFQFLMEEVAVAAQYRVPYVLVMINNAYMGLIRQGELPYGMNFAVDLGYSGPESEYGIDHVGIMEAMGALGRRVRRPEEIRDALRWAVRASEERRVPALVEVMVERETNAAMGPSIDKIREYEPVLDRLPAAQAAEGS

SEQ ID NO: 82430 - DNA, 1683 bp, Burkholderia cepacia R18194
  CDS (1)..(1683)
atgaaggcactggccgatgaaaacgtcgaattcatctggggctaccccggcggctcggtactctacatctacgacgagctttacaagcaggacaagattcagcacgtgctggtgcgccatgaacaggcggccgtgcacgcagccgatgcgtatgcgcgttccaccggcaatgtcggcgtctgtctcgtgacgtcgggccccggtgtcaccaatgcggtgaccggcatcgccacggcgtacatggattcgatcccgatggtcgtgatcagcggccaggtgcccacggccgcgatcggccaggatgcattccaggagtgcgacaccgtcggcatcacgcgtccgtgcgtgaagcacaacttcctcgtgaaggacgtgcgcgacctcgcggaaaccgtcaagaaggcgttttatatcgcccgcaccggccgtccgggcccggtgctgatcgacatcccgaaggacatctcgaagacgccgtgcgaatacgagcccgtcaagagcgtgtcgctgcgttcgtacaacccggtcacgaagggccattcgggccagatccgcaaggccgtgtcgctgctgctgaccgcgaagcgtccgtacatctacacgggtggcggcatcatcctcgccgacgcgtcgcgtgaactgaaccagttcgcggacctgctcggctacccggtcaccaacacgctgatgggcctcggcggctatcgcgcgtcggacaagaaattcctcggcatgctcggcatgcacggcacctacgaagcgaacatggcgatgcagcactgcgacgtgctgatcgcgatcggtgcccgcttcgatgaccgcgtgatcggcgacccggcgcacttcgcgtcgcgtccgcgcaagatcatccacatcgacatcgacccgtcgtcgatctcgaagcgcgtgaaggtcgatatcccgatcgtcggcgacgtgaaggaagtgctgaaggaactgatcgagcaactgcagacggccgagcatggccccgacaccgaggcgctcgcgcaatggtggaaggacatcgagggctggcgctcgaaggactgcctgaaatacgaccgcgaaagcgagatcatcaagccgcaatacgtggtggagaaggcgtgggagctgacggacggcaatgcgttcgtgtgctcggacgtcggccagcaccagatgtgggcggcgcagttctaccgtttcaacaagccgcgtcgctggatcaactccggcggcctcggcacgatgggcttcggcctgccggcagcgatgggcgtcaagatggcgcacccggacgacgacgtgctgtgcatcacgggcgaaggctcgatccagatgtgcatacaggaactgtcgacctgcctgcagtacgacacgcccgtgaagatcatttcgctgaacaaccgctatctcggcatggttcgccagtggcagcagatcgaatacagcaagcgctattcgcattcgtacatggatgcgctgcctgatttcgtgaagcttgccgaagcgtacggccatgtcggcttgcggatcgaaaagacctcggatgtggagccggcgctgaaggaagcgctgcgcctgaaggatcgcaccgtgtttctcgacttccagactgatccgaccgaaaacgtctggccgatggtacaggccggcaagggcatcaccgagatgctgctcggatcggaagatctgtaa

SEQ ID NO: 82431 - protein, 560 aa, Burkholderia cepacia R18194
MKALADENVEFIWGYPGGSVLYIYDELYKQDKIQHVLVRHEQAAVHAADAYARSTGNVGVCLVTSGPGVTNAVTGIATAYMDSIPMVVISGQVPTAAIGQDAFQECDTVGITRPCVKHNFLVKDVRDLAETVKKAFYIARTGRPGPVLIDIPKDISKTPCEYEPVKSVSLRSYNPVTKGHSGQIRKAVSLLLTAKRPYIYTGGGIILADASRELNQFADLLGYPVTNTLMGLGGYRASDKKFLGMLGMHGTYEANMAMQHCDVLIAIGARFDDRVIGDPAHFASRPRKIIHIDIDPSSISKRVKVDIPIVGDVKEVLKELIEQLQTAEHGPDTEALAQWWKDIEGWRSKDCLKYDRESEIIKPQYVVEKAWELTDGNAFVCSDVGQHQMWAAQFYRFNKPRRWINSGGLGTMGFGLPAAMGVKMAHPDDDVLCITGEGSIQMCIQELSTCLQYDTPVKIISLNNRYLGMVRQWQQIEYSKRYSHSYMDALPDFVKLAEAYGHVGLRIEKTSDVEPALKEALRLKDRTVFLDFQTDPTENVWPMVQAGKGITEMLLGSEDL

SEQ ID NO: 82432 - DNA, 1704 bp, Burkholderia cepacia R18194
  CDS (1)..(1704)
atgtcgcattccaaggatctcgagcagcccgccaccaccggcgcgcgactgctcgtcgatgcgttgctcgccaatcacgtcgaacgcgtgttctgcgtgccgggcgagagtttcctcgccgtactcgatgcgctcgcggacgacaccgcccgcatccagacggtcgtctgccgccacgaggcggccgccgcgaacatggccgaggccgtcggcaagctgaccggccgccccggcatcgcattcgtcacgcgcgggcccggcgcgacccatgcgtcgatcggcgtgcacaccgcgttccaggattcgacgccgatgatcctgttcgtcggccagtgcgcgcgcgagcacctcgaccgcgaagccttccaggaaatcgactaccggcggatgttcggccagatggcgaaatgggtcgcgcagatcgacgacccgcgccgcattcccgaatacctgagccatgcgttccacgtcgcgacgtccggcaggcccggcccggtcgtgctcgcgctgccggaagacgtgctgtccgaagcatgcgcgccgcagcccgtcgtgccggccgcgaagcgcgtcgcggccgcgccgtcggccgcgcagctcgacgagttgcgcgagcggctcgcgcgcgcggaacggccgttcgcgatcgtcggcggcagcggctggacgcccgacgcgtgcgcgaacctgcgcaccttcgtcgagcgctggcagttgccggtggcctgcgcattccgctaccaggacacgatcgacaacgcgcacccgaactacgcgggcgacgtcgggctcgggatcaaccccgcgctcgggaagcgcatccgcgacgccgacctgctgctcgtgatcgggccgcgcctcggcgaagcgacgaccggcggctacacgctgctcgacatcccgaagacgcgccagacgctgatccacgtgcaccagggcgcggacgagctcggccgtgtgtatgcggccgacctgccgatcgtgtcgggcatgcccgagatcgccgcgccgctcgccgcgctcgaggcgcccgagcacccggcgtgggccggcacggctgccgacgcgcatcgtgcgtatcgcgaatggcatgcgccgctgccgatgcccggcgacgtccagctcggcgacgtgatggtgcagctgcgcgagcgcctgccgcatgacgcgatcctcaccaacggcgccggcaactatgcgatctggctgcatcgccacttcgcgtaccggcacttccgctcgcagctcgcgccgaccagcggcgcgatgggctacggcgtgccagccgcgcttgccgcgaagtcgctgtacccgtcgcgcgccgtcgtcgcgctcgcgggcgatggctgcttcatgatggccggcaacgagctcgcgaccgcgatgcagtacgggctgaacatcgtcgtgatcgtcgtcaacaacgggcatttcggcacgatccgcatgcatcaggagcgcaactacccgggacgcgtgcacggcacggggctcacgaatcccgatttcgccgcgtatgcgcgcgcgttcggcgcgcatggcgagaccgtcgagcgcaccgccgatttcgcgcccgcgctcgaacgcgcgctgacctgcgggctgcccgcgctgatcgagatccgtattccgcaggacgccagcacgccggccgcgacgctcgagcagatccgcgaacagggccgccgcgcacgcggcggatga

SEQ ID NO: 82433 - protein, 567 aa, Burkholderia cepacia R18194
MSHSKDLEQPATTGARLLVDALLANHVERVFCVPGESFLAVLDALADDTARIQTVVCRHEAAAANMAEAVGKLTGRPGIAFVTRGPGATHASIGVHTAFQDSTPMILFVGQCAREHLDREAFQEIDYRRMFGQMAKWVAQIDDPRRIPEYLSHAFHVATSGRPGPVVLALPEDVLSEACAPQPVVPAAKRVAAAPSAAQLDELRERLARAERPFAIVGGSGWTPDACANLRTFVERWQLPVACAFRYQDTIDNAHPNYAGDVGLGINPALGKRIRDADLLLVIGPRLGEATTGGYTLLDIPKTRQTLIHVHQGADELGRVYAADLPIVSGMPEIAAPLAALEAPEHPAWAGTAADAHRAYREWHAPLPMPGDVQLGDVMVQLRERLPHDAILTNGAGNYAIWLHRHFAYRHFRSQLAPTSGAMGYGVPAALAAKSLYPSRAVVALAGDGCFMMAGNELATAMQYGLNIVVIVVNNGHFGTIRMHQERNYPGRVHGTGLTNPDFAAYARAFGAHGETVERTADFAPALERALTCGLPALIEIRIPQDASTPAATLEQIREQGRRARGG

SEQ ID NO: 82434 - DNA, 1683 bp, Burkholderia cepacia R1808
  CDS (1)..(1683)
atgaaggcactggccgacgaaaaggtcgaattcatctggggttatcccggcggctcggtactctacatctacgacgagctttacaagcaggacaagattcagcacgtgctggtgcgccacgaacaggcggccgtgcacgcagccgatgcgtatgcgcgttccaccggcaacgtcggcgtctgtctcgtcacgtccggccccggcgtcaccaatgcggtgaccggcatcgcgacggcctacatggattcgatcccgatggtcgtgatcagcggccaggtgccgactgccgcgatcggtcaggacgcgttccaggagtgcgatacggtcggcatcacgcgtccgtgcgtgaagcacaacttcctcgtgaaggacgtgcgcgacctcgccgagacggtcaagaaggcgttctacatcgcccgcacaggccgtccgggccccgtgctgatcgacatcccgaaagacatctccaagacgccgtgcccgtacgagccggtcaagagcgtgtcgctgcgctcgtacaacccggtcacgaaggggcattcgggccagatccgcaaggccgtgtcgctgctgctgtccgcgaagcgtccgtatatctacacgggcggcggcatcatcctcgccgatgcgtcgcgcgagctgaaccagttcgccgatctgctcggctacccggtcacgaacacgctgatgggcctcggcggctatcgcgcgtcggacaagaaattcctcggcatgctcggcatgcacggcacgtacgaagcgaacatggcgatgcagcactgcgacgtgctgatcgcgatcggtgcgcgcttcgacgaccgcgtgatcggcgacccggcgcacttcgcgtcgcgtccgcgcaagatcatccacatcgacatcgatccgtcgtccatttccaagcgcgtgaaggtcgacattccgatcgtcggcgacgtgaaggaagtgctgaaggaactgatcgagcagctgcagacggccgagcatggccccgacaccgaagcgctcgcgcagtggtggaaggacatcgaaggctggcgcggcaagaactgcctgaagttcgaccgcgaaagcgagatcatcaagccgcagtacgtggtcgagaaggcgtgggagctgacggacggcaacgcgttcgtgtgctcggacgtcggccagcaccagatgtgggccgcgcagctctaccgtttcaacaagccgcgtcgctggatcaactccggcggcctcggcacgatgggcttcggcctgccggcagcgatgggcgtcaagatggcgcacccggacgacgacgtgctgtgcatcacgggcgaaggctcgatccagatgtgcatccaggaactgtcgacctgcctgcagtacgacacgcccgtgaagatcatttcgctgaacaaccgctatctcggcatggtccgccagtggcagcagatcgaatacagcaagcgctattcgcattcgtacatggatgcgctgcccgacttcgtgaagctcgccgaggcgtacggccatgtcggcatgcggatcgaaaagacttcggatgtggagccggcgctgaaggaggcgctgcgcctgaaggaccgcaccgtgtttctcgacttccagaccgatccgaccgaaaacgtctggccgatggtacaggccggcaagggcatcaccgagatgctgctcggctcggaagacctgtaa

SEQ ID NO: 82435 - protein, 560 aa, Burkholderia cepacia R1808
MKALADEKVEFIWGYPGGSVLYIYDELYKQDKIQHVLVRHEQAAVHAADAYARSTGNVGVCLVTSGPGVTNAVTGIATAYMDSIPMVVISGQVPTAAIGQDAFQECDTVGITRPCVKHNFLVKDVRDLAETVKKAFYIARTGRPGPVLIDIPKDISKTPCPYEPVKSVSLRSYNPVTKGHSGQIRKAVSLLLSAKRPYIYTGGGIILADASRELNQFADLLGYPVTNTLMGLGGYRASDKKFLGMLGMHGTYEANMAMQHCDVLIAIGARFDDRVIGDPAHFASRPRKIIHIDIDPSSISKRVKVDIPIVGDVKEVLKELIEQLQTAEHGPDTEALAQWWKDIEGWRGKNCLKFDRESEIIKPQYVVEKAWELTDGNAFVCSDVGQHQMWAAQLYRFNKPRRWINSGGLGTMGFGLPAAMGVKMAHPDDDVLCITGEGSIQMCIQELSTCLQYDTPVKIISLNNRYLGMVRQWQQIEYSKRYSHSYMDALPDFVKLAEAYGHVGMRIEKTSDVEPALKEALRLKDRTVFLDFQTDPTENVWPMVQAGKGITEMLLGSEDL

SEQ ID NO: 82436 - DNA, 1776 bp, Rubrivivax gelatinosus PM1
  CDS (1)..(1776)
atggacatgtctgccgcggaaatcaagcgggccgccacggcccaaccgcaccccacccaagctgccgagcccaacggttcggaaatcctcgttcgctgcctgcaggccgaaggtgtcaagtacctttggggctacccgggcggcgccgtgctgtacatctacgacgcgctgtacaagcaggagaccatagagcacgtgctcgtgcgccatgagcaggcggccatccatgcggccgacggctatgcgcgcgcgaccggcgacgtgggcgttgcgctggtgacctcggggccgggcgtgacgaatgccatcaccggcattgccaccgcctacatggactcgattccgatggtgatcatcaccgggcaggtgccgacgccagcgatcggcctcgacgccttccaggagtgcgacaccgtcggcatcacccggccgatcgtcaagcacaacttccttgtgaaggacgtgcgcgagctggcgctcaccatgaagaaggccttccacatcgcccgcaccggccgtcctggcccggtggtggtcgacgtgccgaaggacgtgtcgctgaagaccgcgcccttccagtaccctgcggcggtcgagatgcgctcgtacagcccggcgaagaagggccacagcggccagatccgcaaggccgtgcagctgctgctgcaggcgaagcggccttacatctacaccggcggcggcgtgatcctcggcaatgcctcggcgcaactgcgccagctggtcgacctgctcggctacccgtgcaccaacacgctgatgggcctgggcgccttcccgtcgaccgacccgcgcttcctgggcatgctgggcatgcacggcacctacgaagccaacatgacgatgcagaactgtgacgtcctgctggccgtgggcgcacgtttcgacgaccgggtgatcggtaacccgaagcatttcgcttcggtggagcgcaagatcgtgcacgtcgacatcgatccgtcgagcatctccaagcgcgtgaaggtcgacattccgatcgtcggcgacgtgaaggaagtgctgcaagaactgatctcgcagatcaaggaagcgcaggcgaagccggattcgcaggccctgtcggcctggtggaaacagatcgctgaatggcgcggtcgcgagtgcctgaagtacaagaattccgacgaggtcatcaagccgcagttcgtggtcgagaagctctgggagttgacccgcgaacgcgacacctacatcacctccgatgtcggccagcaccagatgtgggcggcgcagtactaccgcttcgacgagccgcggcgctggatcaactcgggtggtctgggcacgatgggggtgggcctgccgtacgccatgggcatcaagctcgcgaagccggactccgatgtcttctgcatcaccggcgaaggctcgatccagatgtgcatccaggagctgtcgacctgcctgcagtacaagacgccggtcaaggtgatctcgttgaacaaccgctatctgggcatggtgcggcagtggcaggagctcgattacggcggccgctattcgcacagctacatggaggccttgcccgatttcgtgaagctggccgaagcctacggtcacgtcggactgaagatcgagaaaccgagcgaggtggaacccgcgctgcgcgaggcgatccggctgaaggatcgcacggtctttctcgacatccgtaccgacccgaccgagaacgtctggccgatggtccaggccggaaagggcatctcggagatgctgctgggctcggaagacctgtaa

SEQ ID NO: 82437 - protein, 591 aa, Rubrivivax gelatinosus PM1
MDMSAAEIKRAATAQPHPTQAAEPNGSEILVRCLQAEGVKYLWGYPGGAVLYIYDALYKQETIEHVLVRHEQAAIHAADGYARATGDVGVALVTSGPGVTNAITGIATAYMDSIPMVIITGQVPTPAIGLDAFQECDTVGITRPIVKHNFLVKDVRELALTMKKAFHIARTGRPGPVVVDVPKDVSLKTAPFQYPAAVEMRSYSPAKKGHSGQIRKAVQLLLQAKRPYIYTGGGVILGNASAQLRQLVDLLGYPCTNTLMGLGAFPSTDPRFLGMLGMHGTYEANMTMQNCDVLLAVGARFDDRVIGNPKHFASVERKIVHVDIDPSSISKRVKVDIPIVGDVKEVLQELISQIKEAQAKPDSQALSAWWKQIAEWRGRECLKYKNSDEVIKPQFVVEKLWELTRERDTYITSDVGQHQMWAAQYYRFDEPRRWINSGGLGTMGVGLPYAMGIKLAKPDSDVFCITGEGSIQMCIQELSTCLQYKTPVKVISLNNRYLGMVRQWQELDYGGRYSHSYMEALPDFVKLAEAYGHVGLKIEKPSEVEPALREAIRLKDRTVFLDIRTDPTENVWPMVQAGKGISEMLLGSEDL

SEQ ID NO: 82438 - DNA, 1701 bp, Pseudomonas fluorescens PfO-1
  CDS (1)..(1701)
atgctcgtccgctttttgcgtgacgaaggcgtcaaatatatctacgggtacccgggtggtgctctccttcatgtttacgatgccctgttcaaagagccggaagtgactcacatcctggttcgccacgaacaagcggctacccatatggctgacggctacgcccgtgccaccggtaaagccggcgtggtattggtgacttccggtccaggcgccacaaacgccatcaccggtatcgccaccgcctatatggactcgattccaatggtgatcatttccggtcaggtgccaagcaccatggtcggcaccgatgcgttccaggaaaccgacatgatcggtatctcacggccgatcgtgaagcacagcttcatgatcaagcacgcttcggaaatcccggaagtcatgaagaaagccttctacctggcgcaatccggtcgtccgggcccggtcgtggtcgatatcccgaaagacatgaccaacccggccgagaagttcgaatacatcttcccgaagaaagccaaactgcgttcctacagcccggccgttcgcggtcactccgggcaaatccgcaaagcggcagaaatgctcctggcggccaagcgtcccgtgctgtactccggcggtggcgtgatcctcggcaacggctccgcgccgctgaccgaactggcaaaaatgctcaacctgccggttaccaataccttgatgggcctgggtgcctatcctggcactgatcgtcagttcatcggcatgctcggcatgcacggcagctataccgccaacctggcgatgcaccatgccgacgtgatcctggcggtcggtgcgcgttttgacgatcgcgtgatcaacggcgcgccgaagttttgcccgaacgccaagatcatccatatcgacatcgacccggcttcgatttccaagaccatcaaggccgacgtgccaatcgttgggccggtggagagcgtcctgaccgaaatggtcgcgatcctcaaggaaatcggcgaaaccccgaacaaggaagccgttgccagctggtggaagcaggttgatgaatggcgcggtgatcgtggcctgttcccttacgacaagggcgacggcagcaagatcaagccacagaccgtgatcgagaccctgtgcgaagtgaccaagggcgatgcctttgtgacctcggacgtgggccagcaccagatgtttgctgcgcagtactacaagttcaacaagcctaaccgctggatcaactccggtggcctgggcacgatgggctttggtctgccggccgcgatgggtatcgctttgagcttccctgacaccgatgttgcgtgcgtcaccggtgaaggcagtatccagatgaacatccaggaactgtcgacctgcctgcaatatggtttgccggtcaagatcgtcatcctgaacaacggtgttctgggcatggttcgtcagtggcaggacatgagttacggcagccgtcactcgcactcctacatggaatcattgcctgacttcgtcaagctggctgaagcctatggccacgtcggcgtgcgcatcaccgaatcgaaagatttgaagtcgaagatggaagaggcgttcgccatgaaagatcgcctggtggtgatcgacatttcggtcgacaccagcgagcacgtctatccgatgcagatcaaagacggctccatgcgcgatatgtggctgagcaagacggagcgtacctaa

SEQ ID NO: 82439 - protein, 566 aa, Pseudomonas fluorescens PfO-1
MLVRFLRDEGVKYIYGYPGGALLHVYDALFKEPEVTHILVRHEQAATHMADGYARATGKAGVVLVTSGPGATNAITGIATAYMDSIPMVIISGQVPSTMVGTDAFQETDMIGISRPIVKHSFMIKHASEIPEVMKKAFYLAQSGRPGPVVVDIPKDMTNPAEKFEYIFPKKAKLRSYSPAVRGHSGQIRKAAEMLLAAKRPVLYSGGGVILGNGSAPLTELAKMLNLPVTNTLMGLGAYPGTDRQFIGMLGMHGSYTANLAMHHADVILAVGARFDDRVINGAPKFCPNAKIIHIDIDPASISKTIKADVPIVGPVESVLTEMVAILKEIGETPNKEAVASWWKQVDEWRGDRGLFPYDKGDGSKIKPQTVIETLCEVTKGDAFVTSDVGQHQMFAAQYYKFNKPNRWINSGGLGTMGFGLPAAMGIALSFPDTDVACVTGEGSIQMNIQELSTCLQYGLPVKIVILNNGVLGMVRQWQDMSYGSRHSHSYMESLPDFVKLAEAYGHVGVRITESKDLKSKMEEAFAMKDRLVVIDISVDTSEHVYPMQIKDGSMRDMWLSKTERT

SEQ ID NO: 82440 - DNA, 1701 bp, Rhodospirillum rubrum
  CDS (1)..(1701)
atggaggtaatcttcggctatccgggcggcgccgtccttccgctctatgacgagatcttcaagcaaaatcagatccgtcacgtgctggtccgtcacgaacaggccgccgtccacgccgccgaaggctatgcccgctcgaccggcaagaccggcgtggtcctggtgaccagcggcccgggcgccaccaatgcggtgaccggcctgaccgacgccatgctcgattccattcccgtggtctgcctgaccggtcaggtgccgacccatctgatcggcaacgatgcctttcaggaggccgacaccaccggcatcacccgccagtgcaccaagcacaattatctggtgaaaaagggcgaggatctggcccgggtgatccacgaggccttccaggtcgccggcagcggccggcccggcccggtggtcatcgatctgcccaaggatatcctgatgggaccggcgccctatgtcgccccgtcgcgggtcaagcacaaaagctaccgtccccagctcaagggcgatatcaccgccattgaaaaggcggtcgagatcatcgccaaggccaagcggccgattttctattgcggcggcggcgtcgtcaattccgggccccaggccagccagttgctgacccagttcgtgaagatgaccggctatccgattaccctgaccctgatggggctgggcatctatccggccagcgatccgcaatatctgggcatgctgggcatgcatggcaccttcgaggccaatcacgccatgcatgactgcgacgtgatggtggcgatcggggcgcggttcgacgaccgggtgaccggccggcttgacgccttctcgcccaattcgaccaagatccagatcgacatcgatcccagttcgatcaacaagaacgtggcggtcgatctggggatcgtcggcgatgtcggtcatgtccttgaagacatgatcaaggtgtggaaggcccggcagtatcaccccgatgtcgccgccctgaaaaactggtgggggcggatcgccgattggcagcgccgcgactgcctgcactatcagccctccgacgaggttaccaagccccaatacgccatcgagcgcctctacgccctgacccgcgaccgcgagaccttcatcaccaccgaggtcggccagcatcagatgtgggcggcccagtacttcaaattcgacaagcccaatcagtggatgacctcgggcgggctcggcaccatgggctatggtttcccggcggcgatcggcgttcagatggcccatcccggcgccctggtcgtcgatatctcgggcgaggcgtcgttcatgatgaacatgcaggaactggccacggccgtgcagtatcgcctgccggtcaaggtgttcatcctcaataaccggtacatgggcatggttcgccagtggcaggaactgctccatggcgggcgttattcggaaagctattccgaatgcctgcccgatttcgtcaagctggccgaggccttcggcgccgtcggcttgcggtcggaaaagcccgccgatcttgatgacgtgatcgccgagatgatcgccgtcgatcggccggtgctggtcgatgtggcggtcgatccttcggaaaacgtctttccgatgatcccctcgggcgcgccccacaaccagatgctgctcggccccgaagacagcctgggtcagccgatttccaaggagggggcgatcctcgtctag

SEQ ID NO: 82441 - protein, 566 aa, Rhodospirillum rubrum
MEVIFGYPGGAVLPLYDEIFKQNQIRHVLVRHEQAAVHAAEGYARSTGKTGVVLVTSGPGATNAVTGLTDAMLDSIPVVCLTGQVPTHLIGNDAFQEADTTGITRQCTKHNYLVKKGEDLARVIHEAFQVAGSGRPGPVVIDLPKDILMGPAPYVAPSRVKHKSYRPQLKGDITAIEKAVEIIAKAKRPIFYCGGGVVNSGPQASQLLTQFVKMTGYPITLTLMGLGIYPASDPQYLGMLGMHGTFEANHAMHDCDVMVAIGARFDDRVTGRLDAFSPNSTKIQIDIDPSSINKNVAVDLGIVGDVGHVLEDMIKVWKARQYHPDVAALKNWWGRIADWQRRDCLHYQPSDEVTKPQYAIERLYALTRDRETFITTEVGQHQMWAAQYFKFDKPNQWMTSGGLGTMGYGFPAAIGVQMAHPGALVVDISGEASFMMNMQELATAVQYRLPVKVFILNNRYMGMVRQWQELLHGGRYSESYSECLPDFVKLAEAFGAVGLRSEKPADLDDVIAEMIAVDRPVLVDVAVDPSENVFPMIPSGAPHNQMLLGPEDSLGQPISKEGAILV

SEQ ID NO: 82442 - DNA, 1791 bp, Ralstonia metallidurans CH34
  CDS (1)..(1791)
atgccgaagatgagagcagtcgacgcggccatcgccgtactggaaaaggaaggcatcaccaccgcgttcggcgtgccgggcgccgccatcaacccgttctactcggccatgcgccgcgctggctcgatccgccacctgctggcgcgccacgtggaaggcgcctcgcacatggccgagggctacacccgtgccgagccgggcaacattggcctctgcatcggcacgtcgggccccgccggcacggacatgatcacgggcctttactcggcctgggcggattcgatccccattctctgcatcaccggccaggccccgcgcgcccgtctgtacaaggaagatttccaggccgtcgatatcgagtcgatcgccaagccggtgaccaagtgggccgtgaccgtgcgcgagccggcgctggtgccgcaggtgttccagcaggcgttccacctgatgcgttcgggccgcccgggtccggtgctgatcgacctgccgttcgacgtgcaggtggccgagatcgaattcgatcccgaaacgtaccaaccgctgcaaccgtacaagccggccgcctcgcgcgcccagatcgagaaggccatctcgatgctgaaccaggccgagcgtccgctgatcgtctgcggcggcggcgtgatcaacgctaacgcgtcggaactgctggtcgagttcgccgagctggtcaatgtgcccgtggtgcccacgctgatgggctggggcgtgctggccgacgaccacccgctgcaagccggcatggtgggcctgcagacctcgcaccgttacggcaacgccacgctgctcgcctcggatttcgtgatgggcatcggcaaccgctgggccaaccgccacaccggcagcgtcgacgtctacaccaagggccgcaagttcgtgcacgtcgacatcgagcccacgcagatcggccgcgtgttcggtcctgacctcggcatcgtctcggatgccaaggccgcgctggagcagttcgtcgaagtggctcgcgaaatgaagatggccggccgcctgccgtgccgcaaggcgtgggtggccgacgtgcagaagcgccgccgcacgatgaagcgcaagagcgacttcgacaacgtgccggtcaagccgcagcgcgtgtaccgcgagatgaaccagtacttcccgcgcgacgtgcgctacgtgacgacgatcggcctgtcgcagatcgccgccgcgcagttcctgtccgtgaaccagccgcgccactggatcaactgcggccaggcaggcccgctgggctggacgattcccgccgccatcggcgtgaagaccgcctcgccgaactcggacatcgtggccatctcgggtgactacgacttccagttcatgatcgaggaactggccgtggccgcgcagttcaaggtgccgtacatccacgtggtggtgaacaactcgtacctgggcctgatccgtcaggcgcagcgcaacttcgagatggactactgcgtgcagctcgcgttcgacaacatcaacgcgcccgagctggaaggctatggcgtggaccacgtgaaggttgtggaaggtctcggctgcaaggcaatccgcgtgttcaagcccgaagacatcgcaccggcctttgccgaagcgcgcgacctgatggccgagttctcggtaccggtagtggtcgaggtgatcctcgagcgcgtcaccaacatcgcgatgggtaccgagatcgacaacatcaacgagttcgagccgatcgaggacctcgagggtgccgtggacgccgattcggcgatcctggtcgaagagaccacggcctga

SEQ ID NO: 82443 - protein, 596 aa, Ralstonia metallidurans CH34
MPKMRAVDAAIAVLEKEGITTAFGVPGAAINPFYSAMRRAGSIRHLLARHVEGASHMAEGYTRAEPGNIGLCIGTSGPAGTDMITGLYSAWADSIPILCITGQAPRARLYKEDFQAVDIESIAKPVTKWAVTVREPALVPQVFQQAFHLMRSGRPGPVLIDLPFDVQVAEIEFDPETYQPLQPYKPAASRAQIEKAISMLNQAERPLIVCGGGVINANASELLVEFAELVNVPVVPTLMGWGVLADDHPLQAGMVGLQTSHRYGNATLLASDFVMGIGNRWANRHTGSVDVYTKGRKFVHVDIEPTQIGRVFGPDLGIVSDAKAALEQFVEVAREMKMAGRLPCRKAWVADVQKRRRTMKRKSDFDNVPVKPQRVYREMNQYFPRDVRYVTTIGLSQIAAAQFLSVNQPRHWINCGQAGPLGWTIPAAIGVKTASPNSDIVAISGDYDFQFMIEELAVAAQFKVPYIHVVVNNSYLGLIRQAQRNFEMDYCVQLAFDNINAPELEGYGVDHVKVVEGLGCKAIRVFKPEDIAPAFAEARDLMAEFSVPVVVEVILERVTNIAMGTEIDNINEFEPIEDLEGAVDADSAILVEETTA

SEQ ID NO: 82444 - DNA, 1758 bp, Burkholderia fungorum LB400
  CDS (1)..(1758)
atgcccagcgcggaattctccacgtcggatacgacccctcatcccgaagctgactctatcggcgccaccgtgctcatgaaggcactggccgacgaagacgtcgagtttgtctggggctatcccggcggctcggtactctacatttacgacgagctgtacaagcaggacaaattccagcacatcctcgtgcgccacgagcaggccgcagtccacgccgccgacgcctacgcgcgttccaccggcaaggtcggtgtgtgcctcgtgacctccggccccggcgtcaccaatgcggtgaccggcatcgccactgcctacatggattcgattccgatggtggtgatcagcggccaggtgccgactgccgcgatcggccaggatgcgttccaggagtgcgacacggtcggtatcacgcgtccttgcgtgaagcacaacttcctcgtgaaggacgtgcgcgacctcgccgccaccgtcaagaaagccttttacattgcccgtaccggccgtcccggccccgtgctgatcgacattccgaaagacgtgtcgaaggcgccttgccagtacgagccgctcaaaagcgtgtcgctgcgctcgtacaacccggtcacgaagggccactccggccagatccgcaaagcggtcgcgctgctgttgtcggcgaagcgtccttatatctataccggcggcggcatcattctcgcggacgcatcgcgtgaactgaaccagttcgccgatctgcttggttatcccgtcaccaacacgttgatgggtctgggcggctaccgcgcgagtgacaaaaaattcctcggcatgctcggcatgcacggcacgtacgaagccaatatggcgatgcagcactgcgacgtgctgatcgcgatcggcgcgcgtttcgacgaccgtgtgatcggcgacccggcgcacttcgcgtcgcgtccgcgcaagatcatccatatcgacatcgacccgtcctccatctccaagcgcgtcaaggtcgacattccgatcgtcggcgacgtgaaggaagtgctgaaggagctgatcgagcagctgcaaacggccgagcacggcccggacaccgcggcgctcgccgactggtggaaggacatcgaggcgtggcgcgcgaaagactgcctcaagttcgaccgcaagagcgacatcatcaagccgcagtacgtggtggaaaaggcgtgggaactgaccgacggcaatgccttcgtgtgttccgacgtcggccagcatcagatgtgggcggcgcagttctatcgcttcaacaagccgcgccgctggatcaactctggtggtctcggcacgatgggcttcggcctgccggcggcgatgggcgtgaagatggcgcacccggacgacgacgtgctctgtatcacgggcgaaggctcgatccagatgtgcatccaggagctctccacctgcaagcagtacgagactccggtgaagatcatttcgctgaacaaccgctatctgggcatggtgcgccagtggcagcagatcgaatacagcaagcgctattcgcattcgtacatggatgcgctgccggatttcgtgaagctcgccgaagcgtacggccacgtgggcatgcgtatcgaacgcacggcggatgtggagccggcgttgaaggaagcgctgcgcctgaaagatcgcacggtgtttctcgatttccagaccgatccgaccgaaaacgtctggccgatggttcaggccggcaagggcatcaccgagatgctcatgggttcggaagatctataa

SEQ ID NO: 82445 - protein, 585 aa, Burkholderia fungorum LB400
MPSAEFSTSDTTPHPEADSIGATVLMKALADEDVEFVWGYPGGSVLYIYDELYKQDKFQHILVRHEQAAVHAADAYARSTGKVGVCLVTSGPGVTNAVTGIATAYMDSIPMVVISGQVPTAAIGQDAFQECDTVGITRPCVKHNFLVKDVRDLAATVKKAFYIARTGRPGPVLIDIPKDVSKAPCQYEPLKSVSLRSYNPVTKGHSGQIRKAVALLLSAKRPYIYTGGGIILADASRELNQFADLLGYPVTNTLMGLGGYRASDKKFLGMLGMHGTYEANMAMQHCDVLIAIGARFDDRVIGDPAHFASRPRKIIHIDIDPSSISKRVKVDIPIVGDVKEVLKELIEQLQTAEHGPDTAALADWWKDIEAWRAKDCLKFDRKSDIIKPQYVVEKAWELTDGNAFVCSDVGQHQMWAAQFYRFNKPRRWINSGGLGTMGFGLPAAMGVKMAHPDDDVLCITGEGSIQMCIQELSTCKQYETPVKIISLNNRYLGMVRQWQQIEYSKRYSHSYMDALPDFVKLAEAYGHVGMRIERTADVEPALKEALRLKDRTVFLDFQTDPTENVWPMVQAGKGITEMLMGSEDL

SEQ ID NO: 82446 - DNA, 1770 bp, Thermobifida fusca
  CDS (1)..(1770)
atgaccgagcagatgaccggagcccaatcgctcatcagggcgctggagcatgtcggcgtcgatgtcgtgttcggaatccctgggggggcgatcctccccgcctacgacccgctgtacgactccaccaaggtgcgccacatcctcatgcgccacgagcagggggccgggcacgcagccgaaggatatgcctacgccacgggacgaccaggggtgtgtatcgccaccagtggccccggcgcgaccaacctggtgaccccgcttgcagacgcctacatggactcggtccccgtggtcgcgatcaccgggcaggtggccagcccggcgatcggcaccgacgcgttccaggaagccgacatctgcggcatcaccatgccgatcaccaagcacaacttcctggtccgggacccctccaagatcgccagcaccatcgccgaggccttccacatcgcctccaccggccgtcctggcccggtcctcgtggacatcgccaaggacgcgctgcaagcacagacccgcttcgaatggccgcaacggcccgaactgcccggctaccgccccgtcaccaaaccgcacggtaagcaggtgcgggaggcggcacggctgatcgccgaagccaaacgccccgtgctctacgtcggcggcggagtgttcaaatcgggtgcgtccaaagaactgcgtgtactggctgaactgacagggattccggtcgtcaccaccctcatggcactgggcaccttccccagcagccatccccagaacctcggcatgccgggaatgcacggcaccgtcgccgcggtcggcgccctgcagcgcgccgacctgatcgtggcgctgggcgcccggttcgatgaccgggtcaccggcaagctcagctcgttcgccccccacgccaccatcgtgcacgccgacatcgacccggccgagatctccaagaaccggtacgccgacgtgccgatcgtgggcgactgccgggaggtcatcgcggatctgatcgtggcggtccgtgccgaccaagccgccggacgccagggcgactacaccgcgtggtgggagcagctcaaccgaatgcgcgagacctacccgctgggctacaccgagccggaggacggttcgctcgccccccagtacgtgatcaagcgcatcggccagatcgtcggccccgacgccacctacgtcgccggagtgggccagcaccagatgtgggctgcccagttcatcgaccaccagcgtcccggctccttcgtcaactcgggcggcgccggaacgatgggcttcgccatccccgcggccctcggcgccaaggtcggcgaccccgatcgggtcatctgggcgatcgacggcgacggctgcttccagatgaccaaccaggagctggccacctgcgcgatcgaaggcatcccgatcaaggttgcggtgatcaacaacggcaacctcggtatggtccgccagtggcagaccctgttctacgacggccgctactccaacaccaacctgcacaccgcgcccacccccgaagacgggaaggtgcgcattccggacttcgtccgcctcgcagaggcgtacggttgtgtcgggctgcgttgcgaccgcgcagaagacgtggacgccaccatcgagaaagccatggccatcaacgacgtgcccgtggtgatcgatttcacggtccaccacgacgcaatggtctggccgatggtcccggctggagtcagcaacgacgacatccagtacgcgcgcgacatggcgcctgaatgggacgacgaggaagaatag

SEQ ID NO: 82447 - protein, 589 aa, Thermobifida fusca
MTEQMTGAQSLIRALEHVGVDVVFGIPGGAILPAYDPLYDSTKVRHILMRHEQGAGHAAEGYAYATGRPGVCIATSGPGATNLVTPLADAYMDSVPVVAITGQVASPAIGTDAFQEADICGITMPITKHNFLVRDPSKIASTIAEAFHIASTGRPGPVLVDIAKDALQAQTRFEWPQRPELPGYRPVTKPHGKQVREAARLIAEAKRPVLYVGGGVFKSGASKELRVLAELTGIPVVTTLMALGTFPSSHPQNLGMPGMHGTVAAVGALQRADLIVALGARFDDRVTGKLSSFAPHATIVHADIDPAEISKNRYADVPIVGDCREVIADLIVAVRADQAAGRQGDYTAWWEQLNRMRETYPLGYTEPEDGSLAPQYVIKRIGQIVGPDATYVAGVGQHQMWAAQFIDHQRPGSFVNSGGAGTMGFAIPAALGAKVGDPDRVIWAIDGDGCFQMTNQELATCAIEGIPIKVAVINNGNLGMVRQWQTLFYDGRYSNTNLHTAPTPEDGKVRIPDFVRLAEAYGCVGLRCDRAEDVDATIEKAMAINDVPVVIDFTVHHDAMVWPMVPAGVSNDDIQYARDMAPEWDDEEE

SEQ ID NO: 82448 - DNA, 1767 bp, Methanosarcina barkeri str. fusaro
  CDS (1)..(1767)
atgacaaccgggtcaacagaaaaagttaatggcgcaagggctctgattaagtgcctggaagaagaaggtgttgacaccatcttcggatatccaggagggcaaatcatccccttctataacgaaatttatgattcgaatctgcgccatatacttgtgcgtcacgaacaggcagcagctcatgctgcggacgggtacgcccgtgcaactggaaagaccggggtctgtgtttctacctcaggtcccggagcaaccaacctggtaacaggaattgctactgcatatatggactcagtacctattgtagccttaacaggacaggtaccgaccttcctgataggtaacgatgctttccaggaagccgacattaagggaattacccagcccattaccaagcacaactacctcgtacaggatgcaaacgaactcccgagaatcgtaaaagaagccttccatatcgcttctaccggaaggcctggcccggtattaattgaccttccaaaggatgtacagaacgcggagatcgacttttactatcctgacaaagtagagcttagaggatataagccaacttacaaaggcaacacccagcagatcaaacgagccgccgaggaaattgcaaattcctgcatgcctattatatacgcaggtggcggtgtgataagttctaatgccagcgctgagcttgtagagctggctgagacaattaatgctccggttacgactactctcctgggaattggtgcaattccgactgaacacccactgcatgttgggatgcttggaatgcacgggaccaagtctgcaaactacgctatccaggaatctgatcttattattgccgtgggcgcaaggttcgatgaccgtgtgaccggaaagctcgagtcctttgcccccaatgcaagggttatccacatcgatgtcgaccctgctgagatctcaaagaacgtaaatgtccagatcccaatcgtcggagacgcaaaacaggtacttaagtccctgaataaatatatcaagtgctgcaaatccgaagcatggcttgaaaagataaaacagtggaagaaggaatatccacttacctataaacagatgtcatctgatgtcataatgcctcagtttgtcatcgagcaaatatctgaggcttgcaaggacgcaattatagttactgaggtcgggcagcatcagatgtgggctgctcagttcttcaagtataaaaaaccccgcactttcattacatcaggcggtcttggcacaatgggctacggtttccctgcagccataggagcaaaagttggcaagccggataaaacggttattaacattgcaggtgatggctctttccagatgaactctcaggagcttgcaactgtagtccagaacgacattccggttgtttctgtgatcattaataatggttatctgggtatggtcagacagtggcaggaactgttctatgacaaacggtattcccagacatttattaagggcagtgttgacttcgtcaaacttgctgaggcctatggggctcttggactgcgtgcggaaaggccgtctgaagtaaggcctgcaattgaagaagctgtcaattcaggtaggcctgctgttgtcgaagtgattgttgaatgcgaggcaaatgtttatcctatggtgccggcaggagctgcaatcaacgaaatccttgatattgaagagcatgcagacactccctgcgctatgcccaatctgcgtacggcaaaaactgatagagttctcgacctggaggaacagtaa

SEQ ID NO: 82449 - protein, 588 aa, Methanosarcina barkeri str. fusaro
MTTGSTEKVNGARALIKCLEEEGVDTIFGYPGGQIIPFYNEIYDSNLRHILVRHEQAAAHAADGYARATGKTGVCVSTSGPGATNLVTGIATAYMDSVPIVALTGQVPTFLIGNDAFQEADIKGITQPITKHNYLVQDANELPRIVKEAFHIASTGRPGPVLIDLPKDVQNAEIDFYYPDKVELRGYKPTYKGNTQQIKRAAEEIANSCMPIIYAGGGVISSNASAELVELAETINAPVTTTLLGIGAIPTEHPLHVGMLGMHGTKSANYAIQESDLIIAVGARFDDRVTGKLESFAPNARVIHIDVDPAEISKNVNVQIPIVGDAKQVLKSLNKYIKCCKSEAWLEKIKQWKKEYPLTYKQMSSDVIMPQFVIEQISEACKDAIIVTEVGQHQMWAAQFFKYKKPRTFITSGGLGTMGYGFPAAIGAKVGKPDKTVINIAGDGSFQMNSQELATVVQNDIPVVSVIINNGYLGMVRQWQELFYDKRYSQTFIKGSVDFVKLAEAYGALGLRAERPSEVRPAIEEAVNSGRPAVVEVIVECEANVYPMVPAGAAINEILDIEEHADTPCAMPNLRTAKTDRVLDLEEQ

SEQ ID NO: 82450 - DNA, 1617 bp, Geobacter metallireducens GS-15
  CDS (1)..(1617)
atgatcaatctctacgacgagcttttcagcttcaaggatatccgccatattctgccccgccacgaacaggcaggtgtccatgcggctgatggatttgcccgtgccaccggcagggtcggtgtcgccatcgccacctccggccccggtgccaccaatacggttaccggtatcgcgaccgcctacatggactccatcccccttgtggtgataaccggccaggtgcccacggccctcattggcaatgatgccttccaggaggtggacatcatcggcattacccgcccctgcaccaagcacaactttctcgtgaaagacgtgaaggatatcgccacgatcatcaagaaagccttttacattgcccgcaccgggcgtcccgggccggttctcgtggacctgccgaaggatgtgcagatcgccacggccgagtttgagtatcccgaagccattgagcttcgcagctacaaaccgaccgtggagggtcacccgaagcagatcgagaaggccgtgtccatgctcctggcggctaagaagccggtcatgtacgtgggagggggcgccatttccggtgatgccgccggtgaactcactgccctagccaccagactccacatcccggtcaccacaaccctcatgggactcggttccttccccgaggacaatcccctctctctcaagcttctcgggatgcatggcacctatttcgccaatatggcggtgaccaactgcgacctgctggttgccgtgggggcgcgcttcgacgaccgggtgaccggaaagatcgccaccttcgctccccatgcaaagatcatccatatggacgtggacccgacatccattcggaagaacgtccgggttgaccttccgattgttggtcaggtcaaggaagtccttggtcgcatgctcaagtcccttgatgagagcggtgacaaggtagccgcgttccatacggcgatcgaaccgtggcttgcggaaatcgaggggtggaagcagaagcatccaataacctacaagcaggcatccacggtgatcaaaccccagttcgtgatccagaaacttcgtgagctttctgatcccgacgccattgtggccaccgacgtggggcagcaccagatgtggactgcccagttcttcgggttccgtgagccccgtacgctcctgtcgtccggcgggctcggaaccatgggattcggattgccagcggccatgggggcccaggcagccttcccgaaccggcaggtcatcgcggtttgcggcgacggcggtttccagatgaacctccaggaggtggcaacgctggtccagaatcggcttcccgtgaagatcgtcatactcaacaataacttcctcggcatggtgcgccagtggcaggaactcttcttcgataagcgctattcacagacctgcatggagcttcccattgatttcatcaagcttgccgaggcgttcggggctaaggggttccaggcgacaaaatccgacgaggtggaagctaccatcaagaaggccttcgagacgccaggaccggttatcatggaattcaagatcgcccgggaggagaaggttctccccatggttcctgccggggcgtcgctcaatgaaatggtgctcaatgcctga

SEQ ID NO: 82451 - protein, 538 aa, Geobacter metallireducens GS-15
MINLYDELFSFKDIRHILPRHEQAGVHAADGFARATGRVGVAIATSGPGATNTVTGIATAYMDSIPLVVITGQVPTALIGNDAFQEVDIIGITRPCTKHNFLVKDVKDIATIIKKAFYIARTGRPGPVLVDLPKDVQIATAEFEYPEAIELRSYKPTVEGHPKQIEKAVSMLLAAKKPVMYVGGGAISGDAAGELTALATRLHIPVTTTLMGLGSFPEDNPLSLKLLGMHGTYFANMAVTNCDLLVAVGARFDDRVTGKIATFAPHAKIIHMDVDPTSIRKNVRVDLPIVGQVKEVLGRMLKSLDESGDKVAAFHTAIEPWLAEIEGWKQKHPITYKQASTVIKPQFVIQKLRELSDPDAIVATDVGQHQMWTAQFFGFREPRTLLSSGGLGTMGFGLPAAMGAQAAFPNRQVIAVCGDGGFQMNLQEVATLVQNRLPVKIVILNNNFLGMVRQWQELFFDKRYSQTCMELPIDFIKLAEAFGAKGFQATKSDEVEATIKKAFETPGPVIMEFKIAREEKVLPMVPAGASLNEMVLNA

SEQ ID NO: 82452 - DNA, 1749 bp, Novosphingobium aromaticivorans DSM 12444
  CDS (1)..(1749)
atgacaaccgagcgcagcggcgccgagatcctggtcgaaagcctcgtcgcaaagggggtcgagttcgtgttcggctatccgggcggcgcggtgctcccgatctacgatgcgctgttcggcgatgaacgcctccgccacatcctagtccgccacgaagccggcgctgcccacgccgccgaaggctacgcgcgcgccaccggcaagcccggcgtcgtgctcgtcacctcgggcccgggcgcgaccaacgccgtcaccggcattgccgatgcgttcatggattcgattccgatggtcgtcatcaccggccaggtccccacggccctgatcggttcggatgcgttccaggaagccgacacgatcggcatcacgcgccactgcacgaagcacaactacctcgtgaaggacccgtcgcagctggcggcgaccatcgacgaagcgttccgcatcgccaccgagggccgccccggcccggtcgtgatcgacatccccaaggatgtgcagatcgcgacggccgcgtggagcagcgccgccccgcagcagcgcaaccgctatgctccccagaccgagggcggcgcgaaggagattgccgaagcgatcgaactgatcgccaaggccaaggcgccggtcttctacacgggcggcggcgtgatcaatgccggcccggaagcggcccgcctgctgcgcgaactccagtcgctgaccggcgcgcccgtgacctccacgctgatgggccttggcgcgtttccggcggaccacccggcatggctcggcatgctcggcatgcacggcacctacgaagccaacatgacgatgaaccgcgccgacctcgtcgtctgcatcggcgcccgcttcgacgaccgcgtcaccggccggctcgatgccttctcgcccaacagcaagaagatccacatcgacatcgaccgggcctcgatcaacaagaccgtccaggtcgaccttccggtcatcggcgattgcggcaaggtccttgcccagctcatcgaagcatggctcgagcgcggctaccagaagcaggacctgactgaatggaacgcccgcatcgatggctggcgtgcccggcagagcctcgccttcccgcgtcgcggcaaggaaatcatgccccagctggcgatcgaacgtctctatgagctgaccaggcacaaggagccgatcatcagcaccgaagtcggccagcaccagatgtgggctgcccagcacttccacttcatgaagccgaacaagtggctgacctcgggcggcctcggcacgatgggctatggccttcccgccgcgatcggtgcacaggccggcttccccgatgcgctggtcatcgacatcgcgggcgatgcttcgatccagatgaacatccaggaactcggcacggccacccagtaccgccttccggtcaaggtcttcgtgctgaacaacgaatggatgggcatggtccgccagtggcaggaactcacctacgagagccgctactcgaactcctactcggacagcctgcccgatttcgtgaagctcgccgaagcctacggctggaagggcatccgcatcaccgacgaaagcgagctggacgccggcatccaggcgatgatcgatcatgacggcccggtcttcgtcgactgcctcgtcgccaaggaagcgaattgcttcccgatgatcccgtcgggggctgcgcacaccgacatgatcctctacggggacgaagtcgccggcacgatggacgacgaagccaaggcgctggtctga

SEQ ID NO: 82453 - protein, 582 aa, Novosphingobium aromaticivorans DSM 12444
MTTERSGAEILVESLVAKGVEFVFGYPGGAVLPIYDALFGDERLRHILVRHEAGAAHAAEGYARATGKPGVVLVTSGPGATNAVTGIADAFMDSIPMVVITGQVPTALIGSDAFQEADTIGITRHCTKHNYLVKDPSQLAATIDEAFRIATEGRPGPVVIDIPKDVQIATAAWSSAAPQQRNRYAPQTEGGAKEIAEAIELIAKAKAPVFYTGGGVINAGPEAARLLRELQSLTGAPVTSTLMGLGAFPADHPAWLGMLGMHGTYEANMTMNRADLVVCIGARFDDRVTGRLDAFSPNSKKIHIDIDRASINKTVQVDLPVIGDCGKVLAQLIEAWLERGYQKQDLTEWNARIDGWRARQSLAFPRRGKEIMPQLAIERLYELTRHKEPIISTEVGQHQMWAAQHFHFMKPNKWLTSGGLGTMGYGLPAAIGAQAGFPDALVIDIAGDASIQMNIQELGTATQYRLPVKVFVLNNEWMGMVRQWQELTYESRYSNSYSDSLPDFVKLAEAYGWKGIRITDESELDAGIQAMIDHDGPVFVDCLVAKEANCFPMIPSGAAHTDMILYGDEVAGTMDDEAKALV

SEQ ID NO: 82454 - DNA, 1683 bp, Clostridium thermocellum ATCC 27405
  CDS (1)..(1683)
atgggggtaataaaaatgaaacttaccggttcgaaaatattaattgagtgccttaaggaacaaggtgtggatacaatatttggatttccgggcggagcggtattgaatatatatgatgaactgtacaggtcgcagaatgaaatccggcatatactgacttcccacgaacagggagctgctcatgccgcagacggctatgcaagggcaacgggaaaggttggggtgtgtcttgccacatccggccccggggccacaaatctggttacaggaatagcaaccgcttacatggattcggttccgatggttgcaattacaggacaggtggcgacgccgctcttgggcaaggattccttccaggaagttgacataaccggaataacaatgcccataacaaaacacaattttatagtaaaggatgttaacaagctggctgacatagtgcgaagagccttttacatagcaaaagaaggaagaccaggcccggttctgattgatatatgcaaagatgtaacggcggcatatgctgaatatgaaccaaagtcccctcaggaattgcccgaggtacctgtaagagtggatgaaaagtgtattgatgaagcggcggaggcaattaacaaagcggaaagaccggttattctcgccggaggaggcgtatcaatcgcgggagcaaataaagaactttttgagtttgcaacaaatgcccagataccagttaccacaactttaatgggcatgggtgctttcccgggaacccatgagctgttcatgggaatgattggaatgcacggcacaaagacgacaaacatggcggtttcggaatcggatctttttattgcgattggtgcaagatttagtgacagagtgataagcaatgttcagagatttgcacctaaagcaagcataatgcatatagacattgaccctgccgaaatcggaaaaaatattaatgttcaatatgctcttgagggaaacatcaagaaaatattgcagcttctgaacgagagagtaaagaagaaagaatgcactgactgggttagaaaaatcaatgagtggaaggaactgtatcctcttaagtatcctcaggatgacaagcttcatccgcaatatattattgagagaatgtatgaacttaccaaaggagaggcaataataactaccgaggtgggtcagcaccagatgtgggccgcccagttttacaaatacacttctccaagacagttcctgtcctcaggtggtctgggtaccatgggatatggtcttggagcatgcattggcgcccggattggaagacccgacaaaaaggtaattaatgttgccggtgacggcagcttcagaatgaactgcaatgagctggccacagctgttgagtacaagcttccgataatagttgcgatattcaacaatcatgctctgggaatggtaagacagtggcagcagttgttctacggcggaaggtattcctcaacctcgctggacagatgtacagactttaaagctttggcggaagcttacggtgcaatcggtataaatgtcacagccaaagaagaagtcgatgaagctttaaacagagcactggcgtctgaggatacccctgtggtaatcaattttgaaattgacaaggatgaaatggtatttcctattgttccgccgggagctcctttaagcgagcttattgaggagtaa

SEQ ID NO: 82455 - protein, 560 aa, Clostridium thermocellum ATCC 27405
MGVIKMKLTGSKILIECLKEQGVDTIFGFPGGAVLNIYDELYRSQNEIRHILTSHEQGAAHAADGYARATGKVGVCLATSGPGATNLVTGIATAYMDSVPMVAITGQVATPLLGKDSFQEVDITGITMPITKHNFIVKDVNKLADIVRRAFYIAKEGRPGPVLIDICKDVTAAYAEYEPKSPQELPEVPVRVDEKCIDEAAEAINKAERPVILAGGGVSIAGANKELFEFATNAQIPVTTTLMGMGAFPGTHELFMGMIGMHGTKTTNMAVSESDLFIAIGARFSDRVISNVQRFAPKASIMHIDIDPAEIGKNINVQYALEGNIKKILQLLNERVKKKECTDWVRKINEWKELYPLKYPQDDKLHPQYIIERMYELTKGEAIITTEVGQHQMWAAQFYKYTSPRQFLSSGGLGTMGYGLGACIGARIGRPDKKVINVAGDGSFRMNCNELATAVEYKLPIIVAIFNNHALGMVRQWQQLFYGGRYSSTSLDRCTDFKALAEAYGAIGINVTAKEEVDEALNRALASEDTPVVINFEIDKDEMVFPIVPPGAPLSELIEE

SEQ ID NO: 82456 - DNA, 1629 bp, Clostridium thermocellum ATCC 27405
  CDS (1)..(1629)
atgaaactttcaggtgcgcaggcaattgtgaaagctttggaattggaaggcgtggaagttgttttcggttatccgggagctgcaatttgtcctttctatgatgcgctgatggaatctaaaataaggcatatactcaccaggcatgaacagggagctgcccatgccgccagcggatatgccagaacaacgggaagggttggtgtgtgtgttgccacatcaggaccgggagcaaccaaccttattacaggcattgctgacgcatacatggactcaataccgttggtggccatcaccgggcaggttaattcggagctgattggaagagacgtgttccaggaggctgacattaccggcgcgacggatcctttctgcaagcataattatttggtaaaaaacgcaaaggatttgccccgggttttaaaggaagccttttacatagcatccaccggaaggccgggccctgttcttatcgacgtacccatagacgtgcagacaaaagagattaattttgagtacccggaaagtgttgatataaaaggctacaagccaaatttaaaaggccattctcttcagataaaaaagattgctcaagctattgaaaaggcaaaaaaaccggttatttgcgccgggggaggagtgattaattccaatgcatccgaggagcttttaactctttcccgaaagtgcggcatacctgttgttacaactttgatgggtatcgggtccgtgccgtatgattatgagctcaatttaggaatgcttgggactcacggagtatatattgcgaattatgccgtaaacaatgctgaccttttgattatcatcggcgcgagggttgcggacagggctataagcaatccccagcaggttgcaaagagaaagcagatagttcatattgacatagatcctgcggagataggcaaaaatatcgatgtttcaataccggtggtaggagatgtgaagcaggtattaaaagagcttatagatatttcccaaaagggagatacggaagaatggataaagacaactcaaaaagaaagagaaaaacatgccgaaaaacctgaaccaaggcccggtataggttttgtgaatcccaaatatttgttgtctgttttgaccgggcttttgggtgatgatgatataattacaacagaagtgggacagaaccagatatgggctgcaaactattttggtgtcaaaaagccccggacctttataacgtccggaggtctgggtaccatgggatacgggcttcccgccgcggtgggggcaaaaattggctgtcccgaccgcaaagtggtatgtgtgggaggagacgggagcttccagatgaacatgcaggagcttggcaccatcaagcaaaacaggctgggagtgaaagtaatcttattcaacaactcaaggctgggaatggtaagggagctgcaaaagacaaagtactgcggccgttatttccaggtatttttggacgacaatcctgactttataaagttgtttgacgcttatggtttcaagggcaggagaatagacgacgattcccaggtggaagatgcgttgaaagagatgctgtcggacgacaaaccttaccttctcgagtgcaaaattgacccggaagaatcaacactatga

SEQ ID NO: 82457 - protein, 542 aa, Clostridium thermocellum ATCC 27405
MKLSGAQAIVKALELEGVEVVFGYPGAAICPFYDALMESKIRHILTRHEQGAAHAASGYARTTGRVGVCVATSGPGATNLITGIADAYMDSIPLVAITGQVNSELIGRDVFQEADITGATDPFCKHNYLVKNAKDLPRVLKEAFYIASTGRPGPVLIDVPIDVQTKEINFEYPESVDIKGYKPNLKGHSLQIKKIAQAIEKAKKPVICAGGGVINSNASEELLTLSRKCGIPVVTTLMGIGSVPYDYELNLGMLGTHGVYIANYAVNNADLLIIIGARVADRAISNPQQVAKRKQIVHIDIDPAEIGKNIDVSIPVVGDVKQVLKELIDISQKGDTEEWIKTTQKEREKHAEKPEPRPGIGFVNPKYLLSVLTGLLGDDDIITTEVGQNQIWAANYFGVKKPRTFITSGGLGTMGYGLPAAVGAKIGCPDRKVVCVGGDGSFQMNMQELGTIKQNRLGVKVILFNNSRLGMVRELQKTKYCGRYFQVFLDDNPDFIKLFDAYGFKGRRIDDDSQVEDALKEMLSDDKPYLLECKIDPEESTL

SEQ ID NO: 82458 - DNA, 1710 bp, Moorella thermoacetica ATCC 39073
  CDS (1)..(1710)
atgctttttaccattggggatcgagctgaaggcaaaaaactaaccggagcggagattattgttcaggccctccaggcagagggagtggataccgtatttggtatcccggggggctccgtcctgcccctttatcatgagctggcggtagccagcatacgccatattttaacgcggcatgagcaggcagccgcccatgccgccgacggttatgcccgcgccagcggcaaactcggtgtgtgtattgctacttccggccctggagcaaccaacctggtgacggggatcgccaatgcctatatggattccatccccctggttgccattaccggccaggtcagtgttcctatgattggccatgattccttccaggaagccgacattaccggcattaccctccccattaccaaggccaattacctggtcaagaacgtccacgacctggcagctaccatccacgaggctttttacatcgctaccaccggccgtccgggtccggtgttgatcgatattcccaaggatattaccacccagcgggcactgtttcgctaccctcccagactccaccttccaggttaccggtgcaaggtgcaaccccacgccctccaggtagcccaggcggctgtcgctatcggggctgcggaaaaacctttactctttattggtggcggcgtaatcacctcagaagcccatgaagaagtacggcaactggctgagggccaggatattcccgtagtcatgagcatgatgggcaagggcggtttcccggaaacccatcctttatttgtaggcatggtgggcatgcatggtacagcggcagccaactacgccatgtgtgagacggatctcattatcggtgtgggtgtccgttttgacgaccgggtcacgggtaaagtcgaagcctttgctccgaaagctaaaattatccacatcgatattgatgccgctgagatcggcaaggtggttcaggcccatattcccattgtcagcgatgctcgtcaggggttggccgccatcctggagaaattgtcgggaaaaggcgatcaccaggcctggcggcagcaaatccggcgctggcaggaagaaaatccgttacgctatgaaaagagtggcctgaaaccccagtatgtcctggaggaattatataatcttactaaggggcaggccattatctgcactgatgtcggccagcaccagatgtgggcggtgcagtattatcccctgagccggccccgcgccttcctttcgtcctgcggattaggaaccatgggctttggcgtcccggcagccatgggagccgctgttgcccggccgggggagccgattgtggttattactggcgacggtagtttccagatgaatatccaggagctcgctaccattagccattaccagttgccactcaagattattatcatgaacaacggttacctgggtatggtgcgtcagtggcaggaattcttttttaaccgccgctatgcctactcggagatgctcggtaatccggactttgtcaaggtggctgaggcctaccgcattccggggcggctggttaacgaaagccgggaggttgttcccgctctggaagaagccctggctgcagaaggccccttcctggttgatgtcaggatcgacagggaggagaacgtctttcccatggtgccgccggggggcaccctcaataagatggtgacgggaggtaagggagcatga

SEQ ID NO: 82459 - protein, 569 aa, Moorella thermoacetica ATCC 39073
MLFTIGDRAEGKKLTGAEIIVQALQAEGVDTVFGIPGGSVLPLYHELAVASIRHILTRHEQAAAHAADGYARASGKLGVCIATSGPGATNLVTGIANAYMDSIPLVAITGQVSVPMIGHDSFQEADITGITLPITKANYLVKNVHDLAATIHEAFYIATTGRPGPVLIDIPKDITTQRALFRYPPRLHLPGYRCKVQPHALQVAQAAVAIGAAEKPLLFIGGGVITSEAHEEVRQLAEGQDIPVVMSMMGKGGFPETHPLFVGMVGMHGTAAANYAMCETDLIIGVGVRFDDRVTGKVEAFAPKAKIIHIDIDAAEIGKVVQAHIPIVSDARQGLAAILEKLSGKGDHQAWRQQIRRWQEENPLRYEKSGLKPQYVLEELYNLTKGQAIICTDVGQHQMWAVQYYPLSRPRAFLSSCGLGTMGFGVPAAMGAAVARPGEPIVVITGDGSFQMNIQELATISHYQLPLKIIIMNNGYLGMVRQWQEFFFNRRYAYSEMLGNPDFVKVAEAYRIPGRLVNESREVVPALEEALAAEGPFLVDVRIDREENVFPMVPPGGTLNKMVTGGKGA

SEQ ID NO: 82460 - DNA, 1683 bp, Moorella thermoacetica ATCC 39073
  CDS (1)..(1683)
atggcacaggagactagcggccgcactggcgcccgggccgtggttgaggccctcctggacgagggtgtggaactggtcttcggttatcccggcggggcggtattgcccctctatcatgagctggcccggacgcccatccgccatatcctggttcgccaggagcagaacgccgttcatgccgccagcggttacgcccgcgccagcggcagaacaggtgtctgctttgccacctcgggtccgggggcgaccaacctggtcaccggtattgccaccgcttttatggattctgtgccggtggttatctttaccggccaggtcccgacgcggatggtgggtagcgatgccttccaggaaaccgacattacgggcattaccatgcctattaccaagcataattacctggtcaaggatgtagaggaattaccccgaatcgtcaaggaggccttctatattgccggcaccggtcgcccgggaccggtgctggtagatatacccaaggatgtggccctggccccctgccgggcacccttaccggaaagggtggagctgcggggttacaaacccacctatcatggccatccgggccagcttcgctccctggcgcgaatcttaggcgaggccgagcggccgttaatcttcgcggggggcggggtacaggtttcccgagccgaggattatttacgccaactggtagaaaagctccagataccggtagtaacctccctcacggggctgggttcctttcccgaggataatcctttatctttaggtatggtcggcctccatggcaagccctgcgccaaccatgccctcatggagtgcgacctcctggtgggcctgggggtacgctttgacgaccgggtaacgggagccctggataagttcgccccccgggccaggattgcccacctggatattgacccggcggaaatcggcaaaaacgtccgggtggatttacctctggtaggcgatatcagctgtatcctgaaggaactcctgcccctggtggaacccgccggacacggcccctggctgcagcgcattaaagaattgcgtaatctctaccccctgacctatggccgcggcggcgaggtgcggccccagtgggtaatcgagcgcctgggggagatgacccgcggccaggcgattattactaccgatgtcggccagcatcagatgtgggcagccctcttttacggttttaccgaaccccgcaccttcatttcttcctgtggcctgggaaccatgggttacggcctgccggcagccgtgggcgccgccctggcccggcccgataaacaggtgtggttgataaccggcgacggcagcttccagatgagcatggcggaactgggtacagccagggagcagggcgtacctttaaagattttacttttcaataaccaaagcctggccatggtgcgccagctgcagcacttttactatgaacgccagtataccgccatcgagtttaccggcaaccccgactttgtccgcctggcggagtgctacggggccgaggggttgcgtataagtaagcaggaagaagtggtgccagtcctggctcgggctatgggcaacgaccgcctgacattgattgaatgcctgatcagtcctgaagagatggtataccccatggtcccggaaggggcggccctggacgagatgattcttccggaataa

SEQ ID NO: 82461 - protein, 560 aa, Moorella thermoacetica ATCC 39073
MAQETSGRTGARAVVEALLDEGVELVFGYPGGAVLPLYHELARTPIRHILVRQEQNAVHAASGYARASGRTGVCFATSGPGATNLVTGIATAFMDSVPVVIFTGQVPTRMVGSDAFQETDITGITMPITKHNYLVKDVEELPRIVKEAFYIAGTGRPGPVLVDIPKDVALAPCRAPLPERVELRGYKPTYHGHPGQLRSLARILGEAERPLIFAGGGVQVSRAEDYLRQLVEKLQIPVVTSLTGLGSFPEDNPLSLGMVGLHGKPCANHALMECDLLVGLGVRFDDRVTGALDKFAPRARIAHLDIDPAEIGKNVRVDLPLVGDISCILKELLPLVEPAGHGPWLQRIKELRNLYPLTYGRGGEVRPQWVIERLGEMTRGQAIITTDVGQHQMWAALFYGFTEPRTFISSCGLGTMGYGLPAAVGAALARPDKQVWLITGDGSFQMSMAELGTAREQGVPLKILLFNNQSLAMVRQLQHFYYERQYTAIEFTGNPDFVRLAECYGAEGLRISKQEEVVPVLARAMGNDRLTLIECLISPEEMVYPMVPEGAALDEMILPE

SEQ ID NO: 82462 - DNA, 1671 bp, Streptococcus suis 89/1591
  CDS (1)..(1671)
atgtcctatctcattttggacaccctgcatcagctaggagtagaccttgtttttggttatcctggtggggcagttttgcctctatatgatgctatctatcaatatgagggaatccagcatattttggctcgtcatgaacaaggagcggtccacgaggccgaaggatacgctaaatcatcaggaaaggtgggcgtagccattgtaacctctgggccaggtgctaccaatgccattactggaattgcggacgcaatgggtgatagtgttcctcttttagtttttactggtcaagtcgcaacacgtggtatcggtaaagatgcttttcaggaagcagatgtcttggggatgacaatgccgattaccaagtacaattaccaaattcgggatacggcagatattcctagagtcatcacagaagctctccatattgcaacaacagggagaccgggtcccgttgttattgatgttccaaaagatattcaagagagagtagttgatttttatcatgacccaactctacatttgccaagttatcagccaacgattgaaccaaatggtttgcaggttaagaaaattttgaaacagcttagccaagctcaaaaaccagttatattggctggtggtggtgtcaattatgcagatgccaataaagaattagttgcctttgcagagcgctaccgtattccagtagtttcaaccctccttggattaggtgcaatgcccattgagcatgaattatccttggctatggggggtatgcacggttcatacgctgccaatatggctatggatcaggctgattatattatcaatattggagcgcgattcgatgaccgcctaacaggaaatccaacaacctatgcgccaaatgcgacggtagcacatattgatattgatcccgcagaaattggtaaagttgtcaaaacggctattccagtagtgggcgacgctaaggcaacattgaaagctctgcttgctttagaaacagtcgaaacaggctatgctgaatggacggcacaagtcttggaaaataaacgtcgggcgccattttggtatgatgaagataaaaaggttattaagccacaggcggcaattgaattaataggtcagttgacgcaaggggatgccattgtcgtgacagacgttggtcagcatcaaatgtgggctgcccaattctacccctacaaacatgcacgtcaacttgtaacatctggtggcatggggaccatgggctttggtattcctgcagctatcggcgccaaattagccaatccagataaagaagtaatcatctttgttggtgatggcggcttccaaatgaccaaccaagaattggctattttgaatggctatggtgtaccgattaaggttgtattgatcaataaccactctcttggaatggttcgtcaatggcaggaatccttctatgaaaagcgtcgtagccaatctgtctttgacgatgaaccgaatttccaattgttggcggaggcctatggaattagtcattatagttttgacaatccagcgactctaagtgaagacatgaaagttatcttagaagataaaccaatgctcatagaggttcatatttctaatcgtgaacatgttcaaccgatggtgccagcaggtaagagcaatgcagaaatgttgggggtgaagttcaatgcgtag

SEQ ID NO: 82463 - protein, 556 aa, Streptococcus suis 89/1591
MSYLILDTLHQLGVDLVFGYPGGAVLPLYDAIYQYEGIQHILARHEQGAVHEAEGYAKSSGKVGVAIVTSGPGATNAITGIADAMGDSVPLLVFTGQVATRGIGKDAFQEADVLGMTMPITKYNYQIRDTADIPRVITEALHIATTGRPGPVVIDVPKDIQERVVDFYHDPTLHLPSYQPTIEPNGLQVKKILKQLSQAQKPVILAGGGVNYADANKELVAFAERYRIPVVSTLLGLGAMPIEHELSLAMGGMHGSYAANMAMDQADYIINIGARFDDRLTGNPTTYAPNATVAHIDIDPAEIGKVVKTAIPVVGDAKATLKALLALETVETGYAEWTAQVLENKRRAPFWYDEDKKVIKPQAAIELIGQLTQGDAIVVTDVGQHQMWAAQFYPYKHARQLVTSGGMGTMGFGIPAAIGAKLANPDKEVIIFVGDGGFQMTNQELAILNGYGVPIKVVLINNHSLGMVRQWQESFYEKRRSQSVFDDEPNFQLLAEAYGISHYSFDNPATLSEDMKVILEDKPMLIEVHISNREHVQPMVPAGKSNAEMLGVKFNA

SEQ ID NO: 82464 - DNA, 1713 bp, Thiobacillus denitrificans ATCC 25259
  CDS (1)..(1713)
atggaagccacgggcgccgagatcgtcgtacgttgtctggctgaagagggggtcgagttcgtcttcggctatcccggcggagccgtgctcaacatctacgacgagatcttcaagcagaacaggttcaagcacgtgctggtgcgccacgaacaggcggccgtccacgctgccgacgcctatgcgcgctcgaccggccgcgtcggcgtggcgctcgtcacctcggggcccggcgtcaccaacgctgtgaccggcatcgccacggcgtatatggattcggtgccgatcgtcgtcgtcaccggccaggtgccgacgcccgcgatcgggctcgacgccttccaggaagtcgacaccgtcggcatcacacggccctgcgtcaaacacaatttcctcgtcaaggacgtcaaggatctggccgcgacgatgaagaaggccttcatcatcgcagccaccggtcgccccggcccggtggtcgtcgacgtacccaaggacgtgacctaccacgtgaccgagttcgaatatccggccacggtcgagatgcgttcgtacaaccccgttgtcaaaggccacagcggtcagttgaagcgcgccgtgcagatgctgctcgaagccaagcgcccgatgatctacgcgggcggcggcgtcgtcctcggcgacgcgtcggcgcagctgaccgaactcgcgcgcctgctcggctttccctgcaccaatacgctgatgggtctcggcggttatcctgcgaccgacaggcagaacctcggcatgctcggcatgcacggcacctatgaagcgaacatggcgatgcagcactgcgacgtgctgctggccgtcggcgcgcgcttcgacgaccgcgtgatcggcaaccccgcgcacttcgccaaggagcagcgtcgcatcatccacatcgacatcgacccgtcttcgatctcgaagcgcgtcaaggtcgacgtgcccatcgtcggcgacgtcaggaacgtgctgcgcgacatgctgagcctgctgaagcaggccaaggaagtgcccgacgctgcggcgctcaacgcgtggtggacgcagatcgaattgtggcgctcgaagaactgcctcaagtacaaccgcaacagcccgatcatcaagccgcagtatgtggtcgaaaagctgtgggaagtcaccaagggcgacgccttcatcacctccgacgtcggccagcaccagatgtgggcggcccagtactacaagttcgacaagccgcgccgctggatcaattccggtggcctcggcaccatgggcgtcggcctgccgtatgcaatgggcgtgcaactcgcgcatccggaggcgcaggtcgcctgcatcaccggcgagtcgtcgatccagatgaacatccaggagctttcgacctgcaagcagtaccgcattccggtcaaggtcgtcacgctcaataaccgctacatgggcatggtgaggcagtggcaggagttcttctacggcagccgctacgccgagtcgtacatggagtcgctgcccgacttcgtcaagctcgccgaagcctacggccacgtcggcatgcgcatcgacaagcccgaggacgtcgaagcggcgctcaaggaagccttctcgcctgtactcaaggaaagaatggtgttcatggacttccagaccgaccagaccgagaacgtcttcccgatggtcgaaggcggcaagggcctgtcggaaatgattctggcggaggagctgtga

SEQ ID NO: 82465 - protein, 570 aa, Thiobacillus denitrificans ATCC 25259
MEATGAEIVVRCLAEEGVEFVFGYPGGAVLNIYDEIFKQNRFKHVLVRHEQAAVHAADAYARSTGRVGVALVTSGPGVTNAVTGIATAYMDSVPIVVVTGQVPTPAIGLDAFQEVDTVGITRPCVKHNFLVKDVKDLAATMKKAFIIAATGRPGPVVVDVPKDVTYHVTEFEYPATVEMRSYNPVVKGHSGQLKRAVQMLLEAKRPMIYAGGGVVLGDASAQLTELARLLGFPCTNTLMGLGGYPATDRQNLGMLGMHGTYEANMAMQHCDVLLAVGARFDDRVIGNPAHFAKEQRRIIHIDIDPSSISKRVKVDVPIVGDVRNVLRDMLSLLKQAKEVPDAAALNAWWTQIELWRSKNCLKYNRNSPIIKPQYVVEKLWEVTKGDAFITSDVGQHQMWAAQYYKFDKPRRWINSGGLGTMGVGLPYAMGVQLAHPEAQVACITGESSIQMNIQELSTCKQYRIPVKVVTLNNRYMGMVRQWQEFFYGSRYAESYMESLPDFVKLAEAYGHVGMRIDKPEDVEAALKEAFSPVLKERMVFMDFQTDQTENVFPMVEGGKGLSEMILAEEL

SEQ ID NO: 82466 - DNA, 1695 bp, Rubrobacter xylanophilus DSM 9941
  CDS (1)..(1695)
atggagaacatagcatacaaggtcgagtacaagccccggaccgggagcgaggccatgtgcgaggctctgctcgacgagggggtcgagtacctcttcggctacccgggcggggcgatcatgccgttctacgacgccctgccggactacccgctgcggcacgtcctggtccggcacgagcaggccgcggcccacgccgccgacggctacgcgcgggccacgggccgggtgggggtgtgcgtggcgacgagcggccccggggcgaccaacctggtaaccgggctggcgaccgcgcagatggactcggtgccggtggtggccatcaccgggcaggtcgggcggggcgcgatgggcaaggactccttccaggagaccaacgtcatggggatgacgctccccttcaccaagcactccttcctggtcgaggacccggaggagctctacgagacgatgcggcgggccttcgccatagcccgctccggcaggccgggacccgtgctcgtcgacgtccccaaggacgtgcagttcgccgagtgcggcggcgacggctaccgggcgctgcgcgaggccccgccgccggtctccagccccgcgctcgaggcggcggcgctgctgctcaagaaggcccggcgccccatcatcgtcgccgggcacggcgtgatcctctccggcgccgagcgggagctcatcgccctcgccgagcggaccggggccccggtggtcaccaccctgctcgggatcagcgccatcccccaggaccacccgctgtacatcggctggccggggatgcacggccaggcctccgtcaaccgggccatagaccgctcggacctgctcttcgcggtggggatgcgcttcgacgacaggatcacgggcgacccctcgcgcttcgcccccaacgcgagggtggtccacatagacatcgacccctcggagctgggcaaggtcataaagcccgcggtgggcatagccgccgacgccagggccgcgctgcggggcgtcttgcgccacatcgggcggccgcaggacaactgcgcagcctggcgggcggagatcgccgagagccagcgccccgagcgggagcgggccgagcgcgcccggccggagtacggccccataaggatcatggacgccataaaggccgccgccggggaggaggtccggctggtaaccgacgtgggacagcaccagatgtgggcggcgcagttcttccggttcaccaagcgaaacagccacatcacctccggcgggctcggcaccatgggcttcgcgctcccggcggcgatgggcgtcaagctcggctgccccgaggacccggtgtgggtggtggccggcgacggcggcttccagatgaacctgcaggagctcgccaccatccgggacctcggcctggacatcaaggtggccgtgctgaacaacggctacctggggatggtgcgccagtggcagcagttcttccacaaccgccgctactccgagacccccatcacggggccggactacgagcacctcgcccgggcctacgggatagcgggcaggaccgtccggcccggcgacgacgtggaggaggcggtgcgctgggcgcagcggacgccggggtgcgtggtgctggacttccacatcgacccggaggccaacgtctaccccatgatcccctctggcatgagcgtggccgagatgatcgaggaagatgcctga

SEQ ID NO: 82467 - protein, 564 aa, Rubrobacter xylanophilus DSM 9941
MENIAYKVEYKPRTGSEAMCEALLDEGVEYLFGYPGGAIMPFYDALPDYPLRHVLVRHEQAAAHAADGYARATGRVGVCVATSGPGATNLVTGLATAQMDSVPVVAITGQVGRGAMGKDSFQETNVMGMTLPFTKHSFLVEDPEELYETMRRAFAIARSGRPGPVLVDVPKDVQFAECGGDGYRALREAPPPVSSPALEAAALLLKKARRPIIVAGHGVILSGAERELIALAERTGAPVVTTLLGISAIPQDHPLYIGWPGMHGQASVNRAIDRSDLLFAVGMRFDDRITGDPSRFAPNARVVHIDIDPSELGKVIKPAVGIAADARAALRGVLRHIGRPQDNCAAWRAEIAESQRPERERAERARPEYGPIRIMDAIKAAAGEEVRLVTDVGQHQMWAAQFFRFTKRNSHITSGGLGTMGFALPAAMGVKLGCPEDPVWVVAGDGGFQMNLQELATIRDLGLDIKVAVLNNGYLGMVRQWQQFFHNRRYSETPITGPDYEHLARAYGIAGRTVRPGDDVEEAVRWAQRTPGCVVLDFHIDPEANVYPMIPSGMSVAEMIEEDA

SEQ ID NO: 82468 - DNA, 1743 bp, Chloroflexus aurantiacus
  CDS (1)..(1743)
atgaccaaacctcttaccggcgcccagattatgtgtgaagccctcatccgggagggagtcgaagtgatgttcggcattcccggcggtgccatcatgcccttctactacgcgatgtgggattatcgcgaccggctgcgccacgtgttgtgtcgccacgagcagggagccggtcacgccgccgaggggtatgcccgtgccaccggcaagatcggggtctgtatcggcaccagtggccccggcgcgaccaatctggttacgccaattgccgatgcgatgatggacagtacgcccttgctggcaattaccggacaggtcggcagtcacgttctcggtaaggatgccttccaggagacggacattaccggaattacgatgccgattaccaagcacaattatctggtgaagaatgtcgatgagctggcctatgtcttcaaagaggcaatttacatcgcaacaaccggacgacccggcccggtgctgatcgacattaccaaagatgcaatgcagaagacgacggtaccgaactgggacatcaagctcaatctgcccggttacaagccaacctatcatggaaaccgtcgtcagattcgggaagcgattaagctgctgatcagcgcgaagaagccgttgatcatcgccggtcacggcatcatcatggcgggtgcgcaccgcgagctgcaagagtttgccgaacggttgcggattccggtgattaccaccctgcacggcattggcgctatccccgaaaatcatccgttgagcattggtatgccgggtatgcacggctgggtgcatgtcaatcgcgctattcaggagtgtgatgttctctttaacatcggcggtcgtttcgacgaccgggtgaccggtaaggccagtacctttgctcccaacgcccgcatcattcacgttgacattgatccctctgagattggtaagaacgtgcgagttgacgtgccgattgtcggcgacgcccggctggtgttgcaggcattcctggaggatttgcccccacccagcgagctggccgatctgcacacgcatgcttcggactggatggagcacatccgcgagatgcaggataagcaccaggggaagcagcagtacaagaaccgggccgcgatggtaaatatggccttgccgccgcacgatgtctacgaggcgctgagccgcactctgaacgcacgtggcaactatcgggtggtcaccgatgtcggtcagcaccaaatgtgggcagcccaattgatcgactggaaccacggcccacgcacgcatattacatcgggtggtgccggaacgatgggttttgcagtgccggcagccatgggcgtggcaatcgcctgccccaacgatacggtctgggctattgtcggtgacggtggcttccagatgaccaatcaagagatggcgaccatcgtgcaggaagggttgaagaatgtcaagatcgccgtcatcaacaacggctatctcggcatggtgcggcagtggcaggagctgttcgagcacaagcggtacagcgggacacctctctctggccccgactttgccaaactggcagaggcttacggctggaagggtctgaccgtcgaacgcagcgaggatgtgcaggatgccattgatgaagcccacgcgaccgatggcccagtcctgatcgatttccgggtcgaacgggaggtcaacgtcttcccgatggtgccccagaacaagtcaatcggcgagatgatcctgtctgagtcgcaggcgtag

SEQ ID NO: 82469 - protein, 580 aa, Chloroflexus aurantiacus
MTKPLTGAQIMCEALIREGVEVMFGIPGGAIMPFYYAMWDYRDRLRHVLCRHEQGAGHAAEGYARATGKIGVCIGTSGPGATNLVTPIADAMMDSTPLLAITGQVGSHVLGKDAFQETDITGITMPITKHNYLVKNVDELAYVFKEAIYIATTGRPGPVLIDITKDAMQKTTVPNWDIKLNLPGYKPTYHGNRRQIREAIKLLISAKKPLIIAGHGIIMAGAHRELQEFAERLRIPVITTLHGIGAIPENHPLSIGMPGMHGWVHVNRAIQECDVLFNIGGRFDDRVTGKASTFAPNARIIHVDIDPSEIGKNVRVDVPIVGDARLVLQAFLEDLPPPSELADLHTHASDWMEHIREMQDKHQGKQQYKNRAAMVNMALPPHDVYEALSRTLNARGNYRVVTDVGQHQMWAAQLIDWNHGPRTHITSGGAGTMGFAVPAAMGVAIACPNDTVWAIVGDGGFQMTNQEMATIVQEGLKNVKIAVINNGYLGMVRQWQELFEHKRYSGTPLSGPDFAKLAEAYGWKGLTVERSEDVQDAIDEAHATDGPVLIDFRVEREVNVFPMVPQNKSIGEMILSESQA

SEQ ID NO: 82470 - DNA, 1776 bp, Polaromonas sp. JS666
  CDS (1)..(1776)
atggccgccgtgctcgtgatggaaaaagaaggcgtgacccaggcctttggcgtgccgggcgcagccatcaacccgctgtacgccgcgctgcgcgagcgccagtcgattacccacatcctggcgcgtcacgtggaaggcgcctcccacatggccgagggctacacccgcgccaaggccggcaacattggcgtgtgcataggcaccagcggcccggccggcaccgacatgatcaccgggctgtactcggccattgccgacagcattccgattttgtgcatcaccggccaggcgccgcgcgcacggctctacaaggaagacttccaggcggtggacatcgaatcgatttccaagccggtgaccaagtggagcgtgacggtgcgcgagccggcccaggtgccgcgcgccttccagcaggcctttcacctgatgcgttcgggccgccccggcccggtgctgattgacctgccgttcgacgtgcagatggccgaaatcgaattcgacatcgacacctacgaaccgctgccggtctacaagccggccgccagccgcaagcagatcgaaaaggcgctcgacatgctggccgccgcctccaagccgctgatcgtcgccggcggcggcatcatcaatgccgatgcgaccgacctgctggtcgagttcgccgagctgaccggcgtgccggtgattcccacgctgatgggctggggcagcattcccgacgaccacccgctgatggcgggcatgtgcggcctgcagaccagccaccgctacggcaacgccaccatgctggccagtgacttcgtgttcggcatcggcaaccgctgggccaaccgccacaccggctcgaccgaggtctactgcaagggccgcacctttgtccacgtcgacatcgaaccgacgcaaatcggccgcgtgttcagccccgacttcggcatcgtcagcgacgccaaggccgcgttgacgctgctggtcgaggtggcccgcgagcgcaaggcggccaagcggctgcgggactacagcgaatgggcggcacgctgcgccgagcgcaagaaactgatgcaccgcaagtcgcacttcaccgagacaccgatcaagccgatgcgggtgtacgaggagatgaacaaggtgtttccgcgcgacacgatttatgtgacgaccatcggcctgtcgcaaattgccggcgcgcagttcctcaacgtctatgggccgcgccagtggatcaactgcggccaggccggcccgctgggctggacgattccggccgcgctgggcgtggtggcggctgacccgacgcgcacggtggtgggcctgtcgggcgactacgacttccagttcctgatggaagagctggccgttggcgcgcagttcaacctgccctatgtgcaggtgctggtgaacaacagctacctgggcctgattcgccagagccagcgcggcttcgacatggactactgcgtgcagctggcatttgaaaaccagaacgtgccggcaggcgaaggcgatctgcgcagctacggcgtcgatcaccaggcagtcgtgcagggcctgggctgcaaatccctgcgcgtcaccgatcccgagaagattgaatcggcgatggtcgaggcccaggccatggcgcgcaaataccgcgtgccggtggtggtggaagtgatcctggaaaaagtcaccaacattgccatgggcaccgaaatcgacaaggtcaatgagtttgaagacattgactgccgccatcccaagggccgcgagggcctggaactggccggcctgctggagtaa

SEQ ID NO: 82471 - protein, 591 aa, Polaromonas sp. JS666
MAAVLVMEKEGVTQAFGVPGAAINPLYAALRERQSITHILARHVEGASHMAEGYTRAKAGNIGVCIGTSGPAGTDMITGLYSAIADSIPILCITGQAPRARLYKEDFQAVDIESISKPVTKWSVTVREPAQVPRAFQQAFHLMRSGRPGPVLIDLPFDVQMAEIEFDIDTYEPLPVYKPAASRKQIEKALDMLAAASKPLIVAGGGIINADATDLLVEFAELTGVPVIPTLMGWGSIPDDHPLMAGMCGLQTSHRYGNATMLASDFVFGIGNRWANRHTGSTEVYCKGRTFVHVDIEPTQIGRVFSPDFGIVSDAKAALTLLVEVARERKAAKRLRDYSEWAARCAERKKLMHRKSHFTETPIKPMRVYEEMNKVFPRDTIYVTTIGLSQIAGAQFLNVYGPRQWINCGQAGPLGWTIPAALGVVAADPTRTVVGLSGDYDFQFLMEELAVGAQFNLPYVQVLVNNSYLGLIRQSQRGFDMDYCVQLAFENQNVPAGEGDLRSYGVDHQAVVQGLGCKSLRVTDPEKIESAMVEAQAMARKYRVPVVVEVILEKVTNIAMGTEIDKVNEFEDIDCRHPKGREGLELAGLLE

SEQ ID NO: 82472 - DNA, 1800 bp, Methanococcus aeolicus
  CDS (1)..(1800): transl_table=11
atgaacggagcagaggctatgataaaagcacttgaagctgaaaaagtcgaaatattatttggttatcctgggggagctctactaccattttacgatgcactacatcatagtgatttaatacatcttttaacacgacatgaacaagccgccgcccatgccgcagacggatatgccagagcaagtggcaaagttggagtatgtataggaacatctggaccaggtgcaactaatcttgttacaggagtggctacagcacattctgattcctctccaatggtggcattgacagggcaagttccaacaaaattaataggaaatgatgcatttcaggaaatagatgcccttggattatttatgcccattgtgaagcataactttcaaattcaaaaaacttgtcaaataccagagattttcagaagtgcttttgaaatagcccagactggaagacctggacccgtgcatatcgatttaccaaaagatgttcaagaattagaattagatattgataaacacccaataccgtcaaaagtaaaattaataggatataatccaaccaccattggacatccgcgacaaataaaaaaagcaattaaattaatcgcttctgctaaaagaccgataattttagcaggtggtggagtactattaagtggagctaatgaagaattattaaaattagtggaattattaaacatacctgtatgtacaactttaatgggtaaaggttgtatatctgaaaatcatccccttgcccttggtatggttggtatgcatgggacaaaaccagctaattattgtctatctgaaagtgatgttttaatatccattggttgtaggttctccgatagaattacaggagatataaaaagttttgctacaaatgcaaaaattatccatattgatatagaccccgccgaaattggcaaaaatgtaaatgtagatgtgccaattgtgggagatgctaaattaatattaaaagaagtaataaaacagctggattatatcatcaataaagatagtaaggaaaataacgataaagaaaatatatcacaatggatagaaaatgttaattcattgaaaaaatcctcaattcctgtaatggattatgatgacattccaataaaaccacaaaaaatagtaaaagaacttatggccgttattgacgatttaaatattaataaaaataccataattacaaccgatgttggacaaaatcaaatgtggatggcccactactttaaaacccaaactccacggtcattcttatcctcgggaggattaggaactatgggattcggattcccctctgcaattggggcaaaggttgcaaaaccagatagcaaagtaatttgtataactggtgatggcggatttatgatgaactgtcaagagctcggcacaatagccgaatacaatatccctgttgtaatttgtatatttgacaatagaacccttggaatggtttatcaatggcaaaatttattctatggaaaaagacaatgtagtgttaatttcgggggagctcctgattttataaaacttgcagaaagctatgggataaaagctagaagaattgaatcacctaatgaaataaatgaagcacttaaagaagccataaattgtgatgaaccttatttattagatttcgcaattgacccctcatcagctctttcaatggtgccaccaggagcaaaattaaccaatataattgatgcagttcaagagcatccaaatgaaaaaatcgtatgtttcgatgaaataaagagaagatatatggaaaataaaagaaataggaaataa

SEQ ID NO: 82473 - protein, 599 aa, Methanococcus aeolicus
MNGAEAMIKALEAEKVEILFGYPGGALLPFYDALHHSDLIHLLTRHEQAAAHAADGYARASGKVGVCIGTSGPGATNLVTGVATAHSDSSPMVALTGQVPTKLIGNDAFQEIDALGLFMPIVKHNFQIQKTCQIPEIFRSAFEIAQTGRPGPVHIDLPKDVQELELDIDKHPIPSKVKLIGYNPTTIGHPRQIKKAIKLIASAKRPIILAGGGVLLSGANEELLKLVELLNIPVCTTLMGKGCISENHPLALGMVGMHGTKPANYCLSESDVLISIGCRFSDRITGDIKSFATNAKIIHIDIDPAEIGKNVNVDVPIVGDAKLILKEVIKQLDYIINKDSKENNDKENISQWIENVNSLKKSSIPVMDYDDIPIKPQKIVKELMAVIDDLNINKNTIITTDVGQNQMWMAHYFKTQTPRSFLSSGGLGTMGFGFPSAIGAKVAKPDSKVICITGDGGFMMNCQELGTIAEYNIPVVICIFDNRTLGMVYQWQNLFYGKRQCSVNFGGAPDFIKLAESYGIKARRIESPNEINEALKEAINCDEPYLLDFAIDPSSALSMVPPGAKLTNIIDAVQEHPNEKIVCFDEIKRRYMENKRNRK

SEQ ID NO: 82474 - DNA, 2052 bp, Chlamydomonas reinhardtii
  CDS (1)..(2052)
atgaaggccctgcgaagtggaaccgctgtggcccggggccaagcgggctgtgtttctcccgctccgcgccctgtgcctatgtcgtctcaggcgatgattccgagcaccagctccccagcagctcgtgcacccgcccggtccggtcgccgcgccctcgctgtgtcggccaagcttgctgatgggtctcgtcgcatgcagtccgaggaggtgcgccgcgccaaggaggtggcccaggctgcgctggccaaggacagccctgccgactgggtggaccgctacggctcggagccgcgcaagggcgccgacatcctggtgcaggcgctggagcgcgagggcgtggacagcgtgttcgcctacccgggcggcgcctccatggagatccaccaggccctcacgcgctccgaccgcatcaccaacgtgctgtgccgccacgagcagggcgagatctttgccgccgagggctacgccaaggccgcgggccgcgtgggcgtgtgcatcgccacctcgggccccggcgccaccaacctggtcacggggctggcggacgccatgatggactccatccccctggtggccatcaccggccaggtgccgcgccgcatgatcggcaccgacgccttccaggagactcccattgtggaggtgactcgcgccatcaccaagcacaactacctggtgctggacatcaaggacctgccgcgtgtgatcaaggaggccttttacctggcccgcaccggccggcccggccctgtgctggtggacgtgcccaaggacatccagcagcagctggcggtgccggactgggaggcgcccatgagcatcacgggctacatcagccgcctgcctccccccgtggaggagtcgcaggtgctgccggtcctgcgcgcgctgcagggcgccgccaagcccgtcatctactacggcggcggctgcctggacgcgcaggcggagctgcgagagttcgcggcgcgcaccggcatcccgctggccagcaccttcatggggctgggcgtggtgccgtccaccgaccccaaccacctccaaatgctgggcatgcacggcaccgtgttcgccaactacgcggtggaccaggccgacctgctggtggcgctgggcgtgcgcttcgacgaccgcgtcaccggcaagctggacgccttcgcggcgcgcgcgcgcatcgtgcacatcgacattgacgctgccgagatcagcaagaacaagaccgcgcacgtgccggtgtgcggcgacgtgaagcaggcgctcagccacctgaaccgcctgctggccgcggagccgctgcccgcagacaagtgggcgggctggcgcgccgagctggcggccaagcgcgccgagttccccatgcgctacccgcagcgcgacgacgccattgtgccgcagcacgccatccaggtgctgggcgaggagacgcagggcgaggccatcattaccacgggcgtgggccagcaccagatgtgggcggcgcagtggtacccctacaaggagacgcggcgctggatcagcagcggcggcctgggctccatgggctttggcctgccggcggcgctgggcgcggcggtggcgttcgacggcaagaacgggcggcccaagaagaccgtggtggacattgacggcgacggctccttcctcatgaacgtgcaggagctggccaccatcttcattgagaagctggacgtcaaggtgatgctgctcaacaaccagcacctgggcatggtggtgcagtgggaggacaggttctacaaggccaaccgcgcgcacacgtacctgggcaagcgcgagagcgagtggcacgccacgcaggacgaggaggacatctaccccaactttgtcaacatggcccaggccttcggcgtgccctcccgccgcgtcatcgtcaaggagcagctgcgcggcgccatccgcaccatgctggacacgcccgggccctacctgctggaggtcatggtgccgcacatcgagcacgtgctgcccatgatccccggcggcgccagcttcaaggacatcattaccgagggagacgggaccgtcaagtactga

SEQ ID NO: 82475 - protein, 683 aa, Chlamydomonas reinhardtii
MKALRSGTAVARGQAGCVSPAPRPVPMSSQAMIPSTSSPAARAPARSGRRALAVSAKLADGSRRMQSEEVRRAKEVAQAALAKDSPADWVDRYGSEPRKGADILVQALEREGVDSVFAYPGGASMEIHQALTRSDRITNVLCRHEQGEIFAAEGYAKAAGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPKDIQQQLAVPDWEAPMSITGYISRLPPPVEESQVLPVLRALQGAAKPVIYYGGGCLDAQAELREFAARTGIPLASTFMGLGVVPSTDPNHLQMLGMHGTVFANYAVDQADLLVALGVRFDDRVTGKLDAFAARARIVHIDIDAAEISKNKTAHVPVCGDVKQALSHLNRLLAAEPLPADKWAGWRAELAAKRAEFPMRYPQRDDAIVPQHAIQVLGEETQGEAIITTGVGQHQMWAAQWYPYKETRRWISSGGLGSMGFGLPAALGAAVAFDGKNGRPKKTVVDIDGDGSFLMNVQELATIFIEKLDVKVMLLNNQHLGMVVQWEDRFYKANRAHTYLGKRESEWHATQDEEDIYPNFVNMAQAFGVPSRRVIVKEQLRGAIRTMLDTPGPYLLEVMVPHIEHVLPMIPGGASFKDIITEGDGTVKY

SEQ ID NO: 82476 - DNA, 2046 bp, Volvox carteri
  CDS (1)..(2046)
atggctttacgtttttgcccgacggctgcacctccgcgcggctgcggtactccgatacagcaccctgtcttgcttcttccgcataaggctttgcttccttattcaactgcggccagccgtcaggcagccaggcccgcccgtgtatgcgtgaccgcctacgctaagcttgcagatggatctgcccgacgcatgcaatctgaagaggtccggcgtgcgaaggaggtggcccaggctgcactggcgaaggagagtccagcggactgggttgatcgattcggctcggagccgcgcaaaggtgccgatatccttgtccagtgcctggaacgcgagggcgtggacaacgtgtttgcgtacccaggcggcgcctccatggagattcatcaggctctcactcgttcagaccgcattacaaatgtgctctgccgccatgagcagggtgaaatctttgctgcggagggttacgccaaggcttccggccgtgtgggcgtctgcattgcgacctcgggccctggcgccaccaacctggtaactggcctggccgatgccatgatggacagcattccacttgtggcgatcaccggccaggtgcctcggcggatgattggcacggacgctttccaggagaccccgattgtggaggttactcgcgccattactaagcataactatctggtgcttgacattaaggatctgcctcgcgttatcaaggaggccttttacctggcgcgcactggccggcccggtccagtgctggtcgacgtccctaaggatattcagcagcagctggctgtgccggactgggactcgcccatgtcaattaccggctacatcagccgccttccaccacctgtggaggagtcccaaatgataccggtgctccgtgccatccagtccgcctccaagcccgtaatctattatggtggtggttgcttagatgcacgggacgagctacgcgagttcgcagcccgcacaggcatcccgctggcgtccacatttatgggcctgggggttgtgccagcggaagaccccaaccatcttcaaatgttgggtatgcacggcaccgtggcggcaaactacgcggtggatcaggcggatctgctggtggccctcggtgtgcgcttcgatgaccgcgtcactggccgcctggacgccttcgcctcccgggcccgcattgtgcacgtcgatattgatgcggccgagatcagcaagaacaagaccgcacacgtgcccgtgtgcggcgacgtgaagcaggctttacgccacctcaaccggatgcttgaggcggaaccgctttcggaccgtttcgttgcctggcgcgcggaactggcggccaagcgagcagagtttccattgcgttacccgcagcgtgatgacgccattgtgccacagtacgctatacaggtcctgggtgaggagacaaagggcgaagtgatcatcaccactggcgtgggacagcaccagatgtgggcagcgcagtggtacccatacaaggagccgcgccggtggatttcctcgggtggcttgggctccatgggtttcggtctgccagcggccttgggtgcggcggtagccttcgacggcaagcaagggagagagaaacgcatcgtcgtagacatcgatggtgacggctctttcctcatgaatgtccaggagctggccactgtgttcatcgaaaagctcgacgtgaaggtcatgatcctcaacaaccagcatctgggcatggtcgtgcaatgggaggaccgcttctacaaggccaaccgagcgcacacctacttgggcaagcgcgaagccgagtggcatgcaactggtgacgaggaggatatctaccctaacttcgtgggcatggctcggtcattcggcgtgccgtcaatgcgtgtcatccgcaaggaagacctgcgcggggcaatccgtactatgctggatacgccagggccgtacttgctcgaggtgatggtgccccacattgagcacgtgctaccgatgatccctggcggggcgacctttaaagatattattacggagggcgacggttccgtgaaatactga

SEQ ID NO: 82477 - protein, 681 aa, Volvox carteri
MALRFCPTAAPPRGCGTPIQHPVLLLPHKALLPYSTAASRQAARPARVCVTAYAKLADGSARRMQSEEVRRAKEVAQAALAKESPADWVDRFGSEPRKGADILVQCLEREGVDNVFAYPGGASMEIHQALTRSDRITNVLCRHEQGEIFAAEGYAKASGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPKDIQQQLAVPDWDSPMSITGYISRLPPPVEESQMIPVLRAIQSASKPVIYYGGGCLDARDELREFAARTGIPLASTFMGLGVVPAEDPNHLQMLGMHGTVAANYAVDQADLLVALGVRFDDRVTGRLDAFASRARIVHVDIDAAEISKNKTAHVPVCGDVKQALRHLNRMLEAEPLSDRFVAWRAELAAKRAEFPLRYPQRDDAIVPQYAIQVLGEETKGEVIITTGVGQHQMWAAQWYPYKEPRRWISSGGLGSMGFGLPAALGAAVAFDGKQGREKRIVVDIDGDGSFLMNVQELATVFIEKLDVKVMILNNQHLGMVVQWEDRFYKANRAHTYLGKREAEWHATGDEEDIYPNFVGMARSFGVPSMRVIRKEDLRGAIRTMLDTPGPYLLEVMVPHIEHVLPMIPGGATFKDIITEGDGSVKY

SEQ ID NO: 82478 - DNA, 2046 bp, Volvox carteri
  CDS (1)..(2046)
atggctttacgtttttgcccgacggctgcacctccgcgcggctgcggtactccgatacagcaccctgtcttgcttcttccgcataaggctctgcttccttattcaactgcggccagccgtcaggcagccaggcccgcccgtgtatgcgtgaccgcctacgctaagcttgcagatggatctgcccgacgcatgcaatctgaagaggtccggcgtgcgaaggaggtggcccaggctgcactggcgaaggagagtccagcggactgggttgatcgattcggctcggagccgcgcaaaggtgccgatatccttatccagtgcctggaacgcgagggcgtggacaacgtgtttgcgtacccaggcggcgcctccatggagattcatcaggctctcactcgttcagaccgcattacaaatgtgctctgccgccatgagcagggtgaaatcttttctgcggagggttacgccaaggcttccggccgtgtgggcgtctgcattgcgacctcgggccctggcgccaccaacctggtaactagactggacgatgccatgatggacagcattacactaatagcgatcaccggccaggtgcctcggcggatgattggcacggacgctttccaggagaccccgattgtggaggttactcgcgccattactaagcataactatctggtgcttgacattaaggatctgcctcgcgttatcaaggaggccttttacctggcgcgcactggccggcccggtccagtgctggtcgacgtccctaaggatattcagcagcagctggctgtgccggactgggactcgcccatgtcaattaccggctacatcagccgccttccaccacctgtggaggagtacaaaatgataccggtgctccgtgccatccagtccgccaccaagccaataatatattatggtggtggttgcttagatgcacggaacgagctacgcgagttcgcagcccgaacaggcatcccgctggcgtccaaatttatgggcctgggggttgtgccagcggaagaccccaaccatcttcaaatgttgggtatgcacggcaccgtggcggcaaactacgcggtggatcaggcggatctgctggtggccctcggtgtgcgcttcgatgaccgcgtcactggccgcctggacgccttcgcctcccgggcccgcattgtgcacgtcgatattgatgcggccgagatcagcaagaacaagaccgcacacgtgcccgtgtgcggcgacgtgaagcaggctttacgccacctcaaccggatgcttgaggcggaaccgctttcggaccgtttcgttgcctggcgcgcggaactggcggccaagcgagcagagtttccattgcgttacccgcagcgtgatgacgccattgtgccacagtacgctatacaggtcctgggtgaggagacaaagggcgaagtgatcatcaccactggcgtgggacagcaccagatgtgggcagcgcagtggtacccatacaaggagccgcgccggtggatttcctcgggtggcttgggctccatgggtttcggtctgccagcggccttgggtgcggcggtagccttcgacggcaagcaagggagagagaaacgcatcgtcgtagacatcgatggtgacggctctttcctcatgaatgtccaggagctggccactgtgttcatcgaaaagctcgacgtgaaggtcatgatcctcaacaaccagcatctgggcatggtcgtgcaatgggaggaccgcttctacaaggccaaccgagcgcacacctacttgggcaagcgcgaagccgagtggcatgcaactggtgacgaggaggatatctaccctaacttcgtgggcatggctcggtcattcggcgtgccgtcaatgcgtgtcatccgcaaggaagacctgcgcggggcaaaccgtactatgctggatacgccagggccgtacttgctcgaggtgatggtgccccacattgagcacgtgctaccgatgatccctggcggggcgacctttaaagatattattacggagggcgacggttccgtgaaatactga

SEQ ID NO: 82479 - protein, 681 aa, Volvox carteri
MALRFCPTAAPPRGCGTPIQHPVLLLPHKALLPYSTAASRQAARPARVCVTAYAKLADGSARRMQSEEVRRAKEVAQAALAKESPADWVDRFGSEPRKGADILIQCLEREGVDNVFAYPGGASMEIHQALTRSDRITNVLCRHEQGEIFSAEGYAKASGRVGVCIATSGPGATNLVTRLDDAMMDSITLIAITGQVPRRMIGTDAFQETPIVEVTRAITKHNYLVLDIKDLPRVIKEAFYLARTGRPGPVLVDVPKDIQQQLAVPDWDSPMSITGYISRLPPPVEEYKMIPVLRAIQSATKPIIYYGGGCLDARNELREFAARTGIPLASKFMGLGVVPAEDPNHLQMLGMHGTVAANYAVDQADLLVALGVRFDDRVTGRLDAFASRARIVHVDIDAAEISKNKTAHVPVCGDVKQALRHLNRMLEAEPLSDRFVAWRAELAAKRAEFPLRYPQRDDAIVPQYAIQVLGEETKGEVIITTGVGQHQMWAAQWYPYKEPRRWISSGGLGSMGFGLPAALGAAVAFDGKQGREKRIVVDIDGDGSFLMNVQELATVFIEKLDVKVMILNNQHLGMVVQWEDRFYKANRAHTYLGKREAEWHATGDEEDIYPNFVGMARSFGVPSMRVIRKEDLRGANRTMLDTPGPYLLEVMVPHIEHVLPMIPGGATFKDIITEGDGSVKY

SEQ ID NO: 82480 - DNA, 2052 bp, Chlamydomonas reinhardtii
  CDS (1)..(2052)
atgaaggccctgcgaagtggaaccgctgtggcccggggccaagcgggctgtgtttctcccgctccgcgccctgtgcctatgtcgtctcagacgatgattccgagcaccagctccccagcaactcgtgcacccgcccggtccggtcgccgcgccctcgctgtgtcggccaagcttgctgatgggtcccgtcgcatgcagtccgaggaggtgcgccgcgccaaggaggtggcccaggctgcgctggccaaggacagccccgccgactgggtggaccgctacggctcggagccgcgcaagggcgccgacatcctggttcaggcgctggagcgcgagggcgtggacagcgtgttcgcctacccgggcggcgcctccatggagatccaccaggccctcacgcgctccgaccgcatcaccaacgtgctgtgccgccacgagcagggcgagatctttgccgccgagggctacgccaaggccgcgggccgcgtgggcgtgtgcatcgccacctcaggccccggcgccaccaacctggtcacggggctggcggacgccatgatggactccatccccctggtggccatcaccggccaggtgccgcgccgcatgatcggcaccgacgccttccaggagactcccattgtggaggtgactcgcgccatcaccaagcacaactacctggtgctggacatcaaggacctgccgcgtgtgatcaaggaggccttctacctggcgcgcaccggccggcccggtcctgtgctggtggacgtgcccacggacatccagcagcagctggcggtgccggactgggaggcgcccatgagcatcacgggctacatcagccgcctgcctccccccgtggaggagtcgcaggtgctgccggtcgtgcgcgcgctgcagggcgccgccaagcccgtcatctactacggcggcggctgcctggacgcgcaggcggagctgcgcgagttcgcggcgcgcaccggcatcccgctggccagcaccttcatggggctgggcgtggtgccgtccaccgaccccaaccacctccaaatgctgggcatgcacggcaccgtgttcgccaactacgcggtggaccaggccgacctgctggtggcgctgggcgtgcgcttcgacgaccgcgtcaccggcaagctggacgccttcgcggcgcgcgcgcgcatcgtgcacatcgacattgacgctgccgagatcagcaagaacaagaccgcgcacgtgccggtgtgtggcgacgtgaagcaggcgctcagccacctgaaccgcctgctggccgcggagccgctgcccgcagacaagtgggcgggctggcgcgccgagctggcggccaagcgcgccgagttccccatgcgctacccgcagcgcgacgacgccattgtgccgcagcacgccatccaggtgctgggcgaggagacgcagggcgaggccatcattaccacgggcgtgggccagcaccagatgtgggcggcgcagtggtacccctacaaggagacgcggcgctggatcagcagcggcggcctgggctccatgggctttggcctgccggcggcgctgggcgcggcggtggcgtttgatggcaagaacgggcggcccaagaagaccgtggtggacattgacggcgacggctctttcctcatgaacgtgcaggagctggccaccatcttcattgagaagctggacgtcaaggtgatgctgctcaacaaccagcacctgggcatggtggtgcagtgggaggacaggttctacaaggccaaccgcgcgcacacgtacctgggcaagcgcgagagcgagtggcacgccacgcaggacgaggaggacatctaccccaactttgtcaacatggcccaggcctttggcgtgccctcccgccgcgtcatcgtcaaggagcagctgcgcggcgccatccgcaccatgctggacacgcccgggccctacctgctggaggtgatggtgccgcacatcgagcacgtgctgcccatgatccccggcggcgccagcttcaaggacatcatcactgagggagacgggaccgtcaagtattga

SEQ ID NO: 82481 - protein, 683 aa, Chlamydomonas reinhardtii
MKALRSGTAVARGQAGCVSPAPRPVPMSSQTMIPSTSSPATRAPARSGRRALAVSAKLADGSRRMQSEEVRRAKEVAQAALAKDSPADWVDRYGSEPRKGADILVQALEREGVDSVFAYPGGASMEIHQALTRSDRITNVLCRHEQGEIFAAEGYAKAAGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPTDIQQQLAVPDWEAPMSITGYISRLPPPVEESQVLPVVRALQGAAKPVIYYGGGCLDAQAELREFAARTGIPLASTFMGLGVVPSTDPNHLQMLGMHGTVFANYAVDQADLLVALGVRFDDRVTGKLDAFAARARIVHIDIDAAEISKNKTAHVPVCGDVKQALSHLNRLLAAEPLPADKWAGWRAELAAKRAEFPMRYPQRDDAIVPQHAIQVLGEETQGEAIITTGVGQHQMWAAQWYPYKETRRWISSGGLGSMGFGLPAALGAAVAFDGKNGRPKKTVVDIDGDGSFLMNVQELATIFIEKLDVKVMLLNNQHLGMVVQWEDRFYKANRAHTYLGKRESEWHATQDEEDIYPNFVNMAQAFGVPSRRVIVKEQLRGAIRTMLDTPGPYLLEVMVPHIEHVLPMIPGGASFKDIITEGDGTVKY

SEQ ID NO: 82482 - DNA, 1764 bp, Porphyridium sp
  CDS (1)..(1764): transl_table=11
atgacacatatagaaaaatcaaattatcaagaacaaaccggggcttttgctttattagatagcttagtaagacacaaagttaaacatatttttggttaccctggcggagctatattgcctatatatgatgaattatataaatgggaagagcaaggatatataaagcatatattggttagacacgaacaaggtgctgcacatgctgcagatggttatgcaagagctaccggtgaagtaggtgtttgtttcgcaacttctggaccaggagccactaatttagtaacagggattgcaacagctcatatggattccatacctattgttataattactggccaggtaggtcgttctttcataggcactgatgcatttcaagaagttgatatttttggtattacgttaccaatagtaaaacactcgtatgtaattagggatcctcgagatatacctagaatagttgctgaagccttctctatagctaagcaggggaggcccggtccagttttaattgatgtgcctaaagatgtcggtcttgaaacattcgaatatcaatatgttaatcctggtgaagcaagaataccaggatttcgcgatctagttgctcccagctctagacaaatcattcattcaattcagttgatacaggaagctaatcagcctttactatacgtaggagggggtgcaataacttctggagctcatgacttaatttataaattagttaatcaatataaaatacctataactactacattaatgggtaaaggaattatcgatgaacaaaatcctttagctttgggtatgctaggcatgcatggtactgcttatgcaaattttgccgttagcgaatgtgatttattaataaccttaggagctcgattcgatgatagagtaacgggtaagctagatgaatttgcttgtaatgctaaagtgattcatgtcgatattgatcctgcagaagtaggaaaaaatagaattcctcaagttgccattgttggtgatattagtttagttttagaacaatggctattatatttagatagaaacttgcaattagatgatagccacttgcgttcatggcatgagcgtatatttaggtggcgccaagaatatccattaattgtacctaaattggttcaaacactgtcaccacaagaaattattgccaatattagtcaaattatgccagatgcatatttttctacagatgttggacagcatcaaatgtgggcagctcaatttgtcaaaacattacctcgaagatggctttctagttctggcttaggcacaatgggatatggcttacctgcagctataggcgccaaaatagcatatcctgaatcacctgtagtatgtattaccggtgattctagttttcaaatgaatattcaggagctaggtactatagcccaatataaattagacatcaaaattattattattaataataaatggcaaggcatggtaagacaatggcaacaagctttttacggagcacgttattctcattcacggatggaagatggagcacctaactttgtcgcattggctaaatctttcggtattgatggtcaatctataagtactaggcaagaaatggattctttatttaatactattataaagtacaaaggtcccatggtcatagactgtaaagtaatagaagatgaaaactgttatcctatggtagctcctggcaaaagcaacgcacagatgattggcttggataaatctaataatgaaataataaaaataaaagaataa

SEQ ID NO: 82483 - protein, 587 aa, Porphyridium sp
MTHIEKSNYQEQTGAFALLDSLVRHKVKHIFGYPGGAILPIYDELYKWEEQGYIKHILVRHEQGAAHAADGYARATGEVGVCFATSGPGATNLVTGIATAHMDSIPIVIITGQVGRSFIGTDAFQEVDIFGITLPIVKHSYVIRDPRDIPRIVAEAFSIAKQGRPGPVLIDVPKDVGLETFEYQYVNPGEARIPGFRDLVAPSSRQIIHSIQLIQEANQPLLYVGGGAITSGAHDLIYKLVNQYKIPITTTLMGKGIIDEQNPLALGMLGMHGTAYANFAVSECDLLITLGARFDDRVTGKLDEFACNAKVIHVDIDPAEVGKNRIPQVAIVGDISLVLEQWLLYLDRNLQLDDSHLRSWHERIFRWRQEYPLIVPKLVQTLSPQEIIANISQIMPDAYFSTDVGQHQMWAAQFVKTLPRRWLSSSGLGTMGYGLPAAIGAKIAYPESPVVCITGDSSFQMNIQELGTIAQYKLDIKIIIINNKWQGMVRQWQQAFYGARYSHSRMEDGAPNFVALAKSFGIDGQSISTRQEMDSLFNTIIKYKGPMVIDCKVIEDENCYPMVAPGKSNAQMIGLDKSNNEIIKIKE

SEQ ID NO: 82484 - DNA, 1686 bp, Citrobacter freundii
  CDS (1)..(1686): transl_table=11
atggcaagttcgggcacaacatcagaaaaaatgcgctttaccggcgcacagttagttattcatttactggaacgtccaggggattacgaccgttgcaggcatcccgggtcgtgctctatccttcccatctatgacgcattaagccaaagcacgcagattcgccacgttctggcgcgtcacgaacaaggcgcgggctttatcgctcaggggatggcgcgtactgagggcaaaccggcggtctgcatggcctgtagcggcccgggcgccaccaacctgatcaccgccatcgccgatgcgcgtctggactcgattccgttggtgtgcattaccggccaggttccggcatcgatgattgggaccgatgcgttccaggaagtcgacacctacggtatctctatccccatcaccaaacataactacctggtccgcgatattgctgaactgccgcaggtgatgagcgacgcctttcgcatcgcccagtccggccgcccgggtccggtgtggatagatattcctaaggatgtgcagacggcgaccatcgagctggaggtgttaccggagccgggtgcgcgcaccgcaccgccgacatttgacagcgccagcgtccacgacgcggcagccatgatcaatgcggctaagcgcccggtactttatctgggcggcggcgtgattaacgcgcctgagcaggtgcgttcgctggcggaaaaagcgaacttgcctaccacgatgaccctgatggcgctggggatgctgccgaaggcgcatgctgttgctgggatgctgggcatgcacggcgcgcgtagcactaactttattctgcaagaagcggatttactgattgttttaggtgcgcgttttgatgaccgggcgattggtaaaaccgagcagttctgcccgaacgcgaaaattattcacgtcgatatcgaccgttccgaactgggtaaaatcaagcagccgcacgtggcgattcaaggggatgtggctgacgttctggcgcatgacgccgcaggtcgccgccagtcgcgcgacgagtggcgccagctggtggcggacctgcagcgtgagtttccttccccgattccgcaggagagcgacccgctcacgcattatggcctgatcaacgccgttgccgcctgcgttaacgatgaagcgatcgtcaccactgacgttggtcaacatcagatgtgggttgcgcaggcttatccgctgaatcgcccgcgccaatggctgacttccggtgggctgggaaccatgggattcggtctgccggcagcggtcggtgcggcgctggcgaatccacagcgcaaagtcatctgcttctccggcgacggcagcctgatgatgaacattcaggagatggccaccgcggctgaaaaccagctggatgtgaaaatcatcctgatgaataacgaagcgctggggctggtctatcagcaacagagcctgttctatcagcagggggtatttgctgcgacctatcccggaatgattaattttatgcagattgccgctggctttggtctgcaaacctgcgatttaaatcacgaagccgacccgcaggcagcgctgcaggcgatcatcgatcgtcccggtccggcgctgattcatgtgcgtattgatgcggaagaaaaagtgtatccgatggttccgccgggagcggcaaatacagaaatggtgggggaataa

SEQ ID NO: 82485 - protein, 561 aa, Citrobacter freundii
MASSGTTSEKMRFTGAQLVIHLLERPGDYDRCRHPGSCSILPIYDALSQSTQIRHVLARHEQGAGFIAQGMARTEGKPAVCMACSGPGATNLITAIADARLDSIPLVCITGQVPASMIGTDAFQEVDTYGISIPITKHNYLVRDIAELPQVMSDAFRIAQSGRPGPVWIDIPKDVQTATIELEVLPEPGARTAPPTFDSASVHDAAAMINAAKRPVLYLGGGVINAPEQVRSLAEKANLPTTMTLMALGMLPKAHAVAGMLGMHGARSTNFILQEADLLIVLGARFDDRAIGKTEQFCPNAKIIHVDIDRSELGKIKQPHVAIQGDVADVLAHDAAGRRQSRDEWRQLVADLQREFPSPIPQESDPLTHYGLINAVAACVNDEAIVTTDVGQHQMWVAQAYPLNRPRQWLTSGGLGTMGFGLPAAVGAALANPQRKVICFSGDGSLMMNIQEMATAAENQLDVKIILMNNEALGLVYQQQSLFYQQGVFAATYPGMINFMQIAAGFGLQTCDLNHEADPQAALQAIIDRPGPALIHVRIDAEEKVYPMVPPGAANTEMVGE

SEQ ID NO: 82486 - DNA, 1800 bp, Brassica napus
  CDS (1)..(1800)
atgtcgcacctccttcccctgaaaaaaccgacaagaacaagactttcgtctcccgctacgcttcccgacgagccccgcaagggtgctgatatcctcgtcgaagccctcgagcgtcaaggcgtcgaaaccgtctttgcttatcccggaggtgcttccatggagatccaccaagccttgactcgctcctccaccatccgtaacgtccttccccgtcacgaacaaggaggagtcttcgccgccgagggttacgctcgttcctccggcaaaccgggaatctgcatagccacttcgggtcccggagctaccaacctcgtcagcgggttagcagacgcgatgcttgacagtgttcctcttgtcgccattacaggacaggtccctcgccggatgatcggtactgacgccttccaagagacaccaatcgttgaggtaacgaggtctattacgaaacataactatttggtgatggatgttgatgacatacctaggatcgttcaagaagctttctttctagctacttccggtagacccggaccggttttggttgatgttcctaaggatattcagcagcagcttgcgattcctaactgggatcaacctatgcgcttacctggctacatgtctaggttgcctcagcctccggaagtttctcagttaggtcagatcgttaggttgatctcggagtctaagaggcctgttttgtacgttggtggtggaagcttgaactcgagtgaagaactggggagatttgtcgagcttactgggatccccgttgcgagtactttgatggggcttggctcttatccttgtaacgatgagttgtccctgcagatgcttggcatgcacgggactgtgtatgctaactacgctgtggagcatagtgatttgttgctggcgtttggtgttaggtttgatgaccgtgtcacgggaaagctcgaggctttcgctagcagggctaaaattgtgcacatagacattgattctgctgagattgggaagaataagacacctcacgtgtctgtgtgtggtgatgtaaagctggctttgcaagggatgaacaaggttcttgagaaccgggcggaggagctcaagcttgatttcggtgtttggaggagtgagttgagcgagcagaaacagaagttccctttgagcttcaaaacgtttggagaagccattcctccgcagtacgcgattcagatcctcgacgagctaaccgaagggaaggcaattatcagtactggtgttggacagcatcagatgtgggcggcgcagttttacaagtacaggaagccgagacagtggctgtcgtcatcaggcctcggagctatgggttttggacttcctgctgcgattggagcgtctgtggcgaaccctgatgcgattgttgtggatattgacggtgatggaagcttcataatgaacgttcaagagctggccacaatccgtgtagagaatcttcctgtgaagatactcttgttaaacaaccagcatcttgggatggtcatgcaatgggaagatcggttctacaaagctaacagagctcacacttatctcggggacccggcaagggagaacgagatcttccctaacatgctgcagtttgcaggagcttgcgggattccagctgcgagagtgacgaagaaagaagaactccgagaagctattcagacaatgctggatacaccaggaccatacctgttggatgtgatatgtccgcaccaagaacatgtgttaccgatgatcccaagtggtggcactttcaaagatgtaataacagaaggggatggtcgcactaagtactga

SEQ ID NO: 82487 - protein, 599 aa, Brassica napus
MSHLLPLKKPTRTRLSSPATLPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLGQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKVLENRAEELKLDFGVWRSELSEQKQKFPLSFKTFGEAIPPQYAIQILDELTEGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARENEIFPNMLQFAGACGIPAARVTKKEELREAIQTMLDTPGPYLLDVICPHQEHVLPMIPSGGTFKDVITEGDGRTKY

SEQ ID NO: 82488 - DNA, 1998 bp, Amaranthus sp
  CDS (1)..(1998)
atggtcactctcaaccacatttcctcttttactaaacctaacaaaacgtatctgcaatcatccatttacgctatccctttttccaattctcttaaacccacttcttcttcttcaatcctcgccgccctcttcaaatctcatcatcttcttctacaatcacctaaacctaaacctccttccgctactataactcaatcaccttcgtctctcaccgatgataaaccctcttcttttgtttcccgatttagccctgaagaacccagaaaaggttgcgatgttctcgttgaagctcttgaacgtgaaggtgttaccgatgtttttgcttaccctggtggagcttccatggaaatccatcaagctcttactcgttctaatatcattagaaatgttcttcctcgacatgaacaaggtggggttttcgctgctcaaggctacgctcgtgctactggacgtgttggagtttgtattgccacttctggtccgggtgctactaatcttgtttccggttttgctgatgcacttcttgactcagtcccgcttgtcgccattactgggcaagttcctcggcgtatgattggtactgatgcttttcaagagacacctatagttgaggtaacacgatcaattactaagcataattatttggtgttagatgttgaggatatccctagaattgttaaggaagctttctttttagctaattctggtagacctggacctgttttgattgatattcctaaagatattcagcaacaattggttgttcctaactgggaacagcccattaaattgggtgggtatctttctaggttgcctaaacccactttttctgctaatgaagagggacttcttgatcaaattgtgaggttggtgggtgagtctaagagacctgtgctgtatactggaggtgggtgtttgaattctagtgaagaattaaggaaatttgtcgagttgacagggattcccgttgctagtactttaatggggttgggggctttcccttgtactgatgatttatcacttcaaatgttgggaatgcacgggactgtgtacgcgaattacgcggtggataaggctgatttgttgcttgctttcggggttaggtttgatgatcgagtgactgggaagctcgaggcgtttgctagccgggctaagattgtgcacatcgatatcgattctgctgaaatcgggaagaataagcaacctcatgtgtcgatttgtggtgaaattaaagttgcattacagggtttgaataagattttggaatctagaaaaggaaagctgaaattggatttctctaattggagggaggagttgaatgagcagaaaaagaagtttcctttgagttttaagtctttcggggacgcaattcctccgcaatatgccattcaggttctggacgagttgacgttgggtgatgcgattgtaagtaccggtgttgggcagcaccaaatgtgggctgcccaattctataagtaccgaaatcctcgccaatggctgacctcgggtggtttgggggctatggggtttggtctaccagcctgctatggagctgctgttgctcgaccagatgcggtggttgtagacattgatggggatgggagttttatcatgaatgttcaagagttggctacgattagggtagagaatctcccggttaaaatcatgctcttgaacaatcaacatttaggtatggttgttcaattggaagatcgattttacaaagctaaccgggcacatacttacctcgggaatccatccaattcttccgaaatcttcccggatatgcttaaatttgctgaagcatgtgatataccagcagcccgtgttaccaaggtgagcgatttaagggctgcaattcaaacaatgttggatacgccaggaccatatctgctggatgtaatcgtaccacatcaggagcatgtgctgcctatgatccctagcggtgccgccttcaaggacaccatcacagagggtgatggaagaagggcttattag

SEQ ID NO: 82489 - protein, 665 aa, Amaranthus sp
MVTLNHISSFTKPNKTYLQSSIYAIPFSNSLKPTSSSSILAALFKSHHLLLQSPKPKPPSATITQSPSSLTDDKPSSFVSRFSPEEPRKGCDVLVEALEREGVTDVFAYPGGASMEIHQALTRSNIIRNVLPRHEQGGVFAAQGYARATGRVGVCIATSGPGATNLVSGFADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTFSANEEGLLDQIVRLVGESKRPVLYTGGGCLNSSEELRKFVELTGIPVASTLMGLGAFPCTDDLSLQMLGMHGTVYANYAVDKADLLLAFGVRFDDRVTGKLEAFASRAKIVHIDIDSAEIGKNKQPHVSICGEIKVALQGLNKILESRKGKLKLDFSNWREELNEQKKKFPLSFKSFGDAIPPQYAIQVLDELTLGDAIVSTGVGQHQMWAAQFYKYRNPRQWLTSGGLGAMGFGLPACYGAAVARPDAVVVDIDGDGSFIMNVQELATIRVENLPVKIMLLNNQHLGMVVQLEDRFYKANRAHTYLGNPSNSSEIFPDMLKFAEACDIPAARVTKVSDLRAAIQTMLDTPGPYLLDVIVPHQEHVLPMIPSGAAFKDTITEGDGRRAY

SEQ ID NO: 82490 - DNA, 1947 bp, Xanthium sp
  CDS (1)..(1947)
atggcggccatccctcatacaaacccttccatcaccaccaaaccaccctcatctccaccacgtcccaccttcctcgcccgtttcacattcccaataacctccacttcccataaacgacaccgtctccacatctccaacgtcctctccgactccaaacccaccatcacccattcaccattaccaaccgaatcatttatctcccgttacgctccagaccaaccaagaaaaggcgctgatgttctcgtcgaagctctggaacgtgaaggcgttacagacgtcttcgcttacccaggtggtgcctccatggagatccaccaagctctcacgcgctcaaccaccatccgcaacgttctcccacgtcacgaacagggcggcgtctttgctgccgaaggctacgcacgtgcctccggtcttcccggcgtctgtattgcaacctctggtcctggagctacgaacctagtaagtggtcttgctgatgctttattagacagtgttccaatggttgctattactggtcaagttcccaggagaatgattggaacagatgcgtttcaagaaacccctattgttgaggtaacacgttccattactaagcataattatttagttttggatgtcgaggatattcccaggattgttagggaagctttttatcttgcgtcttctggtcgacccggaccggttttaattgatgtacctaaggatatacagcagcagttggtagtgcctaaatgggatgagcctattaggttacctgggtatttgtctaggttgcctaaaacggagaataatgggcagttggaacacattgttaggttggtgagtgaggccaagaggccggttttgtatgtggggggtgggtgtttgaattcgggagatgagttgaggcggtttgtggagcttacggggataccggttgcgagtacgttgatggggcttggagcgtaccctgcttctagtgatttgtcgctgcatatgcttgggatgcatgggacggtttatgcgaattatgcggttgataagagtgatttgttgcttgcgtttggggtaaggtttgatgaccgtgtgacggggaagcttgaggcttttgctagcagagctaagattgttcatattgatattgattctgcggaaattgggaagaataagcagcctcatgtgtcgatttgtggtgatatcaaggtcgcgttacagggtctgaacaagattttggaggtaaagaattcggtgactaatcttgatttctcgaactggaggaaggaattggatgagcaaaaggttaagtatccgttgagttttaaaacatttggcgaagctattcctccgcagtatgccattcaagtgcttgatgagttaacgggtgggaatgcgattattagcactggggtcgggcagcatcagatgtgggctgctcagttttacaaatacaacaagcctagacaatggctgacgtcaggtggactaggcgcgatgggttttgggttgcccgctgctatcggggcggctgttgcaagacctgatgcggtagtagttgatatcgatggtgatggaagctttataatgagcgttcaagagttagccacaatccgtgttgaaaatcttcctgttaagattttgttacttaacaatcagcatttgggtatggtggttcagttggaggatcggttttacaaggcgaatcgggctcatacctacttaggaaatccgtcaaaagagtctgaaatattccctaacatgttgaagtttgctgaagcgtgtgatatcccagctgcccgagtgacccggaaggcagatctacgagcagctattcagaagatgttggatacaccggggccttacttgttggatgtgatcgtgccccatcaagaacatgtgttgcccatgatcccggctggtggaggtttcatggatgtgatcaccgaaggcgacggcagaatgaaatattga

SEQ ID NO: 82491 - protein, 648 aa, Xanthium sp
MAAIPHTNPSITTKPPSSPPRPTFLARFTFPITSTSHKRHRLHISNVLSDSKPTITHSPLPTESFISRYAPDQPRKGADVLVEALEREGVTDVFAYPGGASMEIHQALTRSTTIRNVLPRHEQGGVFAAEGYARASGLPGVCIATSGPGATNLVSGLADALLDSVPMVAITGQVPRRMIGTDAFQETPIVEVTRSITKHNYLVLDVEDIPRIVREAFYLASSGRPGPVLIDVPKDIQQQLVVPKWDEPIRLPGYLSRLPKTENNGQLEHIVRLVSEAKRPVLYVGGGCLNSGDELRRFVELTGIPVASTLMGLGAYPASSDLSLHMLGMHGTVYANYAVDKSDLLLAFGVRFDDRVTGKLEAFASRAKIVHIDIDSAEIGKNKQPHVSICGDIKVALQGLNKILEVKNSVTNLDFSNWRKELDEQKVKYPLSFKTFGEAIPPQYAIQVLDELTGGNAIISTGVGQHQMWAAQFYKYNKPRQWLTSGGLGAMGFGLPAAIGAAVARPDAVVVDIDGDGSFIMSVQELATIRVENLPVKILLLNNQHLGMVVQLEDRFYKANRAHTYLGNPSKESEIFPNMLKFAEACDIPAARVTRKADLRAAIQKMLDTPGPYLLDVIVPHQEHVLPMIPAGGGFMDVITEGDGRMKY

SEQ ID NO: 82492 - DNA, 1947 bp, Xanthium sp
  CDS (1)..(1947)
atggcggccatccctcatacaaacccttccatcaccaccaaaccaccctcatctccaccacgtcccaccttcctcgcccgtttcacattcccaataacctccacttcccataaacgacaccgtctccacatctccaacgtcctctccgactccaaacccaccatcacccattcaccattaccaaccaaatcatttatctcccgttacgctccagaccaaccaagaaaaggcgctgatgttctcgtcgaagctctggaacgtgaaggcgttacagacgtcttcgcttacccaggtggtgcctccatggagatccaccaagctctcacgcgctcaaccaccatccgcaacgttctcccacgtcacgaacagggcggcgtctttgctgccgaaggctacgcacgtgcctccggtcttcccggcgtctgtattgcaacctctggtcctggagctacgaacctagtaagtggtcttgctgatgctttattagacagtgttccaatggttgctattactggtcaagttcccaggagaatgattggaacagatgcgtttcaagaaacccctattgttgaggtaacacgttccattactaagcataattatttagttttggatgtcgaggatattcccaggattgttagggaagctttttatcttgcgtcttctggtcgacccggaccggttttaattgatgtacctaaggatatacagcagcagttggtagtgcctaaatgggatgagcctattaggttacctgggtatttgtctaggttccctaaaacggagaataatgggcagttggaacagattgttaggttggtgagtgaggccaagaggccggttttgtatgtggggggtgggtgtttgaattcgggagatgagttgaggcggtttgtggagcttacggggataccggttgcgagtacgttgatggggcttggagcgtaccctgcttctagtgatttgtcgctgcatatgcttgggatgcatgggaccgtttatgcgaattatgcggttgataagagtgatttgttgcttgcgtttggggtaaggtttgatgaccgtgtgacggggaagcttgaggcttttgctagcagagctaagattgttcatattgatattgattctgcggaaattgggaagaataagcagcctcatgtgtcgatttgtggtgatattaaggtcgcgttacagggtctgaacaagattttggaggtaaagaattcggtgactaatcttgatttctcgaactggaggaaggaattggatgagcaaaaggttaagtatccgttgagttttaaaacatttggcgaagctattcctccgcagtatgccattcaagtgcttgatgagttaacgggtgggaatgcgattattagcactggggtcgggcagcatcagatgtgggctgctcagttttacaaatacaacaagcctagacaatggctgacgtcaggtggactaggggcgatgggttttgggttgcccgctgctatcggggccgctgttgcaagacctgatgcggtagtagttgatatcgatggtgatggaagctttataatgaacgttcaagagttagccacaatccgtgttgaaaatcttcctgttaagattttgttacttaacaatcagcatttgggtatggtggttcagtgggaggatcggttttacaaggcgaatcgggctcatacctacttaggaaatccgtcaaaagagtctgaaatattccctaacatgttgaagtttgctgaagcgtgtgatatcccagctgcccgagtgacccggaaggcagatctacgagcagctattcagaagatgttggatacaccggggccttacttgttggatgtgatcgtgccccatcaagaacatgtgttgcccatgatcccggctggtggaggtttcatggatgtgatcaccgaaggcgacggcagaatgaaatattga

SEQ ID NO: 82493 - protein, 648 aa, Xanthium sp
MAAIPHTNPSITTKPPSSPPRPTFLARFTFPITSTSHKRHRLHISNVLSDSKPTITHSPLPTKSFISRYAPDQPRKGADVLVEALEREGVTDVFAYPGGASMEIHQALTRSTTIRNVLPRHEQGGVFAAEGYARASGLPGVCIATSGPGATNLVSGLADALLDSVPMVAITGQVPRRMIGTDAFQETPIVEVTRSITKHNYLVLDVEDIPRIVREAFYLASSGRPGPVLIDVPKDIQQQLVVPKWDEPIRLPGYLSRFPKTENNGQLEQIVRLVSEAKRPVLYVGGGCLNSGDELRRFVELTGIPVASTLMGLGAYPASSDLSLHMLGMHGTVYANYAVDKSDLLLAFGVRFDDRVTGKLEAFASRAKIVHIDIDSAEIGKNKQPHVSICGDIKVALQGLNKILEVKNSVTNLDFSNWRKELDEQKVKYPLSFKTFGEAIPPQYAIQVLDELTGGNAIISTGVGQHQMWAAQFYKYNKPRQWLTSGGLGAMGFGLPAAIGAAVARPDAVVVDIDGDGSFIMNVQELATIRVENLPVKILLLNNQHLGMVVQWEDRFYKANRAHTYLGNPSKESEIFPNMLKFAEACDIPAARVTRKADLRAAIQKMLDTPGPYLLDVIVPHQEHVLPMIPAGGGFMDVITEGDGRMKY

SEQ ID NO: 82494 - DNA, 1917 bp, Zea mays
  CDS (1)..(1917)
atggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactga

SEQ ID NO: 82495 - protein, 638 aa, Zea mays
MATAAAASTALTGATTAAPKARRRAHLLATRRALAAPIRCSAASPAMPMAPPATPLRPWGPTDPRKGADILVESLERCGVRDVFAYPGGASMEIHQALTRSPVIANHLFRHEQGEAFAASGYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFASRAKIVHVDIDPAEIGKNKQPHVSICADVKLALQGMNALLEGSTSKKSFDFGSWNDELDQQKREFPLGYKTSNEEIQPQYAIQVLDELTKGEAIIGTGVGQHQMWAAQYYTYKRPRQWLSSAGLGAMGFGLPAAAGASVANPGVTVVDIDGDGSFLMNVQELAMIRIENLPVKVFVLNNQHLGMVVQWEDRFYKANRAHTYLGNPENESEIYPDFVTIAKGFNIPAVRVTKKNEVRAAIKKMLETPGPYLLDIIVPHQEHVLPMIPSGGAFKDMILDGDGRTVY

SEQ ID NO: 82496 - DNA, 1917 bp, Zea mays
  CDS (1)..(1917)
atggccaccgccgccaccgccgccgccgcgctcaccggcgccactaccgctacgcccaagtcgaggcgccgagcccaccacttggccacccggcgcgccctcgccgcgcccatcaggtgctcagcgttgtcacgcgccacgccgacggctcccccggccactccgctacgtccgtggggccccaacgagccccgcaagggctccgacatcctcgtcgaggctctcgagcgctgtggcgtccgtgacgtcttcgcctaccccggcggcgcatccatggagatccaccaggcactcacccgctcccccgtcatcgccaaccacctcttccgccacgaacaaggggaggccttcgccgcctccgcgtacgcgcgctcctcgggccgcgttggcgtctgcatcgccacctccggccccggcgccaccaacctagtctctgcgctcgcagacgcgttgctcgactccgtccccatggtcgccatcacgggacaggtgccgcgacgcatgattggcaccgacgcctttcaggagacgcccatcgtcgaggtcacccgctccatcaccaagcacaactacctggtcctcgacgtcgacgacatcccccgcgtcgtgcaggaggccttcttcctcgcatcctctggtcgcccggggccggtgcttgttgacatccccaaggacatccagcagcagatggcggtgccggcctgggacacgcccatgagtctgcctgggtacatcgcgcgccttcccaagcctcccgcgactgaatttcttgagcaggtgctgcgtcttgttggtgaatcacggcgccctgttctttatgttggcggtggctgtgcagcatcaggtgaggagttgtgccgctttgtggagttgactggaatcccagtcacaactactcttatgggccttggcaacttccccagcgacgacccactgtcactgcgcatgcttggtatgcatggcacagtgtatgcaaattatgcagtggataaggccgatctgttgcttgcatttggtgtgcggtttgatgatcgtgtgacagggaaaattgaggcttttgcaggcagagctaagattgtgcacattgatattgatcctgctgagattggcaagaacaagcagccacatgtgtccatctgtgcagatgttaagcttgctttgcagggcatgaatactcttctggaaggaagcacatcaaagaagagctttgacttcggctcatggcatgatgaattggatcagcaaaagagggagtttccccttggatataaaatcttcaatgaggaaatccagccacaatatgctattcaggttcttgatgagttgacgaagggggaggccatcattgccacaggtgttgggcagcaccagatgtgggcggcacagtattacacttacaagcggccaaggcagtggctgtcttcagctggtcttggggctatgggatttggtttgccggctgctgctggtgctgctgtggccaacccaggtgtcactgttgttgacatcgacggagatggtagcttcctcatgaacattcaggagctagctatgatccgtattgagaacctcccagtcaaggtctttgtgctaaacaaccagcacctcgggatggtggtgcagtgggaggacaggttctataaggccaatagagcacacacattcttgggaaacccagagaacgaaagtgagatatatccagattttgtggcaattgctaaagggttcaacattccagcagtccgtgtgacaaagaagagcgaagtccatgcagcaatcaagaagatgcttgaggctccagggccgtacctcttggatataatcgtcccgcaccaggagcatgtgttgcctatgatccctagtggtggggctttcaaggatatgatcctggatggtgatggcaggactgtgtattga

SEQ ID NO: 82497 - protein, 638 aa, Zea mays
MATAATAAAALTGATTATPKSRRRAHHLATRRALAAPIRCSALSRATPTAPPATPLRPWGPNEPRKGSDILVEALERCGVRDVFAYPGGASMEIHQALTRSPVIANHLFRHEQGEAFAASAYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPAWDTPMSLPGYIARLPKPPATEFLEQVLRLVGESRRPVLYVGGGCAASGEELCRFVELTGIPVTTTLMGLGNFPSDDPLSLRMLGMHGTVYANYAVDKADLLLAFGVRFDDRVTGKIEAFAGRAKIVHIDIDPAEIGKNKQPHVSICADVKLALQGMNTLLEGSTSKKSFDFGSWHDELDQQKREFPLGYKIFNEEIQPQYAIQVLDELTKGEAIIATGVGQHQMWAAQYYTYKRPRQWLSSAGLGAMGFGLPAAAGAAVANPGVTVVDIDGDGSFLMNIQELAMIRIENLPVKVFVLNNQHLGMVVQWEDRFYKANRAHTFLGNPENESEIYPDFVAIAKGFNIPAVRVTKKSEVHAAIKKMLEAPGPYLLDIIVPHQEHVLPMIPSGGAFKDMILDGDGRTVY

SEQ ID NO: 82498 - DNA, 1980 bp, Gossypium hirsutum
  CDS (1)..(1980)
atggcggctgccactgcgaactccgctttgcctaagctttctacgttaacttcctccttcaaatcttccatacccatttccaaatccagccttcccttctccacaacccctcaaaagcccaccccttaccgctccttcgacgtttcctgctctctttctcatgcaagctctaaccccagatccgccgccacatccgttaccccaaaaaatgctcctccccatgatttcatttccaggtatgcggatgatgagccccggaaaggcgctgatatcctggtggaagccctggttcgtgaaggggtcaaggatgtgtttgcctacccaggtggagcttcaatggagatccaccaggctttaacccgctcaaaaatcatccgaaatgtccttccgcgacacgagcaaggtggggtctttgccgccgagggctacgcgcgctcctctggcattcccggcgtttgcattgcgacgtctggccctggggcaaccaacttggtgagtggtctcgctgatgcaatgctcgatagtatccctctcgtggcgatcactggtcaagtccctcgtcggatgatcggtaccgatgctttccaggaaactccaattgttgaggtaacaaggtctattacgaagcataattatcttgttcttgatgtggatgatattcctaggattgttagtgaggctttctttttagcttcctcgggcaggccgggacctgttctgattgatgttcctaaggatatacaacagcaacttgctgttcctaaatggaaccattctcttagattgccagggtatttgtctaggttgcctaaggctcccggtgaggctcatctcgaacagattgttagattggtttctgagtctaagaagcctgttttatatgttggtggtgggtgtttgaactctagtgaggagttgaagaggtttgttgagcttacagggatacctgttgcaagtactttgatgggtcttggagcctttccgatttcggatgacttgtcgttacaaatgcttgggatgcacggaactgtgtatgccaattatgctgttgataagagtgatttgttgcttgcttttggagtgagatttgatgatagggtgacgggaaaacttgaggcttttgccagccgggcaaagattgtgcatatcgatatcgattctgccgagattgggaagaacaagcagcctcatgtgtcagtgtgttccgatgtgaaattggcattgcaggggataaataagatattggagaccaaggtagcaaagctgaatcttgattattcggaatggaggcaggagttaaacgagcagaagctgaaattccctttgagttacaagacctttggtgaagctattccacctcaatatgcaattcaggttcttgatgaattaactggcgggaatgcaattataagtactggtgttggtcagcatcaaatgtgggctgctcaattttacaagtataagaagcctcgtcaatggttaacatctgggggattgggtgctatgggatttggattgcctgctgctattggagctgccgttgcaaacccagaggcagtcgttgtagacatcgatggtgatggaagttttatcatgaacgtgcaagagttggcgactatccgtgtggaaaatcttccggttaagatattattgttgaataatcagcatttgggtatggttgttcaatgggaggaccggttttacaaggcaaacagggctcatacatacttgggagacccatccaacgagtcggaaatattcccaaatatgttgaaatttgctgaagcatgcgggataccagctgcccgggtgacaaagaaagaagatctaaaagcagcaatgcagaaaatgttggacactcctggaccttacttgttggatgtgattgtcccacatcaagaacatgtcctgcctatgatccccagtggaggggctttcaaagatgtgatcacagagggtgatggaagaacacaatattga

SEQ ID NO: 82499 - protein, 659 aa, Gossypium hirsutum
MAAATANSALPKLSTLTSSFKSSIPISKSSLPFSTTPQKPTPYRSFDVSCSLSHASSNPRSAATSVTPKNAPPHDFISRYADDEPRKGADILVEALVREGVKDVFAYPGGASMEIHQALTRSKIIRNVLPRHEQGGVFAAEGYARSSGIPGVCIATSGPGATNLVSGLADAMLDSIPLVAITGQVPRRMIGTDAFQETPIVEVTRSITKHNYLVLDVDDIPRIVSEAFFLASSGRPGPVLIDVPKDIQQQLAVPKWNHSLRLPGYLSRLPKAPGEAHLEQIVRLVSESKKPVLYVGGGCLNSSEELKRFVELTGIPVASTLMGLGAFPISDDLSLQMLGMHGTVYANYAVDKSDLLLAFGVRFDDRVTGKLEAFASRAKIVHIDIDSAEIGKNKQPHVSVCSDVKLALQGINKILETKVAKLNLDYSEWRQELNEQKLKFPLSYKTFGEAIPPQYAIQVLDELTGGNAIISTGVGQHQMWAAQFYKYKKPRQWLTSGGLGAMGFGLPAAIGAAVANPEAVVVDIDGDGSFIMNVQELATIRVENLPVKILLLNNQHLGMVVQWEDRFYKANRAHTYLGDPSNESEIFPNMLKFAEACGIPAARVTKKEDLKAAMQKMLDTPGPYLLDVIVPHQEHVLPMIPSGGAFKDVITEGDGRTQY

SEQ ID NO: 82500 - DNA, 1941 bp, Helianthus annuus
  CDS (1)..(1941)
atggcagtccccctcactttcatctccggcaaaccaccattctccgccacaccatcacagttaactaccaatctttcactcccactcactcttctacccatcatcccttcaaagactcatgtttctaaacacctcataataaccaatgctattgctaaacattcacattcacataaagcttttgtggtctcgaggttcggtcctgacgaaccaaggaaaggatctgatgtcctagtggaagcactagagcgcgaaggggtaacgaacgtctttgcgtatccaggtggcgccaccttggagatccaccaagcgctaacacgatcaaccatcatacgcaacatcctccctcgccatgagcaaggcggtgtgtttgctgcagagggttacgcacgcgcctctggtttaaccggcgtatgcatatctacttccggtccaggcgctacaaacttggtcagtggccttgccgacgcccttcttgatagcgtcccaatcgtcgccattactggacaagtccctcgtaacatgattggtactgatgctttccaagaaacacccattgttgaggtttcacgctccattactaaacataactacctagttttgaatgtacaagatatcccacgtatagttcatgaagctttctttcttgcctcgtctggtcggcccggcccggttttaatcgacatcccaaaagacatacaacaacagttggttgttcccaattgggatgaacaacaacaacctatgaggttagatggttacatctccaggttaccaaagcctccaaacgagacgcatttacgacaaattgtacgcttcataaaggaatcgaagaggccggttttgtatgtgggtgggggttgtatgaactcgagtgatgaactgggtcgttttgtagagcttaccgggattccagtggcgaatactttgatgggacttggaacataccccgggtcgcatgatttgtcgcttcatatgctagggatgcatggcacggtttatgcgaattatgcgattgataaaagcgacttgttgttggcgtttggcgtccggtttgatgaccgtgtgacgggaaagattgaagcgtttgcgagtcgagcaaagattgttcatatcgatattgatcctgccgagatagggaagaataagcagcctcatttttcgatttgtggggatatcaaggcggctttacaaggactaaacaagattttggaaagaggtgaagatcttgatttcgatttctcaccttggaaggaggaagtaatgaatcagaaagcgagtaacccgttgagttataaaacgtttggggacgcgattccacctcagtatgcgatccaagtgctgaatgaagtgacgggtgggaacgcgatcataacgactggggtggggcagcatcaaatgtggtcagcccagttttacaagtacaataggcctaggcaatggctaacttcggctgggctaggtgctatggggttcgggctgcctgcagctatcggggcggctgttgcacgaccagatgcagtcgtggttgacatcgacggtgatggaagttttatgatgaatgttcaagaattggcgaccattcgtgtagagaatcttcctgttaaaatgatggtgcttaataaccaacacttgggtatggtggttcagtgggaagaccgtttttataaggcgaaccgcgcgcacacctacttaggaaacccgacaaacgaatcgggtatattcccaaatatgttgaagtttgctgaagcgtgtgacatccccgctgcgcgagtaaccaaaaagggagatgttagaaccgcgattcagaaaatgttggatacacccgggccttacttattggatgttatcgttccacatcaagaacatgttttacccatgatcccagccggagggggttttaacgatatcataactgacggcgatggcagaacacaatag

SEQ ID NO: 82501 - protein, 646 aa, Helianthus annuus
MAVPLTFISGKPPFSATPSQLTTNLSLPLTLLPIIPSKTHVSKHLIITNAIAKHSHSHKAFVVSRFGPDEPRKGSDVLVEALEREGVTNVFAYPGGATLEIHQALTRSTIIRNILPRHEQGGVFAAEGYARASGLTGVCISTSGPGATNLVSGLADALLDSVPIVAITGQVPRNMIGTDAFQETPIVEVSRSITKHNYLVLNVQDIPRIVHEAFFLASSGRPGPVLIDIPKDIQQQLVVPNWDEQQQPMRLDGYISRLPKPPNETHLRQIVRFIKESKRPVLYVGGGCMNSSDELGRFVELTGIPVANTLMGLGTYPGSHDLSLHMLGMHGTVYANYAIDKSDLLLAFGVRFDDRVTGKIEAFASRAKIVHIDIDPAEIGKNKQPHFSICGDIKAALQGLNKILERGEDLDFDFSPWKEEVMNQKASNPLSYKTFGDAIPPQYAIQVLNEVTGGNAIITTGVGQHQMWSAQFYKYNRPRQWLTSAGLGAMGFGLPAAIGAAVARPDAVVVDIDGDGSFMMNVQELATIRVENLPVKMMVLNNQHLGMVVQWEDRFYKANRAHTYLGNPTNESGIFPNMLKFAEACDIPAARVTKKGDVRTAIQKMLDTPGPYLLDVIVPHQEHVLPMIPAGGGFNDIITDGDGRTQ

SEQ ID NO: 82502 - DNA, 1947 bp, Helianthus annuus
  CDS (1)..(1947)
atggccgccatacatcctccccacccttccatcaccgccaaaccaccgccatcttccgccgccgccgtcgcactaccaccccacttcgcattctccatcacctccacttcccacaaacgccaccgcctccacatctccaacgtcctctccgactccaccaccaccaccggtgccaccaccgccaccattcacccaccgccattcgtctcccggtacgcgccagatcaaccgagaaaaggcgcagacgtgctcgtggaagctctagaacgggaaggtgtcaccgacgtcttcgcctaccccggcggcgcgtcaatggagatccaccaagctctcacgcgctcaaacaccatccgcaatgtcctcccccgtcacgaacagggcggcgtgttcgccgccgaaggctacgcacgtgcctccggtgttcccggcgtctgtatcgccacttccggtcccggagctacaaacctagttagtggtcttgctgacgcgctgttagacagtgtccccatggtggcaatcaccggtcaagttccccggagaatgatcggaaccgatgcgtttcaagaaaccccaattgttgaggtaacacgttcgattactaaacataattatcttgtgttggatgttgaggatattcccagaattgttagggaggctttttatcttgcgagttcgggtcgacccggcccagttttgatagatgtacctaaggatatacagcaacagttagtggtgccgaaatgggatgaaccgatgaggttaccgggttatttgtctagaatgccgaagcctcaatatgatgggcatttggaacagattgttaggttggtgggggaagcaaagaggcccgttttgtatgtgggtggtgggtgtttgaattcggatgacgagttgaggcggtttgtggagcttacggggattccggttgcgagtactttgatggggcttggagcgtacccggcttcgagtgatttgtcgcttcatatgcttgggatgcatggcacggtttatgcgaattatgcggttgataagagtgatttgttgcttgcgtttggtgtgcggtttgatgatcgtgtgacggggaagcttgaggcgtttgctagtagggcgaagattgttcatattgatattgatccggctgaaattgggaagaataaacagcctcatgtgtcgatttgtggggatatcaaggtcgcgttacagggtttgaacaagattttggaggagaaaaattctcttgatttttcaaattggaggaaggaattagatgaacaaaaagtgaaattcccgttgagctttaaaacgtttggcgaagcgattcctccacagtatgctattcatgtgctcgatgagttaacgggtgggaatgcaattattagcaccggtgtcgggcagcatcagatgtgggctgcccagttttacaaatacaacaaaccgagacaatggctgacgtcgggcgggctaggggcaatgggtttcgggctgcccgctgctatcggggcggccgttgcaagacccgatgcggtagtagttgatatcgacggtgatggaagctttatgatgaacgttcaagagttagccacaatccgtgttgaaaatctgccggttaagattttattacttaacaaccagcatttgggtatggtggttcagtgggaggatcggttttacaaggcgaatcgggctcatacctacttaggaaacccgtcaaaagagtcggaaatattcccgaacatgttgaagtttgctgaagcttgtgatattccagctgcgagagtaacccgaaagggggatctacgagcggctattcagaagatgttggatacaccggggccttacttgttggatgtcattgttccacatcaagaacacgtgttgcccatgatcccggctgggggaggtttctcggatgtgatcaccgagggtgatggcagaatgaaatattga

SEQ ID NO: 82503 - protein, 648 aa, Helianthus annuus
MAAIHPPHPSITAKPPPSSAAAVALPPHFAFSITSTSHKRHRLHISNVLSDSTTTTGATTATIHPPPFVSRYAPDQPRKGADVLVEALEREGVTDVFAYPGGASMEIHQALTRSNTIRNVLPRHEQGGVFAAEGYARASGVPGVCIATSGPGATNLVSGLADALLDSVPMVAITGQVPRRMIGTDAFQETPIVEVTRSITKHNYLVLDVEDIPRIVREAFYLASSGRPGPVLIDVPKDIQQQLVVPKWDEPMRLPGYLSRMPKPQYDGHLEQIVRLVGEAKRPVLYVGGGCLNSDDELRRFVELTGIPVASTLMGLGAYPASSDLSLHMLGMHGTVYANYAVDKSDLLLAFGVRFDDRVTGKLEAFASRAKIVHIDIDPAEIGKNKQPHVSICGDIKVALQGLNKILEEKNSLDFSNWRKELDEQKVKFPLSFKTFGEAIPPQYAIHVLDELTGGNAIISTGVGQHQMWAAQFYKYNKPRQWLTSGGLGAMGFGLPAAIGAAVARPDAVVVDIDGDGSFMMNVQELATIRVENLPVKILLLNNQHLGMVVQWEDRFYKANRAHTYLGNPSKESEIFPNMLKFAEACDIPAARVTRKGDLRAAIQKMLDTPGPYLLDVIVPHQEHVLPMIPAGGGFSDVITEGDGRMKY

SEQ ID NO: 82504 - DNA, 1968 bp, Helianthus annuus
  CDS (1)..(1968)
atggcggctcctcccaacccttccatctccttcaaaccaccgtcacccgccgccgcactgccaccacgctccgccttcctcccccgtttcgcattacccatcacttccactacccaaaaacgacaccgtcttcacatctccaatgttctctccgactccaaatccaccaccaccaccaccaccaccactcaacgaccgttaccggtgcagccttttgtctcccgttacgcgccagatcaaccgagaaaaggcgcagacgtgttggtggaagctctggaacgggaaggtgtcaccgacgtcttcgcctaccccggcggcgcgtcaatggagatccaccaagctctcacgcgctcaagcactatccgcaatgtgctcccccgtcacgaacagggcggcgtgttcgccgccgaaggctacgcgcgcgcctccggtcttcccggcgtgtgtatcgccacttccggtcccggagctacgaacctagttagtggtcttgctgacgcgctgttagacagtgtccccatggtggcaatcaccggtcaagttccccggagaatgatcggaaccgatgcgtttcaagaaaccccaattgttgaggtaacacgttcgatcactaaacataattatcttgtgttggatgttgaggatattcccagaattgttcgtgaggctttttatcttgcgagttcgggtcgacccggcccggttttgatagatgtaccgaaagatatacagcaacagttagtggtgccgaaatgggatgaaccgatgaggttaccgggttatttgtctagaatgccgaagcctcaatatgatgggcatttggaacagattgttaggttggtgggggaagcgaagaggccggttttgtatgtgggtggtgggtgtttgaattcggatgatgagttgaggcggtttgtggagcttacggggattccggttgcgagtactttgatggggctcggagcgtaccctgcttcgagtgatttgtcgcttcatatgcttgggatgcatggtacggtttatgcgaattatgcggttgataagagtgatttgttgcttgcgtttggggtgcggtttgatgatcgtgtgacggggaagcttgaggcgtttgctagtagggcgaagattgttcatattgatattgatcctgctgaaattgggaagaataagcagcctcatgtgtcgatttgtggtgatattaaggtcgcgttacagggtttgaacaagattttggaggaaaagaattcggtgactaatcttgatttttcgacctggagaaaggaattggatgaacaaaaaatgaagttcccgttgagctttaaaacgtttggcgaagcgattcctccacagtatgctattcaagttcttgatgagttaacgggcgggaatgcaattattagcaccggtgtcgggcaacatcagatgtgggctgctcagttttacaaatacaacaaacctagacaatggctgacgtcgggcgggctaggggcaatgggtttcggcctgcccgctgctatcggggcggccgttgcaagacctgatgcggtagtagttgacatcgacggtgacggaagctttatgatgaatgttcaagagttagccacaatccgtgttgaaaatctgccggttaagattttattacttaacaaccagcatttgggtatggtggttcagtgggaggatcggttttacaaggcgaatcgggctcatacctacttaggaaacccgtcaaaagagtcggaaatattccctaacatggtgaagtttgctgaagcctgtgatatcccggctgctcgagtgacccaaaaggcggatctacgagcagctattcagaagatgttggatacacccgggccttacttgttggatgtgattgtgccgcatcaagaacacgtgttgcccatgatcccggctggcggaggtttctcggatgtgatcaccgagggtgatggcagaacgaaatattga

SEQ ID NO: 82505 - protein, 655 aa, Helianthus annuus
MAAPPNPSISFKPPSPAAALPPRSAFLPRFALPITSTTQKRHRLHISNVLSDSKSTTTTTTTTQRPLPVQPFVSRYAPDQPRKGADVLVEALEREGVTDVFAYPGGASMEIHQALTRSSTIRNVLPRHEQGGVFAAEGYARASGLPGVCIATSGPGATNLVSGLADALLDSVPMVAITGQVPRRMIGTDAFQETPIVEVTRSITKHNYLVLDVEDIPRIVREAFYLASSGRPGPVLIDVPKDIQQQLVVPKWDEPMRLPGYLSRMPKPQYDGHLEQIVRLVGEAKRPVLYVGGGCLNSDDELRRFVELTGIPVASTLMGLGAYPASSDLSLHMLGMHGTVYANYAVDKSDLLLAFGVRFDDRVTGKLEAFASRAKIVHIDIDPAEIGKNKQPHVSICGDIKVALQGLNKILEEKNSVTNLDFSTWRKELDEQKMKFPLSFKTFGEAIPPQYAIQVLDELTGGNAIISTGVGQHQMWAAQFYKYNKPRQWLTSGGLGAMGFGLPAAIGAAVARPDAVVVDIDGDGSFMMNVQELATIRVENLPVKILLLNNQHLGMVVQWEDRFYKANRAHTYLGNPSKESEIFPNMVKFAEACDIPAARVTQKADLRAAIQKMLDTPGPYLLDVIVPHQEHVLPMIPAGGGFSDVITEGDGRTKY

SEQ ID NO: 82506 - DNA, 1998 bp, Camelina microcarpa
  CDS (1)..(1998)
atggcggcggcaacaacaacatcatcatcttcgatccccttctcaacaaaaccttcctcctccaaatcaccattaccaatctccagattcaccctcccattctccctaaacccaaacaaatcctcctcccgccgccgcggtatcaaatcaacctccctctcaatctccgccgtcctcaacacaacaaccaatgtctcaaccacaactcctccatcaaaaccaaccaaacccgaaaagaaaaaattcgtctcccgattcgctccagaccaaccccgcaaaggcgctgacatcctcgtcgaagctttagaacgtcaaggcgtagaaacagtcttcgcttacccaggaggtgcatcaatggagattcaccaagccttaactcgttcctcctcgatccgtaacgtccttccacgtcacgaacaaggaggcgtattcgcagctgaaggctacgctagatccacaggtaaaccaggtatctgtatagctacctcaggtcctggagctacaaatctcgttagcggattagccgatgccttgttagatagtgttcctcttgtagccatcacgggtcaagtccctcgtaggatgattggtactgatgcgtttcaagaaactcctatcgttgaggtgacgcgttcgattactaaacataactatcttgtgatggatgttgaagatattcctaggattgttgaggaagctttctttttagctacctctggtagacctggacctgttttggttgatgttcctaaagatattcaacagcagctcgcgattcctaattgggaacagtctatgaggttacctggttatatgtctaggatgcctaaacctccggaagattctcatttggagcagattgttaggttgatttctgagtctaagaagcctgtgttgtatgttggtggtggttgtttgaattcgagtgaggagttgggtaggtttgttgaacttacggggatccctgttgcgagtacgttgatgggtcttggtgcttatccttgtgatgatgagttgtcgttgcatatgcttggcatgcacgggactgtgtatgctaattactctgtggagcatagtgatttgttgttggcttttggggttaggtttgatgatcgtgtcactggtaagcttgaggcgtttgctagtagggcgaagattgttcacattgatattgactcggctgagattgggaagaacaagactcctcatgtgtctgtgtgtggagatgttaagctggctttgcaagggatgaacaaggttcttgagaaccgaggggaggagcttaagcttgattttggagtttggaggagtgagttgaacgaacagaaacaaaagttccctctgagcttcaagacgtttggtgaagctattcctcctcagtatgcgattcaggttcttgatgagctgactgatgggaaggctattataagcactggtgtcgggcaacatcaaatgtgggcggcgcagttttacaagtacaaaaaaccgaggcagtggctatcatcagcaggccttggagctatgggttttggacttcccgctgctattggagcgtccgttgcgaaccctgatgcggttgttgtggatattgacggagatggaagcttcataatgaatgtgcaagagctggccactatcagggtagagaatctcccagtgaagatacttatactaaacaaccagcatcttggcatggttatgcaatgggaggatcggttctacaaagctaaccgagctcacacatatcttggtaacccggcaacggaggacgagatattcccgaacatgctgcagtttgcatcagcctgcgggattccatcggcgagagtgacaaagaaagcagagctccgagaagctatccagaaaatgctggataccccaggaccatacttgttggatgtgatttgtccgcaccaagaacatgtgttgccgatgatcccaagtggcggcactttcaatgatgtcataacggaaggagatggccggacgaaatactga

SEQ ID NO: 82507 - protein, 665 aa, Camelina microcarpa
MAAATTTSSSSIPFSTKPSSSKSPLPISRFTLPFSLNPNKSSSRRRGIKSTSLSISAVLNTTTNVSTTTPPSKPTKPEKKKFVSRFAPDQPRKGADILVEALERQGVETVFAYPGGASMEIHQALTRSSSIRNVLPRHEQGGVFAAEGYARSTGKPGICIATSGPGATNLVSGLADALLDSVPLVAITGQVPRRMIGTDAFQETPIVEVTRSITKHNYLVMDVEDIPRIVEEAFFLATSGRPGPVLVDVPKDIQQQLAIPNWEQSMRLPGYMSRMPKPPEDSHLEQIVRLISESKKPVLYVGGGCLNSSEELGRFVELTGIPVASTLMGLGAYPCDDELSLHMLGMHGTVYANYSVEHSDLLLAFGVRFDDRVTGKLEAFASRAKIVHIDIDSAEIGKNKTPHVSVCGDVKLALQGMNKVLENRGEELKLDFGVWRSELNEQKQKFPLSFKTFGEAIPPQYAIQVLDELTDGKAIISTGVGQHQMWAAQFYKYKKPRQWLSSAGLGAMGFGLPAAIGASVANPDAVVVDIDGDGSFIMNVQELATIRVENLPVKILILNNQHLGMVMQWEDRFYKANRAHTYLGNPATEDEIFPNMLQFASACGIPSARVTKKAELREAIQKMLDTPGPYLLDVICPHQEHVLPMIPSGGTFNDVITEGDGRTKY

SEQ ID NO: 82508 - DNA, 2007 bp, Camelina microcarpa
  CDS (1)..(2007)
atggcggcggcaacaacaacatcatcatcttcgatccccttctcaacaaaacattcctcctccaaatcaccattaccaatctccaggttcaccctcccattctccctaaacccaaacaaatcctcctcctcctcctcccgccgccgcggtatcaaatcaaccgccctctcaatctccgccgtcctcaacacaacaaccaatgtctcaaccaccactcctcaatcaaaaccaaccaaacccgagaaaaaaaaattcgtctcccgattcgctccaggtcagccacgcaaaggcgctgacatcctcgtcgaagctttagaacgccaaggcgtagaaacagtcttcgcttacccaggaggcgcatcaatggagattcaccaagccttaactcgttcctcctcgatccgtaacgtcctcccacgtcacgaacaaggaggcgtgttcgcagccgaaggctacgctagatccacaggtaaaccaggtatctgtatagcaacctcaggtcctggagctacgaatctcgttagcggattagccgatgccttgttagatagtgttcctcttgtagccatcacgggacaagtccctcgtaggatgattggtactgatgcgtttcaagaaactcccatcgttgaggtgacgcgttcgatcacgaaacataactatcttgtgatggatgttgaagatattcctaggattgttgaggaagctttctttttagctacctctggtagacctggacctgttttggttgatgttcctaaagatattcaacagcagctcgcgattcctaattgggaacagtctatgaggttacctggttatatgtctaggatgcctaaacctccggaagattctcatttggagcaaactgttaggttgatttctgagtctaagaagcctgtgttgtatgttggtggtggttgtttgaattcgagtgaggagttgggtaggtttgttgagcttactggtatacctgttgcgagtacgttgatgggtcttggtgcttatccttgtgatgacgagttgtcgttgcatatgcttggcatgcacgggaccgtgtatgcgaattactctgtggagcatagtgatctgttgttggcttttggggtgaggtttgatgatcgtgtcacgggtaagcttgaggcttttgctagtagggcgaagattgttcacattgatattgactcggctgagattgggaagaacaagactcctcatgtctctgtgtgtggagatgttaagcttgctttgcaagggatgaacaaggttcttgagaaccgagctgaggagcttaagcttgattttggagtttggagaagtgagttgaacgaacagaaacaaaagttccctctgagcttcaagacgtttggggaagctattcctcctcagtatgcgattcaggtccttgatgagctgactgatgggagagccattataagtactggcgtcggtcaacatcaaatgtgggcggcgcagttttacaagtacaaaaaaccgaggcagtggctatcatcagcaggccttggagctatgggttttggacttcccgctgctattggagcgtccgttgcgaaccctgattcgattgttgtagatattgacggagatggaagcttcataatgaatgtgcaagagctggccactatcagggtagagaatctcccagtgaagatacttatactaaacaaccagcatcttggcatggttatgcaatgggaggatcggttctacaaagctaaccgagctcacacatatcttggtaacccggcagaggaggacgagatattcccgaacatgctgcagtttgcatcagcttgcggtattccagcggcgagggtgacaaagatagcagagctccgagaagctatccagaaaatgctggataccccaggaccatacttgttggatgtgatttgtccgcaccaagaacatgtgttgccgatgatcccaagtggcggcactttcaatgatgtcataacggaaggagatggccggactaaatactga

SEQ ID NO: 82509 - protein, 668 aa, Camelina microcarpa
MAAATTTSSSSIPFSTKHSSSKSPLPISRFTLPFSLNPNKSSSSSSRRRGIKSTALSISAVLNTTTNVSTTTPQSKPTKPEKKKFVSRFAPGQPRKGADILVEALERQGVETVFAYPGGASMEIHQALTRSSSIRNVLPRHEQGGVFAAEGYARSTGKPGICIATSGPGATNLVSGLADALLDSVPLVAITGQVPRRMIGTDAFQETPIVEVTRSITKHNYLVMDVEDIPRIVEEAFFLATSGRPGPVLVDVPKDIQQQLAIPNWEQSMRLPGYMSRMPKPPEDSHLEQTVRLISESKKPVLYVGGGCLNSSEELGRFVELTGIPVASTLMGLGAYPCDDELSLHMLGMHGTVYANYSVEHSDLLLAFGVRFDDRVTGKLEAFASRAKIVHIDIDSAEIGKNKTPHVSVCGDVKLALQGMNKVLENRAEELKLDFGVWRSELNEQKQKFPLSFKTFGEAIPPQYAIQVLDELTDGRAIISTGVGQHQMWAAQFYKYKKPRQWLSSAGLGAMGFGLPAAIGASVANPDSIVVDIDGDGSFIMNVQELATIRVENLPVKILILNNQHLGMVMQWEDRFYKANRAHTYLGNPAEEDEIFPNMLQFASACGIPAARVTKIAELREAIQKMLDTPGPYLLDVICPHQEHVLPMIPSGGTFNDVITEGDGRTKY

SEQ ID NO: 82510 - DNA, 2007 bp, Camelina microcarpa
  CDS (1)..(2007)
atggcggcggcaacaacaacatcatcatcttcgatccccttctcaacaaaacattcctcctccaaatcaccattaccaatctccaggttcaccctcccattctccctaaacccaaacaaatcctcctcctcctcctcccgccgccgcggtatcaaatcaaccgccctctcaatctccgccgtcctcaacacaacaaccaatgtctcaaccaccactcctcaatcaaaaccaaccaaacccgagaaaaaaaaattcgtctcccgattcgctccagatcagccacgcaaaggcgctgacatcctcgtcgaagctttagaacgccaaggcgtagaaacagccttcgcttacccaggaggcgcatcaatggagattcaccaagccttaactcgttcctcctcgatccgtaacgtcctcccacgtcacgaacaaggaggcgtgttcgcagccgaaggctacgctagatccacaggtaaaccaggtatctgtatagcaacctcaggtcctggagctacgaatctcgttagcggattagccgatgccttgttagatagtgttcctcttgtagccatcacgggacaagtccctcgtaggatgattggtactgatgcgtttcaagaaactcccatcgttgaggtgacgcgttcgatcacgaaacataactatcttgtgatggatgttgaagatattcctaggattgttgaggaagctttctttttagctacctctggtagacctggacctgttttggttgatgttcctaaagatattcaacagcagctcgcgattcctaattgggaacagtctatgaggttacctggttatatgtctaggatgcctaaacctccggaagattctcatttggagcaaattgttaggttgatttctgagtctaagaagcctgtgttgtatgttggtggtggttgtttgaattcgagtgaggagttgggtaggtttgttgagcttactggtatacctgttgcgagtacgttgatgggtcttggtgcttatccttgtgatgacgagttgtcgttgcatatgcttggcatgcacgggaccgtgtatgcgaattactctgtggagcatagtgatctgttgttggcttttggggtgaggtttgatgatcgtgtcacgggtaagcttgaggcttttgctagtagggcgaagattgttcacattgatattgactcggctgagattgggaagaacaagactcctcatgtctctgtgtgtggagatgttaagcttgctttgcaagggatgaacaaggttcttgagaaccgagctgaggagcttaagcttgattttggagtttggagaagtgagttgaacgaacagaaacaaaagttccctctgagcttcaagacgtttggggaagctattcctcctcagtatgcgattcaggtccttgatgagctgactgatgggagagccattataagtactggtgtcggtcaacatcaaatgtgggcggcgcagttttacaagtacaaaaaaccgaggcagtggctatcatcagcaggccttggagctatgggttttggacttcccgctgctattggagcgtccgttgcgaaccctgattcgattgttgtagatattgacggagatggaagcttcataatgaatgtgcaagagctggccactatcagggtagagaatctcccagtgaagatacttatactaaacaaccagcatcttggcatggttatgcaattggaggatcggttctacaaagctaaccgagctcacacatatcttggtaacccggcagaggaggacgagatattcccgaacatgctgcagtttgcatcagcttgcggtattccagcggcgagggtgacaaagatagcagagctccgagaagctatccagaaaatgctggataccccaggaccatacttgttggatgtgatttgtccgcaccaagaacatgtgttgccgatgatcccaagtggcggcactttcaatgatgtcataacggaaggagatggccggactaaatactga

SEQ ID NO: 82511 - protein, 668 aa, Camelina microcarpa
MAAATTTSSSSIPFSTKHSSSKSPLPISRFTLPFSLNPNKSSSSSSRRRGIKSTALSISAVLNTTTNVSTTTPQSKPTKPEKKKFVSRFAPDQPRKGADILVEALERQGVETAFAYPGGASMEIHQALTRSSSIRNVLPRHEQGGVFAAEGYARSTGKPGICIATSGPGATNLVSGLADALLDSVPLVAITGQVPRRMIGTDAFQETPIVEVTRSITKHNYLVMDVEDIPRIVEEAFFLATSGRPGPVLVDVPKDIQQQLAIPNWEQSMRLPGYMSRMPKPPEDSHLEQIVRLISESKKPVLYVGGGCLNSSEELGRFVELTGIPVASTLMGLGAYPCDDELSLHMLGMHGTVYANYSVEHSDLLLAFGVRFDDRVTGKLEAFASRAKIVHIDIDSAEIGKNKTPHVSVCGDVKLALQGMNKVLENRAEELKLDFGVWRSELNEQKQKFPLSFKTFGEAIPPQYAIQVLDELTDGRAIISTGVGQHQMWAAQFYKYKKPRQWLSSAGLGAMGFGLPAAIGASVANPDSIVVDIDGDGSFIMNVQELATIRVENLPVKILILNNQHLGMVMQLEDRFYKANRAHTYLGNPAEEDEIFPNMLQFASACGIPAARVTKIAELREAIQKMLDTPGPYLLDVICPHQEHVLPMIPSGGTFNDVITEGDGRTKY

SEQ ID NO: 82512 - DNA, 1989 bp, Papaver rhoeas
  CDS (1)..(1989)
atggcgtccatcactacaaatctcaaaaacccgttacctttatcatcttccttcaattcttcgaaaccccttttttctaaatccaatcttctctcaatcccaacaaaattcatttcttctcgtcctctacatatcacaaactcatcatatcgaaaccaatccaataaacccaaagctataaccactgaaacacccatttccaccacccacaccacctccgtatctcctcccccatttgtgtctagatacaaagatgatgaaccaagaaaaggggctgatgttctcgttgaagcattggaacgtgaaggagtaacaaatgtttttgcatacccaggtggtgcatcaatggagatacatcaagctttaactagatcttcaagtattagaaatgttctacctagacatgaacaaggtgggattttttctgctgaaggttatgctcgtgcttctggtttacctggcgtctgcattgctacttctggccctggtgctactaatcttgttagcggtcttgccgatgcattgctcgacagcatcccaattgttgctgtaactggtcaagtacctaggaggatgattggtactgatgcatttcaggaaactccaattgttgaggtaacaagatcgattactaaacataattaccttgtccttgatgttgaggatattcctcgtgttgtcaaagaagcattttttctagctacatcaggccgaccaggtccagtacttattgatgtccctaaagatgtgcaacaacagcttgtagtgcctaaatgggatacccctatgaaattacctgggtatatgtctcgagcacccaaatcacctgaacataacctattagaacaggttgttaggttaatttctgaatccaagaaacctgttttatatgttggtggtggctgtataaactatagtgaagaattgagacggtttgttgacttgactggaattcctgttgctagtactttgatgggtttgggtgctcattcgtgtactgatgtgctttctttacaaatgcttggaatgcatgggaccgtatacgcaaactatgcggttgataaagcggatttgttgcttgcctttggtgttagatttgatgatcgtgtgacaggaaagattgaagcattcgctagtaggtcaaaaattgtgcacattgatattgatccagctgaaattggaaagaacaaacaacctcatgtttctatctgtgcggatatgggagtggccttgaaggggttgaataagttgttagaagaaaagatgtccaaacttaaacttgattttgtgtcttggagagaggagcttatggaacaaaagaagaattacccattgagttacaagacttttggagaggcaattcctcctcagtatgcgatcaaggttttggacgaattaacagaagggaaggcgattattagcacgggtgttgggcagcatcagatgtgggctgcacaatggtacaagtatagaggacctcgtcaatggttaacttcagctggattaggcgctatgggttttgggttacctgctgcaattggagctgccgttgctaaacctgaagctattgttgtagacattgacggtgatggaagtttcatgatgaatgttcaggaattggctgcagtaagggtggagaatttaccagtcaaaattcttctgttgaataatcagcatttgggtatggttgttcagtgggaggatcggttttataaggcaaacagggctcacacatatcttgggaatccagctaaagacactgaaatcttcccagatatgttgaaatttgctgaagcatgtgatattccggctgctcgtgttacaaaagtgagtgaactgagggcggccattcagaagatgttggatacccctggaccatatttattggatgtcatagtgccacatcaagagcacgtgttgcctatgattcctgctggtggttcgtttaatgaggtgatcatcgaaggtgatggtagaacgaagtactga

SEQ ID NO: 82513 - protein, 662 aa, Papaver rhoeas
MASITTNLKNPLPLSSSFNSSKPLFSKSNLLSIPTKFISSRPLHITNSSYRNQSNKPKAITTETPISTTHTTSVSPPPFVSRYKDDEPRKGADVLVEALEREGVTNVFAYPGGASMEIHQALTRSSSIRNVLPRHEQGGIFSAEGYARASGLPGVCIATSGPGATNLVSGLADALLDSIPIVAVTGQVPRRMIGTDAFQETPIVEVTRSITKHNYLVLDVEDIPRVVKEAFFLATSGRPGPVLIDVPKDVQQQLVVPKWDTPMKLPGYMSRAPKSPEHNLLEQVVRLISESKKPVLYVGGGCINYSEELRRFVDLTGIPVASTLMGLGAHSCTDVLSLQMLGMHGTVYANYAVDKADLLLAFGVRFDDRVTGKIEAFASRSKIVHIDIDPAEIGKNKQPHVSICADMGVALKGLNKLLEEKMSKLKLDFVSWREELMEQKKNYPLSYKTFGEAIPPQYAIKVLDELTEGKAIISTGVGQHQMWAAQWYKYRGPRQWLTSAGLGAMGFGLPAAIGAAVAKPEAIVVDIDGDGSFMMNVQELAAVRVENLPVKILLLNNQHLGMVVQWEDRFYKANRAHTYLGNPAKDTEIFPDMLKFAEACDIPAARVTKVSELRAAIQKMLDTPGPYLLDVIVPHQEHVLPMIPAGGSFNEVIIEGDGRTKY

SEQ ID NO: 82514 - DNA, 1665 bp, Selenomonas ruminantium
  CDS (1)..(1665): transl_table=11
atgaacggagcacaggcagtcgttgcatgtttaagagaacagggcgtcgatacggtgtttggctatcccggggggatgattctgcctttatacgacgctttatatgatagcaaggagataaagcaggtcttggtcactcacgagcagaatgccgctcacgccgctgacggctatgcccgtgcttcgggaaaagtgggggtctgcatcgctacctccggcccgggggccacgaacctggttacgggactggccacggcctttatggattccattcctgtggtggccatcacagggcaggtggatacgacgcttttagggcgggatgccttccaggaaacggacatcctcgatgtgaccatgcccatcaccaagcataactataaaatcaaggatgcccgccatctgctcagtaccatccgtgaagccttcaccttggcgaagaaaggccgtcccgggcccgtgctggtggatgtgcccagggatttgttcttccaggaagtagcttgggaggaagtacctgcctgcacgaaaaaagtgggcaagccggatgcggatttcctgatctgtgccgcggaggcagcccgggaaatcgtcaaggcccagcgtcctgtggtcatcgtggggggcggcgtcgtatcagcaggagccacggctgaggttacggcctttgtggagaaatacaatctgcctgtagcccatactttgatgggcttgggggccatcccgcgggaacacccgcagtccttgggttttgcgggcatgcacggagagaaggccgccaaccatgccattgccgccgctgatttgattatcgccattggcagccgtttcggtgaccgccagacgggcaatgtcaagaagtatacccaggatacgaaattcatccatattgacattgaccctgcggaaatcgataagaatatcggcaacagcctggggctggccggcgatatgaaagtgattctgggcctgctgatgaagcaggaggctgtgggaaatattgatgaatggtggcagcagattcagtcctggaaagagacttatgactatgactaccacgtcaatcgcctgacggtgccctgggccctgcatcaggtggcgcagaataccaaggggaagccctatgcctttgccacggatgtaggccagcatcagatgtgggcggctctgcatctgcgcattgaggagcccaggacatggctgacttccggcggcctgggcaccatgggctttggcctcgctgcggccatgggggcccagatgtactatggcgatagccgccgggtgatccatgtggccggggatggtggcatcaagatgacgggcaatgagttctataccatcgcccgcctgaatctgccggtgatttccctgattgtcaacaacaccagcctgggcatgatccgccagctgcagaaggttatgtacaaggaacgttacattgcctgcgaatttgactatcagatggattatgctgcctatgccggcagtttcggtatcaaggcggagaccgtctccacccaggaggaatttgctgaggcgctgaatcgtgccttggctgatcaggaccatccccgcgtgattgtcctcaatgtatggcgcagctttgtagaacccatgatcaagggcggcgcccgcattgatgagttcgtggaattcaaataa

SEQ ID NO: 82515 - protein, 554 aa, Selenomonas ruminantium
MNGAQAVVACLREQGVDTVFGYPGGMILPLYDALYDSKEIKQVLVTHEQNAAHAADGYARASGKVGVCIATSGPGATNLVTGLATAFMDSIPVVAITGQVDTTLLGRDAFQETDILDVTMPITKHNYKIKDARHLLSTIREAFTLAKKGRPGPVLVDVPRDLFFQEVAWEEVPACTKKVGKPDADFLICAAEAAREIVKAQRPVVIVGGGVVSAGATAEVTAFVEKYNLPVAHTLMGLGAIPREHPQSLGFAGMHGEKAANHAIAAADLIIAIGSRFGDRQTGNVKKYTQDTKFIHIDIDPAEIDKNIGNSLGLAGDMKVILGLLMKQEAVGNIDEWWQQIQSWKETYDYDYHVNRLTVPWALHQVAQNTKGKPYAFATDVGQHQMWAALHLRIEEPRTWLTSGGLGTMGFGLAAAMGAQMYYGDSRRVIHVAGDGGIKMTGNEFYTIARLNLPVISLIVNNTSLGMIRQLQKVMYKERYIACEFDYQMDYAAYAGSFGIKAETVSTQEEFAEALNRALADQDHPRVIVLNVWRSFVEPMIKGGARIDEFVEFK

SEQ ID NO: 82516 - DNA, 1863 bp, Streptomyces viridifaciens
  CDS (1)..(1863): transl_table=11
atgaccgagcaggccaccggggcccaccatccgcagccgcggccccgttccggaggacagcagtccgcccccgtcgagtacgtgacgggtgcgcagtccctgatccgctctcttgaggaggtcggcgcggacacggtattcggcattcccggtggtgcgatcctcccggcgtacgacccgctgatggactccacccgggtgcggcacgtcctggtccggcacgagcagggtgccggccatgcggccaccggttacgcgcaggccaccggcaaggtcggtgtctgcatggcgacgtcgggtccgggcgcgacgaatctggtcacgccgatcgcggacgcgcacatggactcggtgccgctggtcgcgatcaccgggcaggtggcctccaagtcgatcggcacggacgccttccaggaggcggacatcgtcggtatcaccatgccgatcaccaagcacaactggctggtcaccaaggccgaggacatcccgcgggtgatcgcgcaggcgttccatgtcgcctccaccggccgtcccggtccggtcctggtcgacatcgccaaggacgccctccaggccaggaccaccttctcctggccgcccgtgatggacctgcccggctaccgtccggtgaccaagccgcacgccaagcagatccgcgaggccgccaagctgatcacgaccgcccgccggccggtgctctacgtcggcggcggcgtcctcaaggcgcaggccacggccgagctgaaggtcctggccgagctgaccggcgcgcccgtcaccaccacactgatggcgctcggcgcgttccccgacagccacccgctgcacgtcggcatgccgggtatgcacggcagcgtcgccgcggtcaccgcgctgcagaaggccgacctgatcgtggccctcggtgcccgcttcgacgaccgcgtcaccggcagactggacagcttcgccccctacgccaagatcgtccacgcggacatcgacccggcggagatcggcaagaaccgtgccgcggacgtgccgatcgtcggtgacgcccgggaggtcatcgccgacctggtgcaggccgtgcagaaggagcacagcgagggccacaagggcgactacaccgcctggtggagcgacctgaaccggtggcgcgagacctacccgctcggctacgacctgcccgaggacggttcgctctccccgcagcaggtcatcgagcgcatcggccggctggcgcctcagggcacgatcttcgccgcgggcgtcggccagcaccagatgtggtccgcgcacttcatccagtacgaccggcccgcgacctggctcaactccggcggtgccgggacgatgggttacgcggtccccgccgccatgggcgccaaggccggccgcccggagcagacggtgtgggcgatcgacggtgacggctgcttccagatgaccaatcaggagctgaccacctgtgccctgaacaacatcccgatcaaggtcgccgtcatcaacaacggcgccctcgggatggtccgccagtggcagaccctcttctacaaccagcgctactccaacacccaactccgcggcgagcccagcgctcgggcgcacggcacccgggtgccggacttcgtgaagctgtccgaggcgatgggctgcgtcgcgatgcgctgtgaagacgcggctgaccttgacaccgtgatagcgaaggctaactcgatcaatgaccagcccgtagtggtcgacttcatcgtccacgaggacgcgatggtctggccgatggtcgccgccggcgcctccaacgacgagatcatggccgctcgcgacgttcgccctctcttcgatgacgccgctgaggacttcactgcagagactccgatgtga

SEQ ID NO: 82517 - protein, 620 aa, Streptomyces viridifaciens
MTEQATGAHHPQPRPRSGGQQSAPVEYVTGAQSLIRSLEEVGADTVFGIPGGAILPAYDPLMDSTRVRHVLVRHEQGAGHAATGYAQATGKVGVCMATSGPGATNLVTPIADAHMDSVPLVAITGQVASKSIGTDAFQEADIVGITMPITKHNWLVTKAEDIPRVIAQAFHVASTGRPGPVLVDIAKDALQARTTFSWPPVMDLPGYRPVTKPHAKQIREAAKLITTARRPVLYVGGGVLKAQATAELKVLAELTGAPVTTTLMALGAFPDSHPLHVGMPGMHGSVAAVTALQKADLIVALGARFDDRVTGRLDSFAPYAKIVHADIDPAEIGKNRAADVPIVGDAREVIADLVQAVQKEHSEGHKGDYTAWWSDLNRWRETYPLGYDLPEDGSLSPQQVIERIGRLAPQGTIFAAGVGQHQMWSAHFIQYDRPATWLNSGGAGTMGYAVPAAMGAKAGRPEQTVWAIDGDGCFQMTNQELTTCALNNIPIKVAVINNGALGMVRQWQTLFYNQRYSNTQLRGEPSARAHGTRVPDFVKLSEAMGCVAMRCEDAADLDTVIAKANSINDQPVVVDFIVHEDAMVWPMVAAGASNDEIMAARDVRPLFDDAAEDFTAETPM

SEQ ID NO: 82518 - DNA, 1698 bp, Candidatus Tremblaya princeps
  CDS (1)..(1698): transl_table=11
gtgcttcatgctagcggtgcgcttggactgatatggactctgagtagaatggccatactccggttgtggggatatcctggtggctcagttcttgggttgtacgacgagatatacaggtgtggccttttgaggcacatgtccgtaaggagtgagcctgctgcagcttatgctgcctgctcattctatgccgcaacgcgcgagctaggctcttgcctcgtcacatccggcccaggaataaccaacgccataactggcatagcaacggcggatgctgactcggtggctgtgctggtaataagcgggcaggtgccattggcaagcattgggatgggttcattccaggaatgcgatgctatagggctcgcatcgccgtgcaccaagggctgctatagcctgcgcagggtgcttgacataaggagggcggcatgggaggctagccttgttgccgtaacgaacaaaccatccccagtcctccttgactttccgaaggacgtggtaaggtttaccctgccaggcgttactgcactcaagctacggtataggcgcaaccacaccgcaccactggatgtgtggtcagagccttgcttgtacgtttatgcccaccttgccgcaaggtatatagcctctgctgccagaccgctggcttatgtaggaggaggctctgcgtacagcgtgcaaaggctggcacatattgcttgggctgcctgcatgccttttgcaggtagtctgatgggactcgatgccatacctactatgggctctgtgggcatggtaggaatgtatggccgtctgggttcaaacattgcgctgcagtactgcgacctggtggctgcaatgggggcccggtttgacgaccgggttgtgacaagcccggcacggcttgtctggcgcggcagggctgtagtatctgtgaacgtttcgagctcactgactcggaacgtaggcgtgtcgcacatggcaatggctaatgtagagcacttcataggcacgctgtgcaggttgctctctgtaaggtgcgcgcttaatggatggtctttgcgcccctggaccatcctacggcggagctggcgtatacaccagcggcattgccgaatgggatacgtcctgtatggcaacatgttcaggcgtgcagtgatcggcgcttgctccgtttgctgcgacgtggggcagcatcagatgtggtcagcccagtacaacacggcgggcatcactgcgcgtagaataaactcaggcggcctaggcaccatgggctgtggcctaccattcgcaatgagtgcacagaccctgtcgcatggtctgtactccctttgcattactggcaacggatcattgcaaatgagcatgcacgagctcccaacgctgcgcgacatgggttccagggtaatagtcatcgtgctaaacaacggcagcctgggcatggttcgtcaatggcagcaagtagagcactgcggcaggtactcgcagtctgcgtcagcaatgtacgcctgctcctcttccattgccgagcagcagggtcatgtgggggtggatgtgctaggtccagtccatgtcttcgccgcctttgctgagtctaggagcagcgtacggaacacggcgctactgaacgtgctgcacagtagccatgagtgcgtttggccaatggtgcaaggtggtaggagcattactaacatgatgaccagctctagggatatcaactag

SEQ ID NO: 82519 - protein, 565 aa, Candidatus Tremblaya princeps
MLHASGALGLIWTLSRMAILRLWGYPGGSVLGLYDEIYRCGLLRHMSVRSEPAAAYAACSFYAATRELGSCLVTSGPGITNAITGIATADADSVAVLVISGQVPLASIGMGSFQECDAIGLASPCTKGCYSLRRVLDIRRAAWEASLVAVTNKPSPVLLDFPKDVVRFTLPGVTALKLRYRRNHTAPLDVWSEPCLYVYAHLAARYIASAARPLAYVGGGSAYSVQRLAHIAWAACMPFAGSLMGLDAIPTMGSVGMVGMYGRLGSNIALQYCDLVAAMGARFDDRVVTSPARLVWRGRAVVSVNVSSSLTRNVGVSHMAMANVEHFIGTLCRLLSVRCALNGWSLRPWTILRRSWRIHQRHCRMGYVLYGNMFRRAVIGACSVCCDVGQHQMWSAQYNTAGITARRINSGGLGTMGCGLPFAMSAQTLSHGLYSLCITGNGSLQMSMHELPTLRDMGSRVIVIVLNNGSLGMVRQWQQVEHCGRYSQSASAMYACSSSIAEQQGHVGVDVLGPVHVFAAFAESRSSVRNTALLNVLHSSHECVWPMVQGGRSITNMMTSSRDIN

SEQ ID NO: 82520 - DNA, 2013 bp, Arabidopsis thaliana
  CDS (1)..(2013)
atggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaagctttagaacgtcaaggcgtagaaaccgtattcgcttaccctggaggtgcatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatccctaggattattgaggaagctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtttgaattctagcgatgaattgggtaggtttgttgagcttacggggatccctgttgcgagtacgttgatggggctgggatcttatccttgtgatgatgagttgtcgttacatatgcttggaatgcatgggacggtgtatgcgaattacgctgtggagcatagtgatttgttgttggcgtttggggtgaggtttgatgatcgcgtcacgggtaagcttgaggcttttgctagtagggctaagattgttcatattgatattgactctgctgagattgggaagaataagactcctcatgtgtctgtgtgtggtgatgtcaagctggctttgcaagggatgaataaggttcttgagaaccgagctgaggagcttaagcttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaagccaaggcagtggctatcatcaggaggccttggagctatgggttttggacttcctgctgccattggagcgtctgttgctaaccctgatgcaatagttgtggatattgacggagatggaagctttataatgaatgtgcaagagctggccacaatccgtgtagagcaacttccagtgaagatactcttattaaacaaccagcatcttggcatggttatgcaatgggaagatcggttctacaaggctaaccgagctcacacatttctcggggatccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgagtggtggcactttcaacgatgtcataacggaaggagatggccggattaaatactga

SEQ ID NO: 82521 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVEQLPVKILLLNNQHLGMVMQWEDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 82522 - DNA, 2175 bp, Saccharomycopsis fibuligera
  CDS (1)..(2175)
atgctcaagtcgtccttataccgaggagctgctctcagggccgccataaaatccagttctggatcaagagcatccctttacaaagctgccgccatcactcttcacaacactaatgcatcttcttttgccatacgctccaatagctctcaagcagctctcagagaagaaccgtctccagcattcaaccagaccactcctgaagaaagcagaaaagcactaaacagtttcctcagccagcagcagagcaagtctgcttctgcttctgcttctgcttcttctgctgccagtgctgctgctgccggtgctgaatctgctgccgaaaaaaatgcttctgctgctgccgccgccatggacgactcatttgtcgggttgaccggtggtgagatctttcatgaaatgatgttgcgccataaagtcgacactgtgtttggctacccaggcggggccatcttgcctgtttacgatgccatttacgaatcgaaaaatttcaactttgttcttccgcgccacgagcagggcgctggccatatggccgaagggtacgctcgtgctactgggaagccaggggttgtcttggtcactagtggtcctggcgccaccaatgtcatcacgccaatggccgacgctttgatggacggcgtgcctcttgttgtgttcactggccaggtgccaactagtgccattggtaccgatgcgttccaagaagcggatgtcattggcatctccagatcttgcaccaagtggaacgttatggtcaagtccgttagcgagttgcctagaagaatcaacgaagcttttgaaatcgccaccagcggcagaccgggcccagtgcttgttgacttgcctaaagacgtcactgctgccatcttgagagatccaatcccaaccaactctaccttgccttccaagacccttgccagcatcacaaaacacgcggtgacccaattcgccgaggaaagcatcaaagaggcctccgacttgcttaacgttgccaaaaagcctgttctttatgtcggcgcagggattttgaatcatcctgatggcccaaagttgctcaaggagctcagcgaaaaggcccagattcccgtcaccaccaccatccaagccttgggcgcctttgaccagcgcggcgagaagtctctcgacatgttggggatgcacggttccgcattcgccaacttggccatgcaaaatgctgacttgattatcgccctcggggcaagattcgacgacagagtcattggcgcagtgagcaagtttgcaccaaatgccaaactcgccgctgctaatcaccgcggcgggatcatccactttgaaatctctccaaaaaacatcaacaaggtcgtggaagcagacgtcgccgttgaaggcgacgttacgcgcaacttgcgcaagttcctcccattgatcaaccaggtggaagccactgatcctgctagagccgcatggttcaagcaaatcgctagctggaaagctcaatatccatacgcgtacctcaaagaaaccccggaaagcaagataaaaccacaaaccttgattcaggagttgtccgacaagtgtctcgagttggacaaggacgtcgtggtcactaccggtgtcggccagcaccaaatgtgggccgctcagcactttacctggacccagcctcgcacctttatcacttctggcgggttgggcaccatgggctacgggttgccagccgccattggtgcccaagtcggtagaccagatgccgttgtgattgatattgacggtgatgctagtttcaacatgaccttgactgagctaagcactgccgcgcaattcaacatcccagtgaagatcattgtcttgaataacgaagagcaaggaatggtaacgcaatggcagtcgttgttctacgagcaccgttactcccacactcaccaatctaatccagatttcgtcaagttggccgaggcaatgggcgtgaaggcaatgaagttgacaaagcagggcgagttgcactcgactcttgacgagtttttacagtacagcgcaggcccagtcttgctcgaggttgaagtggaaaagaaggtgccggtcttgccaatggtgccgggcggcaagggcttggacgagttcatctactttgatccagaagttgaaagacagcaaaacgagcttagacgcaagcgcactaacggtaagcactga

SEQ ID NO: 82523 - protein, 724 aa, Saccharomycopsis fibuligera
MLKSSLYRGAALRAAIKSSSGSRASLYKAAAITLHNTNASSFAIRSNSSQAALREEPSPAFNQTTPEESRKALNSFLSQQQSKSASASASASSAASAAAAGAESAAEKNASAAAAAMDDSFVGLTGGEIFHEMMLRHKVDTVFGYPGGAILPVYDAIYESKNFNFVLPRHEQGAGHMAEGYARATGKPGVVLVTSGPGATNVITPMADALMDGVPLVVFTGQVPTSAIGTDAFQEADVIGISRSCTKWNVMVKSVSELPRRINEAFEIATSGRPGPVLVDLPKDVTAAILRDPIPTNSTLPSKTLASITKHAVTQFAEESIKEASDLLNVAKKPVLYVGAGILNHPDGPKLLKELSEKAQIPVTTTIQALGAFDQRGEKSLDMLGMHGSAFANLAMQNADLIIALGARFDDRVIGAVSKFAPNAKLAAANHRGGIIHFEISPKNINKVVEADVAVEGDVTRNLRKFLPLINQVEATDPARAAWFKQIASWKAQYPYAYLKETPESKIKPQTLIQELSDKCLELDKDVVVTTGVGQHQMWAAQHFTWTQPRTFITSGGLGTMGYGLPAAIGAQVGRPDAVVIDIDGDASFNMTLTELSTAAQFNIPVKIIVLNNEEQGMVTQWQSLFYEHRYSHTHQSNPDFVKLAEAMGVKAMKLTKQGELHSTLDEFLQYSAGPVLLEVEVEKKVPVLPMVPGGKGLDEFIYFDPEVERQQNELRRKRTNGKH

SEQ ID NO: 82524 - DNA, 1740 bp, Escherichia coli
  CDS (1)..(1740): transl_table=11
atggcgaggatgcgtgcaatcgaagctgcagtagaaatactgaaaaaagaaggcattagcgttgcttttggtgtacccggcgcagcaataaacccactctatgccgcgatgaaaaaatcaggcggtattgatcatattctggcccgtcatgttgagggcgcctcgcatatggctgaaggttacacccgcagtcagaatggcaatattggcgtgtgtattggcacatcaggccctgcgggcactgatatgattaccgggctgtattctgcctctgcggattccattcctattctctgcattactggtcaagctcccgtaggaaaacttcataaagaagatttccaggccgtcgatattgaggctatcgccacgccagtaaccaaaatggctcgcacaattctcgaagcgggtcagttgccggggatattccagaaagccttctgggaaatgcgttcaggccgccctggcccggttcttttagatctcccttttgatgttcagatgaccgaaattgagtttgatatcgatctctatcagccactaatcccctggcaacctaaggcaacacgggcccaggccgtacgcgcattagaaatgctaaatgacgccgaaaagcccgtcatcatcgctggcggtggcattattaacgccgaagcgagtgaattgttgcgtgagtttgtcgagttaactggcgttcccgtcattcaaaccttacgcggttggggcgctttatcagacgatcaccccctaatgattggtcgcatgggatgtcaggcgggtcatcgctatggtaacgccagttatctggcctcagattttgtttttggtatcggtaaccgttgggcaaaccgccataccggagccattgagacctacaccgaaggccgcaaattcattcatgttgatatcgaacctgcacaaattggccggatatttgcgccggatctgggcattgtttctgatgctgaaagcgccttaacgctatttattcaggtcgcccgtgatatgaagtcacgtggagaactgaaagaccgcagtcgctggattgccgaatgtgccgagcgtaaacgcacaatgcttcgtcgttcagactttgactgcaatccaattaaaccgcagcgcgtgtatcacgaaatgaataaggttttcggaccggagacacgctatatttcgacaattggtctggcgcaaatcgccgcaaaccaatttttacatgtttaccgcccacgccactggattaatgcctgtcaggctgggccgctaggctggacaatgcccgcagcactgggcgcggtaaaagctgatccatctgttcccgttgtggcaatatccggtgattacgattttcaattcttgattgaagaattagccgtcggcgcacaatttaatcttccgtatatccatattttacttaacaacgcttatcttggtttgattcgtcaatcacaacgtgcatttgatattgattattgcgttcaactgtcatttgaaaatattaatgctccagaaattaatggttatggcgttgatcataaagctgtggttgaaggattaggatgtaaagcgattcgcgtattcgcatcacaggatattgcgcctgcactgcaagaagcccagcgtttgcgtgacgaatttcacgtacctgttgttgtagaaattattactgaacgcgtgactaatatcgctatgggacctgacattaataaagtcacagaatttgaagaaattctcgatttataa

SEQ ID NO: 82525 - protein, 579 aa, Escherichia coli
MARMRAIEAAVEILKKEGISVAFGVPGAAINPLYAAMKKSGGIDHILARHVEGASHMAEGYTRSQNGNIGVCIGTSGPAGTDMITGLYSASADSIPILCITGQAPVGKLHKEDFQAVDIEAIATPVTKMARTILEAGQLPGIFQKAFWEMRSGRPGPVLLDLPFDVQMTEIEFDIDLYQPLIPWQPKATRAQAVRALEMLNDAEKPVIIAGGGIINAEASELLREFVELTGVPVIQTLRGWGALSDDHPLMIGRMGCQAGHRYGNASYLASDFVFGIGNRWANRHTGAIETYTEGRKFIHVDIEPAQIGRIFAPDLGIVSDAESALTLFIQVARDMKSRGELKDRSRWIAECAERKRTMLRRSDFDCNPIKPQRVYHEMNKVFGPETRYISTIGLAQIAANQFLHVYRPRHWINACQAGPLGWTMPAALGAVKADPSVPVVAISGDYDFQFLIEELAVGAQFNLPYIHILLNNAYLGLIRQSQRAFDIDYCVQLSFENINAPEINGYGVDHKAVVEGLGCKAIRVFASQDIAPALQEAQRLRDEFHVPVVVEIITERVTNIAMGPDINKVTEFEEILDL

SEQ ID NO: 82526 - DNA, 2010 bp, Amaranthus powellii
  CDS (1)..(2010)
atggcgtccacttcttcaaacccaccattttcctcttttactaaacctaacaaaatccctaatctgcaatcatccatttacgctatccctttttccaattctcttaaacccacttcttcttcttcaatcctccgccgccctcttcaaatctcatcatcttcttctcaatcacctaaacctaaacctccttccgctactataactcaatcaccttcgtctctcaccgatgataaaccctcttcttttgtttcccgatttagccctgaagaacccagaaaaggttgcgatgttctcgttgaagctcttgaacgtgaaggtgttaccgatgtttttgcttaccctggtggagcatccatggaaattcatcaagctcttactcgttctaatatcattagaaatgttcttcctcgacatgaacaaggtggggttttcgctgctgaaggctacgctcgtgctactggacgcgttggagtttgtattgccacttctggtccaggtgctactaatcttgtttctggtcttgctgatgcacttcttgactcagtccctcttgtcgccattactgggcaagttccccggcgtatgattggtactgatgcttttcaagagactccaattgttgaggtaactcgatccattaccaagcataattatttggtgttagatgttgaggatattcctagaattgttaaggaagctttctttttagctaattctggtagacctggacctgttttgattgatattcctaaagatattcagcaacaattagttgttcctaattgggaacagcccattaaattgggtgggtatctttctaggttgcctaaacccacttattctgctaatgaagagggacttcttgatcaaattgtaaggttagtgggtgagtctaagagacctgtgctgtatactggaggtgggtgtttgaattctagtgaagaattgaggaaatttgtcgaattgacaggtattccggtggctagtactttaatggggttgggggctttcccttgtactgatgatttatctcttcatatgttgggaatgcacgggactgtgtacgcgaattacgcggttgataaggccgatttgttgcttgcttttggggttaggtttgatgatcgagtgactggtaagctcgaggcgtttgctagccgggctaagattgtgcacatcgatatcgattctgctgaaatcgggaagaataagcaacctcatgtgtcgatttgtggtgatgttaaagtggcattacaggggttgaataagattttggaatctagaaaaggaaaggtgaaactggatttctctaattggagggaggagttgaatgagcagaaaaagaagtttcctttgagttttaagactttcggggatgcaattcctccgcaatacgccattcaggttcttgacgagttgacgaagggcgatgcggttgtaagtactggtgttgggcagcaccaaatgtgggctgcccaattctataagtaccgaaatcctcgccaatggctgacctcgggtggtttgggggctatggggtttggtctaccagctgctattggagctgctgttgctcgaccagatgcggtggttgtagacattgatggggatgggagtttcatcatgaatgttcaagagttggctacgattagggtagagaatctcccggttaaaatcatgctcttgaacaatcaacatttaggtatggttgttcaatgggaagatcgattttacaaagctaaccgggcacatacatacctcgggaatccttccaattcttccgaaatcttcccggatatgctcaaatttgctgaagcatgtgatataccagcagcccgtgttaccaaggtgagcgatttaaggactgcaattcaaacaatgttggatactccaggaccgtatctgctggatgtaatcgtaccacatcaggagcatgtgctgcctatgatccctagcggtgccgccttcaaggacaccataacagagggtgatggaagaagggcttattag

SEQ ID NO: 82527 - protein, 669 aa, Amaranthus powellii
MASTSSNPPFSSFTKPNKIPNLQSSIYAIPFSNSLKPTSSSSILRRPLQISSSSSQSPKPKPPSATITQSPSSLTDDKPSSFVSRFSPEEPRKGCDVLVEALEREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPCTDDLSLHMLGMHGTVYANYAVDKADLLLAFGVRFDDRVTGKLEAFASRAKIVHIDIDSAEIGKNKQPHVSICGDVKVALQGLNKILESRKGKVKLDFSNWREELNEQKKKFPLSFKTFGDAIPPQYAIQVLDELTKGDAVVSTGVGQHQMWAAQFYKYRNPRQWLTSGGLGAMGFGLPAAIGAAVARPDAVVVDIDGDGSFIMNVQELATIRVENLPVKIMLLNNQHLGMVVQWEDRFYKANRAHTYLGNPSNSSEIFPDMLKFAEACDIPAARVTKVSDLRTAIQTMLDTPGPYLLDVIVPHQEHVLPMIPSGAAFKDTITEGDGRRAY

SEQ ID NO: 82528 - DNA, 2010 bp, Amaranthus retroflexus
  CDS (1)..(2010)
atggcgtccacttcttcaaacccaccattttcctcttttactaaacctaacaaaatccctaatctgcaatcatccatttacgctatccctttttccaattctcttaaacccacttcttcttcttcaatcctccgccgccctcttcaaatctcatcatcttcttctcaatcacctaaacctaaacctccttccgctactataactcaatcaccttcgtctctcaccgatgataaaccctcttcttttgtttcccgatttagtcctgaagaacccagaaaaggttgcgatgttctcgttgaagctcttgaacgtgaaggtgttaccgatgtttttgcttaccctggtggagcatccatggaaattcatcaagctcttactcgttctaatatcattagaaatgttcttcctcgacatgaacaaggtggggttttcgctgctgaaggctacgctcgtgctactggacgcgttggagtttgtattgccacttctggtccaggtgctactaatcttgtttctggtcttgctgatgcacttcttgactcagtccctcttgtcgccattactgggcaagttccccggcgtatgattggtactgatgcttttcaagagactccaattgttgaggtaactcgatccattaccaagcataattatttggtgttagatgttgaggatattcctagaattgttaaggaagctttctttttagctaattctggtagacctggacctgttttgattgatattcctaaagatattcagcaacaattagttgttcctaattgggaacagcccattaaattgggtgggtatctttctaggttgcctaaacccacttattctgctaatgaagagggacttcttgatcaaattgtaaggttagtgggtgagtctaagagacctgtgctgtatactggaggtgggtgtttgaattctagtgaagaattgaggaaatttgtcgaattgacaggtattccggtggctagtactttaatggggttgggggctttcccttgtactgatgatttatctcttcatatgttgggaatgcacgggactgtgtacgcgaattacgcggttgataaggccgatttgttgcttgcttttggggttaggtttgatgatcgagtgactggtaagctcgaggcgtttgctagccgggctaagattgtgcacatcgatatcgattctgctgaaatcgggaagaataagcaacctcatgtgtcgatttgtggtgatgttaaagtggcattacaggggttgaataagattttggaatctagaaaaggaaaggtgaaattggatttctctaattggagggaggagttgaatgagcagaaaaagaagtttcctttgagttttaagactttcggggatgcaattcctccgcaatacgccattcaggttcttgacgagttgacgaagggcgatgcggttgtaagtactggtgttgggcagcaccaaatgtgggctgcccaattctataagtaccggaatcctcgccaatggctgacctcgggtggtttgggggctatggggtttggtctaccagctgctattggagctgctgttgctcgaccagatgcggtggttgtagacattgatggggatgggagttttatcatgaatgttcaagagttggctacgattagggtagagaatctcccggttaaaatcatgctcttgaacaatcaacatttaggtatggttgttcaatgggaagatcgattttacaaagctaaccgggcacatacatacctcgggaatccttccaattcttccgaaatcttcccggatatgctcaaatttgctgaagcatgtgatataccagcagcccgtgttaccaaggtgagcgatttaagggctgcaattcaaacaatgttggatactccaggaccgtatctgctggatgtaatcgtaccacatcaggagcatgtgctgcctatgatccctagcggtgccgccttcaaggacaccataacagagggtgatggaagaagggcttattag

SEQ ID NO: 82529 - protein, 669 aa, Amaranthus retroflexus
MASTSSNPPFSSFTKPNKIPNLQSSIYAIPFSNSLKPTSSSSILRRPLQISSSSSQSPKPKPPSATITQSPSSLTDDKPSSFVSRFSPEEPRKGCDVLVEALEREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPCTDDLSLHMLGMHGTVYANYAVDKADLLLAFGVRFDDRVTGKLEAFASRAKIVHIDIDSAEIGKNKQPHVSICGDVKVALQGLNKILESRKGKVKLDFSNWREELNEQKKKFPLSFKTFGDAIPPQYAIQVLDELTKGDAVVSTGVGQHQMWAAQFYKYRNPRQWLTSGGLGAMGFGLPAAIGAAVARPDAVVVDIDGDGSFIMNVQELATIRVENLPVKIMLLNNQHLGMVVQWEDRFYKANRAHTYLGNPSNSSEIFPDMLKFAEACDIPAARVTKVSDLRAAIQTMLDTPGPYLLDVIVPHQEHVLPMIPSGAAFKDTITEGDGRRAY

SEQ ID NO: 82530 - DNA, 2013 bp, Arabidopsis thaliana
  CDS (1)..(2013)
atggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtgacaaccactccctctccaaccaaacctaccaaacccgaaacattcatctcccgattcgctccagatcaaccccgcaaaggcgctgatatcctcgtcgaagctttagaacgtcaaggcgtagaaaccgtattcgcttaccctggaggtgcatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatccctaggattattgaggaagctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtttgaattctagcgatgaattgggtaggtttgttgagcttacggggatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaagcttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaagcttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagctttataatgaatgtgcaagagctagccactattcgtgtagagaatcttccagtgaaggtacttttattaaacaaccagcatcttggcatggttatgcaatggcaagatcggttctacaaagctaaccgagctcacacatttctcggggatccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgagtggtggcactttcaacgatgtcataacggaaggagatggccggattaaatactga

SEQ ID NO: 82531 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWQDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 82532 - DNA, 1935 bp, Oryza sativa
  CDS (1)..(1935)
atggctacgaccgccgcggccgcggccgccgccctgtccgccgccgcgacggccaagaccggccgtaagaaccaccagcgacaccacgtccttcccgctcgaggccgggtgggggcggcggcggtcaggtgctcggcggtgtccccggtcaccccgccgtccccggcgccgccggccacgccgctccggccgtgggggccggccgagccccgcaagggcgcggacatcctcgtggaggcgctggagcggtgcggcgtcagcgacgtgttcgcctacccgggcggcgcgtccatggagatccaccaggcgctgacgcgctccccggtcatcaccaaccacctcttccgccacgagcagggcgaggcgttcgcggcgtccgggtacgcgcgcgcgtccggccgcgtcggggtctgcgtcgccacctccggccccggggcaaccaacctcgtgtccgcgctcgccgacgcgctgctcgactccgtcccgatggtcgccatcacgggccaggtcccccgccgcatgatcggcaccgacgccttccaggagacgcccatagtcgaggtcacccgctccatcaccaagcacaattaccttgtccttgatgtggaggacatcccccgcgtcatacaggaagccttcttcctcgcgtcctcgggccgtcctggcccggtgctggtcgacatccccaaggacatccagcagcagatggccgtgccggtctgggacacctcgatgaatctaccagggtacatcgcacgcctgcccaagccacccgcgacagaattgcttgagcaggtcttgcgtctggttggcgagtcacggcgcccgattctctatgtcggtggtggctgctctgcatctggtgacgaattgcgctggtttgttgagctgactggtatcccagttacaaccactctgatgggcctcggcaatttccccagtgacgacccgttgtccctgcgcatgcttgggatgcatggcacggtgtacgcaaattatgccgtggataaggctgacctgttgcttgcgtttggtgtgcggtttgatgatcgtgtgacagggaaaattgaggcttttgcaagcagggccaagattgtgcacattgacattgatccagcagagattggaaagaacaagcaaccacatgtgtcaatttgcgcagatgttaagcttgctttacagggcttgaatgctctgctacaacagagcacaacaaagacaagttctgattttagtgcatggcacaatgagttggaccagcagaagagggagtttcctctggggtacaaaacttttggtgaagagatcccaccgcaatatgccattcaggtgctggatgagctgacgaaaggtgaggcaatcatcgctactggtgttgggcagcaccagatgtgggcggcacaatattacacctacaagcggccacggcagtggctgtcttcggctggtctgggcgcaatgggatttgggctgcctgctgcagctggtgcttctgtggctaacccaggtgtcacagttgttgatattgatggggatggtagcttcctcatgaacattcaggagctggcattgatccgcattgagaacctccctgtgaaggtgatggtgttgaacaaccaacatttgggtatggtggtgcaattggaggataggttttacaaggcgaatagggcgcatacatacttgggcaacccggaatgtgagagcgagatatatccagattttgtgactattgctaaggggttcaatattcctgcagtccgtgtaacaaagaagagtgaagtccgtgccgccatcaagaagatgctcgagactccagggccatacttgttggatatcatcgtcccgcaccaggagcatgtgctgcctatgatcccaattgggggcgcattcaaggacatgatcctggatggtgatggcaggactgtgtattaa

SEQ ID NO: 82533 - protein, 644 aa, Oryza sativa
MATTAAAAAAALSAAATAKTGRKNHQRHHVLPARGRVGAAAVRCSAVSPVTPPSPAPPATPLRPWGPAEPRKGADILVEALERCGVSDVFAYPGGASMEIHQALTRSPVITNHLFRHEQGEAFAASGYARASGRVGVCVATSGPGATNLVSALADALLDSVPMVAITGQVPRRMIGTDAFQETPIVEVTRSITKHNYLVLDVEDIPRVIQEAFFLASSGRPGPVLVDIPKDIQQQMAVPVWDTSMNLPGYIARLPKPPATELLEQVLRLVGESRRPILYVGGGCSASGDELRWFVELTGIPVTTTLMGLGNFPSDDPLSLRMLGMHGTVYANYAVDKADLLLAFGVRFDDRVTGKIEAFASRAKIVHIDIDPAEIGKNKQPHVSICADVKLALQGLNALLQQSTTKTSSDFSAWHNELDQQKREFPLGYKTFGEEIPPQYAIQVLDELTKGEAIIATGVGQHQMWAAQYYTYKRPRQWLSSAGLGAMGFGLPAAAGASVANPGVTVVDIDGDGSFLMNIQELALIRIENLPVKVMVLNNQHLGMVVQLEDRFYKANRAHTYLGNPECESEIYPDFVTIAKGFNIPAVRVTKKSEVRAAIKKMLETPGPYLLDIIVPHQEHVLPMIPIGGAFKDMILDGDGRTVY

SEQ ID NO: 82534 - DNA, 1923 bp, Lolium multiflorum
  CDS (1)..(1923)
atggcaactgccacttcgacagccgtcgccttctcgggagccaccgccaccttgcccaaaccacgcactctcccgcgtcacctactgccctcctcacgccgcgccctcgccgcccccatcaggtgctccgcggtgtccccatcgccctcgcccgcccctcccgccaccgcgctccgcccatggggcccatccgagccccgcaagggcgccgacatcctcgtcgaggccctcgagcgctgcggcatcagcgacgtcttcgcctacccgggcggagcctcaatggagatccaccaggcgctcacgagctcgccgctcatcaccaaccacctcttccgccacgagcagggcgaggccttcgcggcgtccgggtacgcgcgggcgtccggccgcgtcggggtctgcgtcgccacctccggcccgggggccaccaacctcgtctccgcgctcgccgacgccctcctcgactccatccccatggtggccatcacggggcaggtccagcgccgcatgatcggcacggacgccttccaggagacgcccatcgtcgaggtcacccgctccatcaccaagcacaactacctcgtcctcgacgtcgaggacatcccccgcgttatccaggaggccttcttcctcgcctcctctggccggccggggcccgtgctcgtcgacatccccaaggacatccagcagcagatggctgtgcccgtctgggacgcgcccatgagtctgccaggctacattgcccgcctgcctaagccgccggctactgaattgctcgagcaggtcctgcgtctggttggcgaggaaagacgcccgattctctatgttggcggtggctgctctgcgtctggggaggacgtgcgccgctttgttgagctcaccgggatccctgttacaactaccctcatgggtcttggcaacttccccagcgacgacccgctgtctctgcgtatgcttgggatgcatggcactgtgtacgcaaactacgccgtcgataaggctgacctgttgcttgcatttggcgtcaggtttgatgatcgcgtcactgggaaaatcgaggcttttgcaagcaggtccaagatcgtgcacattgacattgatccagctgagattggcaagaacaagcagccgcatgtctccatttgcgcagatgtcaagctcgctttgcagggcctgaatgctgtgctaactgggagcaaatgtgacaagagtttcgattttgcttcgtggcatgacgagttggagcagcagaaaagggagtttcctctgggatacaaaactttcggggaggccatcccaccgcagtatgctatccaggtactggatgagctcaccaaaggtgaggccatcattgccactggtgttgggcagcaccagatgtgggcggctcagtattacacttacaagcgcccacggcaggtgctgtcttcggctggtctgggggcaatggggtttgggttgccggctgcagctggcaccgctgtggctaacccaggtgtcacagttgttgacattgatggggatggtagcttcctcatgaacattcaggagttagcgctgattcgcattgagaacctcccagttaaggtgatgatattgaacaaccagcatcttggaatggtggtgcagtgggaggacaggttttacaaggccaatcgggcgcatacataccttgggaacccagaaaatgagagtgagatatatccagattttgtgaccattgctaaagggttcaatgttcctgcagttcgtgtgacaaagaggagtgaagtccgtgcagcgatcaagaagatgcttgagactcctgggccatacttgttggatatcatcgtccctcaccaggagcatgtgctgcctatgatccctagcggtggtgctttcaaggacattatcatggaaggtgatggcaggatttcgtattaa

SEQ ID NO: 82535 - protein, 640 aa, Lolium multiflorum
MATATSTAVAFSGATATLPKPRTLPRHLLPSSRRALAAPIRCSAVSPSPSPAPPATALRPWGPSEPRKGADILVEALERCGISDVFAYPGGASMEIHQALTSSPLITNHLFRHEQGEAFAASGYARASGRVGVCVATSGPGATNLVSALADALLDSIPMVAITGQVQRRMIGTDAFQETPIVEVTRSITKHNYLVLDVEDIPRVIQEAFFLASSGRPGPVLVDIPKDIQQQMAVPVWDAPMSLPGYIARLPKPPATELLEQVLRLVGEERRPILYVGGGCSASGEDVRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNAVLTGSKCDKSFDFASWHDELEQQKREFPLGYKTFGEAIPPQYAIQVLDELTKGEAIIATGVGQHQMWAAQYYTYKRPRQVLSSAGLGAMGFGLPAAAGTAVANPGVTVVDIDGDGSFLMNIQELALIRIENLPVKVMILNNQHLGMVVQWEDRFYKANRAHTYLGNPENESEIYPDFVTIAKGFNVPAVRVTKRSEVRAAIKKMLETPGPYLLDIIVPHQEHVLPMIPSGGAFKDIIMEGDGRISY

SEQ ID NO: 82536 - DNA, 1836 bp, Zymomonas mobilis
  CDS (1)..(1836): transl_table=11
atgacaatcatcgcgattggatcatggggtttcgaaaaggaaataaagcatgtgtcgccaactcagcgcgccgccattgttcttgaaacactcaaggatatgggtgtcgatctgatcttcggctatcccggcggagcagttctccccatttacgatgccctttatcaggatgaaggcatccggcatattctggctcgccaagaaggcggggctgtccatgcagcagaaggctatgcgcggtcgaccggaaaacccggtgttgttatagtgacttcaggtccgggggcgacaaatgccgttaccggcatcgctgatgccatgcttgattccattccgttggttgttttttctggtcaggtcgccacgaatttaatcggaaccgatgctttccaagaggcggataccatcggcattacccgccattgcaccaagcataactatctggttcgcgacccgaaggaatttagctcagacgattgtcgaggccttccatctgggacctccggtcgtccgggaccggtggttattgaccttccgaaaaatgttcagacggcggttatcgactatatcaaaccggatcctaacaagcggatgcatcgcggttatcgtccgcgtgttaaagcggatccagtcgaaattaccaacgctcttgatatgattgccaaggcaaagcgtccggttttctatactggtggcggcgttatcaattctggtcccgatgccagcaaagccttgcgtgaattggccgacttgacgggtgttccggtaacctcaaccctgatgggcttgggcgcatttccagcctcttcccagcaatggttgggtatgcttggtatgcacggcacttacgaagccaattttgccatgcatgacgctgatttagtagttgcccttggcagccgctttgatgatcgtgtgacatgtcgggttgatagcttttcacctcattccaagaaaatccatgtcgatattgatcgttcttcgatcaaccgtatcatccatgtggacttaccgattgtgggtgatgtcggatcagtcatgcaggacatggtcgcgctttggaaagaaaagcattaccagatgcaggatatttcggcatggtgggtgcagattgatgaatggcgcgccaaacaatgcctgaattttaccaagcagggtaacgagatcatgccgcagcaggctatccgtagcctgtgggaagccacaaagggtaagaatccgatcgtctcgacagaagtcggacagcatcagatgtggaccgcccaatatttcggttttgactctcccaatcatttcctgacttcaggtggtttgggaacgatgggctatggtttcccgtctattattggcgcgcaggtcggtaatccagacagcctctgcatgacgattgctggtgaagcctctttccagatgaatattcaggaaatggctacggttgctcaatatcgtttgccggtgaaaattttcatcttgaataaccgtttcatgggcatggtgcgtcagtggcaagatttgctttatgatcatcgccggtcacaaagctattcagaagcactgcctgattttgtcgctttggccaaggcttatggctggaatgcgcttaaaattgagaagccttcccagcttgaagatggcatcaaaacgatgttggaaacgccggggcctgtcttggttgattgtcaggttgctcaattagcgaattgtttgcccatggtgccgccgggagccggccagactgaaatgattttggaatcggatatcaccgataaccatgtcaagaagccggaatataccccttccgctgcgccttcgtctgcgaccaccattcgcggttaa

SEQ ID NO: 82537 - protein, 611 aa, Zymomonas mobilis
MTIIAIGSWGFEKEIKHVSPTQRAAIVLETLKDMGVDLIFGYPGGAVLPIYDALYQDEGIRHILARQEGGAVHAAEGYARSTGKPGVVIVTSGPGATNAVTGIADAMLDSIPLVVFSGQVATNLIGTDAFQEADTIGITRHCTKHNYLVRDPKEFSSDDCRGLPSGTSGRPGPVVIDLPKNVQTAVIDYIKPDPNKRMHRGYRPRVKADPVEITNALDMIAKAKRPVFYTGGGVINSGPDASKALRELADLTGVPVTSTLMGLGAFPASSQQWLGMLGMHGTYEANFAMHDADLVVALGSRFDDRVTCRVDSFSPHSKKIHVDIDRSSINRIIHVDLPIVGDVGSVMQDMVALWKEKHYQMQDISAWWVQIDEWRAKQCLNFTKQGNEIMPQQAIRSLWEATKGKNPIVSTEVGQHQMWTAQYFGFDSPNHFLTSGGLGTMGYGFPSIIGAQVGNPDSLCMTIAGEASFQMNIQEMATVAQYRLPVKIFILNNRFMGMVRQWQDLLYDHRRSQSYSEALPDFVALAKAYGWNALKIEKPSQLEDGIKTMLETPGPVLVDCQVAQLANCLPMVPPGAGQTEMILESDITDNHVKKPEYTPSAAPSSATTIRG

SEQ ID NO: 82538 - DNA, 2001 bp, Kochia scoparia
  CDS (1)..(2001)
atggcgtctacttgtgcaaatcccacttttacccctttcaccagtaaaccccttaaaccccgttctccctttcactctttcccatttccctcaaaccccaaaaccccttcctcttcatttcgcaacctcaaaatcacatcttctctctcttcttcacaacccccgaaaccaccttccgccgtcaaaacccactcaccaccttcccctctcacaaccgacgaacccccgcaaggttttgtttcccgatttgcccctgaccaacccagaaaaggctgcgatgtcctcgttgaggccctcgagcgggagggcgtcaccgacgtgttcgcttatcctggtggcgcatcaatggagattcatcaagctctgactcgctctgattccatacgcaacgtcctgcctcgccacgagcaaggcgggatctttgccgcggaggggtatgctcgtgccacgggccgtgttggtgtctgcattgcgacatctggccctggcgctacgaacctcgtgtccgggtttgctgatgctttgctcgattccgttccactggtggcgatcacggggcaggtgccgcggcgaatgattgggacggatgcttttcaggagactcctattgttgaggtaacacggtctattaccaagcataattatctggtattagatgttgaggatattcctagaattgttaaggaggctttctttttggctaattctggtagacctggacctgttttgattgatattcctaaggatattcagcagcaattggttgtgcctgattgggatcagggggttaggttaggtgggtatgtgtctaggttgccgaaatcggtgttttcggccaatgatgaggggcttcttgagcagattgtgaggttgatgagtgaggctaagaagcctgtgttgtatgtgggaggcgggtgtttgaattctggggaggagttgaggaaattcgtcgagttgactgggattccggtggctagtactttaatgggtttgggcgcttatccctgtaatgatgacttgtctcttcatatgttgggtatgcacgggaccgtgtatgctaattatgctgttgataaggcagatttgttgcttgcctttggggttaggtttgatgatcgtgtgacagggaagcttgaggcgtttgctagccgggctaagatcgtgcatattgatattgattctgctgagattgggaagaataagcaaccccatgtgtcaatatgtgctgatgtcaagtatgcgttgaagggtatgaataagattttggagtctaggaaagggaagttgaaattaaattactctagctggagggaggaattgggtgagcaaaagaagaaattcccattgtcttttaagaccttcggggaagcgattcctcctcagtatgccattcagatgcttgatgagctgaccaatggtaacgctattattagtactggtgttgggcaacatcaaatgtgggctgctcagcattacaagtacagaaaccctcgccaatggctgacctcaggtgggttgggtgccatgggttttggtctaccagccgccattggagctgctgtggctcgacctgatgcagtggtggttgatattgatggcgatgggagtttcattatgaatgttcaagagttggctactattagggtggaaaatctccctgttaagataatgcttttgaataaccaacatttaggtatggtggttcaattggaagataggttttataaagccaatagggcacatacttaccttggaaacccttcaaaagagtctgaaatcttcccggatatgcttaaatttgctgaggcgtgtgatattcctgctgctcgtgtcaccaaggttggagatttgagggcggccatgcagacaatgttggatactccgggaccttacctgcttgatgtgattgtacctcatcaggagcatgtgctgcctatgattcctagtggtgcagccttcaaggatatcattaacgaaggtgatggaagaacaagttattga

SEQ ID NO: 82539 - protein, 666 aa, Kochia scoparia
MASTCANPTFTPFTSKPLKPRSPFHSFPFPSNPKTPSSSFRNLKITSSLSSSQPPKPPSAVKTHSPPSPLTTDEPPQGFVSRFAPDQPRKGCDVLVEALEREGVTDVFAYPGGASMEIHQALTRSDSIRNVLPRHEQGGIFAAEGYARATGRVGVCIATSGPGATNLVSGFADALLDSVPLVAITGQVPRRMIGTDAFQETPIVEVTRSITKHNYLVLDVEDIPRIVKEAFFLANSGRPGPVLIDIPKDIQQQLVVPDWDQGVRLGGYVSRLPKSVFSANDEGLLEQIVRLMSEAKKPVLYVGGGCLNSGEELRKFVELTGIPVASTLMGLGAYPCNDDLSLHMLGMHGTVYANYAVDKADLLLAFGVRFDDRVTGKLEAFASRAKIVHIDIDSAEIGKNKQPHVSICADVKYALKGMNKILESRKGKLKLNYSSWREELGEQKKKFPLSFKTFGEAIPPQYAIQMLDELTNGNAIISTGVGQHQMWAAQHYKYRNPRQWLTSGGLGAMGFGLPAAIGAAVARPDAVVVDIDGDGSFIMNVQELATIRVENLPVKIMLLNNQHLGMVVQLEDRFYKANRAHTYLGNPSKESEIFPDMLKFAEACDIPAARVTKVGDLRAAMQTMLDTPGPYLLDVIVPHQEHVLPMIPSGAAFKDIINEGDGRTSY

SEQ ID NO: 82540 - DNA, 1968 bp, Brassica napus
  CDS (1)..(1968)
atggcggcggcaacatcgtcttctccgatctccttaaccgctaaaccttcttccaaatcccctctacccatttccagattctcccttcccttctccttaaccccacagaaagactcctcccgtctccaccgtcctctcgccatctccgccgttctcaactcacccgtcaatgtcgcacctccttcccctgaaaaaaccgacaagaacaagactttcgtctcccgctacgctcccgacgagccccgcaagggtgctgatatcctcgtcgaagccctcgagcgtcaaggcgtcgaaaccgtctttgcttatcccggaggtgcttccatggagatccaccaagccttgactcgctcctccaccatccgtaacgtccttccccgtcacgaacaaggaggagtcttcgccgccgagggttacgctcgttcctccggcaaaccgggaatctgcatagccacttcgggtcccggagctaccaacctcgtcagcgggttagcagacgcgatgcttgacagtgttcctcttgtcgccattacaggacaggtccctcgccggatgatcggtactgacgccttccaagagacaccaatcgttgaggtaacgaggtctattacgaaacataactatttggtgatggatgttgatgacatacctaggatcgttcaagaagctttctttctagctacttccggtagacccggaccggttttggttgatgttcctaaggatattcagcagcagcttgcgattcctaactgggatcaacctatgcgcttacctggctacatgtctaggttgcctcagcctccggaagtttctcagttaggtcagatcgttaggttgatctcggagtctaagaggcctgttttgtacgttggtggtggaagcttgaactcgagtgaagaactggggagatttgtcgagcttactgggatccccgttgcgagtactttgatggggcttggctcttatccttgtaacgatgagttgtccctgcagatgcttggcatgcacgggactgtgtatgctaactacgctgtggagcatagtgatttgttgctggcgtttggtgttaggtttgatgaccgtgtcacgggaaagctcgaggctttcgctagcagggctaaaattgtgcacatagacattgattctgctgagattgggaagaataagacacctcacgtgtctgtgtgtggtgatgtaaagctggctttgcaagggatgaacaaggttcttgagaaccgggcggaggagctcaagcttgatttcggtgtttggaggagtgagttgagcgagcagaaacagaagttccctttgagcttcaaaacgtttggagaagccattcctccgcagtacgcgattcagatcctcgacgagctaaccgaagggaaggcaattatcagtactggtgttggacagcatcagatgtgggcggcgcagttttacaagtacaggaagccgagacagtggctgtcgtcatcaggcctcggagctatgggttttggacttcctgctgcgattggagcgtctgtggcgaaccctgatgcgattgttgtggatattgacggtgatggaagcttcataatgaacgttcaagagctggccacaatccgtgtagagaatcttcctgtgaagatactcttgttaaacaaccagcatcttgggatggtcatgcaatgggaagatcggttctacaaagctaacagagctcacacttatctcggggacccggcaagggagaacgagatcttccctaacatgctgcagtttgcaggagcttgcgggattccagctgcgagagtgacgaagaaagaagaactccgagaagctattcagacaatgctggatacaccaggaccatacctgttggatgtgatatgtccgcaccaagaacatgtgttaccgatgatcccaagtggtggcactttcaaagatgtaataacagaaggggatggtcgcactaagtactga

SEQ ID NO: 82541 - protein, 655 aa, Brassica napus
MAAATSSSPISLTAKPSSKSPLPISRFSLPFSLTPQKDSSRLHRPLAISAVLNSPVNVAPPSPEKTDKNKTFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLGQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKVLENRAEELKLDFGVWRSELSEQKQKFPLSFKTFGEAIPPQYAIQILDELTEGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARENEIFPNMLQFAGACGIPAARVTKKEELREAIQTMLDTPGPYLLDVICPHQEHVLPMIPSGGTFKDVITEGDGRTKY

SEQ ID NO: 82542 - DNA, 2004 bp, Nicotiana tabacum
  CDS (1)..(2004)
atggcggcggcggctccatctccctcttcttccgctttctccaaaaccctatcgccttcctcctccacatcctccaccctcctccctagatcaaccttccctttcccccaccacccccacaagaccaccccaccacccctccacctcacccacactcacattcacattcacagccaacgccgtcgtttcaccatatccaatgtcatttccactaaccaaaaagtttcccagaccgaaaaaaccgaaactttcgtttcccgttttgctcctgacgaacccagaaagggttccgacgttctcgtggaggctctcgaaagagaaggggttacggacgtctttgcgtacccaggtggcgcttccatggagattcaccaagctttgacccgttcaagcatcatccgcaacgtgctgccacgtcacgagcagggcggtgtcttcgccgctgagggttacgcacgcgccaccggatttcccggcgtttgcattgccacctctggccccggcgccaccaatctcgtcagcggcctcgctgacgcgctactggatagcgtccccattgttgctataacaggtcaagtgccacgtaggatgataggtactgatgcttttcaggaaactcctattgttgaggtaactagatcgattaccaagcataattatctcgttatggacgtagaggatattcctagggttgtacgtgaagcttttttcctcgcgagatcgggccggcctggccctattttgattgatgtacctaaggatattcagcaacaattggtgatacctgactgggatcagccaatgaggttacctggttacatgtctaggttacctaaattgcccaatgagatgcttttagaacaaattgttaggcttatttctgagtcaaagaagcctgttttgtatgtggggggtgggtgttcgcaatcgagtgaggacttgagacgattcgtggagctcacgggtatccccgtggcaagtactttgatgggtcttggagcttttccaactggggatgagctttccctttcaatgttgggtatgcatggtactgtttatgctaattatgctgtggacagtagtgatttgttgctcgcatttggggtgaggtttgatgatagagttactggaaagttagaagcttttgctagccgagcaaaaattgttcacattgatattgattcagctgagattggaaagaacaagcagcctcatgtttccatttgtgcagatatcaagttggcgttacagggtttgaattcgatactggagagtaaggaaggtaaactgaagttggatttttctgcttggaggcaggagttgacggagcagaaagtgaagcacccattgaactttaaaacttttggtgatgcaattcctccgcaatatgctatccaggttctagatgagttaactaatgggaatgctattataagtactggtgtggggcaacaccagatgtgggctgctcaatactataagtacagaaagccacgccaatggttgacatctggtggattaggagcaatgggatttggtttgcccgctgctattggtgcggctgttggaagaccggatgaagttgtggttgacattgatggtgatggcagtttcatcatgaatgtgcaggagcttgcaacaattaaggtggagaatctcccagttaagattatgttactgaataatcaacacttgggaatggtggttcaatgggaggatcggttctataaggctaacagagcacacacatacctggggaatccttctaatgaggcggagatctttcctaatatgctgaaatttgcagaggcttgtggcgtacctgctgcaagagtgacacatagggatgatcttagagctgccattcagaagatgttagacactcctgggccatacttgttggatgtgattgtacctcatcaggaacatgttttacctatgattcccagtggcggagctttcaaagatgtgatcacagagggtgacgggagaagttcctattga

SEQ ID NO: 82543 - protein, 667 aa, Nicotiana tabacum
MAAAAPSPSSSAFSKTLSPSSSTSSTLLPRSTFPFPHHPHKTTPPPLHLTHTHIHIHSQRRRFTISNVISTNQKVSQTEKTETFVSRFAPDEPRKGSDVLVEALEREGVTDVFAYPGGASMEIHQALTRSSIIRNVLPRHEQGGVFAAEGYARATGFPGVCIATSGPGATNLVSGLADALLDSVPIVAITGQVPRRMIGTDAFQETPIVEVTRSITKHNYLVMDVEDIPRVVREAFFLARSGRPGPILIDVPKDIQQQLVIPDWDQPMRLPGYMSRLPKLPNEMLLEQIVRLISESKKPVLYVGGGCSQSSEDLRRFVELTGIPVASTLMGLGAFPTGDELSLSMLGMHGTVYANYAVDSSDLLLAFGVRFDDRVTGKLEAFASRAKIVHIDIDSAEIGKNKQPHVSICADIKLALQGLNSILESKEGKLKLDFSAWRQELTEQKVKHPLNFKTFGDAIPPQYAIQVLDELTNGNAIISTGVGQHQMWAAQYYKYRKPRQWLTSGGLGAMGFGLPAAIGAAVGRPDEVVVDIDGDGSFIMNVQELATIKVENLPVKIMLLNNQHLGMVVQWEDRFYKANRAHTYLGNPSNEAEIFPNMLKFAEACGVPAARVTHRDDLRAAIQKMLDTPGPYLLDVIVPHQEHVLPMIPSGGAFKDVITEGDGRSSY

SEQ ID NO: 82544 - DNA, 1914 bp, Brassica napus
  CDS (1)..(1914)
atggcttcgttttcgttcttcggcaccattccgtcgtctcccacaaaagcttccgtcttctccctgccggtgtcggtaactacgctcccgtccttcccgcgccgccgtgctactcgtgtctccgtttccgccaactcgaagaaagaccaagaccgcacagcttcacgtcgagagaatccgagcacattcagctccaaatacgctcccaacgtgccccgcagtggcgcagacatcctggtcgaagccctggagcgtcaaggagtggacgtagtcttcgcttacccaggaggcgcatcaatggagatccatcaagccctaactcgctccaacacaatccgaaacgtccttccccgtcacgaacaaggaggtatcttcgccgccgagggttacgctcgttcctccggtaaacccggaatctgcatcgccacttccggtccaggagctatgaatctcgtcagcggattagccgacgccctgtttgacagcgtacccctcatcgcaatcacaggacaggtccctcgccggatgattggtaccatggcgttccaggagacacccgttgttgaggtaacgaggactataacgaaacataactatcttgttatggaagttgatgatatacctaggatcgttcgagaagctttctttctagctacttcggttagaccgggaccggttcttatagacgtccccaaagatgttcagcaacagtttgcgattcctaactgggaacagcctatgcgcttacctctttacatgtctacgatgcctaaaccccccaaagtttctcacttagagcagattcttaggttggtttcggagtctaagaggcctgtcttgtacgttggaggtggttgtctgaactcgagtgaggaactgcgcagatttgtggaacttactggcatccctgttgctagtacgttcatgggacttggatcgtatccttgtgacgatgaagagttctctctgcaaatgctaggaatgcatggaacagtgtacgctaattacgctgtcgagtatagcgatcttctgcttgcttttggggttaggtttgacgaccgtgtgaccggaaagcttgaggcctttgctagccgggccaagatcgtgcatattgatattgattctaccgaaatcgggaagaacaagacacctcatgtgtcggtgtgttgtgatgttcagctagccttgcaagggatgaacgaggttcttgagaaccgacgagatgtgcttgacttcggggaatggagatgtgaattgaacgaacagagactaaagttccctctccgctacaagacgtttggggaagagattcctccacagtacgccattcaactacttgacgagctaaccgacgggaaggcaattatcactactggtgtcgggcaacaccagatgtgggccgcccaattctacagattcaagaaaccccgccaatggctgtcttcaggaggcctaggagccatggggttcggtcttcctgcagccatgggagccgctatagccaacccgggagcagtggttgtcgacattgatggggatggtagcttcatcatgaacattcaagaactggcaaccatcagggttgagaatcttccagtcaaggttttgctgattaataatcagcacctcggaatggtccttcagtgggaagaccacttctacgcagctaacagagccgattcttttctgggagacccggcgaaccctgaggcggtattcccggatatgctgttgttcgccgcatcgtgcggtataccagccgccagggtcaccagaagggaggacctccgagaggcaatccagacaatgctggacacacctggaccattcttgttggatgtggtctgtcctcaccaggaccatgtgttaccactcatccctagtggcggcaccttcaaggacattattgtgtag

SEQ ID NO: 82545 - protein, 637 aa, Brassica napus
MASFSFFGTIPSSPTKASVFSLPVSVTTLPSFPRRRATRVSVSANSKKDQDRTASRRENPSTFSSKYAPNVPRSGADILVEALERQGVDVVFAYPGGASMEIHQALTRSNTIRNVLPRHEQGGIFAAEGYARSSGKPGICIATSGPGAMNLVSGLADALFDSVPLIAITGQVPRRMIGTMAFQETPVVEVTRTITKHNYLVMEVDDIPRIVREAFFLATSVRPGPVLIDVPKDVQQQFAIPNWEQPMRLPLYMSTMPKPPKVSHLEQILRLVSESKRPVLYVGGGCLNSSEELRRFVELTGIPVASTFMGLGSYPCDDEEFSLQMLGMHGTVYANYAVEYSDLLLAFGVRFDDRVTGKLEAFASRAKIVHIDIDSTEIGKNKTPHVSVCCDVQLALQGMNEVLENRRDVLDFGEWRCELNEQRLKFPLRYKTFGEEIPPQYAIQLLDELTDGKAIITTGVGQHQMWAAQFYRFKKPRQWLSSGGLGAMGFGLPAAMGAAIANPGAVVVDIDGDGSFIMNIQELATIRVENLPVKVLLINNQHLGMVLQWEDHFYAANRADSFLGDPANPEAVFPDMLLFAASCGIPAARVTRREDLREAIQTMLDTPGPFLLDVVCPHQDHVLPLIPSGGTFKDIIV

SEQ ID NO: 82546 - DNA, 1995 bp, Nicotiana tabacum
  CDS (1)..(1995)
atggcggcggctgcggcggctccatctccctctttctccaaaaccctatcgtcctcctcctccaaatcctccaccctcctccctagatccaccttccctttcccccaccacccccacaaaaccaccccaccacccctccacctcacccccacccacattcacagccaacgccgtcgtttcaccatctccaatgtcatttccactacccaaaaagtttccgagacccaaaaagccgaaactttcgtttcccgttttgcccctgacgaacccagaaagggttccgacgttctcgtggaggccctcgaaagagaaggggttacggacgtttttgcgtacccaggcggcgcttccatggagattcaccaagctttgacgcgctcaagcatcatccgcaacgtgctaccacgtcacgagcagggtggtgtcttcgccgctgagggttacgcacgcgccaccggcttccccggcgtttgcattgccacctccggccctggcgccaccaatctcgtcagtggcctcgcggacgccctactggatagcgtccccattgttgctataaccggtcaagtgccacgtaggatgatcggtactgatgcttttcaggaaactccgattgttgaggtaactagatcgattaccaagcataattatctcgttatggacgtagaggatattcctagggttgtacgtgaggcttttttccttgcgagatcgggccggcctggccctgttttgattgatgtacctaaggatattcagcaacaattggtgatacctgactgggatcagccaatgaggttgcctggttacatgtctaggttacctaaattgcccaatgagatgcttttagaacaaattgttaggcttatttctgagtcaaagaagcctgttttgtatgtggggggtgggtgttcgcaatcgagtgaggagttgagacgattcgtggagctcaccggtatccccgtggcaagtactttgatgggtcttggagcttttccaactggggatgagctttccctttcaatgttgggtatgcatggtactgtttatgctaattatgctgtggacagtagtgatttattgctcgcatttggggtgaggtttgatgatagagttactggaaagttagaagcttttgctagccgagcgaaaattgttcacattgatattgattcagctgagattggaaagaacaagcagcctcatgtttccatttgtgcggatatcaagttggcgttacagggtttgaattcgatattggagagtaaggaaggtaaactgaagttggatttttctgcttggaggcaggagttgacggtgcagaaagtgaagtacccgttgaattttaaaacttttggtgatgctattcctccgcaatatgctatccaggttctagatgagttaactaatgggagtgctattataagtaccggtgttgggcagcaccagatgtgggctgctcaatattataagtacagaaagccacgccaatggttgacatctggtggattaggagcgatgggatttggtttgcccgctgctattggtgcggctgttggaagacctgatgaagttgtggttgacattgatggtgatggcagtttcatcatgaatgtgcaggagctagcaactattaaggtggagaatctcccagttaagattatgttactgaataatcaacacttgggaatggtggttcaatgggaggatcggttctataaggctaacagagcacacacatacctggggaatccttctaatgaggcggagatctttcctaatatgttgaaatttgcagaggcttgtggcgtacctgctgcgagagtgacacacagggatgatcttagagcggctattcaaaagatgttagacactcctgggccatacttgttggatgtgattgtacctcatcaggaacatgttctacctatgattcccagtggcggggctttcaaagatgtgatcacagagggtgacgggagaagttcctattga

SEQ ID NO: 82547 - protein, 664 aa, Nicotiana tabacum
MAAAAAAPSPSFSKTLSSSSSKSSTLLPRSTFPFPHHPHKTTPPPLHLTPTHIHSQRRRFTISNVISTTQKVSETQKAETFVSRFAPDEPRKGSDVLVEALEREGVTDVFAYPGGASMEIHQALTRSSIIRNVLPRHEQGGVFAAEGYARATGFPGVCIATSGPGATNLVSGLADALLDSVPIVAITGQVPRRMIGTDAFQETPIVEVTRSITKHNYLVMDVEDIPRVVREAFFLARSGRPGPVLIDVPKDIQQQLVIPDWDQPMRLPGYMSRLPKLPNEMLLEQIVRLISESKKPVLYVGGGCSQSSEELRRFVELTGIPVASTLMGLGAFPTGDELSLSMLGMHGTVYANYAVDSSDLLLAFGVRFDDRVTGKLEAFASRAKIVHIDIDSAEIGKNKQPHVSICADIKLALQGLNSILESKEGKLKLDFSAWRQELTVQKVKYPLNFKTFGDAIPPQYAIQVLDELTNGSAIISTGVGQHQMWAAQYYKYRKPRQWLTSGGLGAMGFGLPAAIGAAVGRPDEVVVDIDGDGSFIMNVQELATIKVENLPVKIMLLNNQHLGMVVQWEDRFYKANRAHTYLGNPSNEAEIFPNMLKFAEACGVPAARVTHRDDLRAAIQKMLDTPGPYLLDVIVPHQEHVLPMIPSGGAFKDVITEGDGRSSY

SEQ ID NO: 82548 - DNA, 1959 bp, Brassica napus
  CDS (1)..(1959)
atggcggcggcaacatcgtcttctccgatctccttaaccgctaaaccttcttccaaatcccctctacccatttccagattctcccttcccttctccttaaccccacagaaaccctcctcccgtctccaccgtccactcgccatctccgccgttctcaactcacccgtcaatgtcgcacctgaaaaaaccgacaagatcaagactttcatctcccgctacgctcccgacgagccccgcaagggtgctgatatcctcgtggaagccctcgagcgtcaaggcgtcgaaaccgtcttcgcttatcccggaggtgcctccatggagatccaccaagccttgactcgctcctccaccatccgtaacgtcctcccccgtcacgaacaaggaggagtcttcgccgccgagggttacgctcgttcctccggcaaaccgggaatctgcatagccacttcgggtcccggagctaccaacctcgtcagcgggttagccgacgcgatgcttgacagtgttcctctcgtcgccatcacaggacaggtccctcgccggatgatcggtactgacgcgttccaagagacgccaatcgttgaggtaacgaggtctattacgaaacataactatctggtgatggatgttgatgacatacctaggatcgttcaagaagcattctttctagctacttccggtagacccggaccggttttggttgatgttcctaaggatattcagcagcagcttgcgattcctaactgggatcaacctatgcgcttgcctggctacatgtctaggctgcctcagccaccggaagtttctcagttaggccagatcgttaggttgatctcggagtctaagaggcctgttttgtacgttggtggtggaagcttgaactcgagtgaagaactggggagatttgtcgagcttactgggatccctgttgcgagtacgttgatggggcttggctcttatccttgtaacgatgagttgtccctgcagatgcttggcatgcacgggactgtgtatgctaactacgctgtggagcatagtgatttgttgctggcgtttggtgttaggtttgatgaccgtgtcacgggaaagctcgaggcgtttgcgagcagggctaagattgtgcacatagacattgattctgctgagattgggaagaataagacacctcacgtgtctgtgtgtggtgatgtaaagctggctttgcaagggatgaacaaggttcttgagaaccgggcggaggagctcaagcttgatttcggtgtttggaggagtgagttgagcgagcagaaacagaagttcccgttgagcttcaaaacgtttggagaagccattcctccgcagtacgcgattcaggtcctagacgagctaacccaagggaaggcaattatcagtactggtgttggacagcatcagatgtgggcggcgcagttttacaagtacaggaagccgaggcagtggctgtcgtcctcaggactcggagctatgggtttcggacttcctgctgcgattggagcgtctgtggcgaaccctgatgcgattgttgtggacattgacggtgatggaagcttcataatgaacgttcaagagctggccacaatccgtgtagagaatcttcctgtgaagatactcttgttaaacaaccagcatcttgggatggtcatgcaatgggaagatcggttctacaaagctaacagagctcacacttatctcggggacccggcaagggagaacgagatcttccctaacatgctgcagtttgcaggagcttgcgggattccagctgcgagagtgacgaagaaagaagaactccgagaagctattcagacaatgctggatacacctggaccgtacctgttggatgtcatctgtccgcaccaagaacatgtgttaccgatgatcccaagtggtggcactttcaaagatgtaataaccgaaggggatggtcgcactaagtactga

SEQ ID NO: 82549 - protein, 652 aa, Brassica napus
MAAATSSSPISLTAKPSSKSPLPISRFSLPFSLTPQKPSSRLHRPLAISAVLNSPVNVAPEKTDKIKTFISRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLGQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKVLENRAEELKLDFGVWRSELSEQKQKFPLSFKTFGEAIPPQYAIQVLDELTQGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARENEIFPNMLQFAGACGIPAARVTKKEELREAIQTMLDTPGPYLLDVICPHQEHVLPMIPSGGTFKDVITEGDGRTKY

SEQ ID NO: 82550 - DNA, 2013 bp, Arabidopsis thaliana
  CDS (1)..(2013)
atggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaagctttagaacgtcaaggcgtagaaaccgtattcgcttaccctggaggtgcatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatccctaggattattgaggaagctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtttgaattctagcgatgaattgggtaggtttgttgagcttacggggatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaagcttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaagcttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagctttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggatccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgagtggtggcactttcaacgatgtcataacggaaggagatggccggattaaatactga

SEQ ID NO: 82551 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWEDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 82552 - DNA, 2157 bp, Cryptococcus neoformans var
  CDS (1)..(2157)
atgcttacacgccaagctcgtcttctcagacgcatccctcccccgaacgcagtccttcagtcgggcctccaaagaagacacaggtccactgaccgttattccaacaacatccacacatcttccacccaaaatgccccagcccccgtgtatgatactcccatccgcgagaaaggtatgaccctcgaggccaaggagcgtgtccgggcccatgtgaggaaaatccaaagcagcgcttctactgctgctgcaagtcctgctgttaggcctcaacctgcccaacactttcaggctgcgcctcagcccatgcccactaatatgcctcgttttgaaagcgacagccaggtaaagaacgggctggactactcatttatcggtctctccggtggccagatcttccaagagatgatgctccgtcacgacgtaaagcaggtctttggttatccgggaggcgccattcttcctgtctttgacgccatctataactcccctcacttcgagttcgttcttccaagacacgagcagggtgctggccacatggcagaaggctacgctcgcgtttctggcaaaccaggtgttgtccttgtcacttctggccctggcgctaccaacgtcattacccccatgcaagatgccttgagtgacggtgtgcctatggttgttttctgtggtcaggtcgccacgaacctgattggttccgatgctttccaagaagccgatgtcgtcggtatttctagaagttgcacgaagtggaacgtcatggtcaaagacatcgctgagctcccgagaagaatcaacgaagctttcaagattgccaccaccggtcgtcctggcccagtcctagttgatcttcccaaggatgtcaccgctgctattctccgtacaccaatccccgctaaatctgttcaacctggtcactctccttatcttccgtctaaccctctcaacccgtcgtctcaaccgtccgacccccttccaggcgatgccgacttgattacagaggccgctcaaatgatcaacaaggctaagagacccattatcttcgccggtaacggtgtcctttcgtctcctgaaggccctaaacttctgaaggagctctctgacaaggggagaattcctgtgaccaccactcttcagggtctgggagccttcgacgagagagacgagaagagtttacacatgatcggcatgcatgggtccgcatacgccaactttgcgatgcaagaggcggatgtgctgattgccttgggagtgagatttgatgatcgtgtgaccggcaaggttgacaccttcgcacccgctgccaaagcagctgctgctgagggccgaggcggtatcattcacttcgaaatccaacccaaaaacatcaacaagattgttgaggcccagattcctgtgctcggcgatgtcgttgcctctctcggagagcttgtccctcaaattgaagctgtcgaccgatctgcctggattggccgatgcaaggctaccaaggagaggtaccccttcacgtatacccctagccaggagggccagaagttgaagccccaagaggttgttcaggagctcgaccgacaggctgaagctctcggcaaggagaaatttgttatctcgactggtgttggccaacatcaaatgtgggcctgtcagtactaccgatggactgagcctcgttcgtgggtctcttccggtggccttggtactatgggcttcggtcttccctcagctatcggcgccaaggttgccgctcctgaaaagtatgtgattgacatcgacggtgatgcgagcttttccatgactgccatggagctggctactgcaagccagtacgacatcggcgtcaaggtattgttgttcaataatgaattccaagggatggtcgagcaatggcaagatcttttctacgaaaaccgatactctcatacccgaatgaccaaccccgactttgtcaagctctcagagtctatgggagccaaaggactcaggtgcacaaaacttgaagatctgcctcgaatgatgaaggagtttttggaatacgatggcaagaggcccatcgtacttgaatgtctcgtttccagcgaacacgtatatcctatgattcccgcaggcaaagccttacatgagcagcttctccaccctctccttcggaacggctctgagtaa

SEQ ID NO: 82553 - protein, 718 aa, Cryptococcus neoformans var
MLTRQARLLRRIPPPNAVLQSGLQRRHRSTDRYSNNIHTSSTQNAPAPVYDTPIREKGMTLEAKERVRAHVRKIQSSASTAAASPAVRPQPAQHFQAAPQPMPTNMPRFESDSQVKNGLDYSFIGLSGGQIFQEMMLRHDVKQVFGYPGGAILPVFDAIYNSPHFEFVLPRHEQGAGHMAEGYARVSGKPGVVLVTSGPGATNVITPMQDALSDGVPMVVFCGQVATNLIGSDAFQEADVVGISRSCTKWNVMVKDIAELPRRINEAFKIATTGRPGPVLVDLPKDVTAAILRTPIPAKSVQPGHSPYLPSNPLNPSSQPSDPLPGDADLITEAAQMINKAKRPIIFAGNGVLSSPEGPKLLKELSDKGRIPVTTTLQGLGAFDERDEKSLHMIGMHGSAYANFAMQEADVLIALGVRFDDRVTGKVDTFAPAAKAAAAEGRGGIIHFEIQPKNINKIVEAQIPVLGDVVASLGELVPQIEAVDRSAWIGRCKATKERYPFTYTPSQEGQKLKPQEVVQELDRQAEALGKEKFVISTGVGQHQMWACQYYRWTEPRSWVSSGGLGTMGFGLPSAIGAKVAAPEKYVIDIDGDASFSMTAMELATASQYDIGVKVLLFNNEFQGMVEQWQDLFYENRYSHTRMTNPDFVKLSESMGAKGLRCTKLEDLPRMMKEFLEYDGKRPIVLECLVSSEHVYPMIPAGKALHEQLLHPLLRNGSE

SEQ ID NO: 82554 - DNA, 1758 bp, Cyanidium caldarium
  CDS (1)..(1758): transl_table=11
atgaactataaaaaaaactcattaattaagactggggcctttgctttaatagatatgctcgtaaaacacaaagtaaaaaatatttttggatatccaggaggagcgattcttcccatctatgatgaactctatcactgggaaaaaaagaaactaattaaacactatttagttcgtcacgaacaaagtgcagctcatgcagcagatgcttatgccagagcaactaatgaagtaggggtgtgtttagctacatctgggcctggcgcaacaaatttagtaacaggaatagctactgctcaaatggactctgttcccataattgctattacaggacaagttagcagagcatttataggtacagatgcttttcaagaagtggatatttttggaattacactaccgatagttaaacattcattcgtagtaagagaccccagagatatatccacaatcgtttcagaagcattctatattagtaaacatggtagaccaggtgctgttttaatagatgtacctaaagatgttggactagaagaatttaactatcatgactatgactcaatccgtgatcacaaacctataactaaatacaggccaatatacgggcctagcattagacaaattgaaaaattcaaaaaaatgcttttagagtccaaacagcctattctatatgttggaggcggggctgttatgtctagagctcagcacgaaatcgaagaactagcaagctttataaaaattccggtaaccacaactttaatggggaaaggatcttttaatgaatacaatcctttgtatcttggaatgcttggcatgcatggaactgcttatgcgaacttcgctgttagcgagtgcgatttgctcattgccttaggggcaagatttgacgacagagtgactggaaaactagatgaatttgcatgcaatgctcaagtaattcacgtcgacatagatcctgcagaaattggcaaaaacagaattccgcaattagctattatttcagatataaaaatagtgctgaaagaattattgtcgtctatgaaagaaggaacaaacaatatggataaaaatcaaacacaagcttggctacatagaattcataaatggaagaaagaatatccattaagcattcctcatgatagtaaacttctatatccacaagaagtaataaatgaaataagtcaaatagcacaaaaggctttctttgcaacagatgtcggtcaacatcagatgtgggctgctcaatttttaaaagttgaacaaggcaaatggctatcaagctctggccttggtacaatgggatatggattgcccgcggcgataggagcaaaaattgctaatcctaacgacctaattatatgtataacaggagacgccagttttcaaatgaacttgcaagaactagggactatagcacaatatgagttggatatcaaaatatttataattaataatcaatggcaagggatggtcaggcaatggcaacaagctttttacgaccagaggtatgcgcactctaacatggccaagggacaacctgattttgttcaattagcaaactcttacgggataagagggataagagtcacgacaagcaaagatttaaaatcaaaaattgaaagaattatatcaacacctggccctttgttgatcgattgcatcgttgctactagcgaaaattgttatccaatgatagctcctggaaaaagtaattctcaaatgttaggactcacaaaacaattaaaaactattacgaactaa

SEQ ID NO: 82555 - protein, 585 aa, Cyanidium caldarium
MNYKKNSLIKTGAFALIDMLVKHKVKNIFGYPGGAILPIYDELYHWEKKKLIKHYLVRHEQSAAHAADAYARATNEVGVCLATSGPGATNLVTGIATAQMDSVPIIAITGQVSRAFIGTDAFQEVDIFGITLPIVKHSFVVRDPRDISTIVSEAFYISKHGRPGAVLIDVPKDVGLEEFNYHDYDSIRDHKPITKYRPIYGPSIRQIEKFKKMLLESKQPILYVGGGAVMSRAQHEIEELASFIKIPVTTTLMGKGSFNEYNPLYLGMLGMHGTAYANFAVSECDLLIALGARFDDRVTGKLDEFACNAQVIHVDIDPAEIGKNRIPQLAIISDIKIVLKELLSSMKEGTNNMDKNQTQAWLHRIHKWKKEYPLSIPHDSKLLYPQEVINEISQIAQKAFFATDVGQHQMWAAQFLKVEQGKWLSSSGLGTMGYGLPAAIGAKIANPNDLIICITGDASFQMNLQELGTIAQYELDIKIFIINNQWQGMVRQWQQAFYDQRYAHSNMAKGQPDFVQLANSYGIRGIRVTTSKDLKSKIERIISTPGPLLIDCIVATSENCYPMIAPGKSNSQMLGLTKQLKTITN

SEQ ID NO: 82556 - DNA, 1689 bp, Escherichia coli
  CDS (1)..(1689): transl_table=11
atggcaagttcgggcacaacatcgacgcgtaagcgctttaccggcgcagaatttatcgttcatttcctggaacagcagggcattaagattgtgacaggcattccgggcggttctatcctgcctgtttacgatgccttaagccaaagcacgcaaatccgccatattctggcccgtcatgaacagggcgcgggctttatcgctcagggaatggcgcgcaccgacggtaaaccggcggtctgtatggcctgtagcggaccgggtgcgactaacctggtgaccgccattgccgatgcgcggctggactccatcccgctgatttgcatcactggtcaggttcccgcctcgatgatcggcaccgacgccttccaggaagtggacacctacggcatctctatccccatcaccaaacacaactatctggtcagacatatcgaagaactcccgcaggtcatgagcgatgccttccgcattgcgcaatcaggccgcccaggcccggtgtggatagacattcctaaggatgtgcaaacggcagtttttgagattgaaacacagcccgctatggcagaaaaagccgccgcccccgcctttagcgaagaaagcattcgtgacgcagcggcgatgattaacgctgccaaacgcccggtgctttatctgggcggcggtgtgatcaatgcgcccgcacgggtgcgtgaactggcggagaaagcgcaactgcctaccaccatgactttaatggcgctgggcatgttgccaaaagcgcatccgttgtcgctgggtatgctggggatgcacggcgtgcgcagcaccaactatattttgcaggaggcggatttgttgatagtgctcggtgcgcgttttgatgaccgggcgattggcaaaaccgagcagttctgtccgaatgccaaaatcattcatgtcgatatcgaccgtgcagagctgggtaaaatcaagcagccgcacgtggcgattcaggcggatgttgatgacgtgctggcgcagttgatcccgctggtggaagcgcaaccgcgtgcagagtggcaccagttggtagcggatttgcagcgtgagtttccgtgtccaatcccgaaagcgtgcgatccgttaagccattacggcctgatcaacgccgttgccgcctgtgtcgatgacaatgcaattatcaccaccgacgttggtcagcatcagatgtggaccgcgcaagcttatccgctcaatcgcccacgccagtggctgacctccggtgggctgggcacgatgggttttggcctgcctgcggcgattggcgctgcgctggcgaacccggatcgcaaagtgttgtgtttctccggcgacggcagcctgatgatgaatattcaggagatggcgaccgccagtgaaaatcagctggatgtcaaaatcattctgatgaacaacgaagcgctggggctggtgcatcagcaacagagtctgttctacgagcaaggcgtttttgccgccacctatccgggcaaaatcaactttatgcagattgccgccggattcggcctcgaaacctgtgatttgaataacgaagccgatccgcaggcttcattgcaggaaatcatcaatcgccctggcccggcgctgatccatgtgcgcattgatgccgaagaaaaagtttacccgatggtgccgccaggtgcggcgaatactgaaatggtgggggaataa

SEQ ID NO: 82557 - protein, 562 aa, Escherichia coli
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPGPVWIDIPKDVQTAVFEIETQPAMAEKAAAPAFSEESIRDAAAMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPLVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYEQGVFAATYPGKINFMQIAAGFGLETCDLNNEADPQASLQEIINRPGPALIHVRIDAEEKVYPMVPPGAANTEMVGE

SEQ ID NO: 82558 - DNA, 1728 bp, Guillardia theta
  CDS (1)..(1728)
atgcctaatattttaaaaaatagagataccacaggtgcattcgcattaattgatagtttagttcgccatggtgttaaacatatttttggttatccaggtggtgcaattttacctatatatgatgaactttatgcttgggaaaaagaaggatttattgagcatattttagttcgccatgaacaaggagccgctcatgctagtgacggatatgcaagatcaacaggtaacgtaggtgtgtgtttcgctacttcaggacccggtgctacaaatttagtaacaggtattgctactgctcatatggattcagtgcctatggtcattattacgggtcaagtaggacggtcttttataggtactgatgcattccaagaagtcgatatttttggtattactttacctattgttaaacattcatatgttgtccgtgaaacaaaagagatgggtaaaatagtagcagaatcattttttatagcaaaatatggtcgaccaggtcctgtactaattgatataccaaaggatgttgggctagaaaaatttgattatcaaattgtaaatccaaataatataaacttagcaggatgtcctgtcttaaaaaattatgatcagaatagaattagtcaagcagctaatttaataaagcaatccagtcaacctttattatatattggtggtggcgcagtaacgtctaattcacacaacgaaattaatgagttaattaacttagtaaagattccagttgctacaacattaatgggtaaaggaattatcgatgaatctcaccctttatcattaggtatgttaggaatgcatggtactgtttatgcgaattatgcagtaagtgaatgtgatctactcatagctttaggagcgcgctttgacgaccgtgtaacaggtaagttagacgaatttgcgtgtcatgcacaagttattcatgtagatatagatccagctgaaattgggaagaatcgaacaccccaaatcggtattgtaggtgaaatcaaagactttgtccgtgatttaattgaatgtttaaaaaatgacattaattttgacagcgaacagagccaagcttggaggtcacgaataataagatggcgaaaagaatatccacttcttgtaccaaaaaatataaataatttatcaccacaagaagttattcacgaaattagtacagaagctacaaatgcttattttacaacagatgtaggccaacatcaaatgtgggcagctcaatttatcaaaacaagtcaaaaacgatggattacaagtgctggtttaggaacaatgggatacgggttacccgcagctataggtgtacaaatagcacatccaaatgaacaagttatttgtatctctggtgatgcaagtttccaaatgaatatccaagaactaggtacagtatcacaatatggattaccaattaaaatatttattattaataataaatggcaagggatggtaagacaatggcagcaagcgttttacggtgaaagatattcacattctaatatggaaaaaggtgctcctaattttacgaaagtggccgaagcatttggcttacgctcactgaaaataaaatcccgtaacgatctcaaactgagaattaaagaggctttagattatgatggacctatactagttgatatacaagttatcgcagatgaaaactgttatccaatggttgctccaggaaagagtaatgcacaaatgatgggtattaactcgtag

SEQ ID NO: 82559 - protein, 575 aa, Guillardia theta
MPNILKNRDTTGAFALIDSLVRHGVKHIFGYPGGAILPIYDELYAWEKEGFIEHILVRHEQGAAHASDGYARSTGNVGVCFATSGPGATNLVTGIATAHMDSVPMVIITGQVGRSFIGTDAFQEVDIFGITLPIVKHSYVVRETKEMGKIVAESFFIAKYGRPGPVLIDIPKDVGLEKFDYQIVNPNNINLAGCPVLKNYDQNRISQAANLIKQSSQPLLYIGGGAVTSNSHNEINELINLVKIPVATTLMGKGIIDESHPLSLGMLGMHGTVYANYAVSECDLLIALGARFDDRVTGKLDEFACHAQVIHVDIDPAEIGKNRTPQIGIVGEIKDFVRDLIECLKNDINFDSEQSQAWRSRIIRWRKEYPLLVPKNINNLSPQEVIHEISTEATNAYFTTDVGQHQMWAAQFIKTSQKRWITSAGLGTMGYGLPAAIGVQIAHPNEQVICISGDASFQMNIQELGTVSQYGLPIKIFIINNKWQGMVRQWQQAFYGERYSHSNMEKGAPNFTKVAEAFGLRSLKIKSRNDLKLRIKEALDYDGPILVDIQVIADENCYPMVAPGKSNAQMMGINS

SEQ ID NO: 82560 - DNA, 1776 bp, Methanococcus jannaschii
  CDS (1)..(1776): transl_table=11
atgaaaggtgctgaagcaatcataaaagcattggaagcggagggagttaagattatatttggttatccaggaggagctatgcttcctttttatgatgcgttgtatgatagcgatttagttcatatattaacaaggcatgaacaggcagcagcacatgcagcagatggatttgcgagagcaagtggagaggctggggtttgcgtctctacctctggccctggagctacaaacttagttactgggatagcaaccgcttatgcagattcttctccagttattgctttaacagggcaagtcccaacaaaacttattggaaacgatgcatttcaggagattgacgctcttggattattcatgccaataacaaaacacaatttccaaataaaaaaaccagaagagattccagagacgtttagagccgcttttgaaattgccacaactggaagaccaggaccggttcatatagacctcccaaaggatgtgcaagatggagaaatagatattgaaaaatacccaattcctgcaaaggttgatttgccaggttataaaccaaaaactgtagggcatcctctacagataaagaaagctgctaaattgatagctgaatctgagagacctgtaatcttagctggtggaggagttataattagtggagcttcagaagagttattgagattagctgagtttgttaaaattccagtatgcacaaccttaatgggtaagggttgtttcccagaagaccatcctttagctttaggaatggttggaatgcatggaactaaagctgcaaattacgcagttacggagtgtgatgttctcatagctattggatgtagattttcagatagggttactggggatatcagatactttgctccagaggcaaagattattcatatagatatagacccagctgagataggaaaaaatgttagagctgatattccaatagttggagatgcaaaaaatgttttgagagatttgttagctgcattaatagcattagaaattaaagacaaagaaacatggcttgaaagaatttatgaattaaaaaaattatctatcccaatgatggactttgatgataagccaataaagccacaaaggtttgttaaggatttaatggaagttttgaatgagattgactcaaaattaaaaaacacaattataacaacagatgttggacaaaatcagatgtggatggcacacttctttaaaacaaagatgccaagaagctttttagcttctggtggtttaggaactatgggttttggtttccctgctgcaattggggcaaaggtagctaaaccttatgctaatgttatctctattactggagatggaggatttttgatgaactctcaggagttggcaacaattagcgaatatgatattcctgttgttatctgtatttttgacaacagaactttgggaatggtctatcaatggcaaaacctatactatgggcagaggcagagtgaagttcatttgggagagagtcctgactttgttaaattagctgaaagttatggagttaaagctgatagaataataagcccagatgaaattaaagagaagttgaaagaagcaatattaagtaatgagccatacctcttagatattgttatagaccctgctgaagctctgccaatggttcctccaggtgggagattaaccaatattgtccagccaattagggtagaaccaaaaataaaaaaaccacagttcgatgaaattaagaaaataagagatatggcagcagttaaagagttttag

SEQ ID NO: 82561 - protein, 591 aa, Methanococcus jannaschii
MKGAEAIIKALEAEGVKIIFGYPGGAMLPFYDALYDSDLVHILTRHEQAAAHAADGFARASGEAGVCVSTSGPGATNLVTGIATAYADSSPVIALTGQVPTKLIGNDAFQEIDALGLFMPITKHNFQIKKPEEIPETFRAAFEIATTGRPGPVHIDLPKDVQDGEIDIEKYPIPAKVDLPGYKPKTVGHPLQIKKAAKLIAESERPVILAGGGVIISGASEELLRLAEFVKIPVCTTLMGKGCFPEDHPLALGMVGMHGTKAANYAVTECDVLIAIGCRFSDRVTGDIRYFAPEAKIIHIDIDPAEIGKNVRADIPIVGDAKNVLRDLLAALIALEIKDKETWLERIYELKKLSIPMMDFDDKPIKPQRFVKDLMEVLNEIDSKLKNTIITTDVGQNQMWMAHFFKTKMPRSFLASGGLGTMGFGFPAAIGAKVAKPYANVISITGDGGFLMNSQELATISEYDIPVVICIFDNRTLGMVYQWQNLYYGQRQSEVHLGESPDFVKLAESYGVKADRIISPDEIKEKLKEAILSNEPYLLDIVIDPAEALPMVPPGGRLTNIVQPIRVEPKIKKPQFDEIKKIRDMAAVKEF

SEQ ID NO: 82562 - DNA, 1866 bp, Mycobacterium avium
  CDS (1)..(1866): transl_table=11
gtgagcgctcccaccaggcggcccgcccccgacgcacccggcgctgccggcatcgccccggccccgccggccccggccgcgaagcccgccgccggcaaaccgaaacgcattgggcccgaacaagttaccggtgcacaatcggtgatccgatcgctggaggagctcggcgtcgaggtgatcttcggcattcccggcggcgcggtgctgccggtctatgacccgctgttcgactccaagaagctgcggcacgtgctggtccgccacgagcagggcgccggtcacgccgccagcggctacgcgcacgccaccggcaaggtcggtgtctgcatggccacctccggtccgggcgccaccaacctggtcacggcgctggccgacgcccagatggactcgatccccgtcgtcgccgtcaccggccaggtgggacgcacgctgatcggtaccgacgccttccaggaggccgacatctccggcatcaccatgccgatcaccaagcacaacttcctggtcgtccggcaacgaaatcccgcagtgcttgccgaggcgttccacatcgccgcctccggccgcccggcgcggtgctcggtcgacatccccaaggacgtgctgcagggccagtgcacgttcagctggccgccgcgcatccacctgcccgggtacaagccgaccaccaaaccgcacagccggcagatccgcgaacgcgccaagctgatcgcggccgcgcgcaaaccggtgctgtacgtgggcggcggtgtcatccgcggggaggccagcgagcagctgcgcgaactggccgagctgaccggcatcccggtggtgaccacgctgatggcccgcggcgcgttcccggacagccaccgtcagcacctgggcatgcccgggatgcacggcaccgtcgcggcggtggcggccctgcagcgcagcgacctgctgatcgcgctgggtacgcggttcgatgaccgggtgaccggcaagctggacaccttcgccccggaagccaaggtcatccacgccgacatcgacccggccgagatcggcaagaaccggcatgccgacgtgccgatcgtcggcgacgtcaaggccgtcatcgccgaactggtcgagatcctgcgccacgacggggcgcccggcaatctcgacatcgccgactggtgggcctacctcgacgacgtccagtccacctatccgctgagctacgggccgcagagcgacggcagcctcggcccggagtacgtcatcgagaagctgggccagatcgccgggccggacgccctgtacgtggcgggcgtgggtcacgatcagatgtgggcggcccagttcatctcctacgagaagccgcgcacctggctcaattccggcggccagggcaccatggggttcgccattccggccgcgatgggcgccaagatgggccgtccggaggccgaggtgtgggcgatcgacggcgacggttgtttccagatgaccaaccaggagctggccacctgcgccgtcgagggcatcccgatcaaggtggcgctgatcaacaacggcaacctgggcatggtgcgccagtggcagaccctgttctacgaagagcggtattcgcaaacggatcttggccacccactcgcaccgcatcccgacttcgtcaagctcgccgaggcgctgggctgcgtcggattgcgttgcgagcgtgaggaagacgtcgtcgacgtgatcaacgctgcccgggcgatcaacgaccggccggtggtgatcgcattcatcgtcggcgccgacgcgcaggtgtggccgatggtggccgccggcaccagcaacgacgagatccaggccgcccgcgggatccgcccgctgttcgacgacgagaccgaaggcacgccttga

SEQ ID NO: 82563 - protein, 621 aa, Mycobacterium avium
MSAPTRRPAPDAPGAAGIAPAPPAPAAKPAAGKPKRIGPEQVTGAQSVIRSLEELGVEVIFGIPGGAVLPVYDPLFDSKKLRHVLVRHEQGAGHAASGYAHATGKVGVCMATSGPGATNLVTALADAQMDSIPVVAVTGQVGRTLIGTDAFQEADISGITMPITKHNFLVVRQRNPAVLAEAFHIAASGRPARCSVDIPKDVLQGQCTFSWPPRIHLPGYKPTTKPHSRQIRERAKLIAAARKPVLYVGGGVIRGEASEQLRELAELTGIPVVTTLMARGAFPDSHRQHLGMPGMHGTVAAVAALQRSDLLIALGTRFDDRVTGKLDTFAPEAKVIHADIDPAEIGKNRHADVPIVGDVKAVIAELVEILRHDGAPGNLDIADWWAYLDDVQSTYPLSYGPQSDGSLGPEYVIEKLGQIAGPDALYVAGVGHDQMWAAQFISYEKPRTWLNSGGQGTMGFAIPAAMGAKMGRPEAEVWAIDGDGCFQMTNQELATCAVEGIPIKVALINNGNLGMVRQWQTLFYEERYSQTDLGHPLAPHPDFVKLAEALGCVGLRCEREEDVVDVINAARAINDRPVVIAFIVGADAQVWPMVAAGTSNDEIQAARGIRPLFDDETEGTP

SEQ ID NO: 82564 - DNA, 1857 bp, Mycobacterium bovis
  CDS (1)..(1857): transl_table=11
gtgagcgcaccaaccaagccacactcaccgacattcaagccagagccacacagcgcggcgaatgagccaaagcacccggcggctcgtccgaaacatgttgcactgcagcagcttaccggtgcacaggcggtcatccggtcgctggaggaactcggcgtcgacgtcattttcgggattccgggcggtgcggtgctgccggtgtatgacccgctgttcgactcgaaaaagctgcgccacgtgctggtccgccacgaacagggcgccgggcatgccgccagcggctacgcgcacgtcaccggccgggtgggcgtgtgcatggcaacgtcgggtcccggagcgaccaacctggtgaccccgctggccgacgcgcagatggactcgatcccggtggtcgctatcaccggtcaggtcgggcgggggctgatcggcaccgacgccttccaggaggccgacatctcgggcatcacgatgccgatcaccaagcacaactttctggtccgctccggtgacgacattccgcgggtgctggccgaggccttccacatcgcggcctccggccgtccgggcgcggtgctggtcgacatccccaaggacgtgctgcagggccagtgcacgttcagctggccgccgcggatggagctgcccggctacaagcccaacaccaaaccgcacagccggcaggtccgcgaggccgccaagctgatcgcggccgcgcgcaagccggtgctgtatgtcggcggcggcgtcatccgcggtgaggccaccgagcagctccgggagctggccgagctgaccggcatcccggtggtcaccacgctgatggcccgcggcgcgtttcccgacagccaccggcaaaacctcggcatgcccggcatgcacggcacggtggccgccgtggcggcgctgcagcgcagcgacctgctgatcgcgctgggtacccgcttcgacgaccgggtgaccggcaagctcgactcgttcgcgccggaagccaaggtcatccacgccgacatcgacccggccgagatcggcaagaaccgccacgccgacgtgcccatcgtcggtgacgtcaaggccgtcatcaccgaactgatcgcgatgctgcgccaccaccacattcccggcaccatcgagatggccgactggtgggcatacctgaacggtgtgcgcaagacctatccgctgagctatgggccgcagagcgacggcagcctgagcccggaatacgtgatcgaaaagctcggcgagatcgccgggccggacgccgtcttcgtcgccggcgtcggccagcaccagatgtgggccgcgcagttcatcagatacgaaaagccgcgcagctggctgaactccggcggtctgggcaccatggggtttgccatcccggcggccatgggcgccaagatcgccctccccggcaccgaggtctgggcgatcgacggcgacggttgcttccagatgaccaaccaggagctggccacctgcgcggtcgagggcataccggtcaaggtggcgctgatcaacaacggcaacctgggcatggtgcggcagtggcagagcctgttctatgccgagcggtactcgcagaccgacctggccactcattcgcaccgcatccccgacttcgtgaaactggccgaggccttggggtgtgtggggttgcggtgcgagcgggaagaggacgtcgtcgacgtcatcaaccaggcgcgggcgatcaacgactgcccggtggtgatcgacttcatcgtcggtgccgacgcgcaagtgtggccgatggtggccgcgggcaccagcaatgacgagatccaggccgcccgcggcattcgccccctgttcgacgacatcaccgaaggccacgcctga

SEQ ID NO: 82565 - protein, 618 aa, Mycobacterium bovis
MSAPTKPHSPTFKPEPHSAANEPKHPAARPKHVALQQLTGAQAVIRSLEELGVDVIFGIPGGAVLPVYDPLFDSKKLRHVLVRHEQGAGHAASGYAHVTGRVGVCMATSGPGATNLVTPLADAQMDSIPVVAITGQVGRGLIGTDAFQEADISGITMPITKHNFLVRSGDDIPRVLAEAFHIAASGRPGAVLVDIPKDVLQGQCTFSWPPRMELPGYKPNTKPHSRQVREAAKLIAAARKPVLYVGGGVIRGEATEQLRELAELTGIPVVTTLMARGAFPDSHRQNLGMPGMHGTVAAVAALQRSDLLIALGTRFDDRVTGKLDSFAPEAKVIHADIDPAEIGKNRHADVPIVGDVKAVITELIAMLRHHHIPGTIEMADWWAYLNGVRKTYPLSYGPQSDGSLSPEYVIEKLGEIAGPDAVFVAGVGQHQMWAAQFIRYEKPRSWLNSGGLGTMGFAIPAAMGAKIALPGTEVWAIDGDGCFQMTNQELATCAVEGIPVKVALINNGNLGMVRQWQSLFYAERYSQTDLATHSHRIPDFVKLAEALGCVGLRCEREEDVVDVINQARAINDCPVVIDFIVGADAQVWPMVAAGTSNDEIQAARGIRPLFDDITEGHA

SEQ ID NO: 82566 - DNA, 1773 bp, Porphyra purpurea
  CDS (1)..(1773)
atgctatcgaaacaaataatcggctctgagaaaactggtcgtttcgctcttttagatagcattgttcgtcacggagttattcatatatttggttaccctggtggggctattttaccaatttatgatgaactttatgcttgggaggaactttcattaatcaagaatattcttgtaagacatgaacaaggtgcttcacatgctgcagatgcttattctagatcgacaggtaaagttggtgtatgttttgccacttctgggcctggtgccactaatttagtatccggcatagctactgcccatattgactccgttcctatattagctattactggacaagtgggacgaccttttataggaacagatgcatttcaagaagttgatattttcggcattacattacctattgtaaaacattcatatgtagtccgtgaccctagagacatgtctagaattgttgctgaagcgttttacatttgcaaacatggtagacctggcccagttttaattgatgtaccaaaagatgttggactagaaaaatttaattatttctctgttgagccagggcaagttaaaatccctggctgcagacctctatctaatctaaaatcccgtcaaatactaatggctgcaaaaatgattcaacaatcaagtcagccattattatatattggtggtggagctataatttctgatgctcacagtataattaaagaattagttgacttatataaaataccagtaactacaactcttatgggcaaaggtatctttaatgaggatagtgaattttgtctaggtatgctcggaatgcatgggactgcgtacgctaattttgcagttagcgagtgtgatcttctgattgctctaggagctagatttgatgatagggtaactggtaaattagatgaattcgcttgtaatgctcaagttattcatgtagatattgatccagccgaagttggtaaaaatagaatacctcaagttgctattgttggtgatgttacagaagttgttacttcacttttgaatttactgaaaaataattttaagccttatccagagcaaattatatcttggcaagaaagaatacatcgctggcgtcagcaataccctcttttagtaccaaaaaaatcaactagcatttcaccacaagaaatacttgttacaacaaatcaattagcgcaagatgcttattttactactgatgtcggccagcatcaaatgtggtcagctcaatttcttaaggtgaaatctaagcattggatttctagtgctggactaggaacaatgggctatggtttgccagcagctattggtgcccaagtagcacaccctaacgaactagtaatttgtgtaagcggtgattcaagttttcaaatgaatatgcaagaattaggaactattgcccagtataaattacctataaaaattgttattattaataatcgctggcaaggcatggttagacagtggcagcaagcattttacggagaaagatactctcattcacgaatgacagaaggagctcctaattttcaaaagcttgctgaagcttttggtattaaagcttttactgtaaataatagacaaaatatggaatcctctttaaaagatgctatgaaataccctggtcccgttttattagattgccaagtaactgaaaatgaaaattgttatccaatggttgcaccagggaaaagtaatgcacaaatgataggaatagcaaaacctcaaagaggaactgcttccaattatgtcagcagaaatatttaa

SEQ ID NO: 82567 - protein, 590 aa, Porphyra purpurea
MLSKQIIGSEKTGRFALLDSIVRHGVIHIFGYPGGAILPIYDELYAWEELSLIKNILVRHEQGASHAADAYSRSTGKVGVCFATSGPGATNLVSGIATAHIDSVPILAITGQVGRPFIGTDAFQEVDIFGITLPIVKHSYVVRDPRDMSRIVAEAFYICKHGRPGPVLIDVPKDVGLEKFNYFSVEPGQVKIPGCRPLSNLKSRQILMAAKMIQQSSQPLLYIGGGAIISDAHSIIKELVDLYKIPVTTTLMGKGIFNEDSEFCLGMLGMHGTAYANFAVSECDLLIALGARFDDRVTGKLDEFACNAQVIHVDIDPAEVGKNRIPQVAIVGDVTEVVTSLLNLLKNNFKPYPEQIISWQERIHRWRQQYPLLVPKKSTSISPQEILVTTNQLAQDAYFTTDVGQHQMWSAQFLKVKSKHWISSAGLGTMGYGLPAAIGAQVAHPNELVICVSGDSSFQMNMQELGTIAQYKLPIKIVIINNRWQGMVRQWQQAFYGERYSHSRMTEGAPNFQKLAEAFGIKAFTVNNRQNMESSLKDAMKYPGPVLLDCQVTENENCYPMVAPGKSNAQMIGIAKPQRGTASNYVSRNI

SEQ ID NO: 82568 - DNA, 2010 bp, Schizosaccharomyces pombe
  CDS (1)..(2010)
atgactgtgctggctccccttagaagattgcatacgagggcggctttctcgtcttatggacgagaaattgcccttcaaaagagatttttaaatttaaatagttgctcagctgtgcggaggtatggcaccggctttagtaataatttgagaattaaaaaattaaaaaatgcattcggtgtcgttcgggcaaattcgaccaaaagcacctctacagtgactacggctagtcctataaaatatgacagctcgtttgttggaaagactgggggtgaaattttccatgatatgatgctcaagcataatgttaagcatgtatttggttatccaggtggtgctatcttgcctgtcttcgatgcaatttatagatctcctcattttgaatttatcttgccaagacacgagcaagctgctggacatgcagcccaagcttattcccgcgttactaaaaaacccggcgttgtattggttacttctggacccggtgctacgaatgtgattaccccgattgctgatgcattggccgacggtactcccctagttgtattctctggtcaagtagcaaccagcgcaattggtagtgatgcatttcaagaagctgacatggttggtatttctcgttcatgtactaaatggaatgtaatggtcaaagatgttgctgatcttccccgtcgtatagacgaagcttttgagatagctacttctggacgccctggccctgtattggttgaccttcccaaagatgtcactgctagcgttttgaaggagcccattcctatactgtcttctgtaccatcaatgaatcgcagaatgaaggaagtcttagaagagggctccaagaacgttactgccaagatcgatcgtgttgccaatttactaaaattagccaagaagcctgtgattttctgtgggcatggtgttttagctaatcccgaatgccccactttgttacgcaagtttagcgaaaggctgcaaattcctgttactacttctttgcttggacttggtgctgtagatgaacgttctgaccttagtttgcatatgctcggtatgcatggtagtggatacgctaatatggccatgcaggaagccgatcttatccttgctcttggtgttcgctttgacgaccgtgtcaccggtaacgtaagtttgtttgctcctcaagcacgtcttgctgctgccgaagagcgtggcggtattattcactttgatatttcacccaaaaatatcggtaaggtcgtacaacctactgaagcaatagagggcgatgtatacgaatctctaaagcttttagattctgctactaaaaatattaaaattccttcccgatttgactggttatctcaaattcaaacatggaaggaacgcttccctttcactttcactcgtagcgctcctggtgaattggtaaagcctcaagaagtcattcaagaacttgacaaacaaacttctgacataaaggacaaagtcactattaccaccggtgtcggtgcacatcaaatgtgggccgctacattctatcgttggacaaaacctagttctttggtaacctccggtggtctcggtactatgggatttggtctcccagctgccataggtgctagcgttgctgcacctaaagatattgttatagatattgatggtgatgcttcattttcaatgactggtatggaacttgctaccgtccgtcaatttgatatcccagttaaaattcttatcctaaataatgaagagcaaggcatggtcactcaatggcaaaacttgttttatgagaaacgctattctcatactcatcaaaagaatcccaacttcgttaagttggctgacgctatgggcatcaaagcactacgtgtagaaaagagagaagatttggctaaaaaaatgaaggagtttttgtcaactaaaggtcctgtgcttatggaagttttggttgcccaaaaggaacatgtgtatccatttgtccctggtggtaaggctcttcaccaatttattttgcatgaaagcctttcataa

SEQ ID NO: 82569 - protein, 669 aa, Schizosaccharomyces pombe
MTVLAPLRRLHTRAAFSSYGREIALQKRFLNLNSCSAVRRYGTGFSNNLRIKKLKNAFGVVRANSTKSTSTVTTASPIKYDSSFVGKTGGEIFHDMMLKHNVKHVFGYPGGAILPVFDAIYRSPHFEFILPRHEQAAGHAAQAYSRVTKKPGVVLVTSGPGATNVITPIADALADGTPLVVFSGQVATSAIGSDAFQEADMVGISRSCTKWNVMVKDVADLPRRIDEAFEIATSGRPGPVLVDLPKDVTASVLKEPIPILSSVPSMNRRMKEVLEEGSKNVTAKIDRVANLLKLAKKPVIFCGHGVLANPECPTLLRKFSERLQIPVTTSLLGLGAVDERSDLSLHMLGMHGSGYANMAMQEADLILALGVRFDDRVTGNVSLFAPQARLAAAEERGGIIHFDISPKNIGKVVQPTEAIEGDVYESLKLLDSATKNIKIPSRFDWLSQIQTWKERFPFTFTRSAPGELVKPQEVIQELDKQTSDIKDKVTITTGVGAHQMWAATFYRWTKPSSLVTSGGLGTMGFGLPAAIGASVAAPKDIVIDIDGDASFSMTGMELATVRQFDIPVKILILNNEEQGMVTQWQNLFYEKRYSHTHQKNPNFVKLADAMGIKALRVEKREDLAKKMKEFLSTKGPVLMEVLVAQKEHVYPFVPGGKALHQFILHESLS

SEQ ID NO: 82570 - DNA, 2064 bp, Saccharomyces cerevisiae
  CDS (1)..(2064)
atgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagcccgctgaaccttcaaaattggctaagaaactacgcgctgagcctgacatggatacctctttcgtcggtttaactggtggtcaaatatttaacgaaatgatgtccagacaaaacgttgatactgtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgttacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattggatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgctcaaataaataaatggaagaaggaatacccatacgcttatatggaggagactccaggatctaaaattaaaccacagacggttataaagaaactatccaaggttgccaacgacacaggaagacatgtcattgttacaacgggtgtggggcaacatcaaatgtgggctgctcaacactggacatggagaaatccacatactttcatcacatcaggtggtttaggtacgatgggttacggtctccctgccgccatcggtgctcaagttgcaaagccagaatctttggttattgacattgatggtgacgcatcctttaacatgactctaacggaattgagttctgccgttcaagctggtactccagtgaagattttgattttgaacaatgaagagcaaggtatggttactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactga

SEQ ID NO: 82571 - protein, 687 aa, Saccharomyces cerevisiae [sequence omitted]

SEQ ID NO: 82572 - DNA, 1716 bp, Buchnera aphidicola
  CDS (1)..(1716)
atggaaatattatcaggagccgaaatggtcgttcgatcattaattgatcagggaatacagcatatatttggttatcctggtggtgctgtactagatatttatgatgctctaaaaaccgttggtggaatcgaacatattctagtgagacacgaacaggctgcaactcacatggctgacggttattctcgttctactggaaaaactggagtagtattagttacttctggacccggtgcaactaatgctattactggtattgcaacagcatacatggattctattccaatggttgttatttcaggacaagtcgcttcttcattaatcggttatgatgcttttcaagaatgtgatatgatcggaatttctcgtccaatagtaaaacacagtttcttagttaaaaaaactgaagatataccaattgtttttaaaaaagctttttggttagcatctagtggccgtccaggacctatagtaattgatttaccgaaagatattttaaaaaaagacaataaatatctctataaatggccagataatattaatatacgttcatataatccaacaactaaaggtcatatagggcaaattaaaaaagctctgcatacattattaaaagctcaaagaccagtgatttatgcagggggcggaattattagttctaacagtagtgaagaattaagaatttttgcagaaaagatcaactgtcctgttacgacttctttaatgggattaggtagttttccaggcactcatgatcaaaatatttccatgttaggaatgcatggtacgtatgaagctaacatgaccatgcatcatgccgatgttatttttgcaatcggtgtaagattcgatgatcgcacaacaaataatttaaataaatactgtccaaatgcgattgttttacatgttgatattgatccgacttctatttctaaaactgtatctgccaatatacctattgtaggagatgctaaacatgtcttgcaaaaaatgatagaattactaaaaaaagaaaagaaaatttcactgttagaagattggtggaatactattaaaaaatggaaaaaaataaatagtctacaatacaatcaactaagtaataagataaaacctcaaacagttattaaaactctttttaaactcacaaaaggaacgtcttatatcacatcagatgttggacagcatcaaatgtttactgcattatattatccatttaacaaacctagacgttggattaattcaggtggattaggtaccatgggatttggattacccgcggcattaggagttaaattagccctgcccaaagaaactgttatctgtattacaggagatggcagtattcaaatgaatattcaagaattatctacagcacgacaatataatttagcagtattaatattaaatctcaacaattcttctttaggaatggtcaaacaatggcaagatatgatttattcaggacgacattcccattcttatatggactcacttcctgattttgtaaaattatcagaatcctatggccactttggtatccaaattactgaacctatagaattagaagagaaattaatgcttgcattaagtaaattgtctgatggtcatttggtgttcgtagacgttcaaatagataattctgagcatgtttatcctatgcagattcaagggggtggcatgaatgaaatgcggctaaggaaaaaagaggttgcctaa

SEQ ID NO: 82573 - protein, 571 aa, Buchnera aphidicola
MEILSGAEMVVRSLIDQGIQHIFGYPGGAVLDIYDALKTVGGIEHILVRHEQAATHMADGYSRSTGKTGVVLVTSGPGATNAITGIATAYMDSIPMVVISGQVASSLIGYDAFQECDMIGISRPIVKHSFLVKKTEDIPIVFKKAFWLASSGRPGPIVIDLPKDILKKDNKYLYKWPDNINIRSYNPTTKGHIGQIKKALHTLLKAQRPVIYAGGGIISSNSSEELRIFAEKINCPVTTSLMGLGSFPGTHDQNISMLGMHGTYEANMTMHHADVIFAIGVRFDDRTTNNLNKYCPNAIVLHVDIDPTSISKTVSANIPIVGDAKHVLQKMIELLKKEKKISLLEDWWNTIKKWKKINSLQYNQLSNKIKPQTVIKTLFKLTKGTSYITSDVGQHQMFTALYYPFNKPRRWINSGGLGTMGFGLPAALGVKLALPKETVICITGDGSIQMNIQELSTARQYNLAVLILNLNNSSLGMVKQWQDMIYSGRHSHSYMDSLPDFVKLSESYGHFGIQITEPIELEEKLMLALSKLSDGHLVFVDVQIDNSEHVYPMQIQGGGMNEMRLRKKEVA

SEQ ID NO: 82574 - DNA, 1725 bp, Escherichia coli
  CDS (1)..(1725)
atggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctga

SEQ ID NO: 82575 - protein, 574 aa, Escherichia coli
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQTLVAAKKPVVYVGGGAITAGCHQQLKETVEALNLPVVCSLMGLGAFPATHRQALGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGTMGFGLPAALGVKMALPEETVVCVTGDGSIQMNIQELSTALQYELPVLVVNLNNRYLGMVKQWQDMIYSGRHSQSYMQSLPDFVRLAEAYGHVGIQISHPHELESKLSEALEQVRNNRLVFVDVTVDGSEHVYPMQIRGGGMDEMWLSKTERT

SEQ ID NO: 82576 - DNA, 1722 bp, Haemophilus influenzae
  CDS (1)..(1722): transl_table=11
atgaagaagttatctggcgcagagatggtggttcaatctttacgtgatgaaggcgtagagtatgtatttggttatcccggaggcgcggtattagatatttatgatgcaattcatacgctgggtggtattgaacatattttagttcgccacgaacaagccgcggtgcatatggcggatggttacgcacgttcaacgggtaaagttggatgtgtgctagtgacttcggggcctggtgcaacaaatgctatcactggcattttaacggcttataccgattctgtgcctatggttatcatttcgggtcaggttatgagcaatttaattggcagtgatgctttccaagaatgtgatatgctgggtatttctcgtcccgttgtgaagcatagctttattgtcaaaaaggcggaagatattccatctactttgaaaaaagccttttatattgcatctacgggtcgtccaggtcctgttgttgtggatattccaaaagacactgtaaatcctaattttaaatatccttatgaataccctgaatatgtcgagttacgttcttataatccaacagtaaatggacacaaaggtcaaattaaaaaagcgttaaaagcacttttagtggcgaagaaaccaatactttttgtcggtggtggtgcaatcactgctgaatgtagtgagcagttaattcagtttgcacaacgtttaaatttacccgtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacagatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggttttggttttcctgcggcacttggtgttaaattagctcatcctgaaggaactgttgtttgcgttactggcgatggtagtattcaaatgaatattcaagagctttctaccgcaacacaatatggcattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggtgcaatgaatgaaatgattttaagtaaacctcaagaggagacaaactaa

SEQ ID NO: 82577 - protein, 573 aa, Haemophilus influenzae
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 82578 - DNA, 1716 bp, Bacillus subtilis
  CDS (1)..(1716): transl_table=11
gtgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 82579 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 82580 - DNA, 22 bp, Primer
atgaatggcgcacagtgggtgg

SEQ ID NO: 82581 - DNA, 27 bp, Primer
ttattgatttaacggctgctgtaatgc

SEQ ID NO: 82582 - protein, 677 aa, consensus
  MISC_FEATURE (1)..(677): consensus for the disclosure of xaa see table XV
GXXXXXXXLXXXXVXXXFGXPGGXXXXXXXXXXXXXXXXXXXXXXLXRHEQXAXXXAXXYXRXXGXXXXGVXXXTSGPGATNXXTXXXXAXXDSXXPXXXXXGQVXXXXXXXXXXXGXXXFQEXDXXXXXXXXXKXXXXXXXXXXXXXXXXXAFXXAXXGRPGPVXXDXPXDXXXXXXXXXXXXXXXXXXXXXXXXXXXXXXXXXXXXXXXXXXXXXXXXXXXXXXXXXXXXXXXXXXXXXPXXXXGXGXXXXXXXXXXXXXXXXXXXXXXPXXXTLXGXGXXXXXXXXXXXXXXXGMXGXXXXNXXXXXXDXXXXXGXRFXDRXXXXXXXXXXXXXXXXXXXXXXXXHXDXXXXXXXXXXKXXXXXXXXXXDXXXXLXXXXXXXXXXXXXXXXXXXXXXXXXXWXXXXXXXXXXXXXXXXXXXXXXXXXXXXXXXPXXXXXXXXXXXXXXXXXXXXXXXXXXVGXHQMWXAXXXXXXXXXXXXXXSXGXGXMGXGXPXAXGXXXXXPXXXXXXXXXVXXXXGDXXXXMXXQELXTXXXXXXXXXXXXXXNNXXXGMVXQXQXXXXXXXXXXXXXXXXXXXXXXXXXXXXXXXXXXXXXPXXXXXAXXXGXXXXXXXXXXXXXXXXXXXXXXXXXXXXXXXXXXXXXXXXXXXXXXXXXXXXXXXXXXXXXXXXXXP

SEQ ID NO: 82583 - protein, 156 aa, consensus
  MISC_FEATURE (1)..(156): consensus for the disclosure of xaa see table XV
XXXXPGXXXXXXXXXXXXXXXXXXXXXXXXXXXXXXXXXXAXXXXXXXXXXXXXXXXXXXXXXXXXXXXXXXXAXXXXXXPXXXXXXXXXXXXXXXXXXXXXXXXQXXXXXXXXXXXXKXXXXXXXXXXXXXXXXXXXXXXXXXXXGXXXXXXXXX

SEQ ID NO: 82584 - protein, 95 aa, consensus
  MISC_FEATURE (1)..(95): consensus for the disclosure of xaa see table XV
XXXXXXXXXXXXXPXXXXGXXXXXXXXXXXXXXXXXXXXXXXXPXXXXXXXXXXXXXXXXXXXXXXXXXXXXXXXXXXXXXXXDXXXXXGXXXXX

SEQ ID NO: 82585 - protein, 95 aa, consensus
  MISC_FEATURE (1)..(95): consensus for the disclosure of xaa see table XV
XGXXXXXXXXXXXXXXXXXXXXXXXXXXXXXXXXPXXXXXXXXXXXXXXXXXXXXXXXXGXXXXXXXXXXXXXXXXXXXXXXXXXXXXXXXXXXX

SEQ ID NO: 82586 - DNA, 768 bp, Escherichia coli; identical to SEQ ID NO: 66654
  CDS (1)..(768)

SEQ ID NO: 82587 - protein, 255 aa, Escherichia coli; identical to SEQ ID NO: 66655

SEQ ID NO: 82588 - DNA, 828 bp, Gluconobacter oxydans 621H; identical to SEQ ID NO: 66656
  CDS (1)..(828)

SEQ ID NO: 82589 - protein, 275 aa, Gluconobacter oxydans 621H; identical to SEQ ID NO: 66657

SEQ ID NO: 82590 - DNA, 801 bp, Gluconobacter oxydans 621H; identical to SEQ ID NO: 66658
  CDS (1)..(801)

SEQ ID NO: 82591 - protein, 266 aa, Gluconobacter oxydans 621H; identical to SEQ ID NO: 66659

SEQ ID NO: 82592 - DNA, 750 bp, Homo sapiens; identical to SEQ ID NO: 66660
  CDS (1)..(750)

SEQ ID NO: 82593 - protein, 249 aa, Homo sapiens; identical to SEQ ID NO: 66661

SEQ ID NO: 82594 - DNA, 747 bp, Saccharomyces cerevisiae; identical to SEQ ID NO: 66662
  CDS (1)..(747)

SEQ ID NO: 82595 - protein, 248 aa, Saccharomyces cerevisiae; identical to SEQ ID NO: 66663

SEQ ID NO: 82596 - DNA, 750 bp, Mus musculus; identical to SEQ ID NO: 66664
  CDS (1)..(750)

SEQ ID NO: 82597 - protein, 249 aa, Mus musculus; identical to SEQ ID NO: 66665

SEQ ID NO: 82598 - DNA, 753 bp, Agrobacterium rhizogenes; identical to SEQ ID NO: 66666
  CDS (1)..(753): transl_table=11

SEQ ID NO: 82599 - protein, 250 aa, Agrobacterium rhizogenes; identical to SEQ ID NO: 66667

SEQ ID NO: 82600 - DNA, 765 bp, Chlamydophila pneumoniae CWL029; identical to SEQ ID NO: 66668
  CDS (1)..(765): transl_table=11

SEQ ID NO: 82601 - protein, 254 aa, Chlamydophila pneumoniae CWL029; identical to SEQ ID NO: 66669

SEQ ID NO: 82602 - DNA, 1050 bp, Pasteurella multocida subsp. multocida str. Pm70; identical to SEQ ID NO: 66670
  CDS (1)..(1050): transl_table=11

SEQ ID NO: 82603 - protein, 349 aa, Pasteurella multocida subsp. multocida str. Pm70; identical to SEQ ID NO: 66671

SEQ ID NO: 82604 - DNA, 759 bp, Lactococcus lactis subsp. lactis Il1403; identical to SEQ ID NO: 66672
  CDS (1)..(759): transl_table=11

SEQ ID NO: 82605 - protein, 252 aa, Lactococcus lactis subsp. lactis Il1403; identical to SEQ ID NO: 66673

SEQ ID NO: 82606 - DNA, 765 bp, Chlamydophila pneumoniae J138; identical to SEQ ID NO: 66674
  CDS (1)..(765): transl_table=11

SEQ ID NO: 82607 - protein, 254 aa, Chlamydophila pneumoniae J138; identical to SEQ ID NO: 66675

SEQ ID NO: 82608 - DNA, 780 bp, Streptococcus pneumoniae R6; identical to SEQ ID NO: 66676
  CDS (1)..(780): transl_table=11

SEQ ID NO: 82609 - protein, 259 aa, Streptococcus pneumoniae R6; identical to SEQ ID NO: 66677

SEQ ID NO: 82610 - DNA, 729 bp, Encephalitozoon cuniculi; identical to SEQ ID NO: 66678
  CDS (1)..(729): transl_table=11

SEQ ID NO: 82611 - protein, 242 aa, Encephalitozoon cuniculi; identical to SEQ ID NO: 66679

SEQ ID NO: 82612 - DNA, 750 bp, Schizosaccharomyces pombe; identical to SEQ ID NO: 66680
  CDS (1)..(750)

SEQ ID NO: 82613 - protein, 249 aa, Schizosaccharomyces pombe; identical to SEQ ID NO: 66681

SEQ ID NO: 82614 - DNA, 759 bp, Streptococcus pyogenes MGAS8232; identical to SEQ ID NO: 66682
  CDS (1)..(759): transl_table=11

SEQ ID NO: 82615 - protein, 252 aa, Streptococcus pyogenes MGAS8232; identical to SEQ ID NO: 66683

SEQ ID NO: 82616 - DNA, 747 bp, Danio rerio; identical to SEQ ID NO: 66684
  CDS (1)..(747)

SEQ ID NO: 82617 - protein, 248 aa, Danio rerio; identical to SEQ ID NO: 66685

SEQ ID NO: 82618 - DNA, 744 bp, Drosophila melanogaster; identical to SEQ ID NO: 66686
  CDS (1)..(744)

SEQ ID NO: 82619 - protein, 247 aa, Drosophila melanogaster; identical to SEQ ID NO: 66687

SEQ ID NO: 82620 - DNA, 693 bp, Prochlorococcus marinus subsp. pastoris str. CCMP1986; identical to SEQ ID NO: 66688
  CDS (1)..(693): transl_table=11

SEQ ID NO: 82621 - protein, 230 aa, Prochlorococcus marinus subsp. pastoris str. CCMP1986; identical to SEQ ID NO: 66689

SEQ ID NO: 82622 - DNA, 768 bp, Oryza sativa (japonica cultivar-group); identical to SEQ ID NO: 66690
  CDS (1)..(768)

SEQ ID NO: 82623 - protein, 255 aa, Oryza sativa (japonica cultivar-group); identical to SEQ ID NO: 66691

SEQ ID NO: 82624 - DNA, 783 bp, Corynebacterium diphtheriae NCTC 13129; identical to SEQ ID NO: 66692
  CDS (1)..(783): transl_table=11

SEQ ID NO: 82625 - protein, 260 aa, Corynebacterium diphtheriae NCTC 13129; identical to SEQ ID NO: 66693

SEQ ID NO: 82626 - DNA, 837 bp, Rhodopseudomonas palustris CGA009; identical to SEQ ID NO: 66694
  CDS (1)..(837): transl_table=11

SEQ ID NO: 82627 - protein, 278 aa, Rhodopseudomonas palustris CGA009; identical to SEQ ID NO: 66695

SEQ ID NO: 82628 - DNA, 825 bp, Onion yellows phytoplasma OY-M; identical to SEQ ID NO: 66696
  CDS (1)..(825): transl_table=11

SEQ ID NO: 82629 - protein, 274 aa, Onion yellows phytoplasma OY-M; identical to SEQ ID NO: 66697

SEQ ID NO: 82630 - DNA, 1965 bp, Geobacter sulfurreducens PCA; identical to SEQ ID NO: 66698
  CDS (1)..(1965): transl_table=11

SEQ ID NO: 82631 - protein, 654 aa, Geobacter sulfurreducens PCA; identical to SEQ ID NO: 66699

SEQ ID NO: 82632 - DNA, 786 bp, Mycobacterium avium subsp. paratuberculosis str. k10; identical to SEQ ID NO: 66700
  CDS (1)..(786): transl_table=11

SEQ ID NO: 82633 - protein, 261 aa, Mycobacterium avium subsp. paratuberculosis str. k10; identical to SEQ ID NO: 66701

SEQ ID NO: 82634 - DNA, 756 bp, Lactobacillus johnsonii NCC 533; identical to SEQ ID NO: 66702
  CDS (1)..(756): transl_table=11

SEQ ID NO: 82635 - protein, 251 aa, Lactobacillus johnsonii NCC 533; identical to SEQ ID NO: 66703

SEQ ID NO: 82636 - DNA, 729 bp, Wolbachia endosymbiont of Drosophila melanogaster; identical to SEQ ID NO: 66704
  CDS (1)..(729): transl_table=11

SEQ ID NO: 82637 - protein, 242 aa, Wolbachia endosymbiont of Drosophila melanogaster; identical to SEQ ID NO: 66705

SEQ ID NO: 82638 - DNA, 726 bp, Bdellovibrio bacteriovorus HD100; identical to SEQ ID NO: 66706
  CDS (1)..(726): transl_table=11

SEQ ID NO: 82639 - protein, 241 aa, Bdellovibrio bacteriovorus HD100; identical to SEQ ID NO: 66707

SEQ ID NO: 82640 - DNA, 753 bp, Treponema denticola ATCC 35405; identical to SEQ ID NO: 66708
  CDS (1)..(753): transl_table=11

SEQ ID NO: 82641 - protein, 250 aa, Treponema denticola ATCC 35405; identical to SEQ ID NO: 66709

SEQ ID NO: 82642 - DNA, 747 bp, Mycoplasma mycoides subsp. mycoides SC str. PG1; identical to SEQ ID NO: 66710
  CDS (1)..(747): transl_table=4

SEQ ID NO: 82643 - protein, 248 aa, Mycoplasma mycoides subsp. mycoides SC str. PG1; identical to SEQ ID NO: 66711

SEQ ID NO: 82644 - DNA, 756 bp, Bacillus cereus ATCC 10987; identical to SEQ ID NO: 66712
  CDS (1)..(756): transl_table=11

SEQ ID NO: 82645 - protein, 251 aa, Bacillus cereus ATCC 10987; identical to SEQ ID NO: 66713

SEQ ID NO: 82646 - DNA, 795 bp, Anopheles gambiae str. PEST; identical to SEQ ID NO: 66714
  CDS (1)..(795)

SEQ ID NO: 82647 - protein, 264 aa, Anopheles gambiae str. PEST; identical to SEQ ID NO: 66715

SEQ ID NO: 82648 - DNA, 744 bp, Gibberella zeae PH-1; identical to SEQ ID NO: 66716
  CDS (1)..(744)

SEQ ID NO: 82649 - protein, 247 aa, Gibberella zeae PH-1; identical to SEQ ID NO: 66717

SEQ ID NO: 82650 - DNA, 747 bp, Ustilago maydis 521; identical to SEQ ID NO: 66718
  CDS (1)..(747)

SEQ ID NO: 82651 - protein, 248 aa, Ustilago maydis 521; identical to SEQ ID NO: 66719

SEQ ID NO: 82652 - DNA, 774 bp, Kluyveromyces lactis NRRL Y-1140; identical to SEQ ID NO: 66720
  CDS (1)..(774)

SEQ ID NO: 82653 - protein, 257 aa, Kluyveromyces lactis NRRL Y-1140; identical to SEQ ID NO: 66721

SEQ ID NO: 82654 - DNA, 753 bp, Leptospira interrogans serovar Copenhageni str. Fiocruz L1-130; identical to SEQ ID NO: 66722
  CDS (1)..(753): transl_table=11

SEQ ID NO: 82655 - protein, 250 aa, Leptospira interrogans serovar Copenhageni str. Fiocruz L1-130; identical to SEQ ID NO: 66723

SEQ ID NO: 82656 - DNA, 753 bp, Thermus thermophilus HB27; identical to SEQ ID NO: 66724
  CDS (1)..(753): transl_table=11

SEQ ID NO: 82657 - protein, 250 aa, Thermus thermophilus HB27; identical to SEQ ID NO: 66725

SEQ ID NO: 82658 - DNA, 795 bp, Parachlamydia sp. UWE25; identical to SEQ ID NO: 66726
  CDS (1)..(795): transl_table=11

SEQ ID NO: 82659 - protein, 264 aa, Parachlamydia sp. UWE25; identical to SEQ ID NO: 66727

SEQ ID NO: 82660 - DNA, 756 bp, Desulfovibrio vulgaris subsp. vulgaris str. Hildenborough; identical to SEQ ID NO: 66728
  CDS (1)..(756): transl_table=11

SEQ ID NO: 82661 - protein, 251 aa, Desulfovibrio vulgaris subsp. vulgaris str. Hildenborough; identical to SEQ ID NO: 66729

SEQ ID NO: 82662 - DNA, 765 bp, Listeria monocytogenes str. 4b F2365; identical to SEQ ID NO: 66730
  CDS (1)..(765): transl_table=11

SEQ ID NO: 82663 - protein, 254 aa, Listeria monocytogenes str. 4b F2365; identical to SEQ ID NO: 66731

SEQ ID NO: 82664 - DNA, 729 bp, Mycoplasma mobile 163K; identical to SEQ ID NO: 66732
  CDS (1)..(729): transl_table=4

SEQ ID NO: 82665 - protein, 242 aa, Mycoplasma mobile 163K; identical to SEQ ID NO: 66733

SEQ ID NO: 82666 - DNA, 765 bp, Bartonella quintana str. Toulouse; identical to SEQ ID NO: 66734
  CDS (1)..(765): transl_table=11

SEQ ID NO: 82667 - protein, 254 aa, Bartonella quintana str. Toulouse; identical to SEQ ID NO: 66735

SEQ ID NO: 82668 - DNA, 798 bp, Acinetobacter sp. ADP1; identical to SEQ ID NO: 66736
  CDS (1)..(798): transl_table=11

SEQ ID NO: 82669 - protein, 265 aa, Acinetobacter sp. ADP1; identical to SEQ ID NO: 66737

SEQ ID NO: 82670 - DNA, 768 bp, Erwinia carotovora subsp. atroseptica SCRI1043; identical to SEQ ID NO: 66738
  CDS (1)..(768)

SEQ ID NO: 82671 - protein, 255 aa, Erwinia carotovora subsp. atroseptica SCRI1043; identical to SEQ ID NO: 66739

SEQ ID NO: 82672 - DNA, 828 bp, Mesoplasma florum L1; identical to SEQ ID NO: 66740
  CDS (1)..(828): transl_table=4

SEQ ID NO: 82673 - protein, 275 aa, Mesoplasma florum L1; identical to SEQ ID NO: 66741

SEQ ID NO: 82674 - DNA, 780 bp, Propionibacterium acnes KPA171202; identical to SEQ ID NO: 66742
  CDS (1)..(780): transl_table=11

SEQ ID NO: 82675 - protein, 259 aa, Propionibacterium acnes KPA171202; identical to SEQ ID NO: 66743

SEQ ID NO: 82676 - DNA, 804 bp, Leifsonia xyli subsp. xyli str. CTCB07; identical to SEQ ID NO: 66744
  CDS (1)..(804): transl_table=11

SEQ ID NO: 82677 - protein, 267 aa, Leifsonia xyli subsp. xyli str. CTCB07; identical to SEQ ID NO: 66745

SEQ ID NO: 82678 - DNA, 756 bp, Desulfotalea psychrophila LSv54; identical to SEQ ID NO: 66746
  CDS (1)..(756): transl_table=11

SEQ ID NO: 82679 - protein, 251 aa, Desulfotalea psychrophila LSv54; identical to SEQ ID NO: 66747

SEQ ID NO: 82680 - DNA, 762 bp, Borrelia garinii PBi; identical to SEQ ID NO: 66748
  CDS (1)..(762): transl_table=11

SEQ ID NO: 82681 - protein, 253 aa, Borrelia garinii PBi; identical to SEQ ID NO: 66749

SEQ ID NO: 82682 - DNA, 771 bp, Symbiobacterium thermophilum IAM 14863; identical to SEQ ID NO: 66750
  CDS (1)..(771): transl_table=11

SEQ ID NO: 82683 - protein, 256 aa, Symbiobacterium thermophilum IAM 14863; identical to SEQ ID NO: 66751

SEQ ID NO: 82684 - DNA, 768 bp, Mannheimia succiniciproducens MBEL55E; identical to SEQ ID NO: 66752
  CDS (1)..(768): transl_table=11

SEQ ID NO: 82685 - protein, 255 aa, Mannheimia succiniciproducens MBEL55E; identical to SEQ ID NO: 66753

SEQ ID NO: 82686 - DNA, 783 bp, Mannheimia succiniciproducens MBEL55E; identical to SEQ ID NO: 66754
  CDS (1)..(783): transl_table=11

SEQ ID NO: 82687 - protein, 260 aa, Mannheimia succiniciproducens MBEL55E; identical to SEQ ID NO: 66755

SEQ ID NO: 82688 - DNA, 762 bp, Bacillus licheniformis ATCC 14580; identical to SEQ ID NO: 66756
  CDS (1)..(762): transl_table=11

SEQ ID NO: 82689 - protein, 253 aa, Bacillus licheniformis ATCC 14580; identical to SEQ ID NO: 66757

SEQ ID NO: 82690 - DNA, 756 bp, Bacteroides fragilis YCH46; identical to SEQ ID NO: 66758
  CDS (1)..(756): transl_table=11

SEQ ID NO: 82691 - protein, 251 aa, Bacteroides fragilis YCH46; identical to SEQ ID NO: 66759

SEQ ID NO: 82692 - DNA, 756 bp, Burkholderia mallei ATCC 23344; identical to SEQ ID NO: 66760
  CDS (1)..(756): transl_table=11

SEQ ID NO: 82693 - protein, 251 aa, Burkholderia mallei ATCC 23344; identical to SEQ ID NO: 66761

SEQ ID NO: 82694 - DNA, 753 bp, Methylococcus capsulatus str. Bath; identical to SEQ ID NO: 66762
  CDS (1)..(753): transl_table=11

SEQ ID NO: 82695 - protein, 250 aa, Methylococcus capsulatus str. Bath; identical to SEQ ID NO: 66763

SEQ ID NO: 82696 - DNA, 786 bp, Nocardia farcinica IFM 10152; identical to SEQ ID NO: 66764
  CDS (1)..(786): transl_table=11

SEQ ID NO: 82697 - protein, 261 aa, Nocardia farcinica IFM 10152; identical to SEQ ID NO: 66765

SEQ ID NO: 82698 - DNA, 750 bp, Legionella pneumophila str. Lens; identical to SEQ ID NO: 66766
  CDS (1)..(750): transl_table=11

SEQ ID NO: 82699 - protein, 249 aa, Legionella pneumophila str. Lens; identical to SEQ ID NO: 66767

SEQ ID NO: 82700 - DNA, 789 bp, Photobacterium profundum SS9; identical to SEQ ID NO: 66768
  CDS (1)..(789): transl_table=11

SEQ ID NO: 82701 - protein, 262 aa, Photobacterium profundum SS9; identical to SEQ ID NO: 66769

SEQ ID NO: 82702 - DNA, 753 bp, Thermus thermophilus HB8; identical to SEQ ID NO: 66770
  CDS (1)..(753): transl_table=11

SEQ ID NO: 82703 - protein, 250 aa, Thermus thermophilus HB8; identical to SEQ ID NO: 66771

SEQ ID NO: 82704 - DNA, 762 bp, Geobacillus kaustophilus HTA426; identical to SEQ ID NO: 66772
  CDS (1)..(762): transl_table=11

SEQ ID NO: 82705 - protein, 253 aa, Geobacillus kaustophilus HTA426; identical to SEQ ID NO: 66773

SEQ ID NO: 82706 - DNA, 807 bp, Anaplasma marginale str. St. Maries; identical to SEQ ID NO: 66774
  CDS (1)..(807): transl_table=11

SEQ ID NO: 82707 - protein, 268 aa, Anaplasma marginale str. St. Maries; identical to SEQ ID NO: 66775

SEQ ID NO: 82708 - DNA, 759 bp, Idiomarina loihiensis L2TR; identical to SEQ ID NO: 66776
  CDS (1)..(759): transl_table=11

SEQ ID NO: 82709 - protein, 252 aa, Idiomarina loihiensis L2TR; identical to SEQ ID NO: 66777

SEQ ID NO: 82710 - DNA, 816 bp, Azoarcus sp. EbN1; identical to SEQ ID NO: 66778
  CDS (1)..(816): transl_table=11

SEQ ID NO: 82711 - protein, 271 aa, Azoarcus sp. EbN1; identical to SEQ ID NO: 66779

SEQ ID NO: 82712 - DNA, 750 bp, Zymomonas mobilis subsp. mobilis ZM4; identical to SEQ ID NO: 66780
  CDS (1)..(750): transl_table=11

SEQ ID NO: 82713 - protein, 249 aa, Zymomonas mobilis subsp. mobilis ZM4; identical to SEQ ID NO: 66781

SEQ ID NO: 82714 - DNA, 756 bp, Silicibacter pomeroyi DSS-3; identical to SEQ ID NO: 66782
  CDS (1)..(756): transl_table=11

SEQ ID NO: 82715 - protein, 251 aa, Silicibacter pomeroyi DSS-3; identical to SEQ ID NO: 66783

SEQ ID NO: 82716 - DNA, 762 bp, Francisella tularensis subsp. tularensis Schu 4; identical to SEQ ID NO: 66784
  CDS (1)..(762): transl_table=11

SEQ ID NO: 82717 - protein, 253 aa, Francisella tularensis subsp. tularensis Schu 4; identical to SEQ ID NO: 66785

SEQ ID NO: 82718 - DNA, 762 bp, Synechococcus elongatus PCC 6301; identical to SEQ ID NO: 66786
  CDS (1)..(762): transl_table=11

SEQ ID NO: 82719 - protein, 253 aa, Synechococcus elongatus PCC 6301; identical to SEQ ID NO: 66787

SEQ ID NO: 82720 - DNA, 756 bp, Bacillus clausii KSM-K16; identical to SEQ ID NO: 66788
  CDS (1)..(756): transl_table=11

SEQ ID NO: 82721 - protein, 251 aa, Bacillus clausii KSM-K16; identical to SEQ ID NO: 66789

SEQ ID NO: 82722 - DNA, 723 bp, Ehrlichia ruminantium str. Welgevonden; identical to SEQ ID NO: 66790
  CDS (1)..(723): transl_table=11

SEQ ID NO: 82723 - protein, 240 aa, Ehrlichia ruminantium str. Welgevonden; identical to SEQ ID NO: 66791

SEQ ID NO: 82724 - DNA, 756 bp, Dehalococcoides ethenogenes 195; identical to SEQ ID NO: 66792
  CDS (1)..(756): transl_table=11

SEQ ID NO: 82725 - protein, 251 aa, Dehalococcoides ethenogenes 195; identical to SEQ ID NO: 66793

SEQ ID NO: 82726 - DNA, 750 bp, Rhodobacter sphaeroides 2.4.1; identical to SEQ ID NO: 66794
  CDS (1)..(750)

SEQ ID NO: 82727 - protein, 249 aa, Rhodobacter sphaeroides 2.4.1; identical to SEQ ID NO: 66795

SEQ ID NO: 82728 - DNA, 750 bp, Xylella fastidiosa Dixon; identical to SEQ ID NO: 66796
  CDS (1)..(750)

SEQ ID NO: 82729 - protein, 249 aa, Xylella fastidiosa Dixon; identical to SEQ ID NO: 66797

SEQ ID NO: 82730 - DNA, 741 bp, Azotobacter vinelandii; identical to SEQ ID NO: 66798
  CDS (1)..(741)

SEQ ID NO: 82731 - protein, 246 aa, Azotobacter vinelandii; identical to SEQ ID NO: 66799

SEQ ID NO: 82732 - DNA, 762 bp, Azotobacter vinelandii; identical to SEQ ID NO: 66800
  CDS (1)..(762)

SEQ ID NO: 82733 - protein, 253 aa, Azotobacter vinelandii; identical to SEQ ID NO: 66801

SEQ ID NO: 82734 - DNA, 747 bp, Nostoc punctiforme PCC 73102; identical to SEQ ID NO: 66802
  CDS (1)..(747)

SEQ ID NO: 82735 - protein, 248 aa, Nostoc punctiforme PCC 73102; identical to SEQ ID NO: 66803

SEQ ID NO: 82736 - DNA, 723 bp, Desulfovibrio desulfuricans G20; identical to SEQ ID NO: 66804
  CDS (1)..(723)

SEQ ID NO: 82737 - protein, 240 aa, Desulfovibrio desulfuricans G20; identical to SEQ ID NO: 66805

SEQ ID NO: 82738 - DNA, 771 bp, Actinobacillus pleuropneumoniae serovar 1 str. 4074; identical to SEQ ID NO: 66806
  CDS (1)..(771)

SEQ ID NO: 82739 - protein, 256 aa, Actinobacillus pleuropneumoniae serovar 1 str. 4074; identical to SEQ ID NO: 66807

SEQ ID NO: 82740 - DNA, 756 bp, Fusobacterium nucleatum subsp. vincentii ATCC 49256; identical to SEQ ID NO: 66808
  CDS (1)..(756): transl_table=11

SEQ ID NO: 82741 - protein, 251 aa, Fusobacterium nucleatum subsp. vincentii ATCC 49256; identical to SEQ ID NO: 66809

SEQ ID NO: 82742 - DNA, 810 bp, Psychrobacter sp. 273-4; identical to SEQ ID NO: 66810
  CDS (1)..(810)

SEQ ID NO: 82743 - protein, 269 aa, Psychrobacter sp. 273-4; identical to SEQ ID NO: 66811

SEQ ID NO: 82744 - DNA, 792 bp, Haemophilus influenzae R2866; identical to SEQ ID NO: 66812
  CDS (1)..(792)

SEQ ID NO: 82745 - protein, 263 aa, Haemophilus influenzae R2866; identical to SEQ ID NO: 66813

SEQ ID NO: 82746 - DNA, 693 bp, Anabaena variabilis ATCC 29413; identical to SEQ ID NO: 66814
  CDS (1)..(693)

SEQ ID NO: 82747 - protein, 230 aa, Anabaena variabilis ATCC 29413; identical to SEQ ID NO: 66815

SEQ ID NO: 82748 - DNA, 696 bp, Synechococcus elongatus PCC 7942; identical to SEQ ID NO: 66816
  CDS (1)..(696)

SEQ ID NO: 82749 - protein, 231 aa, Synechococcus elongatus PCC 7942; identical to SEQ ID NO: 66817

SEQ ID NO: 82750 - DNA, 753 bp, Methylobacillus flagellatus KT; identical to SEQ ID NO: 66818
  CDS (1)..(753)

SEQ ID NO: 82751 - protein, 250 aa, Methylobacillus flagellatus KT; identical to SEQ ID NO: 66819

SEQ ID NO: 82752 - DNA, 732 bp, Crocosphaera watsonii WH 8501; identical to SEQ ID NO: 66820
  CDS (1)..(732)

SEQ ID NO: 82753 - protein, 243 aa, Crocosphaera watsonii WH 8501; identical to SEQ ID NO: 66821

SEQ ID NO: 82754 - DNA, 753 bp, Exiguobacterium sp. 255-15; identical to SEQ ID NO: 66822
  CDS (1)..(753)

SEQ ID NO: 82755 - protein, 250 aa, Exiguobacterium sp. 255-15; identical to SEQ ID NO: 66823

SEQ ID NO: 82756 - DNA, 771 bp, Rubrobacter xylanophilus DSM 9941; identical to SEQ ID NO: 66824
  CDS (1)..(771)

SEQ ID NO: 82757 - protein, 256 aa, Rubrobacter xylanophilus DSM 9941; identical to SEQ ID NO: 66825

SEQ ID NO: 82758 - DNA, 765 bp, Mesorhizobium sp. BNC1; identical to SEQ ID NO: 66826
  CDS (1)..(765)

SEQ ID NO: 82759 - protein, 254 aa, Mesorhizobium sp. BNC1; identical to SEQ ID NO: 66827

SEQ ID NO: 82760 - DNA, 756 bp, Magnetospirillum magnetotacticum MS-1; identical to SEQ ID NO: 66828
  CDS (1)..(756)

SEQ ID NO: 82761 - protein, 251 aa, Magnetospirillum magnetotacticum MS-1; identical to SEQ ID NO: 66829

SEQ ID NO: 82762 - DNA, 768 bp, Ehrlichia canis str. Jake; identical to SEQ ID NO: 66830
  CDS (1)..(768)

SEQ ID NO: 82763 - protein, 255 aa, Ehrlichia canis str. Jake; identical to SEQ ID NO: 66831

SEQ ID NO: 82764 - DNA, 732 bp, Burkholderia cepacia R1808; identical to SEQ ID NO: 66832
  CDS (1)..(732)

SEQ ID NO: 82765 - protein, 243 aa, Burkholderia cepacia R1808; identical to SEQ ID NO: 66833

SEQ ID NO: 82766 - DNA, 756 bp, Listeria monocytogenes str. 1/2a F6854; identical to SEQ ID NO: 66834
  CDS (1)..(756): transl_table=11

SEQ ID NO: 82767 - protein, 251 aa, Listeria monocytogenes str. 1/2a F6854; identical to SEQ ID NO: 66835

SEQ ID NO: 82768 - DNA, 723 bp, Bacillus cereus G9241; identical to SEQ ID NO: 66836
  CDS (1)..(723): transl_table=11

SEQ ID NO: 82769 - protein, 240 aa, Bacillus cereus G9241; identical to SEQ ID NO: 66837

SEQ ID NO: 82770 - DNA, 756 bp, Rubrivivax gelatinosus PM1; identical to SEQ ID NO: 66838
  CDS (1)..(756)

SEQ ID NO: 82771 - protein, 251 aa, Rubrivivax gelatinosus PM1; identical to SEQ ID NO: 66839

SEQ ID NO: 82772 - DNA, 723 bp, Pseudomonas fluorescens PfO-1; identical to SEQ ID NO: 66840
  CDS (1)..(723)

SEQ ID NO: 82773 - protein, 240 aa, Pseudomonas fluorescens PfO-1; identical to SEQ ID NO: 66841

SEQ ID NO: 82774 - DNA, 720 bp, Rhodospirillum rubrum; identical to SEQ ID NO: 66842
  CDS (1)..(720)

SEQ ID NO: 82775 - protein, 239 aa, Rhodospirillum rubrum; identical to SEQ ID NO: 66843

SEQ ID NO: 82776 - DNA, 741 bp, Rhodospirillum rubrum; identical to SEQ ID NO: 66844
  CDS (1)..(741)

SEQ ID NO: 82777 - protein, 246 aa, Rhodospirillum rubrum; identical to SEQ ID NO: 66845

SEQ ID NO: 82778 - DNA, 819 bp, Ralstonia metallidurans CH34; identical to SEQ ID NO: 66846
  CDS (1)..(819)

SEQ ID NO: 82779 - protein, 272 aa, Ralstonia metallidurans CH34; identical to SEQ ID NO: 66847

SEQ ID NO: 82780 - DNA, 756 bp, Enterococcus faecium; identical to SEQ ID NO: 66848
  CDS (1)..(756)

SEQ ID NO: 82781 - protein, 251 aa, Enterococcus faecium; identical to SEQ ID NO: 66849

SEQ ID NO: 82782 - DNA, 768 bp, Magnetococcus sp. MC-1; identical to SEQ ID NO: 66850
  CDS (1)..(768)

SEQ ID NO: 82783 - protein, 255 aa, Magnetococcus sp. MC-1; identical to SEQ ID NO: 66851

SEQ ID NO: 82784 - DNA, 786 bp, Thermobifida fusca; identical to SEQ ID NO: 66852
  CDS (1)..(786)

SEQ ID NO: 82785 - protein, 261 aa, Thermobifida fusca; identical to SEQ ID NO: 66853

SEQ ID NO: 82786 - DNA, 735 bp, Novosphingobium aromaticivorans DSM 12444; identical to SEQ ID NO: 66854
  CDS (1)..(735)

SEQ ID NO: 82787 - protein, 244 aa, Novosphingobium aromaticivorans DSM 12444; identical to SEQ ID NO: 66855

SEQ ID NO: 82788 - DNA, 756 bp, Cytophaga hutchinsonii; identical to SEQ ID NO: 66856
  CDS (1)..(756)

SEQ ID NO: 82789 - protein, 251 aa, Cytophaga hutchinsonii; identical to SEQ ID NO: 66857

SEQ ID NO: 82790 - DNA, 756 bp, Clostridium thermocellum ATCC 27405; identical to SEQ ID NO: 66858
  CDS (1)..(756)

SEQ ID NO: 82791 - protein, 251 aa, Clostridium thermocellum ATCC 27405; identical to SEQ ID NO: 66859

SEQ ID NO: 82792 - DNA, 708 bp, Microbulbifer degradans 2-40; identical to SEQ ID NO: 66860
  CDS (1)..(708)

SEQ ID NO: 82793 - protein, 235 aa, Microbulbifer degradans 2-40; identical to SEQ ID NO: 66861

SEQ ID NO: 82794 - DNA, 756 bp, Microbulbifer degradans 2-40; identical to SEQ ID NO: 66862
  CDS (1)..(756)

SEQ ID NO: 82795 - protein, 251 aa, Microbulbifer degradans 2-40; identical to SEQ ID NO: 66863

SEQ ID NO: 82796 - DNA, 723 bp, Oenococcus oeni PSU-1; identical to SEQ ID NO: 66864
  CDS (1)..(723)

SEQ ID NO: 82797 - protein, 240 aa, Oenococcus oeni PSU-1; identical to SEQ ID NO: 66865

SEQ ID NO: 82798 - DNA, 756 bp, Pediococcus pentosaceus ATCC 25745; identical to SEQ ID NO: 66866
  CDS (1)..(756)

SEQ ID NO: 82799 - protein, 251 aa, Pediococcus pentosaceus ATCC 25745; identical to SEQ ID NO: 66867

SEQ ID NO: 82800 - DNA, 693 bp, Trichodesmium erythraeum IMS101; identical to SEQ ID NO: 66868
  CDS (1)..(693)

SEQ ID NO: 82801 - protein, 230 aa, Trichodesmium erythraeum IMS101; identical to SEQ ID NO: 66869

SEQ ID NO: 82802 - DNA, 717 bp, Moorella thermoacetica ATCC 39073; identical to SEQ ID NO: 66870
  CDS (1)..(717)

SEQ ID NO: 82803 - protein, 238 aa, Moorella thermoacetica ATCC 39073; identical to SEQ ID NO: 66871

SEQ ID NO: 82804 - DNA, 747 bp, Thiobacillus denitrificans ATCC 25259; identical to SEQ ID NO: 66872
  CDS (1)..(747)

SEQ ID NO: 82805 - protein, 248 aa, Thiobacillus denitrificans ATCC 25259; identical to SEQ ID NO: 66873

SEQ ID NO: 82806 - DNA, 741 bp, Silicibacter sp. TM1040; identical to SEQ ID NO: 66874
  CDS (1)..(741)

SEQ ID NO: 82807 - protein, 246 aa, Silicibacter sp. TM1040; identical to SEQ ID NO: 66875

SEQ ID NO: 82808 - DNA, 753 bp, Chloroflexus aurantiacus; identical to SEQ ID NO: 66876
  CDS (1)..(753)

SEQ ID NO: 82809 - protein, 250 aa, Chloroflexus aurantiacus; identical to SEQ ID NO: 66877

SEQ ID NO: 82810 - DNA, 768 bp, Polaromonas sp. JS666; identical to SEQ ID NO: 66878
  CDS (1)..(768)

SEQ ID NO: 82811 - protein, 255 aa, Polaromonas sp. JS666; identical to SEQ ID NO: 66879

SEQ ID NO: 82812 - DNA, 744 bp, Drosophila simulans; identical to SEQ ID NO: 66880
  CDS (1)..(744)

SEQ ID NO: 82813 - protein, 247 aa, Drosophila simulans; identical to SEQ ID NO: 66881

SEQ ID NO: 82814 - DNA, 744 bp, Drosophila yakuba; identical to SEQ ID NO: 66882
  CDS (1)..(744)

SEQ ID NO: 82815 - protein, 247 aa, Drosophila yakuba; identical to SEQ ID NO: 66883

SEQ ID NO: 82816 - DNA, 774 bp, Giardia lamblia; identical to SEQ ID NO: 66884
  CDS (1)..(774)

SEQ ID NO: 82817 - protein, 257 aa, Giardia lamblia; identical to SEQ ID NO: 66885

SEQ ID NO: 82818 - DNA, 1071 bp, Astasia longa; identical to SEQ ID NO: 66886
  CDS (1)..(1071)

SEQ ID NO: 82819 - protein, 356 aa, Astasia longa; identical to SEQ ID NO: 66887

SEQ ID NO: 82820 - DNA, 768 bp, Astasia longa; identical to SEQ ID NO: 66888
  CDS (1)..(768)

SEQ ID NO: 82821 - protein, 255 aa, Astasia longa; identical to SEQ ID NO: 66889

SEQ ID NO: 82822 - DNA, 849 bp, Chlamydomonas reinhardtii; identical to SEQ ID NO: 66890
  CDS (1)..(849)

SEQ ID NO: 82823 - protein, 282 aa, Chlamydomonas reinhardtii; identical to SEQ ID NO: 66891

SEQ ID NO: 82824 - DNA, 924 bp, Porphyra yezoensis; identical to SEQ ID NO: 66892
  CDS (1)..(924)

SEQ ID NO: 82825 - protein, 307 aa, Porphyra yezoensis; identical to SEQ ID NO: 66893

SEQ ID NO: 82826 - DNA, 759 bp, Helicosporidium sp; identical to SEQ ID NO: 66894
  CDS (1)..(759)

SEQ ID NO: 82827 - protein, 252 aa, Helicosporidium sp; identical to SEQ ID NO: 66895

SEQ ID NO: 82828 - DNA, 750 bp, Macaca fascicularis; identical to SEQ ID NO: 66896
  CDS (1)..(750)

SEQ ID NO: 82829 - protein, 249 aa, Macaca fascicularis; identical to SEQ ID NO: 66897

SEQ ID NO: 82830 - DNA, 747 bp, Bombyx mori; identical to SEQ ID NO: 66898
  CDS (1)..(747)

SEQ ID NO: 82831 - protein, 248 aa, Bombyx mori; identical to SEQ ID NO: 66899

SEQ ID NO: 82832 - DNA, 915 bp, Oryza sativa; identical to SEQ ID NO: 66900
  CDS (1)..(915)

SEQ ID NO: 82833 - protein, 304 aa, Oryza sativa; identical to SEQ ID NO: 66901

SEQ ID NO: 82834 - DNA, 762 bp, Glycine max; identical to SEQ ID NO: 66902
  CDS (1)..(762)

SEQ ID NO: 82835 - protein, 253 aa, Glycine max; identical to SEQ ID NO: 66903

SEQ ID NO: 82836 - DNA, 750 bp, Rattus norvegicus; identical to SEQ ID NO: 66904
  CDS (1)..(750)

SEQ ID NO: 82837 - protein, 249 aa, Rattus norvegicus; identical to SEQ ID NO: 66905

SEQ ID NO: 82838 - DNA, 765 bp, Solanum chacoense; identical to SEQ ID NO: 66906
  CDS (1)..(765)

SEQ ID NO: 82839 - protein, 254 aa, Solanum chacoense; identical to SEQ ID NO: 66907

SEQ ID NO: 82840 - DNA, 1074 bp, Euglena gracilis; identical to SEQ ID NO: 66908
  CDS (1)..(1074)

SEQ ID NO: 82841 - protein, 357 aa, Euglena gracilis; identical to SEQ ID NO: 66909

SEQ ID NO: 82842 - DNA, 768 bp, Euglena gracilis; identical to SEQ ID NO: 66910
  CDS (1)..(768)

SEQ ID NO: 82843 - protein, 255 aa, Euglena gracilis; identical to SEQ ID NO: 66911

SEQ ID NO: 82844 - DNA, 798 bp, Klebsiella pneumoniae; identical to SEQ ID NO: 66912
  CDS (1)..(798): s means g or c

SEQ ID NO: 82845 - protein, 265 aa, Klebsiella pneumoniae; identical to SEQ ID NO: 66913
  misc_feature (219)..(219): Xaa can be Thr or Ser or Arg

SEQ ID NO: 82846 - DNA, 747 bp, Brachydanio rerio; identical to SEQ ID NO: 66914
  CDS (1)..(747)

SEQ ID NO: 82847 - protein, 248 aa, Brachydanio rerio; identical to SEQ ID NO: 66915

SEQ ID NO: 82848 - DNA, 747 bp, Xenopus laevis; identical to SEQ ID NO: 66916
  CDS (1)..(747)

SEQ ID NO: 82849 - protein, 248 aa, Xenopus laevis; identical to SEQ ID NO: 66917

SEQ ID NO: 82850 - DNA, 897 bp, Cyanidioschyzon merolae; identical to SEQ ID NO: 66918
  CDS (1)..(897)

SEQ ID NO: 82851 - protein, 298 aa, Cyanidioschyzon merolae; identical to SEQ ID NO: 66919

SEQ ID NO: 82852 - DNA, 774 bp, Dictyostelium discoideum; identical to SEQ ID NO: 66920
  CDS (1)..(774)

SEQ ID NO: 82853 - protein, 257 aa, Dictyostelium discoideum; identical to SEQ ID NO: 66921

SEQ ID NO: 82854 - DNA, 759 bp, Schistosoma japonicum; identical to SEQ ID NO: 66922
  CDS (1)..(759)

SEQ ID NO: 82855 - protein, 252 aa, Schistosoma japonicum; identical to SEQ ID NO: 66923

SEQ ID NO: 82856 - DNA, 744 bp, Tenebrio molitor; identical to SEQ ID NO: 66924
  CDS (1)..(744)

SEQ ID NO: 82857 - protein, 247 aa, Tenebrio molitor; identical to SEQ ID NO: 66925

SEQ ID NO: 82858 - DNA, 756 bp, Leishmania infantum; identical to SEQ ID NO: 66926
  CDS (1)..(756)

SEQ ID NO: 82859 - protein, 251 aa, Leishmania infantum; identical to SEQ ID NO: 66927

SEQ ID NO: 82860 - DNA, 744 bp, Xiphophorus maculatus; identical to SEQ ID NO: 66928
  CDS (1)..(744)

SEQ ID NO: 82861 - protein, 247 aa, Xiphophorus maculatus; identical to SEQ ID NO: 66929

SEQ ID NO: 82862 - DNA, 744 bp, Xiphophorus maculatus; identical to SEQ ID NO: 66930
  CDS (1)..(744)

SEQ ID NO: 82863 - protein, 247 aa, Xiphophorus maculatus; identical to SEQ ID NO: 66931

SEQ ID NO: 82864 - DNA, 747 bp, Brachydanio rerio; identical to SEQ ID NO: 66932
  CDS (1)..(747)

SEQ ID NO: 82865 - protein, 248 aa, Brachydanio rerio; identical to SEQ ID NO: 66933

SEQ ID NO: 82866 - DNA, 750 bp, Acipenser brevirostrum; identical to SEQ ID NO: 66934
  CDS (1)..(750)

SEQ ID NO: 82867 - protein, 249 aa, Acipenser brevirostrum; identical to SEQ ID NO: 66935

SEQ ID NO: 82868 - DNA, 723 bp, Cowdria ruminantium; identical to SEQ ID NO: 66936
  CDS (1)..(723): transl_table=11

SEQ ID NO: 82869 - protein, 240 aa, Cowdria ruminantium; identical to SEQ ID NO: 66937

SEQ ID NO: 82870 - DNA, 762 bp, Triticum aestivum; identical to SEQ ID NO: 66938
  CDS (1)..(762)

SEQ ID NO: 82871 - protein, 253 aa, Triticum aestivum; identical to SEQ ID NO: 66939

SEQ ID NO: 82872 - DNA, 744 bp, Drosophila melanogaster; identical to SEQ ID NO: 66940
  CDS (1)..(744)

SEQ ID NO: 82873 - protein, 247 aa, Drosophila melanogaster; identical to SEQ ID NO: 66941

SEQ ID NO: 82874 - DNA, 765 bp, Brucella melitensis; identical to SEQ ID NO: 66942
  CDS (1)..(765): transl_table=11

SEQ ID NO: 82875 - protein, 254 aa, Brucella melitensis; identical to SEQ ID NO: 66943

SEQ ID NO: 82876 - DNA, 774 bp, Giardia lamblia; identical to SEQ ID NO: 66944
  CDS (1)..(774)

SEQ ID NO: 82877 - protein, 257 aa, Giardia lamblia; identical to SEQ ID NO: 66945

SEQ ID NO: 82878 - DNA, 771 bp, Rhizobium loti; identical to SEQ ID NO: 66946
  CDS (1)..(771)

SEQ ID NO: 82879 - protein, 256 aa, Rhizobium loti; identical to SEQ ID NO: 66947

SEQ ID NO: 82880 - DNA, 771 bp, Brucella suis; identical to SEQ ID NO: 66948
  CDS (1)..(771)

SEQ ID NO: 82881 - protein, 256 aa, Brucella suis; identical to SEQ ID NO: 66949

SEQ ID NO: 82882 - DNA, 774 bp, Giardia lamblia; identical to SEQ ID NO: 66950
  CDS (1)..(774)

SEQ ID NO: 82883 - protein, 257 aa, Giardia lamblia; identical to SEQ ID NO: 66951

SEQ ID NO: 82884 - DNA, 765 bp, Rhizobium loti; identical to SEQ ID NO: 66952
  CDS (1)..(765)

SEQ ID NO: 82885 - protein, 254 aa, Rhizobium loti; identical to SEQ ID NO: 66953

SEQ ID NO: 82886 - DNA, 768 bp, Rhizobium meliloti; identical to SEQ ID NO: 66954
  CDS (1)..(768): transl_table=11

SEQ ID NO: 82887 - protein, 255 aa, Rhizobium meliloti; identical to SEQ ID NO: 66955

SEQ ID NO: 82888 - DNA, 948 bp, Arabidopsis thaliana; identical to SEQ ID NO: 66956
  CDS (1)..(948)

SEQ ID NO: 82889 - protein, 315 aa, Arabidopsis thaliana; identical to SEQ ID NO: 66957

SEQ ID NO: 82890 - DNA, 945 bp, Fragaria ananassa; identical to SEQ ID NO: 66958
  CDS (1)..(945)

SEQ ID NO: 82891 - protein, 314 aa, Fragaria ananassa; identical to SEQ ID NO: 66959

SEQ ID NO: 82892 - DNA, 897 bp, Secale cereale; identical to SEQ ID NO: 66960
  CDS (1)..(897)

SEQ ID NO: 82893 - protein, 298 aa, Secale cereale; identical to SEQ ID NO: 66961

SEQ ID NO: 82894 - DNA, 969 bp, Spinacia oleracea; identical to SEQ ID NO: 66962
  CDS (1)..(969)

SEQ ID NO: 82895 - protein, 322 aa, Spinacia oleracea; identical to SEQ ID NO: 66963

SEQ ID NO: 82896 - DNA, 771 bp, Agrobacterium tumefaciens; identical to SEQ ID NO: 66964
  CDS (1)..(771): transl_table=11

SEQ ID NO: 82897 - protein, 256 aa, Agrobacterium tumefaciens; identical to SEQ ID NO: 66965

SEQ ID NO: 82898 - DNA, 726 bp, Anabaena sp; identical to SEQ ID NO: 66966
  CDS (1)..(726)

SEQ ID NO: 82899 - protein, 241 aa, Anabaena sp; identical to SEQ ID NO: 66967

SEQ ID NO: 82900 - DNA, 744 bp, Aquifex aeolicus; identical to SEQ ID NO: 66968
  CDS (1)..(744): transl_table=11

SEQ ID NO: 82901 - protein, 247 aa, Aquifex aeolicus; identical to SEQ ID NO: 66969

SEQ ID NO: 82902 - DNA, 765 bp, Arabidopsis thaliana; identical to SEQ ID NO: 66970
  CDS (1)..(765)

SEQ ID NO: 82903 - protein, 254 aa, Arabidopsis thaliana; identical to SEQ ID NO: 66971

SEQ ID NO: 82904 - DNA, 747 bp, Ashbya gossypii; identical to SEQ ID NO: 66972
  CDS (1)..(747)

SEQ ID NO: 82905 - protein, 248 aa, Ashbya gossypii; identical to SEQ ID NO: 66973

SEQ ID NO: 82906 - DNA, 756 bp, Aspergillus oryzae; identical to SEQ ID NO: 66974
  CDS (1)..(756)

SEQ ID NO: 82907 - protein, 251 aa, Aspergillus oryzae; identical to SEQ ID NO: 66975

SEQ ID NO: 82908 - DNA, 756 bp, Bacillus megaterium; identical to SEQ ID NO: 66976
  CDS (1)..(756): transl_table=11

SEQ ID NO: 82909 - protein, 251 aa, Bacillus megaterium; identical to SEQ ID NO: 66977

SEQ ID NO: 82910 - DNA, 765 bp, Bartonella henselae; identical to SEQ ID NO: 66978
  CDS (1)..(765): transl_table=11

SEQ ID NO: 82911 - protein, 254 aa, Bartonella henselae; identical to SEQ ID NO: 66979

SEQ ID NO: 82912 - DNA, 804 bp, Bifidobacterium longum; identical to SEQ ID NO: 66980
  CDS (1)..(804): transl_table=11

SEQ ID NO: 82913 - protein, 267 aa, Bifidobacterium longum; identical to SEQ ID NO: 66981

SEQ ID NO: 82914 - DNA, 747 bp, Bordetella bronchiseptica; identical to SEQ ID NO: 66982
  CDS (1)..(747): transl_table=11

SEQ ID NO: 82915 - protein, 248 aa, Bordetella bronchiseptica; identical to SEQ ID NO: 66983

SEQ ID NO: 82916 - DNA, 762 bp, Borrelia burgdorferi; identical to SEQ ID NO: 66984
  CDS (1)..(762): transl_table=11

SEQ ID NO: 82917 - protein, 253 aa, Borrelia burgdorferi; identical to SEQ ID NO: 66985

SEQ ID NO: 82918 - DNA, 756 bp, Bradyrhizobium japonicum; identical to SEQ ID NO: 66986
  CDS (1)..(756)

SEQ ID NO: 82919 - protein, 251 aa, Bradyrhizobium japonicum; identical to SEQ ID NO: 66987

SEQ ID NO: 82920 - DNA, 765 bp, Buchnera aphidicola; identical to SEQ ID NO: 66988
  CDS (1)..(765): transl_table=11

SEQ ID NO: 82921 - protein, 254 aa, Buchnera aphidicola; identical to SEQ ID NO: 66989

SEQ ID NO: 82922 - DNA, 744 bp, Caenorhabditis elegans; identical to SEQ ID NO: 66990
  CDS (1)..(744)

SEQ ID NO: 82923 - protein, 247 aa, Caenorhabditis elegans; identical to SEQ ID NO: 66991

SEQ ID NO: 82924 - DNA, 747 bp, Candida albicans; identical to SEQ ID NO: 66992
  CDS (1)..(747)

SEQ ID NO: 82925 - protein, 248 aa, Candida albicans; identical to SEQ ID NO: 66993

SEQ ID NO: 82926 - DNA, 789 bp, Candidatus Blochmannia floridanus; identical to SEQ ID NO: 66994
  CDS (1)..(789): transl_table=11

SEQ ID NO: 82927 - protein, 262 aa, Candidatus Blochmannia floridanus; identical to SEQ ID NO: 66995

SEQ ID NO: 82928 - DNA, 747 bp, Candida glabrata; identical to SEQ ID NO: 66996
  CDS (1)..(747)

SEQ ID NO: 82929 - protein, 248 aa, Candida glabrata; identical to SEQ ID NO: 66997

SEQ ID NO: 82930 - DNA, 762 bp, Caulobacter crescentus; identical to SEQ ID NO: 66998
  CDS (1)..(762): transl_table=11

SEQ ID NO: 82931 - protein, 253 aa, Caulobacter crescentus; identical to SEQ ID NO: 66999

SEQ ID NO: 82932 - DNA, 765 bp, Chlamydophila caviae; identical to SEQ ID NO: 67000
  CDS (1)..(765): transl_table=11

SEQ ID NO: 82933 - protein, 254 aa, Chlamydophila caviae; identical to SEQ ID NO: 67001

SEQ ID NO: 82934 - DNA, 738 bp, Chlorobium tepidum; identical to SEQ ID NO: 67002
  CDS (1)..(738): transl_table=11

SEQ ID NO: 82935 - protein, 245 aa, Chlorobium tepidum; identical to SEQ ID NO: 67003

SEQ ID NO: 82936 - DNA, 825 bp, Chlamydia trachomatis; identical to SEQ ID NO: 67004
  CDS (1)..(825): transl_table=11

SEQ ID NO: 82937 - protein, 274 aa, Chlamydia trachomatis; identical to SEQ ID NO: 67005

SEQ ID NO: 82938 - DNA, 747 bp, Chromobacterium violaceum; identical to SEQ ID NO: 67006
  CDS (1)..(747): transl_table=11

SEQ ID NO: 82939 - protein, 248 aa, Chromobacterium violaceum; identical to SEQ ID NO: 67007

SEQ ID NO: 82940 - DNA, 747 bp, Clostridium acetobutylicum; identical to SEQ ID NO: 67008
  CDS (1)..(747): transl_table=11

SEQ ID NO: 82941 - protein, 248 aa, Clostridium acetobutylicum; identical to SEQ ID NO: 67009

SEQ ID NO: 82942 - DNA, 747 bp, Clostridium perfringens; identical to SEQ ID NO: 67010
  CDS (1)..(747)

SEQ ID NO: 82943 - protein, 248 aa, Clostridium perfringens; identical to SEQ ID NO: 67011

SEQ ID NO: 82944 - DNA, 768 bp, Clostridium tetani; identical to SEQ ID NO: 67012
  CDS (1)..(768): transl_table=11

SEQ ID NO: 82945 - protein, 255 aa, Clostridium tetani; identical to SEQ ID NO: 67013

SEQ ID NO: 82946 - DNA, 756 bp, Coprinus cinereus; identical to SEQ ID NO: 67014
  CDS (1)..(756)

SEQ ID NO: 82947 - protein, 251 aa, Coprinus cinereus; identical to SEQ ID NO: 67015

SEQ ID NO: 82948 - DNA, 762 bp, Coptis japonica; identical to SEQ ID NO: 67016
  CDS (1)..(762)

SEQ ID NO: 82949 - protein, 253 aa, Coptis japonica; identical to SEQ ID NO: 67017

SEQ ID NO: 82950 - DNA, 789 bp, Corynebacterium efficiens; identical to SEQ ID NO: 67018
  CDS (1)..(789)

SEQ ID NO: 82951 - protein, 262 aa, Corynebacterium efficiens; identical to SEQ ID NO: 67019

SEQ ID NO: 82952 - DNA, 780 bp, Corynebacterium glutamicum; identical to SEQ ID NO: 67020
  CDS (1)..(780): transl_table=11

SEQ ID NO: 82953 - protein, 259 aa, Corynebacterium glutamicum; identical to SEQ ID NO: 67021

SEQ ID NO: 82954 - DNA, 768 bp, Coxiella burnetii; identical to SEQ ID NO: 67022
  CDS (1)..(768): transl_table=11

SEQ ID NO: 82955 - protein, 255 aa, Coxiella burnetii; identical to SEQ ID NO: 67023

SEQ ID NO: 82956 - DNA, 744 bp, Culex tarsalis; identical to SEQ ID NO: 67024
  CDS (1)..(744)

SEQ ID NO: 82957 - protein, 247 aa, Culex tarsalis; identical to SEQ ID NO: 67025

SEQ ID NO: 82958 - DNA, 747 bp, Debaryomyces hansenii; identical to SEQ ID NO: 67026
  CDS (1)..(747)

SEQ ID NO: 82959 - protein, 248 aa, Debaryomyces hansenii; identical to SEQ ID NO: 67027

SEQ ID NO: 82960 - DNA, 744 bp, Drosophila melanogaster; identical to SEQ ID NO: 67028
  CDS (1)..(744)

SEQ ID NO: 82961 - protein, 247 aa, Drosophila melanogaster; identical to SEQ ID NO: 67029

SEQ ID NO: 82962 - DNA, 750 bp, Emericella nidulans; identical to SEQ ID NO: 67030
  CDS (1)..(750)

SEQ ID NO: 82963 - protein, 249 aa, Emericella nidulans; identical to SEQ ID NO: 67031

SEQ ID NO: 82964 - DNA, 768 bp, Enterobacter cloacae; identical to SEQ ID NO: 67032
  CDS (1)..(768): transl_table=11

SEQ ID NO: 82965 - protein, 255 aa, Enterobacter cloacae; identical to SEQ ID NO: 67033

SEQ ID NO: 82966 - DNA, 756 bp, Enterococcus faecalis; identical to SEQ ID NO: 67034
  CDS (1)..(756): transl_table=11

SEQ ID NO: 82967 - protein, 251 aa, Enterococcus faecalis; identical to SEQ ID NO: 67035

SEQ ID NO: 82968 - DNA, 756 bp, Fusobacterium nucleatum; identical to SEQ ID NO: 67036
  CDS (1)..(756): transl_table=11

SEQ ID NO: 82969 - protein, 251 aa, Fusobacterium nucleatum; identical to SEQ ID NO: 67037

SEQ ID NO: 82970 - DNA, 723 bp, Gloeobacter violaceus; identical to SEQ ID NO: 67038
  CDS (1)..(723)

SEQ ID NO: 82971 - protein, 240 aa, Gloeobacter violaceus; identical to SEQ ID NO: 67039

SEQ ID NO: 82972 - DNA, 771 bp, Haemophilus ducreyi; identical to SEQ ID NO: 67040
  CDS (1)..(771): transl_table=11

SEQ ID NO: 82973 - protein, 256 aa, Haemophilus ducreyi; identical to SEQ ID NO: 67041

SEQ ID NO: 82974 - DNA, 708 bp, Helicobacter hepaticus; identical to SEQ ID NO: 67042
  CDS (1)..(708): transl_table=11

SEQ ID NO: 82975 - protein, 235 aa, Helicobacter hepaticus; identical to SEQ ID NO: 67043

SEQ ID NO: 82976 - DNA, 705 bp, Helicobacter pylori J99; identical to SEQ ID NO: 67044
  CDS (1)..(705): transl_table=11

SEQ ID NO: 82977 - protein, 234 aa, Helicobacter pylori J99; identical to SEQ ID NO: 67045

SEQ ID NO: 82978 - DNA, 705 bp, Helicobacter pylori; identical to SEQ ID NO: 67046
  CDS (1)..(705): transl_table=11

SEQ ID NO: 82979 - protein, 234 aa, Helicobacter pylori; identical to SEQ ID NO: 67047

SEQ ID NO: 82980 - DNA, 762 bp, Hordeum vulgare; identical to SEQ ID NO: 67048
  CDS (1)..(762)

SEQ ID NO: 82981 - protein, 253 aa, Hordeum vulgare; identical to SEQ ID NO: 67049

SEQ ID NO: 82982 - DNA, 768 bp, Klebsiella pneumoniae; identical to SEQ ID NO: 67050
  CDS (1)..(768): transl_table=11

SEQ ID NO: 82983 - protein, 255 aa, Klebsiella pneumoniae; identical to SEQ ID NO: 67051

SEQ ID NO: 82984 - DNA, 747 bp, Kluyveromyces lactis; identical to SEQ ID NO: 67052
  CDS (1)..(747)

SEQ ID NO: 82985 - protein, 248 aa, Kluyveromyces lactis; identical to SEQ ID NO: 67053

SEQ ID NO: 82986 - DNA, 747 bp, Kluyveromyces marxianus; identical to SEQ ID NO: 67054
  CDS (1)..(747)

SEQ ID NO: 82987 - protein, 248 aa, Kluyveromyces marxianus; identical to SEQ ID NO: 67055

SEQ ID NO: 82988 - DNA, 759 bp, Lactobacillus delbrueckii; identical to SEQ ID NO: 67056
  CDS (1)..(759): transl_table=11

SEQ ID NO: 82989 - protein, 252 aa, Lactobacillus delbrueckii; identical to SEQ ID NO: 67057

SEQ ID NO: 82990 - DNA, 759 bp, Lactococcus lactis; identical to SEQ ID NO: 66672
  CDS (1)..(759)

SEQ ID NO: 82991 - protein, 252 aa, Lactococcus lactis; identical to SEQ ID NO: 66673

SEQ ID NO: 82992 - DNA, 756 bp, Leishmania mexicana; identical to SEQ ID NO: 67060
  CDS (1)..(756)

SEQ ID NO: 82993 - protein, 251 aa, Leishmania mexicana; identical to SEQ ID NO: 67061

SEQ ID NO: 82994 - DNA, 1141 bp, Zea mays; identical to SEQ ID NO: 67062
  CDS (83)..(844)

SEQ ID NO: 82995 - protein, 253 aa, Zea mays; identical to SEQ ID NO: 67063

SEQ ID NO: 82996 - DNA, 810 bp, Moraxella sp; identical to SEQ ID NO: 67064
  CDS (1)..(810): transl_table=11

SEQ ID NO: 82997 - protein, 269 aa, Moraxella sp; identical to SEQ ID NO: 67065

SEQ ID NO: 82998 - DNA, 735 bp, Mycoplasma genitalium; identical to SEQ ID NO: 67066
  CDS (1)..(735): transl_table=4

SEQ ID NO: 82999 - protein, 244 aa, Mycoplasma genitalium; identical to SEQ ID NO: 67067

SEQ ID NO: 83000 - DNA, 729 bp, Mycoplasma hyopneumoniae; identical to SEQ ID NO: 67068
  CDS (1)..(729): transl_table=4

SEQ ID NO: 83001 - protein, 242 aa, Mycoplasma hyopneumoniae; identical to SEQ ID NO: 67069

SEQ ID NO: 83002 - DNA, 786 bp, Mycobacterium leprae; identical to SEQ ID NO: 67070
  CDS (1)..(786): transl_table=11

SEQ ID NO: 83003 - protein, 261 aa, Mycobacterium leprae; identical to SEQ ID NO: 67071

SEQ ID NO: 83004 - DNA, 753 bp, Mycoplasma penetrans; identical to SEQ ID NO: 67072
  CDS (31)..(234)

SEQ ID NO: 83005 - protein, 67 aa, Mycoplasma penetrans; identical to SEQ ID NO: 67073

SEQ ID NO: 83006 - DNA, 747 bp, Mycoplasma pulmonis; identical to SEQ ID NO: 67074
  CDS (1)..(747): transl_table=4

SEQ ID NO: 83007 - protein, 248 aa, Mycoplasma pulmonis; identical to SEQ ID NO: 67075

SEQ ID NO: 83008 - DNA, 756 bp, Neisseria meningitidis; identical to SEQ ID NO: 67076
  CDS (1)..(756): transl_table=11

SEQ ID NO: 83009 - protein, 251 aa, Neisseria meningitidis; identical to SEQ ID NO: 67077

SEQ ID NO: 83010 - DNA, 747 bp, Neurospora crassa; identical to SEQ ID NO: 67078
  CDS (1)..(747)

SEQ ID NO: 83011 - protein, 248 aa, Neurospora crassa; identical to SEQ ID NO: 67079

SEQ ID NO: 83012 - DNA, 759 bp, Nitrosomonas europaea; identical to SEQ ID NO: 67080
  CDS (1)..(759): transl_table=11

SEQ ID NO: 83013 - protein, 252 aa, Nitrosomonas europaea; identical to SEQ ID NO: 67081

SEQ ID NO: 83014 - DNA, 759 bp, Oceanobacillus iheyensis; identical to SEQ ID NO: 67082
  CDS (1)..(759)

SEQ ID NO: 83015 - protein, 252 aa, Oceanobacillus iheyensis; identical to SEQ ID NO: 67083

SEQ ID NO: 83016 - DNA, 762 bp, Oryza sativa; identical to SEQ ID NO: 67084
  CDS (1)..(762)

SEQ ID NO: 83017 - protein, 253 aa, Oryza sativa; identical to SEQ ID NO: 67085

SEQ ID NO: 83018 - DNA, 750 bp, Paracoccidioides brasiliensis; identical to SEQ ID NO: 67086
  CDS (1)..(750)

SEQ ID NO: 83019 - protein, 249 aa, Paracoccidioides brasiliensis; identical to SEQ ID NO: 67087

SEQ ID NO: 83020 - DNA, 786 bp, Pasteurella multocida; identical to SEQ ID NO: 67088
  CDS (1)..(786): transl_table=11

SEQ ID NO: 83021 - protein, 261 aa, Pasteurella multocida; identical to SEQ ID NO: 67089

SEQ ID NO: 83022 - DNA, 765 bp, Petunia hybrida; identical to SEQ ID NO: 67090
  CDS (1)..(765)

SEQ ID NO: 83023 - protein, 254 aa, Petunia hybrida; identical to SEQ ID NO: 67091

SEQ ID NO: 83024 - DNA, 768 bp, Photorhabdus luminescens; identical to SEQ ID NO: 67092
  CDS (1)..(768): transl_table=11

SEQ ID NO: 83025 - protein, 255 aa, Photorhabdus luminescens; identical to SEQ ID NO: 67093

SEQ ID NO: 83026 - DNA, 747 bp, Plasmodium falciparum; identical to SEQ ID NO: 67094
  CDS (1)..(747)

SEQ ID NO: 83027 - protein, 248 aa, Plasmodium falciparum; identical to SEQ ID NO: 67095

SEQ ID NO: 83028 - DNA, 756 bp, Porphyromonas gingivalis; identical to SEQ ID NO: 67096
  CDS (1)..(756): transl_table=11

SEQ ID NO: 83029 - protein, 251 aa, Porphyromonas gingivalis; identical to SEQ ID NO: 67097

SEQ ID NO: 83030 - DNA, 732 bp, Prochlorococcus marinus; identical to SEQ ID NO: 67098
  CDS (1)..(732): transl_table=11

SEQ ID NO: 83031 - protein, 243 aa, Prochlorococcus marinus; identical to SEQ ID NO: 67099

SEQ ID NO: 83032 - DNA, 756 bp, Pseudomonas aeruginosa; identical to SEQ ID NO: 67100
  CDS (1)..(756): transl_table=11

SEQ ID NO: 83033 - protein, 251 aa, Pseudomonas aeruginosa; identical to SEQ ID NO: 67101

SEQ ID NO: 83034 - DNA, 756 bp, Pseudomonas putida; identical to SEQ ID NO: 67102
  CDS (1)..(756): transl_table=11

SEQ ID NO: 83035 - protein, 251 aa, Pseudomonas putida; identical to SEQ ID NO: 67103

SEQ ID NO: 83036 - DNA, 756 bp, Pseudomonas syringae; identical to SEQ ID NO: 67104
  CDS (1)..(756): transl_table=11

SEQ ID NO: 83037 - protein, 251 aa, Pseudomonas syringae; identical to SEQ ID NO: 67105

SEQ ID NO: 83038 - DNA, 756 bp, Pseudomonas syringae; identical to SEQ ID NO: 67106
  CDS (1)..(756): transl_table=11

SEQ ID NO: 83039 - protein, 251 aa, Pseudomonas syringae; identical to SEQ ID NO: 67107

SEQ ID NO: 83040 - DNA, 765 bp, Rhodopirellula baltica; identical to SEQ ID NO: 67108
  CDS (1)..(765): transl_table=11

SEQ ID NO: 83041 - protein, 254 aa, Rhodopirellula baltica; identical to SEQ ID NO: 67109

SEQ ID NO: 83042 - DNA, 768 bp, Salmonella typhimurium; identical to SEQ ID NO: 67110
  CDS (1)..(768): transl_table=11

SEQ ID NO: 83043 - protein, 255 aa, Salmonella typhimurium; identical to SEQ ID NO: 67111

SEQ ID NO: 83044 - DNA, 759 bp, Schistosoma japonicum; identical to SEQ ID NO: 67112
  CDS (1)..(759)

SEQ ID NO: 83045 - protein, 252 aa, Schistosoma japonicum; identical to SEQ ID NO: 67113

SEQ ID NO: 83046 - DNA, 762 bp, Schistosoma mansoni; identical to SEQ ID NO: 67114
  CDS (1)..(762)

SEQ ID NO: 83047 - protein, 253 aa, Schistosoma mansoni; identical to SEQ ID NO: 67115

SEQ ID NO: 83048 - DNA, 1033 bp, Secale cereale; identical to SEQ ID NO: 67116
  CDS (55)..(816)

SEQ ID NO: 83049 - protein, 253 aa, Secale cereale; identical to SEQ ID NO: 67117

SEQ ID NO: 83050 - DNA, 783 bp, Shewanella oneidensis; identical to SEQ ID NO: 67118
  CDS (1)..(783): transl_table=11

SEQ ID NO: 83051 - protein, 260 aa, Shewanella oneidensis; identical to SEQ ID NO: 67119

SEQ ID NO: 83052 - DNA, 762 bp, Staphylococcus aureus; identical to SEQ ID NO: 67120
  CDS (1)..(762): transl_table=11

SEQ ID NO: 83053 - protein, 253 aa, Staphylococcus aureus; identical to SEQ ID NO: 67121

SEQ ID NO: 83054 - DNA, 774 bp, Stellaria longipes; identical to SEQ ID NO: 67122
  CDS (1)..(774)

SEQ ID NO: 83055 - protein, 257 aa, Stellaria longipes; identical to SEQ ID NO: 67123

SEQ ID NO: 83056 - DNA, 798 bp, Synechococcus elongatus; identical to SEQ ID NO: 67124
  CDS (1)..(798)

SEQ ID NO: 83057 - protein, 265 aa, Synechococcus elongatus; identical to SEQ ID NO: 67125

SEQ ID NO: 83058 - DNA, 732 bp, Synechococcus sp; identical to SEQ ID NO: 67126
  CDS (1)..(732): transl_table=11

SEQ ID NO: 83059 - protein, 243 aa, Synechococcus sp; identical to SEQ ID NO: 67127

SEQ ID NO: 83060 - DNA, 729 bp, Synechocystis sp; identical to SEQ ID NO: 67128
  CDS (1)..(729)

SEQ ID NO: 83061 - protein, 242 aa, Synechocystis sp; identical to SEQ ID NO: 67129

SEQ ID NO: 83062 - DNA, 753 bp, Taenia solium; identical to SEQ ID NO: 67130
  CDS (1)..(753)

SEQ ID NO: 83063 - protein, 250 aa, Taenia solium; identical to SEQ ID NO: 67131

SEQ ID NO: 83064 - DNA, 747 bp, Thermoanaerobacter tengcongensis; identical to SEQ ID NO: 67132
  CDS (1)..(747): transl_table=11

SEQ ID NO: 83065 - protein, 248 aa, Thermoanaerobacter tengcongensis; identical to SEQ ID NO: 67133

SEQ ID NO: 83066 - DNA, 750 bp, Treponema pallidum; identical to SEQ ID NO: 67134
  CDS (1)..(750): transl_table=11

SEQ ID NO: 83067 - protein, 249 aa, Treponema pallidum; identical to SEQ ID NO: 67135

SEQ ID NO: 83068 - DNA, 756 bp, Trypanosoma cruzi; identical to SEQ ID NO: 67136
  CDS (1)..(756)

SEQ ID NO: 83069 - protein, 251 aa, Trypanosoma cruzi; identical to SEQ ID NO: 67137

SEQ ID NO: 83070 - DNA, 774 bp, Vibrio cholerae; identical to SEQ ID NO: 67138
  CDS (1)..(774)

SEQ ID NO: 83071 - protein, 257 aa, Vibrio cholerae; identical to SEQ ID NO: 67139

SEQ ID NO: 83072 - DNA, 771 bp, Vibrio marinus; identical to SEQ ID NO: 67140
  CDS (1)..(771): transl_table=11

SEQ ID NO: 83073 - protein, 256 aa, Vibrio marinus; identical to SEQ ID NO: 67141

SEQ ID NO: 83074 - DNA, 771 bp, Wigglesworthia glossinidia brevipalpis; identical to SEQ ID NO: 67142
  CDS (1)..(771)

SEQ ID NO: 83075 - protein, 256 aa, Wigglesworthia glossinidia brevipalpis; identical to SEQ ID NO: 67143

SEQ ID NO: 83076 - DNA, 699 bp, Wolinella succinogenes; identical to SEQ ID NO: 67144
  CDS (1)..(699): transl_table=11

SEQ ID NO: 83077 - protein, 232 aa, Wolinella succinogenes; identical to SEQ ID NO: 67145

SEQ ID NO: 83078 - DNA, 756 bp, Xanthomonas axonopodis; identical to SEQ ID NO: 67146
  CDS (1)..(756): transl_table=11

SEQ ID NO: 83079 - protein, 251 aa, Xanthomonas axonopodis; identical to SEQ ID NO: 67147

SEQ ID NO: 83080 - DNA, 750 bp, Xanthobacter flavus; identical to SEQ ID NO: 67148
  CDS (1)..(750): transl_table=11

SEQ ID NO: 83081 - protein, 249 aa, Xanthobacter flavus; identical to SEQ ID NO: 67149

SEQ ID NO: 83082 - DNA, 744 bp, Yarrowia lipolytica; identical to SEQ ID NO: 67150
  CDS (1)..(744)

SEQ ID NO: 83083 - protein, 247 aa, Yarrowia lipolytica; identical to SEQ ID NO: 67151

SEQ ID NO: 83084 - DNA, 768 bp, Yersinia pestis; identical to SEQ ID NO: 67152
  CDS (1)..(768): transl_table=11

SEQ ID NO: 83085 - protein, 255 aa, Yersinia pestis; identical to SEQ ID NO: 67153

SEQ ID NO: 83086 - DNA, 747 bp, Zygosaccharomyces bailii; identical to SEQ ID NO: 67154
  CDS (1)..(747)

SEQ ID NO: 83087 - protein, 248 aa, Zygosaccharomyces bailii; identical to SEQ ID NO: 67155

SEQ ID NO: 83088 - DNA, 23 bp, Primer
atgcgacatcctttagtgatggg

SEQ ID NO: 83089 - DNA, 23 bp, Primer
ttaagcctgtttagccgcttctg

SEQ ID NO: 83090 - protein, 264 aa, consensus; identical to SEQ ID NO: 67158
  MISC_FEATURE (1)..(264): consensus for the disclosure of xaa see table XV

SEQ ID NO: 83091 - protein, 138 aa, consensus; identical to SEQ ID NO: 67159
  MISC_FEATURE (1)..(138): consensus for the disclosure of xaa see table XV

SEQ ID NO: 83092 - protein, 79 aa, consensus; identical to SEQ ID NO: 67160
  MISC_FEATURE (1)..(79): consensus for the disclosure of xaa see table XV

SEQ ID NO: 83093 - DNA, 1509 bp, Escherichia coli; identical to SEQ ID NO: 69414
  CDS (1)..(1509)

SEQ ID NO: 83094 - protein, 502 aa, Escherichia coli; identical to SEQ ID NO: 69415

SEQ ID NO: 83095 - DNA, 2409 bp, Cryptococcus neoformans var. neoformans JEC21; identical to SEQ ID NO: 69416
  CDS (46)..(2325)

SEQ ID NO: 83096 - protein, 759 aa, Cryptococcus neoformans var. neoformans JEC21; identical to SEQ ID NO: 69417

SEQ ID NO: 83097 - DNA, 1494 bp, Thermococcus kodakaraensis; identical to SEQ ID NO: 69418
  CDS (1)..(1494)

SEQ ID NO: 83098 - protein, 497 aa, Thermococcus kodakaraensis; identical to SEQ ID NO: 69419

SEQ ID NO: 83099 - DNA, 1593 bp, Staphylococcus aureus subsp. aureus COL; identical to SEQ ID NO: 69420
  CDS (97)..(1593)

SEQ ID NO: 83100 - protein, 498 aa, Staphylococcus aureus subsp. aureus COL; identical to SEQ ID NO: 69421

SEQ ID NO: 83101 - DNA, 1539 bp, Gluconobacter oxydans 621H; identical to SEQ ID NO: 69422
  CDS (1)..(1539)

SEQ ID NO: 83102 - protein, 512 aa, Gluconobacter oxydans 621H; identical to SEQ ID NO: 69423

SEQ ID NO: 83103 - DNA, 1503 bp, Lactobacillus acidophilus NCFM; identical to SEQ ID NO: 69424
  CDS (1)..(1503)

SEQ ID NO: 83104 - protein, 500 aa, Lactobacillus acidophilus NCFM; identical to SEQ ID NO: 69425

SEQ ID NO: 83105 - DNA, 1650 bp, Mus musculus; identical to SEQ ID NO: 69426
  CDS (1)..(1650)

SEQ ID NO: 83106 - protein, 549 aa, Mus musculus; identical to SEQ ID NO: 69427

SEQ ID NO: 83107 - DNA, 1503 bp, Agrobacterium rhizogenes; identical to SEQ ID NO: 69428
  CDS (1)..(1503): transl_table=11

SEQ ID NO: 83108 - protein, 500 aa, Agrobacterium rhizogenes; identical to SEQ ID NO: 69429

SEQ ID NO: 83109 - DNA, 1482 bp, Archaeoglobus fulgidus DSM 4304; identical to SEQ ID NO: 69430
  CDS (1)..(1482): transl_table=11

SEQ ID NO: 83110 - protein, 493 aa, Archaeoglobus fulgidus DSM 4304; identical to SEQ ID NO: 69431

SEQ ID NO: 83111 - DNA, 1497 bp, Thermoplasma volcanium GSS1; identical to SEQ ID NO: 69432
  CDS (1)..(1497): transl_table=11

SEQ ID NO: 83112 - protein, 498 aa, Thermoplasma volcanium GSS1; identical to SEQ ID NO: 69433

SEQ ID NO: 83113 - DNA, 1569 bp, Arabidopsis thaliana; identical to SEQ ID NO: 69434
  CDS (1)..(1569)

SEQ ID NO: 83114 - protein, 522 aa, Arabidopsis thaliana; identical to SEQ ID NO: 69435

SEQ ID NO: 83115 - DNA, 1449 bp, Thermotoga maritima MSB8; identical to SEQ ID NO: 69436
  CDS (1)..(1449): transl_table=11

SEQ ID NO: 83116 - protein, 482 aa, Thermotoga maritima MSB8; identical to SEQ ID NO: 69437

SEQ ID NO: 83117 - DNA, 1416 bp, Pseudomonas aeruginosa PAO1; identical to SEQ ID NO: 69438
  CDS (1)..(1416): transl_table=11

SEQ ID NO: 83118 - protein, 471 aa, Pseudomonas aeruginosa PAO1; identical to SEQ ID NO: 69439

SEQ ID NO: 83119 - DNA, 1551 bp, Xylella fastidiosa 9a5c; identical to SEQ ID NO: 69440
  CDS (1)..(1551): transl_table=11

SEQ ID NO: 83120 - protein, 516 aa, Xylella fastidiosa 9a5c; identical to SEQ ID NO: 69441

SEQ ID NO: 83121 - DNA, 1524 bp, Agrobacterium tumefaciens str. C58; identical to SEQ ID NO: 69442
  CDS (1)..(1524): transl_table=11

SEQ ID NO: 83122 - protein, 507 aa, Agrobacterium tumefaciens str. C58; identical to SEQ ID NO: 69443

SEQ ID NO: 83123 - DNA, 1467 bp, Thermoplasma acidophilum DSM 1728; identical to SEQ ID NO: 69444
  CDS (1)..(1467): transl_table=11

SEQ ID NO: 83124 - protein, 488 aa, Thermoplasma acidophilum DSM 1728; identical to SEQ ID NO: 69445

SEQ ID NO: 83125 - DNA, 1491 bp, Caulobacter crescentus CB15; identical to SEQ ID NO: 69446
  CDS (1)..(1491): transl_table=11

SEQ ID NO: 83126 - protein, 496 aa, Caulobacter crescentus CB15; identical to SEQ ID NO: 69447

SEQ ID NO: 83127 - DNA, 1509 bp, Salmonella typhimurium LT2; identical to SEQ ID NO: 69448
  CDS (1)..(1509): transl_table=11

SEQ ID NO: 83128 - protein, 502 aa, Salmonella typhimurium LT2; identical to SEQ ID NO: 69449

SEQ ID NO: 83129 - DNA, 1515 bp, Caenorhabditis elegans; identical to SEQ ID NO: 69450
  CDS (1)..(1515)

SEQ ID NO: 83130 - protein, 504 aa, Caenorhabditis elegans; identical to SEQ ID NO: 69451

SEQ ID NO: 83131 - DNA, 1617 bp, Drosophila melanogaster; identical to SEQ ID NO: 69452
  CDS (1)..(1617)

SEQ ID NO: 83132 - protein, 538 aa, Drosophila melanogaster; identical to SEQ ID NO: 69453

SEQ ID NO: 83133 - DNA, 1470 bp, Agrobacterium tumefaciens str. C58; identical to SEQ ID NO: 69454
  CDS (1)..(1470): transl_table=11

SEQ ID NO: 83134 - protein, 489 aa, Agrobacterium tumefaciens str. C58; identical to SEQ ID NO: 69455

SEQ ID NO: 83135 - DNA, 1791 bp, Drosophila melanogaster; identical to SEQ ID NO: 69456
  CDS (1)..(1791)

SEQ ID NO: 83136 - protein, 596 aa, Drosophila melanogaster; identical to SEQ ID NO: 69457

SEQ ID NO: 83137 - DNA, 1440 bp, Streptomyces coelicolor A3(2); identical to SEQ ID NO: 69458
  CDS (1)..(1440)

SEQ ID NO: 83138 - protein, 479 aa, Streptomyces coelicolor A3(2); identical to SEQ ID NO: 69459

SEQ ID NO: 83139 - DNA, 1671 bp, Drosophila melanogaster; identical to SEQ ID NO: 69460
  CDS (1)..(1671)

SEQ ID NO: 83140 - protein, 556 aa, Drosophila melanogaster; identical to SEQ ID NO: 69461

SEQ ID NO: 83141 - DNA, 1452 bp, Chlorobium tepidum TLS; identical to SEQ ID NO: 69462
  CDS (1)..(1452): transl_table=11

SEQ ID NO: 83142 - protein, 483 aa, Chlorobium tepidum TLS; identical to SEQ ID NO: 69463

SEQ ID NO: 83143 - DNA, 1524 bp, Yersinia pestis KIM; identical to SEQ ID NO: 69464
  CDS (1)..(1524): transl_table=11

SEQ ID NO: 83144 - protein, 507 aa, Yersinia pestis KIM; identical to SEQ ID NO: 69465

SEQ ID NO: 83145 - DNA, 1506 bp, Plasmodium falciparum 3D7; identical to SEQ ID NO: 69466
  CDS (1)..(1506)

SEQ ID NO: 83146 - protein, 501 aa, Plasmodium falciparum 3D7; identical to SEQ ID NO: 69467

SEQ ID NO: 83147 - DNA, 1359 bp, Shigella flexneri 2a str. 301; identical to SEQ ID NO: 69468
  CDS (1)..(1359): transl_table=11

SEQ ID NO: 83148 - protein, 452 aa, Shigella flexneri 2a str. 301; identical to SEQ ID NO: 69469

SEQ ID NO: 83149 - DNA, 1491 bp, Leptospira interrogans serovar Lai str. 56601; identical to SEQ ID NO: 69470
  CDS (1)..(1491): transl_table=11

SEQ ID NO: 83150 - protein, 496 aa, Leptospira interrogans serovar Lai str. 56601; identical to SEQ ID NO: 69471

SEQ ID NO: 83151 - DNA, 1548 bp, Leptospira interrogans serovar Lai str. 56601; identical to SEQ ID NO: 69472
  CDS (1)..(1548): transl_table=11

SEQ ID NO: 83152 - protein, 515 aa, Leptospira interrogans serovar Lai str. 56601; identical to SEQ ID NO: 69473

SEQ ID NO: 83153 - DNA, 1635 bp, Drosophila melanogaster; identical to SEQ ID NO: 69474
  CDS (1)..(1635)

SEQ ID NO: 83154 - protein, 544 aa, Drosophila melanogaster; identical to SEQ ID NO: 69475

SEQ ID NO: 83155 - DNA, 1620 bp, Drosophila melanogaster; identical to SEQ ID NO: 69476
  CDS (1)..(1620)

SEQ ID NO: 83156 - protein, 539 aa, Drosophila melanogaster; identical to SEQ ID NO: 69477

SEQ ID NO: 83157 - DNA, 1476 bp, Pseudomonas syringae pv. tomato str. DC3000; identical to SEQ ID NO: 69478
  CDS (1)..(1476): transl_table=11

SEQ ID NO: 83158 - protein, 491 aa, Pseudomonas syringae pv. tomato str. DC3000; identical to SEQ ID NO: 69479

SEQ ID NO: 83159 - DNA, 1506 bp, Synechococcus sp. WH 8102; identical to SEQ ID NO: 69480
  CDS (1)..(1506): transl_table=11

SEQ ID NO: 83160 - protein, 501 aa, Synechococcus sp. WH 8102; identical to SEQ ID NO: 69481

SEQ ID NO: 83161 - DNA, 1524 bp, Photorhabdus luminescens subsp. laumondii TTO1; identical to SEQ ID NO: 69482
  CDS (1)..(1524): transl_table=11

SEQ ID NO: 83162 - protein, 507 aa, Photorhabdus luminescens subsp. laumondii TTO1; identical to SEQ ID NO: 69483

SEQ ID NO: 83163 - DNA, 1521 bp, Corynebacterium diphtheriae NCTC 13129; identical to SEQ ID NO: 69484
  CDS (1)..(1521): transl_table=11

SEQ ID NO: 83164 - protein, 506 aa, Corynebacterium diphtheriae NCTC 13129; identical to SEQ ID NO: 69485

SEQ ID NO: 83165 - DNA, 1503 bp, Rhodopseudomonas palustris CGA009; identical to SEQ ID NO: 69486
  CDS (1)..(1503): transl_table=11

SEQ ID NO: 83166 - protein, 500 aa, Rhodopseudomonas palustris CGA009; identical to SEQ ID NO: 69487

SEQ ID NO: 83167 - DNA, 1491 bp, Geobacter sulfurreducens PCA; identical to SEQ ID NO: 69488
  CDS (1)..(1491): transl_table=11

SEQ ID NO: 83168 - protein, 496 aa, Geobacter sulfurreducens PCA; identical to SEQ ID NO: 69489

SEQ ID NO: 83169 - DNA, 1548 bp, Mycobacterium avium subsp. paratuberculosis str. k10; identical to SEQ ID NO: 69490
  CDS (1)..(1548): transl_table=11

SEQ ID NO: 83170 - protein, 515 aa, Mycobacterium avium subsp. paratuberculosis str. k10; identical to SEQ ID NO: 69491

SEQ ID NO: 83171 - DNA, 1452 bp, Lactobacillus johnsonii NCC 533; identical to SEQ ID NO: 69492
  CDS (1)..(1452): transl_table=11

SEQ ID NO: 83172 - protein, 483 aa, Lactobacillus johnsonii NCC 533; identical to SEQ ID NO: 69493

SEQ ID NO: 83173 - DNA, 1488 bp, Bdellovibrio bacteriovorus HD100; identical to SEQ ID NO: 69494
  CDS (1)..(1488): transl_table=11

SEQ ID NO: 83174 - protein, 495 aa, Bdellovibrio bacteriovorus HD100; identical to SEQ ID NO: 69495

SEQ ID NO: 83175 - DNA, 1491 bp, Treponema denticola ATCC 35405; identical to SEQ ID NO: 69496
  CDS (1)..(1491): transl_table=11

SEQ ID NO: 83176 - protein, 496 aa, Treponema denticola ATCC 35405; identical to SEQ ID NO: 69497

SEQ ID NO: 83177 - DNA, 1518 bp, Mycoplasma mycoides subsp. mycoides SC str. PG1; identical to SEQ ID NO: 69498
  CDS (1)..(1518): transl_table=4

SEQ ID NO: 83178 - protein, 505 aa, Mycoplasma mycoides subsp. mycoides SC str. PG1; identical to SEQ ID NO: 69499

SEQ ID NO: 83179 - DNA, 1593 bp, Homo sapiens; identical to SEQ ID NO: 69500
  CDS (1)..(1593)

SEQ ID NO: 83180 - protein, 530 aa, Homo sapiens; identical to SEQ ID NO: 69501

SEQ ID NO: 83181 - DNA, 1533 bp, Bacillus cereus ATCC 10987; identical to SEQ ID NO: 69502
  CDS (1)..(1533): k means g or t/u, m means a or c

SEQ ID NO: 83182 - protein, 510 aa, Bacillus cereus ATCC 10987; identical to SEQ ID NO: 69503
  misc_feature (20)..(20): Xaa can be Val or Phe
  misc_feature (387)..(387): Xaa can be Thr or Pro

SEQ ID NO: 83183 - DNA, 1935 bp, Eremothecium gossypii; identical to SEQ ID NO: 69504
  CDS (1)..(1935)

SEQ ID NO: 83184 - protein, 644 aa, Eremothecium gossypii; identical to SEQ ID NO: 69505

SEQ ID NO: 83185 - DNA, 1662 bp, Mus musculus; identical to SEQ ID NO: 69506
  CDS (1)..(1662)

SEQ ID NO: 83186 - protein, 553 aa, Mus musculus; identical to SEQ ID NO: 69507

SEQ ID NO: 83187 - DNA, 1560 bp, Anopheles gambiae str. PEST; identical to SEQ ID NO: 69508
  CDS (1)..(1560)

SEQ ID NO: 83188 - protein, 519 aa, Anopheles gambiae str. PEST; identical to SEQ ID NO: 69509

SEQ ID NO: 83189 - DNA, 1668 bp, Anopheles gambiae str. PEST; identical to SEQ ID NO: 69510
  CDS (1)..(1668)

SEQ ID NO: 83190 - protein, 555 aa, Anopheles gambiae str. PEST; identical to SEQ ID NO: 69511

SEQ ID NO: 83191 - DNA, 1974 bp, Neurospora crassa; identical to SEQ ID NO: 69512
  CDS (1)..(1974)

SEQ ID NO: 83192 - protein, 657 aa, Neurospora crassa; identical to SEQ ID NO: 69513

SEQ ID NO: 83193 - DNA, 1734 bp, Magnaporthe grisea 70-15; identical to SEQ ID NO: 69514
  CDS (1)..(1734)

SEQ ID NO: 83194 - protein, 577 aa, Magnaporthe grisea 70-15; identical to SEQ ID NO: 69515

SEQ ID NO: 83195 - DNA, 1551 bp, Gibberella zeae PH-1; identical to SEQ ID NO: 69516
  CDS (1)..(1551)

SEQ ID NO: 83196 - protein, 516 aa, Gibberella zeae PH-1; identical to SEQ ID NO: 69517

SEQ ID NO: 83197 - DNA, 1539 bp, Apis mellifera; identical to SEQ ID NO: 69518
  CDS (1)..(1539)

SEQ ID NO: 83198 - protein, 512 aa, Apis mellifera; identical to SEQ ID NO: 69519

SEQ ID NO: 83199 - DNA, 1647 bp, Apis mellifera; identical to SEQ ID NO: 69520
  CDS (1)..(1647)

SEQ ID NO: 83200 - protein, 548 aa, Apis mellifera; identical to SEQ ID NO: 69521

SEQ ID NO: 83201 - DNA, 1545 bp, Apis mellifera; identical to SEQ ID NO: 69522
  CDS (1)..(1545)

SEQ ID NO: 83202 - protein, 514 aa, Apis mellifera; identical to SEQ ID NO: 69523

SEQ ID NO: 83203 - DNA, 1533 bp, Ustilago maydis 521; identical to SEQ ID NO: 69524
  CDS (1)..(1533)

SEQ ID NO: 83204 - protein, 510 aa, Ustilago maydis 521; identical to SEQ ID NO: 69525

SEQ ID NO: 83205 - DNA, 1827 bp, Aspergillus nidulans FGSC A4; identical to SEQ ID NO: 69526
  CDS (1)..(1827)

SEQ ID NO: 83206 - protein, 608 aa, Aspergillus nidulans FGSC A4; identical to SEQ ID NO: 69527

SEQ ID NO: 83207 - DNA, 1704 bp, Aspergillus nidulans FGSC A4; identical to SEQ ID NO: 69528
  CDS (1)..(1704)

SEQ ID NO: 83208 - protein, 567 aa, Aspergillus nidulans FGSC A4; identical to SEQ ID NO: 69529

SEQ ID NO: 83209 - DNA, 1581 bp, Gallus gallus; identical to SEQ ID NO: 69530
  CDS (1)..(1581): n means a or g or c or t/u

SEQ ID NO: 83210 - protein, 526 aa, Gallus gallus; identical to SEQ ID NO: 69531

SEQ ID NO: 83211 - DNA, 2019 bp, Candida glabrata CBS138; identical to SEQ ID NO: 69532
  CDS (1)..(2019)

SEQ ID NO: 83212 - protein, 672 aa, Candida glabrata CBS138; identical to SEQ ID NO: 69533

SEQ ID NO: 83213 - DNA, 1986 bp, Kluyveromyces lactis NRRL Y-1140; identical to SEQ ID NO: 69534
  CDS (1)..(1986)

SEQ ID NO: 83214 - protein, 661 aa, Kluyveromyces lactis NRRL Y-1140; identical to SEQ ID NO: 69535

SEQ ID NO: 83215 - DNA, 1893 bp, Debaryomyces hansenii CBS767; identical to SEQ ID NO: 69536
  CDS (1)..(1893)

SEQ ID NO: 83216 - protein, 630 aa, Debaryomyces hansenii CBS767; identical to SEQ ID NO: 69537

SEQ ID NO: 83217 - DNA, 1512 bp, Yarrowia lipolytica CLIB99; identical to SEQ ID NO: 69538
  CDS (1)..(1512)

SEQ ID NO: 83218 - protein, 503 aa, Yarrowia lipolytica CLIB99; identical to SEQ ID NO: 69539

SEQ ID NO: 83219 - DNA, 1737 bp, Pan troglodytes; identical to SEQ ID NO: 69540
  CDS (1)..(1737)

SEQ ID NO: 83220 - protein, 578 aa, Pan troglodytes; identical to SEQ ID NO: 69541

SEQ ID NO: 83221 - DNA, 1533 bp, Mycoplasma mobile 163K; identical to SEQ ID NO: 69542
  CDS (1)..(1533): transl_table=4

SEQ ID NO: 83222 - protein, 510 aa, Mycoplasma mobile 163K; identical to SEQ ID NO: 69543

SEQ ID NO: 83223 - DNA, 1350 bp, Picrophilus torridus DSM 9790; identical to SEQ ID NO: 69544
  CDS (1)..(1350): transl_table=11

SEQ ID NO: 83224 - protein, 449 aa, Picrophilus torridus DSM 9790; identical to SEQ ID NO: 69545

SEQ ID NO: 83225 - DNA, 1488 bp, Acinetobacter sp. ADP1; identical to SEQ ID NO: 69546
  CDS (1)..(1488): transl_table=11

SEQ ID NO: 83226 - protein, 495 aa, Acinetobacter sp. ADP1; identical to SEQ ID NO: 69547

SEQ ID NO: 83227 - DNA, 1491 bp, Erwinia carotovora subsp. atroseptica SCRI1043; identical to SEQ ID NO: 69548
  CDS (1)..(1491)

SEQ ID NO: 83228 - protein, 496 aa, Erwinia carotovora subsp. atroseptica SCRI1043; identical to SEQ ID NO: 69549

SEQ ID NO: 83229 - DNA, 1512 bp, Erwinia carotovora subsp. atroseptica SCRI1043; identical to SEQ ID NO: 69550
  CDS (1)..(1512)

SEQ ID NO: 83230 - protein, 503 aa, Erwinia carotovora subsp. atroseptica SCRI1043; identical to SEQ ID NO: 69551

SEQ ID NO: 83231 - DNA, 1548 bp, Propionibacterium acnes KPA171202; identical to SEQ ID NO: 69552
  CDS (1)..(1548): transl_table=11

SEQ ID NO: 83232 - protein, 515 aa, Propionibacterium acnes KPA171202; identical to SEQ ID NO: 69553

SEQ ID NO: 83233 - DNA, 1515 bp, Streptococcus pyogenes MGAS10394; identical to SEQ ID NO: 69554
  CDS (1)..(1515): transl_table=11

SEQ ID NO: 83234 - protein, 504 aa, Streptococcus pyogenes MGAS10394; identical to SEQ ID NO: 69555

SEQ ID NO: 83235 - DNA, 1521 bp, Leifsonia xyli subsp. xyli str. CTCB07; identical to SEQ ID NO: 69556
  CDS (1)..(1521): transl_table=11

SEQ ID NO: 83236 - protein, 506 aa, Leifsonia xyli subsp. xyli str. CTCB07; identical to SEQ ID NO: 69557

SEQ ID NO: 83237 - DNA, 1488 bp, Yersinia pseudotuberculosis IP 32953; identical to SEQ ID NO: 69558
  CDS (1)..(1488): transl_table=11

SEQ ID NO: 83238 - protein, 495 aa, Yersinia pseudotuberculosis IP 32953; identical to SEQ ID NO: 69559

SEQ ID NO: 83239 - DNA, 1497 bp, Symbiobacterium thermophilum IAM 14863; identical to SEQ ID NO: 69560
  CDS (1)..(1497): transl_table=11

SEQ ID NO: 83240 - protein, 498 aa, Symbiobacterium thermophilum IAM 14863; identical to SEQ ID NO: 69561

SEQ ID NO: 83241 - DNA, 1491 bp, Bacillus cereus ZK; identical to SEQ ID NO: 69562
  CDS (1)..(1491): transl_table=11

SEQ ID NO: 83242 - protein, 496 aa, Bacillus cereus ZK; identical to SEQ ID NO: 69563

SEQ ID NO: 83243 - DNA, 1554 bp, Mannheimia succiniciproducens MBEL55E; identical to SEQ ID NO: 69564
  CDS (1)..(1554): transl_table=11

SEQ ID NO: 83244 - protein, 517 aa, Mannheimia succiniciproducens MBEL55E; identical to SEQ ID NO: 69565

SEQ ID NO: 83245 - DNA, 1503 bp, Burkholderia pseudomallei K96243; identical to SEQ ID NO: 69566
  CDS (1)..(1503): transl_table=11

SEQ ID NO: 83246 - protein, 500 aa, Burkholderia pseudomallei K96243; identical to SEQ ID NO: 69567

SEQ ID NO: 83247 - DNA, 1533 bp, Mycoplasma hyopneumoniae 232; identical to SEQ ID NO: 69568
  CDS (1)..(1533): transl_table=4

SEQ ID NO: 83248 - protein, 510 aa, Mycoplasma hyopneumoniae 232; identical to SEQ ID NO: 69569

SEQ ID NO: 83249 - DNA, 1500 bp, Nocardia farcinica IFM 10152; identical to SEQ ID NO: 69570
  CDS (1)..(1500): transl_table=11

SEQ ID NO: 83250 - protein, 499 aa, Nocardia farcinica IFM 10152; identical to SEQ ID NO: 69571

SEQ ID NO: 83251 - DNA, 1476 bp, Legionella pneumophila str. Paris; identical to SEQ ID NO: 69572
  CDS (1)..(1476): transl_table=11

SEQ ID NO: 83252 - protein, 491 aa, Legionella pneumophila str. Paris; identical to SEQ ID NO: 69573

SEQ ID NO: 83253 - DNA, 1527 bp, Photobacterium profundum SS9; identical to SEQ ID NO: 69574
  CDS (1)..(1527): transl_table=11

SEQ ID NO: 83254 - protein, 508 aa, Photobacterium profundum SS9; identical to SEQ ID NO: 69575

SEQ ID NO: 83255 - DNA, 1533 bp, Haloarcula marismortui ATCC 43049; identical to SEQ ID NO: 69576
  CDS (1)..(1533): transl_table=11

SEQ ID NO: 83256 - protein, 510 aa, Haloarcula marismortui ATCC 43049; identical to SEQ ID NO: 69577

SEQ ID NO: 83257 - DNA, 1488 bp, Thermus thermophilus HB8; identical to SEQ ID NO: 69578
  CDS (1)..(1488): transl_table=11

SEQ ID NO: 83258 - protein, 495 aa, Thermus thermophilus HB8; identical to SEQ ID NO: 69579

SEQ ID NO: 83259 - DNA, 1491 bp, Azoarcus sp. EbN1; identical to SEQ ID NO: 69580
  CDS (1)..(1491): transl_table=11

SEQ ID NO: 83260 - protein, 496 aa, Azoarcus sp. EbN1; identical to SEQ ID NO: 69581

SEQ ID NO: 83261 - DNA, 1479 bp, Silicibacter pomeroyi DSS-3; identical to SEQ ID NO: 69582
  CDS (1)..(1479): transl_table=11

SEQ ID NO: 83262 - protein, 492 aa, Silicibacter pomeroyi DSS-3; identical to SEQ ID NO: 69583

SEQ ID NO: 83263 - DNA, 1509 bp, Francisella tularensis subsp. tularensis Schu 4; identical to SEQ ID NO: 69584
  CDS (1)..(1509): transl_table=11

SEQ ID NO: 83264 - protein, 502 aa, Francisella tularensis subsp. tularensis Schu 4; identical to SEQ ID NO: 69585

SEQ ID NO: 83265 - DNA, 1497 bp, Bacillus clausii KSM-K16; identical to SEQ ID NO: 69586
  CDS (1)..(1497): transl_table=11

SEQ ID NO: 83266 - protein, 498 aa, Bacillus clausii KSM-K16; identical to SEQ ID NO: 69587

SEQ ID NO: 83267 - DNA, 1518 bp, Azotobacter vinelandii; identical to SEQ ID NO: 69588
  CDS (1)..(1518)

SEQ ID NO: 83268 - protein, 505 aa, Azotobacter vinelandii; identical to SEQ ID NO: 69589

SEQ ID NO: 83269 - DNA, 1485 bp, Desulfitobacterium hafniense DCB-2; identical to SEQ ID NO: 69590
  CDS (1)..(1485)

SEQ ID NO: 83270 - protein, 494 aa, Desulfitobacterium hafniense DCB-2; identical to SEQ ID NO: 69591

SEQ ID NO: 83271 - DNA, 1494 bp, Desulfovibrio desulfuricans G20; identical to SEQ ID NO: 69592
  CDS (1)..(1494)

SEQ ID NO: 83272 - protein, 497 aa, Desulfovibrio desulfuricans G20; identical to SEQ ID NO: 69593

SEQ ID NO: 83273 - DNA, 1512 bp, Actinobacillus pleuropneumoniae serovar 1 str. 4074; identical to SEQ ID NO: 69594
  CDS (1)..(1512)

SEQ ID NO: 83274 - protein, 503 aa, Actinobacillus pleuropneumoniae serovar 1 str. 4074; identical to SEQ ID NO: 69595

SEQ ID NO: 83275 - DNA, 1485 bp, Pseudomonas aeruginosa UCBPP-PA14; identical to SEQ ID NO: 69596
  CDS (1)..(1485)

SEQ ID NO: 83276 - protein, 494 aa, Pseudomonas aeruginosa UCBPP-PA14; identical to SEQ ID NO: 69597

SEQ ID NO: 83277 - DNA, 1518 bp, Pseudomonas aeruginosa UCBPP-PA14; identical to SEQ ID NO: 69598
  CDS (1)..(1518)

SEQ ID NO: 83278 - protein, 505 aa, Pseudomonas aeruginosa UCBPP-PA14; identical to SEQ ID NO: 69599

SEQ ID NO: 83279 - DNA, 1494 bp, Fusobacterium nucleatum subsp. vincentii ATCC 49256; identical to SEQ ID NO: 69600
  CDS (1)..(1494): transl_table=11

SEQ ID NO: 83280 - protein, 497 aa, Fusobacterium nucleatum subsp. vincentii ATCC 49256; identical to SEQ ID NO: 69601

SEQ ID NO: 83281 - DNA, 1533 bp, Psychrobacter sp. 273-4; identical to SEQ ID NO: 69602
  CDS (1)..(1533)

SEQ ID NO: 83282 - protein, 510 aa, Psychrobacter sp. 273-4; identical to SEQ ID NO: 69603

SEQ ID NO: 83283 - DNA, 1503 bp, Anabaena variabilis ATCC 29413; identical to SEQ ID NO: 69604
  CDS (1)..(1503)

SEQ ID NO: 83284 - protein, 500 aa, Anabaena variabilis ATCC 29413; identical to SEQ ID NO: 69605

SEQ ID NO: 83285 - DNA, 1551 bp, Ralstonia eutropha JMP134; identical to SEQ ID NO: 69606
  CDS (1)..(1551)

SEQ ID NO: 83286 - protein, 516 aa, Ralstonia eutropha JMP134; identical to SEQ ID NO: 69607

SEQ ID NO: 83287 - DNA, 1512 bp, Rubrobacter xylanophilus DSM 9941; identical to SEQ ID NO: 69608
  CDS (1)..(1512)

SEQ ID NO: 83288 - protein, 503 aa, Rubrobacter xylanophilus DSM 9941; identical to SEQ ID NO: 69609

SEQ ID NO: 83289 - DNA, 1503 bp, Mesorhizobium sp. BNC1; identical to SEQ ID NO: 69610
  CDS (1)..(1503)

SEQ ID NO: 83290 - protein, 500 aa, Mesorhizobium sp. BNC1; identical to SEQ ID NO: 69611

SEQ ID NO: 83291 - DNA, 1509 bp, Dechloromonas aromatica RCB; identical to SEQ ID NO: 69612
  CDS (1)..(1509)

SEQ ID NO: 83292 - protein, 502 aa, Dechloromonas aromatica RCB; identical to SEQ ID NO: 69613

SEQ ID NO: 83293 - DNA, 1482 bp, Rhodobacter sphaeroides 2.4.1; identical to SEQ ID NO: 69614
  CDS (1)..(1482)

SEQ ID NO: 83294 - protein, 493 aa, Rhodobacter sphaeroides 2.4.1; identical to SEQ ID NO: 69615

SEQ ID NO: 83295 - DNA, 1542 bp, Burkholderia cepacia R18194; identical to SEQ ID NO: 69616
  CDS (1)..(1542)

SEQ ID NO: 83296 - protein, 513 aa, Burkholderia cepacia R18194; identical to SEQ ID NO: 69617

SEQ ID NO: 83297 - DNA, 1503 bp, Burkholderia cepacia R18194; identical to SEQ ID NO: 69618
  CDS (1)..(1503)

SEQ ID NO: 83298 - protein, 500 aa, Burkholderia cepacia R18194; identical to SEQ ID NO: 69619

SEQ ID NO: 83299 - DNA, 1464 bp, Listeria monocytogenes str. 1/2a F6854; identical to SEQ ID NO: 69620
  CDS (1)..(1464): transl_table=11

SEQ ID NO: 83300 - protein, 487 aa, Listeria monocytogenes str. 1/2a F6854; identical to SEQ ID NO: 69621

SEQ ID NO: 83301 - DNA, 1500 bp, Rubrivivax gelatinosus PM1; identical to SEQ ID NO: 69622
  CDS (1)..(1500)

SEQ ID NO: 83302 - protein, 499 aa, Rubrivivax gelatinosus PM1; identical to SEQ ID NO: 69623

SEQ ID NO: 83303 - DNA, 1494 bp, Rhodospirillum rubrum; identical to SEQ ID NO: 69624
  CDS (1)..(1494)

SEQ ID NO: 83304 - protein, 497 aa, Rhodospirillum rubrum; identical to SEQ ID NO: 69625

SEQ ID NO: 83305 - DNA, 1488 bp, Rhodospirillum rubrum; identical to SEQ ID NO: 69626
  CDS (1)..(1488)

SEQ ID NO: 83306 - protein, 495 aa, Rhodospirillum rubrum; identical to SEQ ID NO: 69627

SEQ ID NO: 83307 - DNA, 1542 bp, Ralstonia metallidurans CH34; identical to SEQ ID NO: 69628
  CDS (1)..(1542)

SEQ ID NO: 83308 - protein, 513 aa, Ralstonia metallidurans CH34; identical to SEQ ID NO: 69629

SEQ ID NO: 83309 - DNA, 1521 bp, Ralstonia metallidurans CH34; identical to SEQ ID NO: 69630
  CDS (1)..(1521)

SEQ ID NO: 83310 - protein, 506 aa, Ralstonia metallidurans CH34; identical to SEQ ID NO: 69631

SEQ ID NO: 83311 - DNA, 1500 bp, Burkholderia fungorum LB400; identical to SEQ ID NO: 69632
  CDS (1)..(1500)

SEQ ID NO: 83312 - protein, 499 aa, Burkholderia fungorum LB400; identical to SEQ ID NO: 69633

SEQ ID NO: 83313 - DNA, 1503 bp, Thermobifida fusca; identical to SEQ ID NO: 69634
  CDS (1)..(1503)

SEQ ID NO: 83314 - protein, 500 aa, Thermobifida fusca; identical to SEQ ID NO: 69635

SEQ ID NO: 83315 - DNA, 1464 bp, Novosphingobium aromaticivorans DSM 12444; identical to SEQ ID NO: 69636
  CDS (1)..(1464)

SEQ ID NO: 83316 - protein, 487 aa, Novosphingobium aromaticivorans DSM 12444; identical to SEQ ID NO: 69637

SEQ ID NO: 83317 - DNA, 1470 bp, Novosphingobium aromaticivorans DSM 12444; identical to SEQ ID NO: 69638
  CDS (1)..(1470)

SEQ ID NO: 83318 - protein, 489 aa, Novosphingobium aromaticivorans DSM 12444; identical to SEQ ID NO: 69639

SEQ ID NO: 83319 - DNA, 1470 bp, Ferroplasma acidarmanus; identical to SEQ ID NO: 69640
  CDS (1)..(1470)

SEQ ID NO: 83320 - protein, 489 aa, Ferroplasma acidarmanus; identical to SEQ ID NO: 69641

SEQ ID NO: 83321 - DNA, 1485 bp, Clostridium thermocellum ATCC 27405; identical to SEQ ID NO: 69642
  CDS (1)..(1485)

SEQ ID NO: 83322 - protein, 494 aa, Clostridium thermocellum ATCC 27405; identical to SEQ ID NO: 69643

SEQ ID NO: 83323 - DNA, 1476 bp, Microbulbifer degradans 2-40; identical to SEQ ID NO: 69644
  CDS (1)..(1476)

SEQ ID NO: 83324 - protein, 491 aa, Microbulbifer degradans 2-40; identical to SEQ ID NO: 69645

SEQ ID NO: 83325 - DNA, 1515 bp, Pediococcus pentosaceus ATCC 25745; identical to SEQ ID NO: 69646
  CDS (1)..(1515)

SEQ ID NO: 83326 - protein, 504 aa, Pediococcus pentosaceus ATCC 25745; identical to SEQ ID NO: 69647

SEQ ID NO: 83327 - DNA, 1515 bp, Trichodesmium erythraeum IMS101; identical to SEQ ID NO: 69648
  CDS (1)..(1515)

SEQ ID NO: 83328 - protein, 504 aa, Trichodesmium erythraeum IMS101; identical to SEQ ID NO: 69649

SEQ ID NO: 83329 - DNA, 1485 bp, Silicibacter sp. TM1040; identical to SEQ ID NO: 69650
  CDS (1)..(1485)

SEQ ID NO: 83330 - protein, 494 aa, Silicibacter sp. TM1040; identical to SEQ ID NO: 69651

SEQ ID NO: 83331 - DNA, 1518 bp, Exiguobacterium sp. 255-15; identical to SEQ ID NO: 69652
  CDS (1)..(1518)

SEQ ID NO: 83332 - protein, 505 aa, Exiguobacterium sp. 255-15; identical to SEQ ID NO: 69653

SEQ ID NO: 83333 - DNA, 1491 bp, Exiguobacterium sp. 255-15; identical to SEQ ID NO: 69654
  CDS (1)..(1491)

SEQ ID NO: 83334 - protein, 496 aa, Exiguobacterium sp. 255-15; identical to SEQ ID NO: 69655

SEQ ID NO: 83335 - DNA, 1497 bp, Chloroflexus aurantiacus; identical to SEQ ID NO: 69656
  CDS (1)..(1497)

SEQ ID NO: 83336 - protein, 498 aa, Chloroflexus aurantiacus; identical to SEQ ID NO: 69657

SEQ ID NO: 83337 - DNA, 1494 bp, Polaromonas sp. JS666; identical to SEQ ID NO: 69658
  CDS (1)..(1494)

SEQ ID NO: 83338 - protein, 497 aa, Polaromonas sp. JS666; identical to SEQ ID NO: 69659

SEQ ID NO: 83339 - DNA, 1650 bp, Anopheles gambiae str; identical to SEQ ID NO: 69660
  CDS (1)..(1650)

SEQ ID NO: 83340 - protein, 549 aa, Anopheles gambiae str; identical to SEQ ID NO: 69661

SEQ ID NO: 83341 - DNA, 1554 bp, Gallus gallus; identical to SEQ ID NO: 69662
  CDS (1)..(1554)

SEQ ID NO: 83342 - protein, 517 aa, Gallus gallus; identical to SEQ ID NO: 69663

SEQ ID NO: 83343 - DNA, 1440 bp, Xenopus laevis; identical to SEQ ID NO: 69664
  CDS (1)..(1440)

SEQ ID NO: 83344 - protein, 479 aa, Xenopus laevis; identical to SEQ ID NO: 69665

SEQ ID NO: 83345 - DNA, 1554 bp, Dictyocaulus viviparus; identical to SEQ ID NO: 69666
  CDS (1)..(1554)

SEQ ID NO: 83346 - protein, 517 aa, Dictyocaulus viviparus; identical to SEQ ID NO: 69667

SEQ ID NO: 83347 - DNA, 1596 bp, Pandanus amaryllifolius; identical to SEQ ID NO: 69668
  CDS (1)..(1596)

SEQ ID NO: 83348 - protein, 531 aa, Pandanus amaryllifolius; identical to SEQ ID NO: 69669

SEQ ID NO: 83349 - DNA, 1560 bp, Glycine max; identical to SEQ ID NO: 69670
  CDS (1)..(1560)

SEQ ID NO: 83350 - protein, 519 aa, Glycine max; identical to SEQ ID NO: 69671

SEQ ID NO: 83351 - DNA, 1893 bp, Pichia farinosa; identical to SEQ ID NO: 69672
  CDS (1)..(1893)

SEQ ID NO: 83352 - protein, 630 aa, Pichia farinosa; identical to SEQ ID NO: 69673

SEQ ID NO: 83353 - DNA, 1494 bp, uncultured marine alpha proteobacterium HOT2C01; identical to SEQ ID NO: 69674
  CDS (1)..(1494): transl_table=11

SEQ ID NO: 83354 - protein, 497 aa, uncultured marine alpha proteobacterium HOT2C01; identical to SEQ ID NO: 69675

SEQ ID NO: 83355 - DNA, 1539 bp, Trypanosoma congolense; identical to SEQ ID NO: 69676
  CDS (1)..(1539)

SEQ ID NO: 83356 - protein, 512 aa, Trypanosoma congolense; identical to SEQ ID NO: 69677

SEQ ID NO: 83357 - DNA, 1497 bp, Flavobacterium meningosepticum; identical to SEQ ID NO: 69678
  CDS (1)..(1497)

SEQ ID NO: 83358 - protein, 498 aa, Flavobacterium meningosepticum; identical to SEQ ID NO: 69679

SEQ ID NO: 83359 - DNA, 1692 bp, Xenopus laevis; identical to SEQ ID NO: 69680
  CDS (1)..(1692)

SEQ ID NO: 83360 - protein, 563 aa, Xenopus laevis; identical to SEQ ID NO: 69681

SEQ ID NO: 83361 - DNA, 1509 bp, uncultured bacterium; identical to SEQ ID NO: 69682
  CDS (1)..(1509): transl_table=11

SEQ ID NO: 83362 - protein, 502 aa, uncultured bacterium; identical to SEQ ID NO: 69683

SEQ ID NO: 83363 - DNA, 1488 bp, Borrelia hermsii; identical to SEQ ID NO: 69684
  CDS (1)..(1488): transl_table=11

SEQ ID NO: 83364 - protein, 495 aa, Borrelia hermsii; identical to SEQ ID NO: 69685

SEQ ID NO: 83365 - DNA, 1491 bp, Bacillus subtilis var; identical to SEQ ID NO: 69686
  CDS (1)..(1491): transl_table=11

SEQ ID NO: 83366 - protein, 496 aa, Bacillus subtilis var; identical to SEQ ID NO: 69687

SEQ ID NO: 83367 - DNA, 1518 bp, Lactobacillus rhamnosus; identical to SEQ ID NO: 69688
  CDS (1)..(1518): transl_table=11

SEQ ID NO: 83368 - protein, 505 aa, Lactobacillus rhamnosus; identical to SEQ ID NO: 69689

SEQ ID NO: 83369 - DNA, 1455 bp, Lactobacillus rhamnosus; identical to SEQ ID NO: 69690
  CDS (1)..(1455): transl_table=11

SEQ ID NO: 83370 - protein, 484 aa, Lactobacillus rhamnosus; identical to SEQ ID NO: 69691

SEQ ID NO: 83371 - DNA, 1497 bp, Clostridium tetani; identical to SEQ ID NO: 69692
  CDS (1)..(1497): transl_table=11

SEQ ID NO: 83372 - protein, 498 aa, Clostridium tetani; identical to SEQ ID NO: 69693

SEQ ID NO: 83373 - DNA, 1506 bp, Sulfolobus solfataricus; identical to SEQ ID NO: 69694
  CDS (1)..(1506): transl_table=11

SEQ ID NO: 83374 - protein, 501 aa, Sulfolobus solfataricus; identical to SEQ ID NO: 69695

SEQ ID NO: 83375 - DNA, 1479 bp, Thermotoga maritima; identical to SEQ ID NO: 69696
  CDS (1)..(1479): transl_table=11

SEQ ID NO: 83376 - protein, 492 aa, Thermotoga maritima; identical to SEQ ID NO: 69697

SEQ ID NO: 83377 - DNA, 1482 bp, Clostridium tetani; identical to SEQ ID NO: 69698
  CDS (1)..(1482): transl_table=11

SEQ ID NO: 83378 - protein, 493 aa, Clostridium tetani; identical to SEQ ID NO: 69699

SEQ ID NO: 83379 - DNA, 1500 bp, Sulfolobus solfataricus; identical to SEQ ID NO: 69700
  CDS (1)..(1500): transl_table=11

SEQ ID NO: 83380 - protein, 499 aa, Sulfolobus solfataricus; identical to SEQ ID NO: 69701

SEQ ID NO: 83381 - DNA, 1503 bp, Anabaena sp; identical to SEQ ID NO: 69702
  CDS (1)..(1503)

SEQ ID NO: 83382 - protein, 500 aa, Anabaena sp; identical to SEQ ID NO: 69703

SEQ ID NO: 83383 - DNA, 1479 bp, Aquifex aeolicus; identical to SEQ ID NO: 69704
  CDS (1)..(1479): transl_table=11

SEQ ID NO: 83384 - protein, 492 aa, Aquifex aeolicus; identical to SEQ ID NO: 69705

SEQ ID NO: 83385 - DNA, 1491 bp, Bacillus anthracis; identical to SEQ ID NO: 69706
  CDS (1)..(1491): transl_table=11

SEQ ID NO: 83386 - protein, 496 aa, Bacillus anthracis; identical to SEQ ID NO: 69707

SEQ ID NO: 83387 - DNA, 1491 bp, Bacillus subtilis; identical to SEQ ID NO: 69708
  CDS (1)..(1491): transl_table=11

SEQ ID NO: 83388 - protein, 496 aa, Bacillus subtilis; identical to SEQ ID NO: 69709

SEQ ID NO: 83389 - DNA, 1527 bp, Bordetella bronchiseptica; identical to SEQ ID NO: 69710
  CDS (1)..(1527): transl_table=11

SEQ ID NO: 83390 - protein, 508 aa, Bordetella bronchiseptica; identical to SEQ ID NO: 69711

SEQ ID NO: 83391 - DNA, 1506 bp, Borrelia burgdorferi; identical to SEQ ID NO: 69712
  CDS (1)..(1506): transl_table=11

SEQ ID NO: 83392 - protein, 501 aa, Borrelia burgdorferi; identical to SEQ ID NO: 69713

SEQ ID NO: 83393 - DNA, 1503 bp, Bradyrhizobium japonicum; identical to SEQ ID NO: 69714
  CDS (1)..(1503)

SEQ ID NO: 83394 - protein, 500 aa, Bradyrhizobium japonicum; identical to SEQ ID NO: 69715

SEQ ID NO: 83395 - DNA, 1503 bp, Chromobacterium violaceum; identical to SEQ ID NO: 69716
  CDS (1)..(1503): transl_table=11

SEQ ID NO: 83396 - protein, 500 aa, Chromobacterium violaceum; identical to SEQ ID NO: 69717

SEQ ID NO: 83397 - DNA, 1503 bp, Clostridium perfringens; identical to SEQ ID NO: 69718
  CDS (1)..(1503)

SEQ ID NO: 83398 - protein, 500 aa, Clostridium perfringens; identical to SEQ ID NO: 69719

SEQ ID NO: 83399 - DNA, 1527 bp, Corynebacterium efficiens; identical to SEQ ID NO: 69720
  CDS (1)..(1527)

SEQ ID NO: 83400 - protein, 508 aa, Corynebacterium efficiens; identical to SEQ ID NO: 69721

SEQ ID NO: 83401 - DNA, 1530 bp, Corynebacterium glutamicum; identical to SEQ ID NO: 69722
  CDS (1)..(1530): transl_table=11

SEQ ID NO: 83402 - protein, 509 aa, Corynebacterium glutamicum; identical to SEQ ID NO: 69723

SEQ ID NO: 83403 - DNA, 1506 bp, Coxiella burnetii; identical to SEQ ID NO: 69724
  CDS (1)..(1506): transl_table=11

SEQ ID NO: 83404 - protein, 501 aa, Coxiella burnetii; identical to SEQ ID NO: 69725

SEQ ID NO: 83405 - DNA, 1506 bp, Deinococcus radiodurans; identical to SEQ ID NO: 69726
  CDS (1)..(1506): transl_table=11

SEQ ID NO: 83406 - protein, 501 aa, Deinococcus radiodurans; identical to SEQ ID NO: 69727

SEQ ID NO: 83407 - DNA, 1521 bp, Enterococcus casseliflavus; identical to SEQ ID NO: 69728
  CDS (1)..(1521)

SEQ ID NO: 83408 - protein, 506 aa, Enterococcus casseliflavus; identical to SEQ ID NO: 69729

SEQ ID NO: 83409 - DNA, 1533 bp, Halobacterium sp; identical to SEQ ID NO: 69730
  CDS (1)..(1533): transl_table=11

SEQ ID NO: 83410 - protein, 510 aa, Halobacterium sp; identical to SEQ ID NO: 69731

SEQ ID NO: 83411 - DNA, 1497 bp, Lactococcus lactis; identical to SEQ ID NO: 69732
  CDS (1)..(1497): transl_table=11

SEQ ID NO: 83412 - protein, 498 aa, Lactococcus lactis; identical to SEQ ID NO: 69733

SEQ ID NO: 83413 - DNA, 1494 bp, Listeria innocua; identical to SEQ ID NO: 69734
  CDS (1)..(1494): transl_table=11

SEQ ID NO: 83414 - protein, 497 aa, Listeria innocua; identical to SEQ ID NO: 69735

SEQ ID NO: 83415 - DNA, 1542 bp, Mycoplasma gallisepticum; identical to SEQ ID NO: 69736
  CDS (1)..(1542): transl_table=4

SEQ ID NO: 83416 - protein, 513 aa, Mycoplasma gallisepticum; identical to SEQ ID NO: 69737

SEQ ID NO: 83417 - DNA, 1527 bp, Mycoplasma genitalium; identical to SEQ ID NO: 69738
  CDS (1)..(1527): transl_table=4

SEQ ID NO: 83418 - protein, 508 aa, Mycoplasma genitalium; identical to SEQ ID NO: 69739

SEQ ID NO: 83419 - DNA, 1527 bp, Mycobacterium leprae; identical to SEQ ID NO: 69740
  CDS (1)..(1527): transl_table=11

SEQ ID NO: 83420 - protein, 508 aa, Mycobacterium leprae; identical to SEQ ID NO: 69741

SEQ ID NO: 83421 - DNA, 1524 bp, Mycoplasma pulmonis; identical to SEQ ID NO: 69742
  CDS (1)..(1524): transl_table=4

SEQ ID NO: 83422 - protein, 507 aa, Mycoplasma pulmonis; identical to SEQ ID NO: 69743

SEQ ID NO: 83423 - DNA, 1554 bp, Mycobacterium tuberculosis; identical to SEQ ID NO: 69744
  CDS (1)..(1554): transl_table=11

SEQ ID NO: 83424 - protein, 517 aa, Mycobacterium tuberculosis; identical to SEQ ID NO: 69745

SEQ ID NO: 83425 - DNA, 1503 bp, Oceanobacillus iheyensis; identical to SEQ ID NO: 69746
  CDS (1)..(1503)

SEQ ID NO: 83426 - protein, 500 aa, Oceanobacillus iheyensis; identical to SEQ ID NO: 69747

SEQ ID NO: 83427 - DNA, 1509 bp, Pasteurella multocida; identical to SEQ ID NO: 69748
  CDS (1)..(1509): transl_table=11

SEQ ID NO: 83428 - protein, 502 aa, Pasteurella multocida; identical to SEQ ID NO: 69749

SEQ ID NO: 83429 - DNA, 1506 bp, Pseudomonas syringae; identical to SEQ ID NO: 69750
  CDS (1)..(1506): transl_table=11

SEQ ID NO: 83430 - protein, 501 aa, Pseudomonas syringae; identical to SEQ ID NO: 69751

SEQ ID NO: 83431 - DNA, 1512 bp, Pseudomonas tolaasii; identical to SEQ ID NO: 69752
  CDS (1)..(1512): transl_table=11

SEQ ID NO: 83432 - protein, 503 aa, Pseudomonas tolaasii; identical to SEQ ID NO: 69753

SEQ ID NO: 83433 - DNA, 1485 bp, Pyrococcus abyssi; identical to SEQ ID NO: 69754
  CDS (1)..(1485): transl_table=11

SEQ ID NO: 83434 - protein, 494 aa, Pyrococcus abyssi; identical to SEQ ID NO: 69755

SEQ ID NO: 83435 - DNA, 1473 bp, Pyrococcus furiosus; identical to SEQ ID NO: 69756
  CDS (1)..(1473): transl_table=11

SEQ ID NO: 83436 - protein, 490 aa, Pyrococcus furiosus; identical to SEQ ID NO: 69757

SEQ ID NO: 83437 - DNA, 1494 bp, Pyrococcus kodakaraensis; identical to SEQ ID NO: 69758
  CDS (1)..(1494): transl_table=11

SEQ ID NO: 83438 - protein, 497 aa, Pyrococcus kodakaraensis; identical to SEQ ID NO: 69759

SEQ ID NO: 83439 - DNA, 1494 bp, Rhizobium meliloti; identical to SEQ ID NO: 69760
  CDS (1)..(1494): transl_table=11

SEQ ID NO: 83440 - protein, 497 aa, Rhizobium meliloti; identical to SEQ ID NO: 69761

SEQ ID NO: 83441 - DNA, 1620 bp, Rhodopirellula baltica; identical to SEQ ID NO: 69762
  CDS (1)..(1620): transl_table=11

SEQ ID NO: 83442 - protein, 539 aa, Rhodopirellula baltica; identical to SEQ ID NO: 69763

SEQ ID NO: 83443 - DNA, 1485 bp, Shewanella oneidensis; identical to SEQ ID NO: 69764
  CDS (1)..(1485): transl_table=11

SEQ ID NO: 83444 - protein, 494 aa, Shewanella oneidensis; identical to SEQ ID NO: 69765

SEQ ID NO: 83445 - DNA, 1497 bp, Staphylococcus aureus; identical to SEQ ID NO: 69766
  CDS (1)..(1497): transl_table=11

SEQ ID NO: 83446 - protein, 498 aa, Staphylococcus aureus; identical to SEQ ID NO: 69767

SEQ ID NO: 83447 - DNA, 1509 bp, Streptococcus pneumoniae; identical to SEQ ID NO: 69768
  CDS (1)..(1509): transl_table=11

SEQ ID NO: 83448 - protein, 502 aa, Streptococcus pneumoniae; identical to SEQ ID NO: 69769

SEQ ID NO: 83449 - DNA, 1488 bp, Synechocystis sp; identical to SEQ ID NO: 69770
  CDS (1)..(1488)

SEQ ID NO: 83450 - protein, 495 aa, Synechocystis sp; identical to SEQ ID NO: 69771

SEQ ID NO: 83451 - DNA, 1491 bp, Thermus aquaticus; identical to SEQ ID NO: 69772
  CDS (1)..(1491): transl_table=11

SEQ ID NO: 83452 - protein, 496 aa, Thermus aquaticus; identical to SEQ ID NO: 69773

SEQ ID NO: 83453 - DNA, 1488 bp, Thermus brockianus; identical to SEQ ID NO: 69774
  CDS (1)..(1488): transl_table=11

SEQ ID NO: 83454 - protein, 495 aa, Thermus brockianus; identical to SEQ ID NO: 69775

SEQ ID NO: 83455 - DNA, 1494 bp, Thermoanaerobacter tengcongensis; identical to SEQ ID NO: 69776
  CDS (1)..(1494): transl_table=11

SEQ ID NO: 83456 - protein, 497 aa, Thermoanaerobacter tengcongensis; identical to SEQ ID NO: 69777

SEQ ID NO: 83457 - DNA, 1539 bp, Trypanosoma brucei brucei; identical to SEQ ID NO: 69778
  CDS (1)..(1539)

SEQ ID NO: 83458 - protein, 512 aa, Trypanosoma brucei brucei; identical to SEQ ID NO: 69779

SEQ ID NO: 83459 - DNA, 1518 bp, Vibrio cholerae; identical to SEQ ID NO: 69780
  CDS (1)..(1518): transl_table=11

SEQ ID NO: 83460 - protein, 505 aa, Vibrio cholerae; identical to SEQ ID NO: 69781

SEQ ID NO: 83461 - DNA, 1518 bp, Vibrio parahaemolyticus; identical to SEQ ID NO: 69782
  CDS (1)..(1518)

SEQ ID NO: 83462 - protein, 505 aa, Vibrio parahaemolyticus; identical to SEQ ID NO: 69783

SEQ ID NO: 83463 - DNA, 1500 bp, Xanthomonas campestris; identical to SEQ ID NO: 69784
  CDS (1)..(1500): transl_table=11

SEQ ID NO: 83464 - protein, 499 aa, Xanthomonas campestris; identical to SEQ ID NO: 69785

SEQ ID NO: 83465 - DNA, 2130 bp, Saccharomyces cerevisiae; identical to SEQ ID NO: 69786
  CDS (1)..(2130)

SEQ ID NO: 83466 - protein, 709 aa, Saccharomyces cerevisiae; identical to SEQ ID NO: 69787

SEQ ID NO: 83467 - DNA, 1479 bp, Archaeoglobus fulgidus; identical to SEQ ID NO: 69788
  CDS (1)..(1479): transl_table=11

SEQ ID NO: 83468 - protein, 492 aa, Archaeoglobus fulgidus; identical to SEQ ID NO: 69789

SEQ ID NO: 83469 - DNA, 26 bp, Primer
atgactgaaaaaaaatatatcgttgc

SEQ ID NO: 83470 - DNA, 23 bp, Primer
ttattcgtcgtgttcttcccacg

SEQ ID NO: 83471 - protein, 799 aa, consensus; identical to SEQ ID NO: 69792
  MISC_FEATURE (1)..(799): consensus for the disclosure of xaa see table XV

SEQ ID NO: 83472 - protein, 175 aa, consensus; identical to SEQ ID NO: 69793
  MISC_FEATURE (1)..(175): consensus for the disclosure of xaa see table XV

SEQ ID NO: 83473 - protein, 94 aa, consensus; identical to SEQ ID NO: 69794
  MISC_FEATURE (1)..(94): consensus for the disclosure of xaa see table XV

SEQ ID NO: 83474 - protein, 105 aa, consensus; identical to SEQ ID NO: 69795
  MISC_FEATURE (1)..(105): consensus for the disclosure of xaa see table XV

SEQ ID NO: 83475 - protein, 40 aa, consensus; identical to SEQ ID NO: 69796
  MISC_FEATURE (1)..(40): consensus for the disclosure of xaa see table XV

SEQ ID NO: 83476 - protein, 45 aa, consensus; identical to SEQ ID NO: 69797
  MISC_FEATURE (1)..(45): consensus for the disclosure of xaa see table XV

SEQ ID NO: 83477 - DNA, 318 bp, Escherichia coli K12; identical to SEQ ID NO: 26631
  CDS (1)..(318)

SEQ ID NO: 83478 - protein, 105 aa, Escherichia coli K12; identical to SEQ ID NO: 26632

SEQ ID NO: 83479 - DNA, 318 bp, Salmonella typhimurium; identical to SEQ ID NO: 26633
  CDS (1)..(318)

SEQ ID NO: 83480 - protein, 105 aa, Salmonella typhimurium; identical to SEQ ID NO: 26634

SEQ ID NO: 83481 - DNA, 318 bp, Haemophilus influenzae; identical to SEQ ID NO: 26635
  CDS (1)..(318)

SEQ ID NO: 83482 - protein, 105 aa, Haemophilus influenzae; identical to SEQ ID NO: 26636

SEQ ID NO: 83483 - DNA, 318 bp, Yersinia pestis; identical to SEQ ID NO: 26637
  CDS (1)..(318)

SEQ ID NO: 83484 - protein, 105 aa, Yersinia pestis; identical to SEQ ID NO: 26638

SEQ ID NO: 83485 - DNA, 318 bp, Yersinia pseudotuberculosis IP 32953; identical to SEQ ID NO: 26639
  CDS (1)..(318)

SEQ ID NO: 83486 - protein, 105 aa, Yersinia pseudotuberculosis IP 32953; identical to SEQ ID NO: 26640

SEQ ID NO: 83487 - DNA, 318 bp, Erwinia carotovora; identical to SEQ ID NO: 26641
  CDS (1)..(318)

SEQ ID NO: 83488 - protein, 105 aa, Erwinia carotovora; identical to SEQ ID NO: 26642

SEQ ID NO: 83489 - DNA, 318 bp, Photobacterium profundum; identical to SEQ ID NO: 26643
  CDS (1)..(318)

SEQ ID NO: 83490 - protein, 105 aa, Photobacterium profundum; identical to SEQ ID NO: 26644

SEQ ID NO: 83491 - DNA, 318 bp, Haemophilus ducreyi; identical to SEQ ID NO: 26645
  CDS (1)..(318)

SEQ ID NO: 83492 - protein, 105 aa, Haemophilus ducreyi; identical to SEQ ID NO: 26646

SEQ ID NO: 83493 - DNA, 318 bp, Pasteurella multocida; identical to SEQ ID NO: 26647
  CDS (1)..(318)

SEQ ID NO: 83494 - protein, 105 aa, Pasteurella multocida; identical to SEQ ID NO: 26648

SEQ ID NO: 83495 - DNA, 318 bp, Photorhabdus luminescens; identical to SEQ ID NO: 26649
  CDS (1)..(318)

SEQ ID NO: 83496 - protein, 105 aa, Photorhabdus luminescens; identical to SEQ ID NO: 26650

SEQ ID NO: 83497 - DNA, 315 bp, Shewanella oneidensis; identical to SEQ ID NO: 26651
  CDS (1)..(315)

SEQ ID NO: 83498 - protein, 104 aa, Shewanella oneidensis; identical to SEQ ID NO: 26652

SEQ ID NO: 83499 - DNA, 321 bp, Vibrio parahaemolyticus; identical to SEQ ID NO: 26653
  CDS (1)..(321)

SEQ ID NO: 83500 - protein, 106 aa, Vibrio parahaemolyticus; identical to SEQ ID NO: 26654

SEQ ID NO: 83501 - DNA, 318 bp, Vibrio vulnificus; identical to SEQ ID NO: 26655
  CDS (1)..(318)

SEQ ID NO: 83502 - protein, 105 aa, Vibrio vulnificus; identical to SEQ ID NO: 26656

SEQ ID NO: 83503 - DNA, 20 bp, Primer
atggctgaatggagcggcga

SEQ ID NO: 83504 - DNA, 22 bp, Primer
ttagtattcccacgtctccggg

SEQ ID NO: 83505 - protein, 97 aa, consensus; identical to SEQ ID NO: 27310
  MISC_FEATURE (1)..(97): consensus for the disclosure of xaa see table XV

SEQ ID NO: 83506 - protein, 97 aa, consensus; identical to SEQ ID NO: 27309
  MISC_FEATURE (1)..(97): consensus for the disclosure of xaa see table XV

SEQ ID NO: 83507 - DNA, 429 bp, Escherichia coli; identical to SEQ ID NO: 37675
  CDS (1)..(429)

SEQ ID NO: 83508 - protein, 142 aa, Escherichia coli; identical to SEQ ID NO: 37676

SEQ ID NO: 83509 - DNA, 703 bp, Anopheles gambiae str. PEST; identical to SEQ ID NO: 37677
  CDS (57)..(647)

SEQ ID NO: 83510 - protein, 196 aa, Anopheles gambiae str. PEST; identical to SEQ ID NO: 37678

SEQ ID NO: 83511 - DNA, 498 bp, Thermococcus kodakaraensis; identical to SEQ ID NO: 37679
  CDS (1)..(498)

SEQ ID NO: 83512 - protein, 165 aa, Thermococcus kodakaraensis; identical to SEQ ID NO: 37680

SEQ ID NO: 83513 - DNA, 432 bp, Staphylococcus aureus subsp. aureus COL; identical to SEQ ID NO: 37681
  CDS (1)..(432)

SEQ ID NO: 83514 - protein, 143 aa, Staphylococcus aureus subsp. aureus COL; identical to SEQ ID NO: 37682

SEQ ID NO: 83515 - DNA, 591 bp, Danio rerio; identical to SEQ ID NO: 37683
  CDS (1)..(591)

SEQ ID NO: 83516 - protein, 196 aa, Danio rerio; identical to SEQ ID NO: 37684

SEQ ID NO: 83517 - DNA, 612 bp, Rattus norvegicus; identical to SEQ ID NO: 37685
  CDS (1)..(612)

SEQ ID NO: 83518 - protein, 203 aa, Rattus norvegicus; identical to SEQ ID NO: 37686

SEQ ID NO: 83519 - DNA, 519 bp, Dictyostelium discoideum; identical to SEQ ID NO: 37687
  CDS (1)..(519)

SEQ ID NO: 83520 - protein, 172 aa, Dictyostelium discoideum; identical to SEQ ID NO: 37688

SEQ ID NO: 83521 - DNA, 432 bp, Malawimonas jakobiformis; identical to SEQ ID NO: 37689
  CDS (1)..(432)

SEQ ID NO: 83522 - protein, 143 aa, Malawimonas jakobiformis; identical to SEQ ID NO: 37690

SEQ ID NO: 83523 - DNA, 414 bp, Mycoplasma genitalium G-37; identical to SEQ ID NO: 37691
  CDS (1)..(414): transl_table=4

SEQ ID NO: 83524 - protein, 137 aa, Mycoplasma genitalium G-37; identical to SEQ ID NO: 37692

SEQ ID NO: 83525 - DNA, 468 bp, Arabidopsis thaliana; identical to SEQ ID NO: 37693
  CDS (1)..(468)

SEQ ID NO: 83526 - protein, 155 aa, Arabidopsis thaliana; identical to SEQ ID NO: 37694

SEQ ID NO: 83527 - DNA, 426 bp, Thermotoga maritima MSB8; identical to SEQ ID NO: 37695
  CDS (1)..(426): transl_table=11

SEQ ID NO: 83528 - protein, 141 aa, Thermotoga maritima MSB8; identical to SEQ ID NO: 37696

SEQ ID NO: 83529 - DNA, 492 bp, Halobacterium salinarum NRC-1; identical to SEQ ID NO: 37697
  CDS (1)..(492): transl_table=11

SEQ ID NO: 83530 - protein, 163 aa, Halobacterium salinarum NRC-1; identical to SEQ ID NO: 37698

SEQ ID NO: 83531 - DNA, 654 bp, Mycoplasma pulmonis UAB CTIP; identical to SEQ ID NO: 37699
  CDS (1)..(654): transl_table=4

SEQ ID NO: 83532 - protein, 217 aa, Mycoplasma pulmonis UAB CTIP; identical to SEQ ID NO: 37700

SEQ ID NO: 83533 - DNA, 522 bp, Sulfolobus solfataricus P2; identical to SEQ ID NO: 37701
  CDS (1)..(522): transl_table=11

SEQ ID NO: 83534 - protein, 173 aa, Sulfolobus solfataricus P2; identical to SEQ ID NO: 37702

SEQ ID NO: 83535 - DNA, 426 bp, Bacillus subtilis subsp. subtilis str. 168; identical to SEQ ID NO: 37703
  CDS (1)..(426): transl_table=11

SEQ ID NO: 83536 - protein, 141 aa, Bacillus subtilis subsp. subtilis str. 168; identical to SEQ ID NO: 37704

SEQ ID NO: 83537 - DNA, 459 bp, Thermoplasma acidophilum DSM 1728; identical to SEQ ID NO: 37705
  CDS (1)..(459): transl_table=11

SEQ ID NO: 83538 - protein, 152 aa, Thermoplasma acidophilum DSM 1728; identical to SEQ ID NO: 37706

SEQ ID NO: 83539 - DNA, 435 bp, Schizosaccharomyces pombe; identical to SEQ ID NO: 37707
  CDS (1)..(435)

SEQ ID NO: 83540 - protein, 144 aa, Schizosaccharomyces pombe; identical to SEQ ID NO: 37708

SEQ ID NO: 83541 - DNA, 528 bp, Plasmodium falciparum 3D7; identical to SEQ ID NO: 37709
  CDS (1)..(528)

SEQ ID NO: 83542 - protein, 175 aa, Plasmodium falciparum 3D7; identical to SEQ ID NO: 37710

SEQ ID NO: 83543 - DNA, 546 bp, Homo sapiens; identical to SEQ ID NO: 37711
  CDS (1)..(546)

SEQ ID NO: 83544 - protein, 181 aa, Homo sapiens; identical to SEQ ID NO: 37712

SEQ ID NO: 83545 - DNA, 543 bp, Corynebacterium efficiens YS-314; identical to SEQ ID NO: 37713
  CDS (1)..(543): transl_table=11

SEQ ID NO: 83546 - protein, 180 aa, Corynebacterium efficiens YS-314; identical to SEQ ID NO: 37714

SEQ ID NO: 83547 - DNA, 384 bp, Eimeria tenella; identical to SEQ ID NO: 37715
  CDS (1)..(384): transl_table=11

SEQ ID NO: 83548 - protein, 127 aa, Eimeria tenella; identical to SEQ ID NO: 37716

SEQ ID NO: 83549 - DNA, 468 bp, Oryza sativa (japonica cultivar-group); identical to SEQ ID NO: 37717
  CDS (1)..(468)

SEQ ID NO: 83550 - protein, 155 aa, Oryza sativa (japonica cultivar-group); identical to SEQ ID NO: 37718

SEQ ID NO: 83551 - DNA, 438 bp, Bdellovibrio bacteriovorus HD100; identical to SEQ ID NO: 37719
  CDS (1)..(438): transl_table=11

SEQ ID NO: 83552 - protein, 145 aa, Bdellovibrio bacteriovorus HD100; identical to SEQ ID NO: 37720

SEQ ID NO: 83553 - DNA, 450 bp, Eremothecium gossypii; identical to SEQ ID NO: 37721
  CDS (1)..(450)

SEQ ID NO: 83554 - protein, 149 aa, Eremothecium gossypii; identical to SEQ ID NO: 37722

SEQ ID NO: 83555 - DNA, 477 bp, Neurospora crassa; identical to SEQ ID NO: 37723
  CDS (1)..(477)

SEQ ID NO: 83556 - protein, 158 aa, Neurospora crassa; identical to SEQ ID NO: 37724

SEQ ID NO: 83557 - DNA, 1029 bp, Trypanosoma brucei; identical to SEQ ID NO: 37725
  CDS (1)..(1029)

SEQ ID NO: 83558 - protein, 342 aa, Trypanosoma brucei; identical to SEQ ID NO: 37726

SEQ ID NO: 83559 - DNA, 474 bp, Magnaporthe grisea 70-15; identical to SEQ ID NO: 37727
  CDS (1)..(474)

SEQ ID NO: 83560 - protein, 157 aa, Magnaporthe grisea 70-15; identical to SEQ ID NO: 37728

SEQ ID NO: 83561 - DNA, 471 bp, Gibberella zeae PH-1; identical to SEQ ID NO: 37729
  CDS (1)..(471)

SEQ ID NO: 83562 - protein, 156 aa, Gibberella zeae PH-1; identical to SEQ ID NO: 37730

SEQ ID NO: 83563 - DNA, 462 bp, Aspergillus nidulans FGSC A4; identical to SEQ ID NO: 37731
  CDS (1)..(462)

SEQ ID NO: 83564 - protein, 153 aa, Aspergillus nidulans FGSC A4; identical to SEQ ID NO: 37732

SEQ ID NO: 83565 - DNA, 450 bp, Candida glabrata CBS138; identical to SEQ ID NO: 37733
  CDS (1)..(450)

SEQ ID NO: 83566 - protein, 149 aa, Candida glabrata CBS138; identical to SEQ ID NO: 37734

SEQ ID NO: 83567 - DNA, 450 bp, Kluyveromyces lactis NRRL Y-1140; identical to SEQ ID NO: 37735
  CDS (1)..(450)

SEQ ID NO: 83568 - protein, 149 aa, Kluyveromyces lactis NRRL Y-1140; identical to SEQ ID NO: 37736

SEQ ID NO: 83569 - DNA, 432 bp, Debaryomyces hansenii CBS767; identical to SEQ ID NO: 37737
  CDS (1)..(432)

SEQ ID NO: 83570 - protein, 143 aa, Debaryomyces hansenii CBS767; identical to SEQ ID NO: 37738

SEQ ID NO: 83571 - DNA, 666 bp, Oryza sativa (japonica cultivar-group); identical to SEQ ID NO: 37739
  CDS (1)..(666)

SEQ ID NO: 83572 - protein, 221 aa, Oryza sativa (japonica cultivar-group); identical to SEQ ID NO: 37740

SEQ ID NO: 83573 - DNA, 459 bp, Yarrowia lipolytica CLIB99; identical to SEQ ID NO: 37741
  CDS (1)..(459)

SEQ ID NO: 83574 - protein, 152 aa, Yarrowia lipolytica CLIB99; identical to SEQ ID NO: 37742

SEQ ID NO: 83575 - DNA, 426 bp, Gracilaria tenuistipitata var. liui; identical to SEQ ID NO: 37743
  CDS (1)..(426): transl_table=11

SEQ ID NO: 83576 - protein, 141 aa, Gracilaria tenuistipitata var. liui; identical to SEQ ID NO: 37744

SEQ ID NO: 83577 - DNA, 405 bp, Bacillus cereus ZK; identical to SEQ ID NO: 37745
  CDS (1)..(405): transl_table=11

SEQ ID NO: 83578 - protein, 134 aa, Bacillus cereus ZK; identical to SEQ ID NO: 37746

SEQ ID NO: 83579 - DNA, 426 bp, Bacillus licheniformis ATCC 14580; identical to SEQ ID NO: 37747
  CDS (1)..(426): transl_table=11

SEQ ID NO: 83580 - protein, 141 aa, Bacillus licheniformis ATCC 14580; identical to SEQ ID NO: 37748

SEQ ID NO: 83581 - DNA, 435 bp, Legionella pneumophila subsp. pneumophila str. Philadelphia 1; identical to SEQ ID NO: 37749
  CDS (1)..(435): transl_table=11

SEQ ID NO: 83582 - protein, 144 aa, Legionella pneumophila subsp. pneumophila str. Philadelphia 1; identical to SEQ ID NO: 37750

SEQ ID NO: 83583 - DNA, 432 bp, Methylococcus capsulatus str. Bath; identical to SEQ ID NO: 37751
  CDS (1)..(432): transl_table=11

SEQ ID NO: 83584 - protein, 143 aa, Methylococcus capsulatus str. Bath; identical to SEQ ID NO: 37752

SEQ ID NO: 83585 - DNA, 450 bp, Mycoplasma hyopneumoniae 232; identical to SEQ ID NO: 37753
  CDS (1)..(450): transl_table=4

SEQ ID NO: 83586 - protein, 149 aa, Mycoplasma hyopneumoniae 232; identical to SEQ ID NO: 37754

SEQ ID NO: 83587 - DNA, 435 bp, Nocardia farcinica IFM 10152; identical to SEQ ID NO: 37755
  CDS (1)..(435): transl_table=11

SEQ ID NO: 83588 - protein, 144 aa, Nocardia farcinica IFM 10152; identical to SEQ ID NO: 37756

SEQ ID NO: 83589 - DNA, 489 bp, Haloarcula marismortui ATCC 43049; identical to SEQ ID NO: 37757
  CDS (1)..(489): transl_table=11

SEQ ID NO: 83590 - protein, 162 aa, Haloarcula marismortui ATCC 43049; identical to SEQ ID NO: 37758

SEQ ID NO: 83591 - DNA, 426 bp, Geobacillus kaustophilus HTA426; identical to SEQ ID NO: 37759
  CDS (1)..(426): transl_table=11

SEQ ID NO: 83592 - protein, 141 aa, Geobacillus kaustophilus HTA426; identical to SEQ ID NO: 37760

SEQ ID NO: 83593 - DNA, 444 bp, Anaplasma marginale str. St. Maries; identical to SEQ ID NO: 37761
  CDS (1)..(444): transl_table=11

SEQ ID NO: 83594 - protein, 147 aa, Anaplasma marginale str. St. Maries; identical to SEQ ID NO: 37762

SEQ ID NO: 83595 - DNA, 429 bp, Idiomarina loihiensis L2TR; identical to SEQ ID NO: 37763
  CDS (1)..(429): transl_table=11

SEQ ID NO: 83596 - protein, 142 aa, Idiomarina loihiensis L2TR; identical to SEQ ID NO: 37764

SEQ ID NO: 83597 - DNA, 432 bp, Azoarcus sp. EbN1; identical to SEQ ID NO: 37765
  CDS (1)..(432): transl_table=11

SEQ ID NO: 83598 - protein, 143 aa, Azoarcus sp. EbN1; identical to SEQ ID NO: 37766

SEQ ID NO: 83599 - DNA, 432 bp, Zymomonas mobilis subsp. mobilis ZM4; identical to SEQ ID NO: 37767
  CDS (1)..(432): transl_table=11

SEQ ID NO: 83600 - protein, 143 aa, Zymomonas mobilis subsp. mobilis ZM4; identical to SEQ ID NO: 37768

SEQ ID NO: 83601 - DNA, 426 bp, Silicibacter pomeroyi DSS-3; identical to SEQ ID NO: 37769
  CDS (1)..(426): transl_table=11

SEQ ID NO: 83602 - protein, 141 aa, Silicibacter pomeroyi DSS-3; identical to SEQ ID NO: 37770

SEQ ID NO: 83603 - DNA, 435 bp, Francisella tularensis subsp. tularensis Schu 4; identical to SEQ ID NO: 37771
  CDS (1)..(435): transl_table=11

SEQ ID NO: 83604 - protein, 144 aa, Francisella tularensis subsp. tularensis Schu 4; identical to SEQ ID NO: 37772

SEQ ID NO: 83605 - DNA, 426 bp, Synechococcus elongatus PCC 6301; identical to SEQ ID NO: 37773
  CDS (1)..(426): transl_table=11

SEQ ID NO: 83606 - protein, 141 aa, Synechococcus elongatus PCC 6301; identical to SEQ ID NO: 37774

SEQ ID NO: 83607 - DNA, 426 bp, Bacillus clausii KSM-K16; identical to SEQ ID NO: 37775
  CDS (1)..(426): transl_table=11

SEQ ID NO: 83608 - protein, 141 aa, Bacillus clausii KSM-K16; identical to SEQ ID NO: 37776

SEQ ID NO: 83609 - DNA, 444 bp, Ehrlichia ruminantium str. Welgevonden; identical to SEQ ID NO: 37777
  CDS (1)..(444): transl_table=11

SEQ ID NO: 83610 - protein, 147 aa, Ehrlichia ruminantium str. Welgevonden; identical to SEQ ID NO: 37778

SEQ ID NO: 83611 - DNA, 423 bp, Dehalococcoides ethenogenes 195; identical to SEQ ID NO: 37779
  CDS (1)..(423): transl_table=11

SEQ ID NO: 83612 - protein, 140 aa, Dehalococcoides ethenogenes 195; identical to SEQ ID NO: 37780

SEQ ID NO: 83613 - DNA, 453 bp, Rhodobacter sphaeroides 2.4.1; identical to SEQ ID NO: 37781
  CDS (1)..(453)

SEQ ID NO: 83614 - protein, 150 aa, Rhodobacter sphaeroides 2.4.1; identical to SEQ ID NO: 37782

SEQ ID NO: 83615 - DNA, 426 bp, Lactobacillus gasseri; identical to SEQ ID NO: 37783
  CDS (1)..(426)

SEQ ID NO: 83616 - protein, 141 aa, Lactobacillus gasseri; identical to SEQ ID NO: 37784

SEQ ID NO: 83617 - DNA, 432 bp, Azotobacter vinelandii; identical to SEQ ID NO: 37785
  CDS (1)..(432)

SEQ ID NO: 83618 - protein, 143 aa, Azotobacter vinelandii; identical to SEQ ID NO: 37786

SEQ ID NO: 83619 - DNA, 447 bp, Desulfovibrio desulfuricans G20; identical to SEQ ID NO: 37787
  CDS (1)..(447)

SEQ ID NO: 83620 - protein, 148 aa, Desulfovibrio desulfuricans G20; identical to SEQ ID NO: 37788

SEQ ID NO: 83621 - DNA, 426 bp, Fusobacterium nucleatum subsp. vincentii ATCC 49256; identical to SEQ ID NO: 37789
  CDS (1)..(426): transl_table=11

SEQ ID NO: 83622 - protein, 141 aa, Fusobacterium nucleatum subsp. vincentii ATCC 49256; identical to SEQ ID NO: 37790

SEQ ID NO: 83623 - DNA, 486 bp, Methanococcoides burtonii DSM 6242; identical to SEQ ID NO: 37791
  CDS (1)..(486)

SEQ ID NO: 83624 - protein, 161 aa, Methanococcoides burtonii DSM 6242; identical to SEQ ID NO: 37792

SEQ ID NO: 83625 - DNA, 432 bp, Dechloromonas aromatica RCB; identical to SEQ ID NO: 37793
  CDS (1)..(432)

SEQ ID NO: 83626 - protein, 143 aa, Dechloromonas aromatica RCB; identical to SEQ ID NO: 37794

SEQ ID NO: 83627 - DNA, 429 bp, Haemophilus influenzae R2866; identical to SEQ ID NO: 37795
  CDS (1)..(429)

SEQ ID NO: 83628 - protein, 142 aa, Haemophilus influenzae R2866; identical to SEQ ID NO: 37796

SEQ ID NO: 83629 - DNA, 426 bp, Synechococcus elongatus PCC 7942; identical to SEQ ID NO: 37797
  CDS (1)..(426)

SEQ ID NO: 83630 - protein, 141 aa, Synechococcus elongatus PCC 7942; identical to SEQ ID NO: 37798

SEQ ID NO: 83631 - DNA, 327 bp, Methylobacillus flagellatus KT; identical to SEQ ID NO: 37799
  CDS (1)..(327)

SEQ ID NO: 83632 - protein, 108 aa, Methylobacillus flagellatus KT; identical to SEQ ID NO: 37800

SEQ ID NO: 83633 - DNA, 429 bp, Mesorhizobium sp. BNC1; identical to SEQ ID NO: 37801
  CDS (1)..(429)

SEQ ID NO: 83634 - protein, 142 aa, Mesorhizobium sp. BNC1; identical to SEQ ID NO: 37802

SEQ ID NO: 83635 - DNA, 438 bp, Rubrobacter xylanophilus DSM 9941; identical to SEQ ID NO: 37803
  CDS (1)..(438)

SEQ ID NO: 83636 - protein, 145 aa, Rubrobacter xylanophilus DSM 9941; identical to SEQ ID NO: 37804

SEQ ID NO: 83637 - DNA, 432 bp, Psychrobacter sp. 273-4; identical to SEQ ID NO: 37805
  CDS (1)..(432)

SEQ ID NO: 83638 - protein, 143 aa, Psychrobacter sp. 273-4; identical to SEQ ID NO: 37806

SEQ ID NO: 83639 - DNA, 432 bp, Rubrivivax gelatinosus PM1; identical to SEQ ID NO: 37807
  CDS (1)..(432)

SEQ ID NO: 83640 - protein, 143 aa, Rubrivivax gelatinosus PM1; identical to SEQ ID NO: 37808

SEQ ID NO: 83641 - DNA, 429 bp, Rhodospirillum rubrum; identical to SEQ ID NO: 37809
  CDS (1)..(429)

SEQ ID NO: 83642 - protein, 142 aa, Rhodospirillum rubrum; identical to SEQ ID NO: 37810

SEQ ID NO: 83643 - DNA, 432 bp, Ralstonia metallidurans CH34; identical to SEQ ID NO: 37811
  CDS (1)..(432)

SEQ ID NO: 83644 - protein, 143 aa, Ralstonia metallidurans CH34; identical to SEQ ID NO: 37812

SEQ ID NO: 83645 - DNA, 429 bp, Magnetococcus sp. MC-1; identical to SEQ ID NO: 37813
  CDS (1)..(429)

SEQ ID NO: 83646 - protein, 142 aa, Magnetococcus sp. MC-1; identical to SEQ ID NO: 37814

SEQ ID NO: 83647 - DNA, 486 bp, Methanosarcina barkeri str. fusaro; identical to SEQ ID NO: 37815
  CDS (1)..(486)

SEQ ID NO: 83648 - protein, 161 aa, Methanosarcina barkeri str. fusaro; identical to SEQ ID NO: 37816

SEQ ID NO: 83649 - DNA, 423 bp, Geobacter metallireducens GS-15; identical to SEQ ID NO: 37817
  CDS (1)..(423)

SEQ ID NO: 83650 - protein, 140 aa, Geobacter metallireducens GS-15; identical to SEQ ID NO: 37818

SEQ ID NO: 83651 - DNA, 432 bp, Novosphingobium aromaticivorans DSM 12444; identical to SEQ ID NO: 37819
  CDS (1)..(432)

SEQ ID NO: 83652 - protein, 143 aa, Novosphingobium aromaticivorans DSM 12444; identical to SEQ ID NO: 37820

SEQ ID NO: 83653 - DNA, 477 bp, Ferroplasma acidarmanus; identical to SEQ ID NO: 37821
  CDS (1)..(477)

SEQ ID NO: 83654 - protein, 158 aa, Ferroplasma acidarmanus; identical to SEQ ID NO: 37822

SEQ ID NO: 83655 - DNA, 444 bp, Cytophaga hutchinsonii; identical to SEQ ID NO: 37823
  CDS (1)..(444)

SEQ ID NO: 83656 - protein, 147 aa, Cytophaga hutchinsonii; identical to SEQ ID NO: 37824

SEQ ID NO: 83657 - DNA, 426 bp, Clostridium thermocellum ATCC 27405; identical to SEQ ID NO: 37825
  CDS (1)..(426)

SEQ ID NO: 83658 - protein, 141 aa, Clostridium thermocellum ATCC 27405; identical to SEQ ID NO: 37826

SEQ ID NO: 83659 - DNA, 432 bp, Microbulbifer degradans 2-40; identical to SEQ ID NO: 37827
  CDS (1)..(432)

SEQ ID NO: 83660 - protein, 143 aa, Microbulbifer degradans 2-40; identical to SEQ ID NO: 37828

SEQ ID NO: 83661 - DNA, 609 bp, Oenococcus oeni PSU-1; identical to SEQ ID NO: 37829
  CDS (1)..(609)

SEQ ID NO: 83662 - protein, 202 aa, Oenococcus oeni PSU-1; identical to SEQ ID NO: 37830

SEQ ID NO: 83663 - DNA, 426 bp, Trichodesmium erythraeum IMS101; identical to SEQ ID NO: 37831
  CDS (1)..(426)

SEQ ID NO: 83664 - protein, 141 aa, Trichodesmium erythraeum IMS101; identical to SEQ ID NO: 37832

SEQ ID NO: 83665 - DNA, 426 bp, Moorella thermoacetica ATCC 39073; identical to SEQ ID NO: 37833
  CDS (1)..(426)

SEQ ID NO: 83666 - protein, 141 aa, Moorella thermoacetica ATCC 39073; identical to SEQ ID NO: 37834

SEQ ID NO: 83667 - DNA, 426 bp, Streptococcus suis 89/1591; identical to SEQ ID NO: 37835
  CDS (1)..(426)

SEQ ID NO: 83668 - protein, 141 aa, Streptococcus suis 89/1591; identical to SEQ ID NO: 37836

SEQ ID NO: 83669 - DNA, 432 bp, Thiobacillus denitrificans ATCC 25259; identical to SEQ ID NO: 37837
  CDS (1)..(432)

SEQ ID NO: 83670 - protein, 143 aa, Thiobacillus denitrificans ATCC 25259; identical to SEQ ID NO: 37838

SEQ ID NO: 83671 - DNA, 402 bp, Silicibacter sp. TM1040; identical to SEQ ID NO: 37839
  CDS (1)..(402)

SEQ ID NO: 83672 - protein, 133 aa, Silicibacter sp. TM1040; identical to SEQ ID NO: 37840

SEQ ID NO: 83673 - DNA, 438 bp, Rickettsia akari str. Hartford; identical to SEQ ID NO: 37841
  CDS (1)..(438)

SEQ ID NO: 83674 - protein, 145 aa, Rickettsia akari str. Hartford; identical to SEQ ID NO: 37842

SEQ ID NO: 83675 - DNA, 426 bp, Nostoc punctiforme PCC 73102; identical to SEQ ID NO: 37843
  CDS (1)..(426)

SEQ ID NO: 83676 - protein, 141 aa, Nostoc punctiforme PCC 73102; identical to SEQ ID NO: 37844

SEQ ID NO: 83677 - DNA, 456 bp, Polaromonas sp. JS666; identical to SEQ ID NO: 37845
  CDS (1)..(456)

SEQ ID NO: 83678 - protein, 151 aa, Polaromonas sp. JS666; identical to SEQ ID NO: 37846

SEQ ID NO: 83679 - DNA, 426 bp, Campylobacter lari RM2100; identical to SEQ ID NO: 37847
  CDS (1)..(426): transl_table=11

SEQ ID NO: 83680 - protein, 141 aa, Campylobacter lari RM2100; identical to SEQ ID NO: 37848

SEQ ID NO: 83681 - DNA, 579 bp, Xenopus laevis; identical to SEQ ID NO: 37849
  CDS (1)..(579)

SEQ ID NO: 83682 - protein, 192 aa, Xenopus laevis; identical to SEQ ID NO: 37850

SEQ ID NO: 83683 - DNA, 429 bp, uncultured marine gamma proteobacterium EBAC20E09; identical to SEQ ID NO: 37851
  CDS (1)..(429): transl_table=11

SEQ ID NO: 83684 - protein, 142 aa, uncultured marine gamma proteobacterium EBAC20E09; identical to SEQ ID NO: 37852

SEQ ID NO: 83685 - DNA, 429 bp, uncultured bacterium 562; identical to SEQ ID NO: 37853
  CDS (1)..(429): transl_table=11

SEQ ID NO: 83686 - protein, 142 aa, uncultured bacterium 562; identical to SEQ ID NO: 37854

SEQ ID NO: 83687 - DNA, 429 bp, uncultured marine alpha proteobacterium HOT2C01; identical to SEQ ID NO: 37855
  CDS (1)..(429): transl_table=11

SEQ ID NO: 83688 - protein, 142 aa, uncultured marine alpha proteobacterium HOT2C01; identical to SEQ ID NO: 37856

SEQ ID NO: 83689 - DNA, 708 bp, Chlorarachnion sp; identical to SEQ ID NO: 37857
  CDS (1)..(708)

SEQ ID NO: 83690 - protein, 235 aa, Chlorarachnion sp; identical to SEQ ID NO: 37858

SEQ ID NO: 83691 - DNA, 474 bp, Schistosoma japonicum; identical to SEQ ID NO: 37859
  CDS (1)..(474)

SEQ ID NO: 83692 - protein, 157 aa, Schistosoma japonicum; identical to SEQ ID NO: 37860

SEQ ID NO: 83693 - DNA, 558 bp, Echinococcus multilocularis; identical to SEQ ID NO: 37861
  CDS (1)..(558)

SEQ ID NO: 83694 - protein, 185 aa, Echinococcus multilocularis; identical to SEQ ID NO: 37862

SEQ ID NO: 83695 - DNA, 417 bp, Candidatus Tremblaya princeps; identical to SEQ ID NO: 37863
  CDS (1)..(417): transl_table=11

SEQ ID NO: 83696 - protein, 138 aa, Candidatus Tremblaya princeps; identical to SEQ ID NO: 37864

SEQ ID NO: 83697 - DNA, 465 bp, Triticum aestivum; identical to SEQ ID NO: 37865
  CDS (1)..(465)

SEQ ID NO: 83698 - protein, 154 aa, Triticum aestivum; identical to SEQ ID NO: 37866

SEQ ID NO: 83699 - DNA, 423 bp, Staphylococcus aureus; identical to SEQ ID NO: 37867
  CDS (1)..(423): transl_table=11

SEQ ID NO: 83700 - protein, 140 aa, Staphylococcus aureus; identical to SEQ ID NO: 37868

SEQ ID NO: 83701 - DNA, 429 bp, Carsonella ruddii; identical to SEQ ID NO: 37869
  CDS (1)..(429): transl_table=11

SEQ ID NO: 83702 - protein, 142 aa, Carsonella ruddii; identical to SEQ ID NO: 37870

SEQ ID NO: 83703 - DNA, 633 bp, Oryza sativa; identical to SEQ ID NO: 37871
  CDS (1)..(633)

SEQ ID NO: 83704 - protein, 210 aa, Oryza sativa; identical to SEQ ID NO: 37872

SEQ ID NO: 83705 - DNA, 669 bp, Arabidopsis thaliana; identical to SEQ ID NO: 37873
  CDS (1)..(669)

SEQ ID NO: 83706 - protein, 222 aa, Arabidopsis thaliana; identical to SEQ ID NO: 37874

SEQ ID NO: 83707 - DNA, 669 bp, Arabidopsis thaliana; identical to SEQ ID NO: 37875
  CDS (1)..(669)

SEQ ID NO: 83708 - protein, 222 aa, Arabidopsis thaliana; identical to SEQ ID NO: 37876

SEQ ID NO: 83709 - DNA, 426 bp, Cyanidium caldarium; identical to SEQ ID NO: 37877
  CDS (1)..(426): transl_table=11

SEQ ID NO: 83710 - protein, 141 aa, Cyanidium caldarium; identical to SEQ ID NO: 37878

SEQ ID NO: 83711 - DNA, 417 bp, Cyanidioschyzon merolae; identical to SEQ ID NO: 37879
  CDS (1)..(417): transl_table=11

SEQ ID NO: 83712 - protein, 138 aa, Cyanidioschyzon merolae; identical to SEQ ID NO: 37880

SEQ ID NO: 83713 - DNA, 426 bp, Cyanophora paradoxa; identical to SEQ ID NO: 37881
  CDS (1)..(426)

SEQ ID NO: 83714 - protein, 141 aa, Cyanophora paradoxa; identical to SEQ ID NO: 37882

SEQ ID NO: 83715 - DNA, 426 bp, Guillardia theta; identical to SEQ ID NO: 37883
  CDS (1)..(426)

SEQ ID NO: 83716 - protein, 141 aa, Guillardia theta; identical to SEQ ID NO: 37884

SEQ ID NO: 83717 - DNA, 426 bp, Odontella sinensis; identical to SEQ ID NO: 37885
  CDS (1)..(426): transl_table=11

SEQ ID NO: 83718 - protein, 141 aa, Odontella sinensis; identical to SEQ ID NO: 37886

SEQ ID NO: 83719 - DNA, 426 bp, Porphyra purpurea; identical to SEQ ID NO: 37887
  CDS (1)..(426)

SEQ ID NO: 83720 - protein, 141 aa, Porphyra purpurea; identical to SEQ ID NO: 37888

SEQ ID NO: 83721 - DNA, 675 bp, Spinacia oleracea; identical to SEQ ID NO: 37889
  CDS (1)..(675)

SEQ ID NO: 83722 - protein, 224 aa, Spinacia oleracea; identical to SEQ ID NO: 37890

SEQ ID NO: 83723 - DNA, 429 bp, Acinetobacter sp; identical to SEQ ID NO: 37891
  CDS (1)..(429): transl_table=11

SEQ ID NO: 83724 - protein, 142 aa, Acinetobacter sp; identical to SEQ ID NO: 37892

SEQ ID NO: 83725 - DNA, 432 bp, Agrobacterium tumefaciens; identical to SEQ ID NO: 37893
  CDS (1)..(432): transl_table=11

SEQ ID NO: 83726 - protein, 143 aa, Agrobacterium tumefaciens; identical to SEQ ID NO: 37894

SEQ ID NO: 83727 - DNA, 426 bp, Anabaena sp; identical to SEQ ID NO: 37895
  CDS (1)..(426)

SEQ ID NO: 83728 - protein, 141 aa, Anabaena sp; identical to SEQ ID NO: 37896

SEQ ID NO: 83729 - DNA, 438 bp, Aquifex aeolicus; identical to SEQ ID NO: 37897
  CDS (1)..(438): transl_table=11

SEQ ID NO: 83730 - protein, 145 aa, Aquifex aeolicus; identical to SEQ ID NO: 37898

SEQ ID NO: 83731 - DNA, 474 bp, Archaeoglobus fulgidus; identical to SEQ ID NO: 37899
  CDS (1)..(474): transl_table=11

SEQ ID NO: 83732 - protein, 157 aa, Archaeoglobus fulgidus; identical to SEQ ID NO: 37900

SEQ ID NO: 83733 - DNA, 444 bp, Bacteroides fragilis; identical to SEQ ID NO: 37901
  CDS (1)..(444): transl_table=11

SEQ ID NO: 83734 - protein, 147 aa, Bacteroides fragilis; identical to SEQ ID NO: 37902

SEQ ID NO: 83735 - DNA, 429 bp, Bartonella henselae; identical to SEQ ID NO: 37903
  CDS (1)..(429): transl_table=11

SEQ ID NO: 83736 - protein, 142 aa, Bartonella henselae; identical to SEQ ID NO: 37904

SEQ ID NO: 83737 - DNA, 429 bp, Bartonella quintana; identical to SEQ ID NO: 37905
  CDS (1)..(429): transl_table=11

SEQ ID NO: 83738 - protein, 142 aa, Bartonella quintana; identical to SEQ ID NO: 37906

SEQ ID NO: 83739 - DNA, 432 bp, Bifidobacterium longum; identical to SEQ ID NO: 37907
  CDS (1)..(432): transl_table=11

SEQ ID NO: 83740 - protein, 143 aa, Bifidobacterium longum; identical to SEQ ID NO: 37908

SEQ ID NO: 83741 - DNA, 432 bp, Bordetella bronchiseptica; identical to SEQ ID NO: 37909
  CDS (1)..(432): transl_table=11

SEQ ID NO: 83742 - protein, 143 aa, Bordetella bronchiseptica; identical to SEQ ID NO: 37910

SEQ ID NO: 83743 - DNA, 429 bp, Bradyrhizobium japonicum; identical to SEQ ID NO: 37911
  CDS (1)..(429)

SEQ ID NO: 83744 - protein, 142 aa, Bradyrhizobium japonicum; identical to SEQ ID NO: 37912

SEQ ID NO: 83745 - DNA, 429 bp, Brucella melitensis; identical to SEQ ID NO: 37913
  CDS (1)..(429): transl_table=11

SEQ ID NO: 83746 - protein, 142 aa, Brucella melitensis; identical to SEQ ID NO: 37914

SEQ ID NO: 83747 - DNA, 429 bp, Buchnera aphidicola; identical to SEQ ID NO: 37915
  CDS (1)..(429): transl_table=11

SEQ ID NO: 83748 - protein, 142 aa, Buchnera aphidicola; identical to SEQ ID NO: 37916

SEQ ID NO: 83749 - DNA, 441 bp, Buchnera aphidicola; identical to SEQ ID NO: 37917
  CDS (1)..(441): transl_table=11

SEQ ID NO: 83750 - protein, 146 aa, Buchnera aphidicola; identical to SEQ ID NO: 37918

SEQ ID NO: 83751 - DNA, 432 bp, Burkholderia mallei; identical to SEQ ID NO: 37919
  CDS (1)..(432): transl_table=11

SEQ ID NO: 83752 - protein, 143 aa, Burkholderia mallei; identical to SEQ ID NO: 37920

SEQ ID NO: 83753 - DNA, 426 bp, Campylobacter jejuni; identical to SEQ ID NO: 37921
  CDS (1)..(426): transl_table=11

SEQ ID NO: 83754 - protein, 141 aa, Campylobacter jejuni; identical to SEQ ID NO: 37922

SEQ ID NO: 83755 - DNA, 441 bp, Candidatus Blochmannia floridanus; identical to SEQ ID NO: 37923
  CDS (1)..(441): transl_table=11

SEQ ID NO: 83756 - protein, 146 aa, Candidatus Blochmannia floridanus; identical to SEQ ID NO: 37924

SEQ ID NO: 83757 - DNA, 432 bp, Caulobacter crescentus; identical to SEQ ID NO: 37925
  CDS (1)..(432): transl_table=11

SEQ ID NO: 83758 - protein, 143 aa, Caulobacter crescentus; identical to SEQ ID NO: 37926

SEQ ID NO: 83759 - DNA, 426 bp, Chlamydophila caviae; identical to SEQ ID NO: 37927
  CDS (1)..(426): transl_table=11

SEQ ID NO: 83760 - protein, 141 aa, Chlamydophila caviae; identical to SEQ ID NO: 37928

SEQ ID NO: 83761 - DNA, 426 bp, Chlamydia muridarum; identical to SEQ ID NO: 37929
  CDS (1)..(426): transl_table=11

SEQ ID NO: 83762 - protein, 141 aa, Chlamydia muridarum; identical to SEQ ID NO: 37930

SEQ ID NO: 83763 - DNA, 426 bp, Chlamydia pneumoniae; identical to SEQ ID NO: 37931
  CDS (1)..(426): transl_table=11

SEQ ID NO: 83764 - protein, 141 aa, Chlamydia pneumoniae; identical to SEQ ID NO: 37932

SEQ ID NO: 83765 - DNA, 426 bp, Chlorobium tepidum; identical to SEQ ID NO: 37933
  CDS (1)..(426): transl_table=11

SEQ ID NO: 83766 - protein, 141 aa, Chlorobium tepidum; identical to SEQ ID NO: 37934

SEQ ID NO: 83767 - DNA, 432 bp, Chromobacterium violaceum; identical to SEQ ID NO: 37935
  CDS (1)..(432): transl_table=11

SEQ ID NO: 83768 - protein, 143 aa, Chromobacterium violaceum; identical to SEQ ID NO: 37936

SEQ ID NO: 83769 - DNA, 426 bp, Clostridium acetobutylicum; identical to SEQ ID NO: 37937
  CDS (1)..(426): transl_table=11

SEQ ID NO: 83770 - protein, 141 aa, Clostridium acetobutylicum; identical to SEQ ID NO: 37938

SEQ ID NO: 83771 - DNA, 426 bp, Clostridium perfringens; identical to SEQ ID NO: 37939
  CDS (1)..(426)

SEQ ID NO: 83772 - protein, 141 aa, Clostridium perfringens; identical to SEQ ID NO: 37940

SEQ ID NO: 83773 - DNA, 426 bp, Clostridium tetani; identical to SEQ ID NO: 37941
  CDS (1)..(426): transl_table=11

SEQ ID NO: 83774 - protein, 141 aa, Clostridium tetani; identical to SEQ ID NO: 37942

SEQ ID NO: 83775 - DNA, 429 bp, Corynebacterium diphtheriae; identical to SEQ ID NO: 37943
  CDS (1)..(429): transl_table=11

SEQ ID NO: 83776 - protein, 142 aa, Corynebacterium diphtheriae; identical to SEQ ID NO: 37944

SEQ ID NO: 83777 - DNA, 438 bp, Corynebacterium glutamicum; identical to SEQ ID NO: 37945
  CDS (1)..(438): transl_table=11

SEQ ID NO: 83778 - protein, 145 aa, Corynebacterium glutamicum; identical to SEQ ID NO: 37946

SEQ ID NO: 83779 - DNA, 438 bp, Coxiella burnetii; identical to SEQ ID NO: 37947
  CDS (1)..(438): transl_table=11

SEQ ID NO: 83780 - protein, 145 aa, Coxiella burnetii; identical to SEQ ID NO: 37948

SEQ ID NO: 83781 - DNA, 435 bp, Deinococcus radiodurans; identical to SEQ ID NO: 37949
  CDS (1)..(435): transl_table=11

SEQ ID NO: 83782 - protein, 144 aa, Deinococcus radiodurans; identical to SEQ ID NO: 37950

SEQ ID NO: 83783 - DNA, 426 bp, Desulfotalea psychrophila; identical to SEQ ID NO: 37951
  CDS (1)..(426): transl_table=11

SEQ ID NO: 83784 - protein, 141 aa, Desulfotalea psychrophila; identical to SEQ ID NO: 37952

SEQ ID NO: 83785 - DNA, 423 bp, Enterococcus faecalis; identical to SEQ ID NO: 37953
  CDS (1)..(423): transl_table=11

SEQ ID NO: 83786 - protein, 140 aa, Enterococcus faecalis; identical to SEQ ID NO: 37954

SEQ ID NO: 83787 - DNA, 429 bp, Erwinia carotovora; identical to SEQ ID NO: 37955
  CDS (1)..(429): transl_table=11

SEQ ID NO: 83788 - protein, 142 aa, Erwinia carotovora; identical to SEQ ID NO: 37956

SEQ ID NO: 83789 - DNA, 426 bp, Fusobacterium nucleatum; identical to SEQ ID NO: 37957
  CDS (1)..(426): transl_table=11

SEQ ID NO: 83790 - protein, 141 aa, Fusobacterium nucleatum; identical to SEQ ID NO: 37958

SEQ ID NO: 83791 - DNA, 426 bp, Geobacter sulfurreducens; identical to SEQ ID NO: 37959
  CDS (1)..(426): transl_table=11

SEQ ID NO: 83792 - protein, 141 aa, Geobacter sulfurreducens; identical to SEQ ID NO: 37960

SEQ ID NO: 83793 - DNA, 426 bp, Gloeobacter violaceus; identical to SEQ ID NO: 37961
  CDS (1)..(426)

SEQ ID NO: 83794 - protein, 141 aa, Gloeobacter violaceus; identical to SEQ ID NO: 37962

SEQ ID NO: 83795 - DNA, 480 bp, Halobacterium volcanii; identical to SEQ ID NO: 37963
  CDS (1)..(480)

SEQ ID NO: 83796 - protein, 159 aa, Halobacterium volcanii; identical to SEQ ID NO: 37964

SEQ ID NO: 83797 - DNA, 426 bp, Helicobacter pylori J99; identical to SEQ ID NO: 37965
  CDS (1)..(426): transl_table=11

SEQ ID NO: 83798 - protein, 141 aa, Helicobacter pylori J99; identical to SEQ ID NO: 37966

SEQ ID NO: 83799 - DNA, 426 bp, Lactobacillus johnsonii; identical to SEQ ID NO: 37967
  CDS (1)..(426): transl_table=11

SEQ ID NO: 83800 - protein, 141 aa, Lactobacillus johnsonii; identical to SEQ ID NO: 37968

SEQ ID NO: 83801 - DNA, 432 bp, Leifsonia xyli; identical to SEQ ID NO: 37969
  CDS (1)..(432): transl_table=11

SEQ ID NO: 83802 - protein, 143 aa, Leifsonia xyli; identical to SEQ ID NO: 37970

SEQ ID NO: 83803 - DNA, 429 bp, Leptospira interrogans; identical to SEQ ID NO: 37971
  CDS (1)..(429): transl_table=11

SEQ ID NO: 83804 - protein, 142 aa, Leptospira interrogans; identical to SEQ ID NO: 37972

SEQ ID NO: 83805 - DNA, 429 bp, Liberibacter asiaticus; identical to SEQ ID NO: 37973
  CDS (1)..(429)

SEQ ID NO: 83806 - protein, 142 aa, Liberibacter asiaticus; identical to SEQ ID NO: 37974

SEQ ID NO: 83807 - DNA, 426 bp, Listeria innocua; identical to SEQ ID NO: 37975
  CDS (1)..(426): transl_table=11

SEQ ID NO: 83808 - protein, 141 aa, Listeria innocua; identical to SEQ ID NO: 37976

SEQ ID NO: 83809 - DNA, 429 bp, Mannheimia succiniciproducens; identical to SEQ ID NO: 37977
  CDS (1)..(429): transl_table=11

SEQ ID NO: 83810 - protein, 142 aa, Mannheimia succiniciproducens; identical to SEQ ID NO: 37978

SEQ ID NO: 83811 - DNA, 429 bp, Mesoplasma florum; identical to SEQ ID NO: 37979
  CDS (1)..(429): transl_table=4

SEQ ID NO: 83812 - protein, 142 aa, Mesoplasma florum; identical to SEQ ID NO: 37980

SEQ ID NO: 83813 - DNA, 486 bp, Methanosarcina acetivorans; identical to SEQ ID NO: 37981
  CDS (1)..(486): transl_table=11

SEQ ID NO: 83814 - protein, 161 aa, Methanosarcina acetivorans; identical to SEQ ID NO: 37982

SEQ ID NO: 83815 - DNA, 486 bp, Methanococcus jannaschii; identical to SEQ ID NO: 37983
  CDS (1)..(486): transl_table=11

SEQ ID NO: 83816 - protein, 161 aa, Methanococcus jannaschii; identical to SEQ ID NO: 37984

SEQ ID NO: 83817 - DNA, 501 bp, Methanopyrus kandleri; identical to SEQ ID NO: 37985
  CDS (1)..(501): transl_table=11

SEQ ID NO: 83818 - protein, 166 aa, Methanopyrus kandleri; identical to SEQ ID NO: 37986

SEQ ID NO: 83819 - DNA, 486 bp, Methanosarcina mazei; identical to SEQ ID NO: 37987
  CDS (1)..(486): transl_table=11

SEQ ID NO: 83820 - protein, 161 aa, Methanosarcina mazei; identical to SEQ ID NO: 37988

SEQ ID NO: 83821 - DNA, 483 bp, Methanobacterium thermoautotrophicum; identical to SEQ ID NO: 37989
  CDS (1)..(483): transl_table=11

SEQ ID NO: 83822 - protein, 160 aa, Methanobacterium thermoautotrophicum; identical to SEQ ID NO: 37990

SEQ ID NO: 83823 - DNA, 459 bp, Mycoplasma gallisepticum; identical to SEQ ID NO: 37991
  CDS (1)..(459): transl_table=4

SEQ ID NO: 83824 - protein, 152 aa, Mycoplasma gallisepticum; identical to SEQ ID NO: 37992

SEQ ID NO: 83825 - DNA, 429 bp, Mycobacterium leprae; identical to SEQ ID NO: 37993
  CDS (1)..(429): transl_table=11

SEQ ID NO: 83826 - protein, 142 aa, Mycobacterium leprae; identical to SEQ ID NO: 37994

SEQ ID NO: 83827 - DNA, 429 bp, Mycobacterium paratuberculosis; identical to SEQ ID NO: 37995
  CDS (1)..(429): transl_table=11

SEQ ID NO: 83828 - protein, 142 aa, Mycobacterium paratuberculosis; identical to SEQ ID NO: 37996

SEQ ID NO: 83829 - DNA, 483 bp, Nanoarchaeum equitans; identical to SEQ ID NO: 37997
  CDS (1)..(483): transl_table=11

SEQ ID NO: 83830 - protein, 160 aa, Nanoarchaeum equitans; identical to SEQ ID NO: 37998

SEQ ID NO: 83831 - DNA, 435 bp, Neisseria meningitidis; identical to SEQ ID NO: 37999
  CDS (1)..(435): transl_table=11

SEQ ID NO: 83832 - protein, 144 aa, Neisseria meningitidis; identical to SEQ ID NO: 38000

SEQ ID NO: 83833 - DNA, 435 bp, Neisseria meningitidis; identical to SEQ ID NO: 38001
  CDS (1)..(435): transl_table=11

SEQ ID NO: 83834 - protein, 144 aa, Neisseria meningitidis; identical to SEQ ID NO: 38002

SEQ ID NO: 83835 - DNA, 432 bp, Nitrosomonas europaea; identical to SEQ ID NO: 38003
  CDS (1)..(432): transl_table=11

SEQ ID NO: 83836 - protein, 143 aa, Nitrosomonas europaea; identical to SEQ ID NO: 38004

SEQ ID NO: 83837 - DNA, 426 bp, Onion yellows phytoplasma; identical to SEQ ID NO: 38005
  CDS (1)..(426): transl_table=11

SEQ ID NO: 83838 - protein, 141 aa, Onion yellows phytoplasma; identical to SEQ ID NO: 38006

SEQ ID NO: 83839 - DNA, 429 bp, Parachlamydia sp; identical to SEQ ID NO: 38007
  CDS (1)..(429): transl_table=11

SEQ ID NO: 83840 - protein, 142 aa, Parachlamydia sp; identical to SEQ ID NO: 38008

SEQ ID NO: 83841 - DNA, 429 bp, Pasteurella multocida; identical to SEQ ID NO: 38009
  CDS (1)..(429): transl_table=11

SEQ ID NO: 83842 - protein, 142 aa, Pasteurella multocida; identical to SEQ ID NO: 38010

SEQ ID NO: 83843 - DNA, 429 bp, Photorhabdus luminescens; identical to SEQ ID NO: 38011
  CDS (1)..(429): transl_table=11

SEQ ID NO: 83844 - protein, 142 aa, Photorhabdus luminescens; identical to SEQ ID NO: 38012

SEQ ID NO: 83845 - DNA, 429 bp, Photobacterium profundum; identical to SEQ ID NO: 38013
  CDS (1)..(429): transl_table=11

SEQ ID NO: 83846 - protein, 142 aa, Photobacterium profundum; identical to SEQ ID NO: 38014

SEQ ID NO: 83847 - DNA, 468 bp, Picrophilus torridus; identical to SEQ ID NO: 38015
  CDS (1)..(468): transl_table=11

SEQ ID NO: 83848 - protein, 155 aa, Picrophilus torridus; identical to SEQ ID NO: 38016

SEQ ID NO: 83849 - DNA, 438 bp, Porphyromonas gingivalis; identical to SEQ ID NO: 38017
  CDS (1)..(438): transl_table=11

SEQ ID NO: 83850 - protein, 145 aa, Porphyromonas gingivalis; identical to SEQ ID NO: 38018

SEQ ID NO: 83851 - DNA, 429 bp, Gamma; identical to SEQ ID NO: 38019
  CDS (1)..(429): transl_table=11

SEQ ID NO: 83852 - protein, 142 aa, Gamma; identical to SEQ ID NO: 38020

SEQ ID NO: 83853 - DNA, 426 bp, Prochlorococcus marinus subsp; identical to SEQ ID NO: 38021
  CDS (1)..(426): transl_table=11

SEQ ID NO: 83854 - protein, 141 aa, Prochlorococcus marinus subsp; identical to SEQ ID NO: 38022

SEQ ID NO: 83855 - DNA, 432 bp, Pseudomonas aeruginosa; identical to SEQ ID NO: 38023
  CDS (1)..(432): transl_table=11

SEQ ID NO: 83856 - protein, 143 aa, Pseudomonas aeruginosa; identical to SEQ ID NO: 38024

SEQ ID NO: 83857 - DNA, 432 bp, Pseudomonas putida; identical to SEQ ID NO: 38025
  CDS (1)..(432): transl_table=11

SEQ ID NO: 83858 - protein, 143 aa, Pseudomonas putida; identical to SEQ ID NO: 38026

SEQ ID NO: 83859 - DNA, 432 bp, Pseudomonas syringae; identical to SEQ ID NO: 38027
  CDS (1)..(432): transl_table=11

SEQ ID NO: 83860 - protein, 143 aa, Pseudomonas syringae; identical to SEQ ID NO: 38028

SEQ ID NO: 83861 - DNA, 495 bp, Pyrococcus horikoshii; identical to SEQ ID NO: 38029
  CDS (1)..(495)

SEQ ID NO: 83862 - protein, 164 aa, Pyrococcus horikoshii; identical to SEQ ID NO: 38030

SEQ ID NO: 83863 - DNA, 432 bp, Ralstonia solanacearum; identical to SEQ ID NO: 38031
  CDS (1)..(432): transl_table=11

SEQ ID NO: 83864 - protein, 143 aa, Ralstonia solanacearum; identical to SEQ ID NO: 38032

SEQ ID NO: 83865 - DNA, 429 bp, Rhizobium meliloti; identical to SEQ ID NO: 38033
  CDS (1)..(429): transl_table=11

SEQ ID NO: 83866 - protein, 142 aa, Rhizobium meliloti; identical to SEQ ID NO: 38034

SEQ ID NO: 83867 - DNA, 426 bp, Rhodopirellula baltica; identical to SEQ ID NO: 38035
  CDS (1)..(426): transl_table=11

SEQ ID NO: 83868 - protein, 141 aa, Rhodopirellula baltica; identical to SEQ ID NO: 38036

SEQ ID NO: 83869 - DNA, 429 bp, Rhodopseudomonas palustris; identical to SEQ ID NO: 38037
  CDS (1)..(429): transl_table=11

SEQ ID NO: 83870 - protein, 142 aa, Rhodopseudomonas palustris; identical to SEQ ID NO: 38038

SEQ ID NO: 83871 - DNA, 438 bp, Rickettsia typhi; identical to SEQ ID NO: 38039
  CDS (1)..(438): transl_table=11

SEQ ID NO: 83872 - protein, 145 aa, Rickettsia typhi; identical to SEQ ID NO: 38040

SEQ ID NO: 83873 - DNA, 429 bp, Shewanella oneidensis; identical to SEQ ID NO: 38041
  CDS (1)..(429): transl_table=11

SEQ ID NO: 83874 - protein, 142 aa, Shewanella oneidensis; identical to SEQ ID NO: 38042

SEQ ID NO: 83875 - DNA, 423 bp, Staphylococcus epidermidis; identical to SEQ ID NO: 38043
  CDS (1)..(423): transl_table=11

SEQ ID NO: 83876 - protein, 140 aa, Staphylococcus epidermidis; identical to SEQ ID NO: 38044

SEQ ID NO: 83877 - DNA, 426 bp, Synechococcus elongatus; identical to SEQ ID NO: 38045
  CDS (1)..(426)

SEQ ID NO: 83878 - protein, 141 aa, Synechococcus elongatus; identical to SEQ ID NO: 38046

SEQ ID NO: 83879 - DNA, 426 bp, Synechococcus sp; identical to SEQ ID NO: 38047
  CDS (1)..(426): transl_table=11

SEQ ID NO: 83880 - protein, 141 aa, Synechococcus sp; identical to SEQ ID NO: 38048

SEQ ID NO: 83881 - DNA, 471 bp, Thermoplasma acidophilum; identical to SEQ ID NO: 38049
  CDS (1)..(471)

SEQ ID NO: 83882 - protein, 156 aa, Thermoplasma acidophilum; identical to SEQ ID NO: 38050

SEQ ID NO: 83883 - DNA, 426 bp, Thermotoga maritima; identical to SEQ ID NO: 37695
  CDS (1)..(426)

SEQ ID NO: 83884 - protein, 141 aa, Thermotoga maritima; identical to SEQ ID NO: 37696

SEQ ID NO: 83885 - DNA, 444 bp, Thermus thermophilus; identical to SEQ ID NO: 38053
  CDS (1)..(444): transl_table=11

SEQ ID NO: 83886 - protein, 147 aa, Thermus thermophilus; identical to SEQ ID NO: 38054

SEQ ID NO: 83887 - DNA, 423 bp, Thermoanaerobacter tengcongensis; identical to SEQ ID NO: 38055
  CDS (1)..(423): transl_table=11

SEQ ID NO: 83888 - protein, 140 aa, Thermoanaerobacter tengcongensis; identical to SEQ ID NO: 38056

SEQ ID NO: 83889 - DNA, 477 bp, Thermoplasma volcanium; identical to SEQ ID NO: 38057
  CDS (1)..(477)

SEQ ID NO: 83890 - protein, 158 aa, Thermoplasma volcanium; identical to SEQ ID NO: 38058

SEQ ID NO: 83891 - DNA, 432 bp, Treponema denticola; identical to SEQ ID NO: 38059
  CDS (1)..(432): transl_table=11

SEQ ID NO: 83892 - protein, 143 aa, Treponema denticola; identical to SEQ ID NO: 38060

SEQ ID NO: 83893 - DNA, 426 bp, Tropheryma whipplei; identical to SEQ ID NO: 38061
  CDS (1)..(426): transl_table=11

SEQ ID NO: 83894 - protein, 141 aa, Tropheryma whipplei; identical to SEQ ID NO: 38062

SEQ ID NO: 83895 - DNA, 453 bp, Ureaplasma parvum; identical to SEQ ID NO: 38063
  CDS (1)..(453): transl_table=4

SEQ ID NO: 83896 - protein, 150 aa, Ureaplasma parvum; identical to SEQ ID NO: 38064

SEQ ID NO: 83897 - DNA, 429 bp, Vibrio parahaemolyticus; identical to SEQ ID NO: 38065
  CDS (1)..(429)

SEQ ID NO: 83898 - protein, 142 aa, Vibrio parahaemolyticus; identical to SEQ ID NO: 38066

SEQ ID NO: 83899 - DNA, 429 bp, Vibrio vulnificus; identical to SEQ ID NO: 38067
  CDS (1)..(429)

SEQ ID NO: 83900 - protein, 142 aa, Vibrio vulnificus; identical to SEQ ID NO: 38068

SEQ ID NO: 83901 - DNA, 429 bp, Wigglesworthia glossinidia brevipalpis; identical to SEQ ID NO: 38069
  CDS (1)..(429)

SEQ ID NO: 83902 - protein, 142 aa, Wigglesworthia glossinidia brevipalpis; identical to SEQ ID NO: 38070

SEQ ID NO: 83903 - DNA, 441 bp, Wolbachia pipientis wMel; identical to SEQ ID NO: 38071
  CDS (1)..(441): transl_table=11

SEQ ID NO: 83904 - protein, 146 aa, Wolbachia pipientis wMel; identical to SEQ ID NO: 38072

SEQ ID NO: 83905 - DNA, 426 bp, Wolinella succinogenes; identical to SEQ ID NO: 38073
  CDS (1)..(426): transl_table=11

SEQ ID NO: 83906 - protein, 141 aa, Wolinella succinogenes; identical to SEQ ID NO: 38074

SEQ ID NO: 83907 - DNA, 429 bp, Xanthomonas axonopodis; identical to SEQ ID NO: 38075
  CDS (1)..(429): transl_table=11

SEQ ID NO: 83908 - protein, 142 aa, Xanthomonas axonopodis; identical to SEQ ID NO: 38076

SEQ ID NO: 83909 - DNA, 429 bp, Xanthomonas campestris; identical to SEQ ID NO: 38077
  CDS (1)..(429): transl_table=11

SEQ ID NO: 83910 - protein, 142 aa, Xanthomonas campestris; identical to SEQ ID NO: 38078

SEQ ID NO: 83911 - DNA, 429 bp, Xylella fastidiosa; identical to SEQ ID NO: 38079
  CDS (1)..(429)

SEQ ID NO: 83912 - protein, 142 aa, Xylella fastidiosa; identical to SEQ ID NO: 38080

SEQ ID NO: 83913 - DNA, 429 bp, Yersinia pestis; identical to SEQ ID NO: 38081
  CDS (1)..(429): transl_table=11

SEQ ID NO: 83914 - protein, 142 aa, Yersinia pestis; identical to SEQ ID NO: 38082

SEQ ID NO: 83915 - DNA, 588 bp, Caenorhabditis elegans; identical to SEQ ID NO: 38083
  CDS (1)..(588)

SEQ ID NO: 83916 - protein, 195 aa, Caenorhabditis elegans; identical to SEQ ID NO: 38084

SEQ ID NO: 83917 - DNA, 591 bp, Drosophila melanogaster; identical to SEQ ID NO: 38085
  CDS (1)..(591)

SEQ ID NO: 83918 - protein, 196 aa, Drosophila melanogaster; identical to SEQ ID NO: 38086

SEQ ID NO: 83919 - DNA, 438 bp, Reclinomonas americana; identical to SEQ ID NO: 38087
  CDS (1)..(438)

SEQ ID NO: 83920 - protein, 145 aa, Reclinomonas americana; identical to SEQ ID NO: 38088

SEQ ID NO: 83921 - DNA, 477 bp, Saccharomyces cerevisiae; identical to SEQ ID NO: 38089
  CDS (1)..(477)

SEQ ID NO: 83922 - protein, 158 aa, Saccharomyces cerevisiae; identical to SEQ ID NO: 38090

SEQ ID NO: 83923 - DNA, 25 bp, Primer
atggctaagaaagtacaagcctatg

SEQ ID NO: 83924 - DNA, 22 bp, Primer
ttagtcctccactaccaggccc

SEQ ID NO: 83925 - protein, 167 aa, consensus; identical to SEQ ID NO: 38093
  MISC_FEATURE (1)..(167): consensus for the disclosure of xaa see table XV

SEQ ID NO: 83926 - protein, 38 aa, consensus; identical to SEQ ID NO: 38094
  MISC_FEATURE (1)..(38): consensus for the disclosure of xaa see table XV

SEQ ID NO: 83927 - protein, 39 aa, consensus; identical to SEQ ID NO: 38095
  MISC_FEATURE (1)..(39): consensus for the disclosure of xaa see table XV

SEQ ID NO: 83928 - protein, 46 aa, consensus; identical to SEQ ID NO: 38096
  MISC_FEATURE (1)..(46): consensus for the disclosure of xaa see table XV

SEQ ID NO: 83929 - DNA, 1518 bp, Escherichia coli; identical to SEQ ID NO: 32416
  CDS (1)..(1518)

SEQ ID NO: 83930 - protein, 505 aa, Escherichia coli; identical to SEQ ID NO: 32417

SEQ ID NO: 83931 - DNA, 1536 bp, Streptococcus thermophilus CNRZ1066; identical to SEQ ID NO: 32418
  CDS (1)..(1536)

SEQ ID NO: 83932 - protein, 511 aa, Streptococcus thermophilus CNRZ1066; identical to SEQ ID NO: 32419

SEQ ID NO: 83933 - DNA, 1512 bp, Idiomarina loihiensis L2TR; identical to SEQ ID NO: 32420
  CDS (1)..(1512)

SEQ ID NO: 83934 - protein, 503 aa, Idiomarina loihiensis L2TR; identical to SEQ ID NO: 32421

SEQ ID NO: 83935 - DNA, 1731 bp, Francisella tularensis subsp. tularensis; identical to SEQ ID NO: 32422
  CDS (1)..(1731)

SEQ ID NO: 83936 - protein, 576 aa, Francisella tularensis subsp. tularensis; identical to SEQ ID NO: 32423

SEQ ID NO: 83937 - DNA, 1737 bp, Xenopus tropicalis; identical to SEQ ID NO: 32424
  CDS (1)..(1737)

SEQ ID NO: 83938 - protein, 578 aa, Xenopus tropicalis; identical to SEQ ID NO: 32425

SEQ ID NO: 83939 - DNA, 1809 bp, Danio rerio; identical to SEQ ID NO: 32426
  CDS (1)..(1809)

SEQ ID NO: 83940 - protein, 602 aa, Danio rerio; identical to SEQ ID NO: 32427

SEQ ID NO: 83941 - DNA, 1809 bp, Arabidopsis thaliana; identical to SEQ ID NO: 32428
  CDS (1)..(1809)

SEQ ID NO: 83942 - protein, 602 aa, Arabidopsis thaliana; identical to SEQ ID NO: 32429

SEQ ID NO: 83943 - DNA, 1539 bp, Vibrio cholerae O1 biovar eltor str. N16961; identical to SEQ ID NO: 32430
  CDS (1)..(1539): transl_table=11

SEQ ID NO: 83944 - protein, 512 aa, Vibrio cholerae O1 biovar eltor str. N16961; identical to SEQ ID NO: 32431

SEQ ID NO: 83945 - DNA, 1584 bp, Chlamydophila pneumoniae J138; identical to SEQ ID NO: 32432
  CDS (1)..(1584): transl_table=11

SEQ ID NO: 83946 - protein, 527 aa, Chlamydophila pneumoniae J138; identical to SEQ ID NO: 32433

SEQ ID NO: 83947 - DNA, 1335 bp, Sulfolobus tokodaii str. 7; identical to SEQ ID NO: 32434
  CDS (1)..(1335): transl_table=11

SEQ ID NO: 83948 - protein, 444 aa, Sulfolobus tokodaii str. 7; identical to SEQ ID NO: 32435

SEQ ID NO: 83949 - DNA, 1518 bp, Escherichia coli K12; identical to SEQ ID NO: 32436
  CDS (1)..(1518): transl_table=11

SEQ ID NO: 83950 - protein, 505 aa, Escherichia coli K12; identical to SEQ ID NO: 32437

SEQ ID NO: 83951 - DNA, 1518 bp, Salmonella typhimurium LT2; identical to SEQ ID NO: 32438
  CDS (1)..(1518): transl_table=11

SEQ ID NO: 83952 - protein, 505 aa, Salmonella typhimurium LT2; identical to SEQ ID NO: 32439

SEQ ID NO: 83953 - DNA, 1449 bp, Pyrobaculum aerophilum str. IM2; identical to SEQ ID NO: 32440
  CDS (1)..(1449): transl_table=11

SEQ ID NO: 83954 - protein, 482 aa, Pyrobaculum aerophilum str. IM2; identical to SEQ ID NO: 32441

SEQ ID NO: 83955 - DNA, 1725 bp, Drosophila melanogaster; identical to SEQ ID NO: 32442
  CDS (1)..(1725)

SEQ ID NO: 83956 - protein, 574 aa, Drosophila melanogaster; identical to SEQ ID NO: 32443

SEQ ID NO: 83957 - DNA, 1323 bp, Encephalitozoon cuniculi; identical to SEQ ID NO: 32444
  CDS (1)..(1323): transl_table=11

SEQ ID NO: 83958 - protein, 440 aa, Encephalitozoon cuniculi; identical to SEQ ID NO: 32445

SEQ ID NO: 83959 - DNA, 1596 bp, Schizosaccharomyces pombe; identical to SEQ ID NO: 32446
  CDS (1)..(1596)

SEQ ID NO: 83960 - protein, 531 aa, Schizosaccharomyces pombe; identical to SEQ ID NO: 32447

SEQ ID NO: 83961 - DNA, 1776 bp, Schizosaccharomyces pombe; identical to SEQ ID NO: 32448
  CDS (1)..(1776)

SEQ ID NO: 83962 - protein, 591 aa, Schizosaccharomyces pombe; identical to SEQ ID NO: 32449

SEQ ID NO: 83963 - DNA, 1581 bp, Corynebacterium glutamicum ATCC 13032; identical to SEQ ID NO: 32450
  CDS (1)..(1581): transl_table=11

SEQ ID NO: 83964 - protein, 526 aa, Corynebacterium glutamicum ATCC 13032; identical to SEQ ID NO: 32451

SEQ ID NO: 83965 - DNA, 1683 bp, Bifidobacterium longum NCC2705; identical to SEQ ID NO: 32452
  CDS (1)..(1683): transl_table=11

SEQ ID NO: 83966 - protein, 560 aa, Bifidobacterium longum NCC2705; identical to SEQ ID NO: 32453

SEQ ID NO: 83967 - DNA, 1752 bp, Plasmodium falciparum 3D7; identical to SEQ ID NO: 32454
  CDS (1)..(1752)

SEQ ID NO: 83968 - protein, 583 aa, Plasmodium falciparum 3D7; identical to SEQ ID NO: 32455

SEQ ID NO: 83969 - DNA, 1641 bp, Rhodopirellula baltica SH 1; identical to SEQ ID NO: 32456
  CDS (1)..(1641): transl_table=11

SEQ ID NO: 83970 - protein, 546 aa, Rhodopirellula baltica SH 1; identical to SEQ ID NO: 32457

SEQ ID NO: 83971 - DNA, 1563 bp, Corynebacterium diphtheriae NCTC 13129; identical to SEQ ID NO: 32458
  CDS (1)..(1563): transl_table=11

SEQ ID NO: 83972 - protein, 520 aa, Corynebacterium diphtheriae NCTC 13129; identical to SEQ ID NO: 32459

SEQ ID NO: 83973 - DNA, 1536 bp, Onion yellows phytoplasma OY-M; identical to SEQ ID NO: 32460
  CDS (1)..(1536): transl_table=11

SEQ ID NO: 83974 - protein, 511 aa, Onion yellows phytoplasma OY-M; identical to SEQ ID NO: 32461

SEQ ID NO: 83975 - DNA, 1542 bp, Lactobacillus johnsonii NCC 533; identical to SEQ ID NO: 32462
  CDS (1)..(1542): transl_table=11

SEQ ID NO: 83976 - protein, 513 aa, Lactobacillus johnsonii NCC 533; identical to SEQ ID NO: 32463

SEQ ID NO: 83977 - DNA, 1515 bp, Bdellovibrio bacteriovorus HD100; identical to SEQ ID NO: 32464
  CDS (1)..(1515): transl_table=11

SEQ ID NO: 83978 - protein, 504 aa, Bdellovibrio bacteriovorus HD100; identical to SEQ ID NO: 32465

SEQ ID NO: 83979 - DNA, 1503 bp, Mycoplasma mycoides subsp. mycoides SC str. PG1; identical to SEQ ID NO: 32466
  CDS (1)..(1503): transl_table=4

SEQ ID NO: 83980 - protein, 500 aa, Mycoplasma mycoides subsp. mycoides SC str. PG1; identical to SEQ ID NO: 32467

SEQ ID NO: 83981 - DNA, 1500 bp, Bacillus cereus ATCC 10987; identical to SEQ ID NO: 32468
  CDS (1)..(1500): transl_table=11

SEQ ID NO: 83982 - protein, 499 aa, Bacillus cereus ATCC 10987; identical to SEQ ID NO: 32469

SEQ ID NO: 83983 - DNA, 1578 bp, Eremothecium gossypii; identical to SEQ ID NO: 32470
  CDS (1)..(1578)

SEQ ID NO: 83984 - protein, 525 aa, Eremothecium gossypii; identical to SEQ ID NO: 32471

SEQ ID NO: 83985 - DNA, 1770 bp, Eremothecium gossypii; identical to SEQ ID NO: 32472
  CDS (1)..(1770)

SEQ ID NO: 83986 - protein, 589 aa, Eremothecium gossypii; identical to SEQ ID NO: 32473

SEQ ID NO: 83987 - DNA, 1917 bp, Magnaporthe grisea 70-15; identical to SEQ ID NO: 32474
  CDS (1)..(1917)

SEQ ID NO: 83988 - protein, 638 aa, Magnaporthe grisea 70-15; identical to SEQ ID NO: 32475

SEQ ID NO: 83989 - DNA, 1833 bp, Gibberella zeae PH-1; identical to SEQ ID NO: 32476
  CDS (1)..(1833)

SEQ ID NO: 83990 - protein, 610 aa, Gibberella zeae PH-1; identical to SEQ ID NO: 32477

SEQ ID NO: 83991 - DNA, 1821 bp, Aspergillus nidulans FGSC A4; identical to SEQ ID NO: 32478
  CDS (1)..(1821)

SEQ ID NO: 83992 - protein, 606 aa, Aspergillus nidulans FGSC A4; identical to SEQ ID NO: 32479

SEQ ID NO: 83993 - DNA, 1776 bp, Candida glabrata CBS138; identical to SEQ ID NO: 32480
  CDS (1)..(1776)

SEQ ID NO: 83994 - protein, 591 aa, Candida glabrata CBS138; identical to SEQ ID NO: 32481

SEQ ID NO: 83995 - DNA, 1782 bp, Debaryomyces hansenii CBS767; identical to SEQ ID NO: 32482
  CDS (1)..(1782)

SEQ ID NO: 83996 - protein, 593 aa, Debaryomyces hansenii CBS767; identical to SEQ ID NO: 32483

SEQ ID NO: 83997 - DNA, 1761 bp, Oryza sativa (japonica cultivar-group); identical to SEQ ID NO: 32484
  CDS (1)..(1761)

SEQ ID NO: 83998 - protein, 586 aa, Oryza sativa (japonica cultivar-group); identical to SEQ ID NO: 32485

SEQ ID NO: 83999 - DNA, 1749 bp, Yarrowia lipolytica CLIB99; identical to SEQ ID NO: 32486
  CDS (1)..(1749)

SEQ ID NO: 84000 - protein, 582 aa, Yarrowia lipolytica CLIB99; identical to SEQ ID NO: 32487

SEQ ID NO: 84001 - DNA, 1488 bp, Leptospira interrogans serovar Copenhageni str. Fiocruz L1-130; identical to SEQ ID NO: 32488
  CDS (1)..(1488): transl_table=11

SEQ ID NO: 84002 - protein, 495 aa, Leptospira interrogans serovar Copenhageni str. Fiocruz L1-130; identical to SEQ ID NO: 32489

SEQ ID NO: 84003 - DNA, 1590 bp, Parachlamydia sp. UWE25; identical to SEQ ID NO: 32490
  CDS (1)..(1590): transl_table=11

SEQ ID NO: 84004 - protein, 529 aa, Parachlamydia sp. UWE25; identical to SEQ ID NO: 32491

SEQ ID NO: 84005 - DNA, 1506 bp, Desulfovibrio vulgaris subsp. vulgaris str. Hildenborough; identical to SEQ ID NO: 32492
  CDS (1)..(1506): transl_table=11

SEQ ID NO: 84006 - protein, 501 aa, Desulfovibrio vulgaris subsp. vulgaris str. Hildenborough; identical to SEQ ID NO: 32493

SEQ ID NO: 84007 - DNA, 1518 bp, Erwinia carotovora subsp. atroseptica SCRI1043; identical to SEQ ID NO: 32494
  CDS (1)..(1518)

SEQ ID NO: 84008 - protein, 505 aa, Erwinia carotovora subsp. atroseptica SCRI1043; identical to SEQ ID NO: 32495

SEQ ID NO: 84009 - DNA, 1500 bp, Mesoplasma florum L1; identical to SEQ ID NO: 32496
  CDS (1)..(1500): transl_table=4

SEQ ID NO: 84010 - protein, 499 aa, Mesoplasma florum L1; identical to SEQ ID NO: 32497

SEQ ID NO: 84011 - DNA, 1533 bp, Propionibacterium acnes KPA171202; identical to SEQ ID NO: 32498
  CDS (1)..(1533): transl_table=11

SEQ ID NO: 84012 - protein, 510 aa, Propionibacterium acnes KPA171202; identical to SEQ ID NO: 32499

SEQ ID NO: 84013 - DNA, 1515 bp, Leifsonia xyli subsp. xyli str. CTCB07; identical to SEQ ID NO: 32500
  CDS (1)..(1515): transl_table=11

SEQ ID NO: 84014 - protein, 504 aa, Leifsonia xyli subsp. xyli str. CTCB07; identical to SEQ ID NO: 32501

SEQ ID NO: 84015 - DNA, 1512 bp, Desulfotalea psychrophila LSv54; identical to SEQ ID NO: 32502
  CDS (1)..(1512): transl_table=11

SEQ ID NO: 84016 - protein, 503 aa, Desulfotalea psychrophila LSv54; identical to SEQ ID NO: 32503

SEQ ID NO: 84017 - DNA, 1488 bp, Symbiobacterium thermophilum IAM 14863; identical to SEQ ID NO: 32504
  CDS (1)..(1488): transl_table=11

SEQ ID NO: 84018 - protein, 495 aa, Symbiobacterium thermophilum IAM 14863; identical to SEQ ID NO: 32505

SEQ ID NO: 84019 - DNA, 1512 bp, Mannheimia succiniciproducens MBEL55E; identical to SEQ ID NO: 32506
  CDS (1)..(1512): transl_table=11

SEQ ID NO: 84020 - protein, 503 aa, Mannheimia succiniciproducens MBEL55E; identical to SEQ ID NO: 32507

SEQ ID NO: 84021 - DNA, 1728 bp, Bacteroides fragilis YCH46; identical to SEQ ID NO: 32508
  CDS (1)..(1728): transl_table=11

SEQ ID NO: 84022 - protein, 575 aa, Bacteroides fragilis YCH46; identical to SEQ ID NO: 32509

SEQ ID NO: 84023 - DNA, 1491 bp, Methylococcus capsulatus str. Bath; identical to SEQ ID NO: 32510
  CDS (1)..(1491): transl_table=11

SEQ ID NO: 84024 - protein, 496 aa, Methylococcus capsulatus str. Bath; identical to SEQ ID NO: 32511

SEQ ID NO: 84025 - DNA, 1467 bp, Nocardia farcinica IFM 10152; identical to SEQ ID NO: 32512
  CDS (1)..(1467): transl_table=11

SEQ ID NO: 84026 - protein, 488 aa, Nocardia farcinica IFM 10152; identical to SEQ ID NO: 32513

SEQ ID NO: 84027 - DNA, 1491 bp, Legionella pneumophila str. Paris; identical to SEQ ID NO: 32514
  CDS (1)..(1491): transl_table=11

SEQ ID NO: 84028 - protein, 496 aa, Legionella pneumophila str. Paris; identical to SEQ ID NO: 32515

SEQ ID NO: 84029 - DNA, 1509 bp, Photobacterium profundum SS9; identical to SEQ ID NO: 32516
  CDS (1)..(1509): transl_table=11

SEQ ID NO: 84030 - protein, 502 aa, Photobacterium profundum SS9; identical to SEQ ID NO: 32517

SEQ ID NO: 84031 - DNA, 1488 bp, Leuconostoc mesenteroides subsp. mesenteroides ATCC 8293; identical to SEQ ID NO: 32518
  CDS (1)..(1488)

SEQ ID NO: 84032 - protein, 495 aa, Leuconostoc mesenteroides subsp. mesenteroides ATCC 8293; identical to SEQ ID NO: 32519

SEQ ID NO: 84033 - DNA, 1503 bp, Azotobacter vinelandii; identical to SEQ ID NO: 32520
  CDS (1)..(1503)

SEQ ID NO: 84034 - protein, 500 aa, Azotobacter vinelandii; identical to SEQ ID NO: 32521

SEQ ID NO: 84035 - DNA, 1686 bp, Nostoc punctiforme PCC 73102; identical to SEQ ID NO: 32522
  CDS (1)..(1686)

SEQ ID NO: 84036 - protein, 561 aa, Nostoc punctiforme PCC 73102; identical to SEQ ID NO: 32523

SEQ ID NO: 84037 - DNA, 1503 bp, Actinobacillus pleuropneumoniae serovar 1 str. 4074; identical to SEQ ID NO: 32524
  CDS (1)..(1503)

SEQ ID NO: 84038 - protein, 500 aa, Actinobacillus pleuropneumoniae serovar 1 str. 4074; identical to SEQ ID NO: 32525

SEQ ID NO: 84039 - DNA, 1482 bp, Fusobacterium nucleatum subsp. vincentii ATCC 49256; identical to SEQ ID NO: 32526
  CDS (1)..(1482): transl_table=11

SEQ ID NO: 84040 - protein, 493 aa, Fusobacterium nucleatum subsp. vincentii ATCC 49256; identical to SEQ ID NO: 32527

SEQ ID NO: 84041 - DNA, 1545 bp, Psychrobacter sp. 273-4; identical to SEQ ID NO: 32528
  CDS (1)..(1545)

SEQ ID NO: 84042 - protein, 514 aa, Psychrobacter sp. 273-4; identical to SEQ ID NO: 32529

SEQ ID NO: 84043 - DNA, 1506 bp, Dechloromonas aromatica RCB; identical to SEQ ID NO: 32530
  CDS (1)..(1506)

SEQ ID NO: 84044 - protein, 501 aa, Dechloromonas aromatica RCB; identical to SEQ ID NO: 32531

SEQ ID NO: 84045 - DNA, 1509 bp, Haemophilus influenzae R2866; identical to SEQ ID NO: 32532
  CDS (1)..(1509)

SEQ ID NO: 84046 - protein, 502 aa, Haemophilus influenzae R2866; identical to SEQ ID NO: 32533

SEQ ID NO: 84047 - DNA, 1686 bp, Anabaena variabilis ATCC 29413; identical to SEQ ID NO: 32534
  CDS (1)..(1686)

SEQ ID NO: 84048 - protein, 561 aa, Anabaena variabilis ATCC 29413; identical to SEQ ID NO: 32535

SEQ ID NO: 84049 - DNA, 1515 bp, Synechococcus elongatus PCC 7942; identical to SEQ ID NO: 32536
  CDS (1)..(1515)

SEQ ID NO: 84050 - protein, 504 aa, Synechococcus elongatus PCC 7942; identical to SEQ ID NO: 32537

SEQ ID NO: 84051 - DNA, 1551 bp, Ralstonia eutropha JMP134; identical to SEQ ID NO: 32538
  CDS (1)..(1551)

SEQ ID NO: 84052 - protein, 516 aa, Ralstonia eutropha JMP134; identical to SEQ ID NO: 32539

SEQ ID NO: 84053 - DNA, 1530 bp, Methylobacillus flagellatus KT; identical to SEQ ID NO: 32540
  CDS (1)..(1530)

SEQ ID NO: 84054 - protein, 509 aa, Methylobacillus flagellatus KT; identical to SEQ ID NO: 32541

SEQ ID NO: 84055 - DNA, 1722 bp, Crocosphaera watsonii WH 8501; identical to SEQ ID NO: 32542
  CDS (1)..(1722)

SEQ ID NO: 84056 - protein, 573 aa, Crocosphaera watsonii WH 8501; identical to SEQ ID NO: 32543

SEQ ID NO: 84057 - DNA, 1482 bp, Exiguobacterium sp. 255-15; identical to SEQ ID NO: 32544
  CDS (1)..(1482)

SEQ ID NO: 84058 - protein, 493 aa, Exiguobacterium sp. 255-15; identical to SEQ ID NO: 32545

SEQ ID NO: 84059 - DNA, 1527 bp, Burkholderia cepacia R1808; identical to SEQ ID NO: 32546
  CDS (1)..(1527)

SEQ ID NO: 84060 - protein, 508 aa, Burkholderia cepacia R1808; identical to SEQ ID NO: 32547

SEQ ID NO: 84061 - DNA, 1527 bp, Rubrivivax gelatinosus PM1; identical to SEQ ID NO: 32548
  CDS (1)..(1527)

SEQ ID NO: 84062 - protein, 508 aa, Rubrivivax gelatinosus PM1; identical to SEQ ID NO: 32549

SEQ ID NO: 84063 - DNA, 1506 bp, Magnetococcus sp. MC-1; identical to SEQ ID NO: 32550
  CDS (1)..(1506)

SEQ ID NO: 84064 - protein, 501 aa, Magnetococcus sp. MC-1; identical to SEQ ID NO: 32551

SEQ ID NO: 84065 - DNA, 1491 bp, Thermobifida fusca; identical to SEQ ID NO: 32552
  CDS (1)..(1491)

SEQ ID NO: 84066 - protein, 496 aa, Thermobifida fusca; identical to SEQ ID NO: 32553

SEQ ID NO: 84067 - DNA, 1548 bp, Methanosarcina barkeri str. fusaro; identical to SEQ ID NO: 32554
  CDS (1)..(1548)

SEQ ID NO: 84068 - protein, 515 aa, Methanosarcina barkeri str. fusaro; identical to SEQ ID NO: 32555

SEQ ID NO: 84069 - DNA, 1476 bp, Geobacter metallireducens GS-15; identical to SEQ ID NO: 32556
  CDS (1)..(1476)

SEQ ID NO: 84070 - protein, 491 aa, Geobacter metallireducens GS-15; identical to SEQ ID NO: 32557

SEQ ID NO: 84071 - DNA, 1755 bp, Cytophaga hutchinsonii; identical to SEQ ID NO: 32558
  CDS (1)..(1755)

SEQ ID NO: 84072 - protein, 584 aa, Cytophaga hutchinsonii; identical to SEQ ID NO: 32559

SEQ ID NO: 84073 - DNA, 1509 bp, Microbulbifer degradans 2-40; identical to SEQ ID NO: 32560
  CDS (1)..(1509)

SEQ ID NO: 84074 - protein, 502 aa, Microbulbifer degradans 2-40; identical to SEQ ID NO: 32561

SEQ ID NO: 84075 - DNA, 1497 bp, Pediococcus pentosaceus ATCC 25745; identical to SEQ ID NO: 32562
  CDS (1)..(1497)

SEQ ID NO: 84076 - protein, 498 aa, Pediococcus pentosaceus ATCC 25745; identical to SEQ ID NO: 32563

SEQ ID NO: 84077 - DNA, 1569 bp, Trichodesmium erythraeum IMS101; identical to SEQ ID NO: 32564
  CDS (1)..(1569)

SEQ ID NO: 84078 - protein, 522 aa, Trichodesmium erythraeum IMS101; identical to SEQ ID NO: 32565

SEQ ID NO: 84079 - DNA, 1491 bp, Streptococcus suis 89/1591; identical to SEQ ID NO: 32566
  CDS (1)..(1491)

SEQ ID NO: 84080 - protein, 496 aa, Streptococcus suis 89/1591; identical to SEQ ID NO: 32567

SEQ ID NO: 84081 - DNA, 1506 bp, Thiobacillus denitrificans ATCC 25259; identical to SEQ ID NO: 32568
  CDS (1)..(1506)

SEQ ID NO: 84082 - protein, 501 aa, Thiobacillus denitrificans ATCC 25259; identical to SEQ ID NO: 32569

SEQ ID NO: 84083 - DNA, 1551 bp, Polaromonas sp. JS666; identical to SEQ ID NO: 32570
  CDS (1)..(1551)

SEQ ID NO: 84084 - protein, 516 aa, Polaromonas sp. JS666; identical to SEQ ID NO: 32571

SEQ ID NO: 84085 - DNA, 1734 bp, Brachydanio rerio; identical to SEQ ID NO: 32572
  CDS (1)..(1734)

SEQ ID NO: 84086 - protein, 577 aa, Brachydanio rerio; identical to SEQ ID NO: 32573

SEQ ID NO: 84087 - DNA, 1506 bp, uncultured bacterium 577; identical to SEQ ID NO: 32574
  CDS (1)..(1506): transl_table=11

SEQ ID NO: 84088 - protein, 501 aa, uncultured bacterium 577; identical to SEQ ID NO: 32575

SEQ ID NO: 84089 - DNA, 1491 bp, Candidatus Portiera aleyrodidarum; identical to SEQ ID NO: 32576
  CDS (1)..(1491): transl_table=11

SEQ ID NO: 84090 - protein, 496 aa, Candidatus Portiera aleyrodidarum; identical to SEQ ID NO: 32577

SEQ ID NO: 84091 - DNA, 1518 bp, Citrobacter freundii; identical to SEQ ID NO: 32578
  CDS (1)..(1518): transl_table=11

SEQ ID NO: 84092 - protein, 505 aa, Citrobacter freundii; identical to SEQ ID NO: 32579

SEQ ID NO: 84093 - DNA, 1497 bp, Escherichia coli; identical to SEQ ID NO: 32580
  CDS (1)..(1497): transl_table=11

SEQ ID NO: 84094 - protein, 498 aa, Escherichia coli; identical to SEQ ID NO: 32581

SEQ ID NO: 84095 - DNA, 1788 bp, Mus musculus; identical to SEQ ID NO: 32582
  CDS (1)..(1788)

SEQ ID NO: 84096 - protein, 595 aa, Mus musculus; identical to SEQ ID NO: 32583

SEQ ID NO: 84097 - DNA, 1551 bp, Methanosarcina barkeri; identical to SEQ ID NO: 32584
  CDS (1)..(1551): transl_table=11

SEQ ID NO: 84098 - protein, 516 aa, Methanosarcina barkeri; identical to SEQ ID NO: 32585

SEQ ID NO: 84099 - DNA, 1878 bp, Homo sapiens; identical to SEQ ID NO: 32586
  CDS (1)..(1878)

SEQ ID NO: 84100 - protein, 625 aa, Homo sapiens [sequence omitted]

SEQ ID NO: 84101 - DNA, 1536 bp, Methanosarcina acetivorans; identical to SEQ ID NO: 32588
  CDS (1)..(1536): transl_table=11

SEQ ID NO: 84102 - protein, 511 aa, Methanosarcina acetivorans; identical to SEQ ID NO: 32589

SEQ ID NO: 84103 - DNA, 1536 bp, Methanosarcina mazei; identical to SEQ ID NO: 32590
  CDS (1)..(1536): transl_table=11

SEQ ID NO: 84104 - protein, 511 aa, Methanosarcina mazei; identical to SEQ ID NO: 32591

SEQ ID NO: 84105 - DNA, 1779 bp, Saccharomyces cerevisiae; identical to SEQ ID NO: 32592
  CDS (1)..(1779)

SEQ ID NO: 84106 - protein, 592 aa, Saccharomyces cerevisiae; identical to SEQ ID NO: 32593

SEQ ID NO: 84107 - DNA, 1731 bp, Saccharomyces cerevisiae; identical to SEQ ID NO: 32594
  CDS (1)..(1731)

SEQ ID NO: 84108 - protein, 576 aa, Saccharomyces cerevisiae; identical to SEQ ID NO: 32595

SEQ ID NO: 84109 - DNA, 1530 bp, Acinetobacter sp; identical to SEQ ID NO: 32596
  CDS (1)..(1530): transl_table=11

SEQ ID NO: 84110 - protein, 509 aa, Acinetobacter sp; identical to SEQ ID NO: 32597

SEQ ID NO: 84111 - DNA, 1500 bp, Agrobacterium tumefaciens; identical to SEQ ID NO: 32598
  CDS (1)..(1500): transl_table=11

SEQ ID NO: 84112 - protein, 499 aa, Agrobacterium tumefaciens; identical to SEQ ID NO: 32599

SEQ ID NO: 84113 - DNA, 1686 bp, Anabaena sp; identical to SEQ ID NO: 32600
  CDS (1)..(1686): transl_table=11

SEQ ID NO: 84114 - protein, 561 aa, Anabaena sp; identical to SEQ ID NO: 32601

SEQ ID NO: 84115 - DNA, 1794 bp, Aquifex aeolicus; identical to SEQ ID NO: 32602
  CDS (1)..(1794): transl_table=11

SEQ ID NO: 84116 - protein, 597 aa, Aquifex aeolicus; identical to SEQ ID NO: 32603

SEQ ID NO: 84117 - DNA, 1881 bp, Arabidopsis thaliana; identical to SEQ ID NO: 32604
  CDS (1)..(1881)

SEQ ID NO: 84118 - protein, 626 aa, Arabidopsis thaliana; identical to SEQ ID NO: 32605

SEQ ID NO: 84119 - DNA, 1485 bp, Bacillus stearothermophilus; identical to SEQ ID NO: 32606
  CDS (1)..(1485): transl_table=11

SEQ ID NO: 84120 - protein, 494 aa, Bacillus stearothermophilus; identical to SEQ ID NO: 32607

SEQ ID NO: 84121 - DNA, 1500 bp, Bacillus subtilis; identical to SEQ ID NO: 32608
  CDS (1)..(1500): transl_table=11

SEQ ID NO: 84122 - protein, 499 aa, Bacillus subtilis; identical to SEQ ID NO: 32609

SEQ ID NO: 84123 - DNA, 1731 bp, Bacteroides thetaiotaomicron; identical to SEQ ID NO: 32610
  CDS (1)..(1731): transl_table=11

SEQ ID NO: 84124 - protein, 576 aa, Bacteroides thetaiotaomicron; identical to SEQ ID NO: 32611

SEQ ID NO: 84125 - DNA, 1521 bp, Buchnera aphidicola; identical to SEQ ID NO: 32612
  CDS (1)..(1521): transl_table=11

SEQ ID NO: 84126 - protein, 506 aa, Buchnera aphidicola; identical to SEQ ID NO: 32613

SEQ ID NO: 84127 - DNA, 1512 bp, Buchnera aphidicola; identical to SEQ ID NO: 32614
  CDS (1)..(1512): transl_table=11

SEQ ID NO: 84128 - protein, 503 aa, Buchnera aphidicola; identical to SEQ ID NO: 32615

SEQ ID NO: 84129 - DNA, 1719 bp, Caenorhabditis elegans; identical to SEQ ID NO: 32616
  CDS (1)..(1719)

SEQ ID NO: 84130 - protein, 572 aa, Caenorhabditis elegans; identical to SEQ ID NO: 32617

SEQ ID NO: 84131 - DNA, 1506 bp, Campylobacter jejuni; identical to SEQ ID NO: 32618
  CDS (1)..(1506): transl_table=11

SEQ ID NO: 84132 - protein, 501 aa, Campylobacter jejuni; identical to SEQ ID NO: 32619

SEQ ID NO: 84133 - DNA, 1458 bp, Candidatus Blochmannia floridanus; identical to SEQ ID NO: 32620
  CDS (1)..(1458): transl_table=11

SEQ ID NO: 84134 - protein, 485 aa, Candidatus Blochmannia floridanus; identical to SEQ ID NO: 32621

SEQ ID NO: 84135 - DNA, 1578 bp, Chlamydophila caviae; identical to SEQ ID NO: 32622
  CDS (1)..(1578): transl_table=11

SEQ ID NO: 84136 - protein, 525 aa, Chlamydophila caviae; identical to SEQ ID NO: 32623

SEQ ID NO: 84137 - DNA, 1536 bp, Chlorobium tepidum; identical to SEQ ID NO: 32624
  CDS (1)..(1536): transl_table=11

SEQ ID NO: 84138 - protein, 511 aa, Chlorobium tepidum; identical to SEQ ID NO: 32625

SEQ ID NO: 84139 - DNA, 1581 bp, Chlamydia trachomatis; identical to SEQ ID NO: 32626
  CDS (1)..(1581): transl_table=11

SEQ ID NO: 84140 - protein, 526 aa, Chlamydia trachomatis; identical to SEQ ID NO: 32627

SEQ ID NO: 84141 - DNA, 1509 bp, Chromobacterium violaceum; identical to SEQ ID NO: 32628
  CDS (1)..(1509): transl_table=11

SEQ ID NO: 84142 - protein, 502 aa, Chromobacterium violaceum; identical to SEQ ID NO: 32629

SEQ ID NO: 84143 - DNA, 1506 bp, Clostridium perfringens; identical to SEQ ID NO: 32630
  CDS (1)..(1506): transl_table=11

SEQ ID NO: 84144 - protein, 501 aa, Clostridium perfringens; identical to SEQ ID NO: 32631

SEQ ID NO: 84145 - DNA, 1509 bp, Clostridium tetani; identical to SEQ ID NO: 32632
  CDS (1)..(1509): transl_table=11

SEQ ID NO: 84146 - protein, 502 aa, Clostridium tetani; identical to SEQ ID NO: 32633

SEQ ID NO: 84147 - DNA, 1497 bp, Coxiella burnetii; identical to SEQ ID NO: 32634
  CDS (1)..(1497): transl_table=11

SEQ ID NO: 84148 - protein, 498 aa, Coxiella burnetii; identical to SEQ ID NO: 32635

SEQ ID NO: 84149 - DNA, 1794 bp, Cricetulus longicaudatus; identical to SEQ ID NO: 32636
  CDS (1)..(1794)

SEQ ID NO: 84150 - protein, 597 aa, Cricetulus longicaudatus; identical to SEQ ID NO: 32637

SEQ ID NO: 84151 - DNA, 1578 bp, Deinococcus radiodurans; identical to SEQ ID NO: 32638
  CDS (1)..(1578): transl_table=11

SEQ ID NO: 84152 - protein, 525 aa, Deinococcus radiodurans; identical to SEQ ID NO: 32639

SEQ ID NO: 84153 - DNA, 1497 bp, Enterococcus faecalis; identical to SEQ ID NO: 32640
  CDS (1)..(1497): transl_table=11

SEQ ID NO: 84154 - protein, 498 aa, Enterococcus faecalis; identical to SEQ ID NO: 32641

SEQ ID NO: 84155 - DNA, 1482 bp, Fusobacterium nucleatum; identical to SEQ ID NO: 32642
  CDS (1)..(1482): transl_table=11

SEQ ID NO: 84156 - protein, 493 aa, Fusobacterium nucleatum; identical to SEQ ID NO: 32643

SEQ ID NO: 84157 - DNA, 1494 bp, Gloeobacter violaceus; identical to SEQ ID NO: 32644
  CDS (1)..(1494): transl_table=11

SEQ ID NO: 84158 - protein, 497 aa, Gloeobacter violaceus; identical to SEQ ID NO: 32645

SEQ ID NO: 84159 - DNA, 1497 bp, Haemophilus ducreyi; identical to SEQ ID NO: 32646
  CDS (1)..(1497): transl_table=11

SEQ ID NO: 84160 - protein, 498 aa, Haemophilus ducreyi; identical to SEQ ID NO: 32647

SEQ ID NO: 84161 - DNA, 1557 bp, Helicobacter hepaticus; identical to SEQ ID NO: 32648
  CDS (1)..(1557): transl_table=11

SEQ ID NO: 84162 - protein, 518 aa, Helicobacter hepaticus; identical to SEQ ID NO: 32649

SEQ ID NO: 84163 - DNA, 1485 bp, Lactococcus lactis; identical to SEQ ID NO: 32650
  CDS (1)..(1485): transl_table=11

SEQ ID NO: 84164 - protein, 494 aa, Lactococcus lactis; identical to SEQ ID NO: 32651

SEQ ID NO: 84165 - DNA, 1500 bp, Lactobacillus plantarum; identical to SEQ ID NO: 32652
  CDS (1)..(1500): transl_table=11

SEQ ID NO: 84166 - protein, 499 aa, Lactobacillus plantarum; identical to SEQ ID NO: 32653

SEQ ID NO: 84167 - DNA, 1497 bp, Listeria monocytogenes; identical to SEQ ID NO: 32654
  CDS (1)..(1497): transl_table=11

SEQ ID NO: 84168 - protein, 498 aa, Listeria monocytogenes; identical to SEQ ID NO: 32655

SEQ ID NO: 84169 - DNA, 1767 bp, Lycopersicon esculentum; identical to SEQ ID NO: 32656
  CDS (1)..(1767)

SEQ ID NO: 84170 - protein, 588 aa, Lycopersicon esculentum; identical to SEQ ID NO: 32657

SEQ ID NO: 84171 - DNA, 1512 bp, Neisseria meningitidis; identical to SEQ ID NO: 32658
  CDS (1)..(1512): transl_table=11

SEQ ID NO: 84172 - protein, 503 aa, Neisseria meningitidis; identical to SEQ ID NO: 32659

SEQ ID NO: 84173 - DNA, 1509 bp, Nitrosomonas europaea; identical to SEQ ID NO: 32660
  CDS (1)..(1509): transl_table=11

SEQ ID NO: 84174 - protein, 502 aa, Nitrosomonas europaea; identical to SEQ ID NO: 32661

SEQ ID NO: 84175 - DNA, 1482 bp, Oceanobacillus iheyensis; identical to SEQ ID NO: 32662
  CDS (1)..(1482): transl_table=11

SEQ ID NO: 84176 - protein, 493 aa, Oceanobacillus iheyensis; identical to SEQ ID NO: 32663

SEQ ID NO: 84177 - DNA, 1809 bp, Oryza sativa; identical to SEQ ID NO: 32664
  CDS (1)..(1809)

SEQ ID NO: 84178 - protein, 602 aa, Oryza sativa; identical to SEQ ID NO: 32665

SEQ ID NO: 84179 - DNA, 1506 bp, Pasteurella multocida; identical to SEQ ID NO: 32666
  CDS (1)..(1506): transl_table=11

SEQ ID NO: 84180 - protein, 501 aa, Pasteurella multocida; identical to SEQ ID NO: 32667

SEQ ID NO: 84181 - DNA, 1737 bp, Porphyromonas gingivalis; identical to SEQ ID NO: 32668
  CDS (1)..(1737): transl_table=11

SEQ ID NO: 84182 - protein, 578 aa, Porphyromonas gingivalis; identical to SEQ ID NO: 32669

SEQ ID NO: 84183 - DNA, 1506 bp, Pseudomonas aeruginosa; identical to SEQ ID NO: 32670
  CDS (1)..(1506): transl_table=11

SEQ ID NO: 84184 - protein, 501 aa, Pseudomonas aeruginosa; identical to SEQ ID NO: 32671

SEQ ID NO: 84185 - DNA, 1503 bp, Pseudomonas syringae; identical to SEQ ID NO: 32672
  CDS (1)..(1503): transl_table=11

SEQ ID NO: 84186 - protein, 500 aa, Pseudomonas syringae; identical to SEQ ID NO: 32673

SEQ ID NO: 84187 - DNA, 1533 bp, Ralstonia solanacearum; identical to SEQ ID NO: 32674
  CDS (1)..(1533): transl_table=11

SEQ ID NO: 84188 - protein, 510 aa, Ralstonia solanacearum; identical to SEQ ID NO: 32675

SEQ ID NO: 84189 - DNA, 1497 bp, Rhizobium meliloti; identical to SEQ ID NO: 32676
  CDS (1)..(1497): transl_table=11

SEQ ID NO: 84190 - protein, 498 aa, Rhizobium meliloti; identical to SEQ ID NO: 32677

SEQ ID NO: 84191 - DNA, 1503 bp, Shewanella oneidensis; identical to SEQ ID NO: 32678
  CDS (1)..(1503): transl_table=11

SEQ ID NO: 84192 - protein, 500 aa, Shewanella oneidensis; identical to SEQ ID NO: 32679

SEQ ID NO: 84193 - DNA, 1488 bp, Staphylococcus aureus; identical to SEQ ID NO: 32680
  CDS (1)..(1488): transl_table=11

SEQ ID NO: 84194 - protein, 495 aa, Staphylococcus aureus; identical to SEQ ID NO: 32681

SEQ ID NO: 84195 - DNA, 1485 bp, Sulfolobus solfataricus; identical to SEQ ID NO: 32682
  CDS (1)..(1485): transl_table=11

SEQ ID NO: 84196 - protein, 494 aa, Sulfolobus solfataricus; identical to SEQ ID NO: 32683

SEQ ID NO: 84197 - DNA, 1521 bp, Synechococcus elongatus; identical to SEQ ID NO: 32684
  CDS (1)..(1521): transl_table=11

SEQ ID NO: 84198 - protein, 506 aa, Synechococcus elongatus; identical to SEQ ID NO: 32685

SEQ ID NO: 84199 - DNA, 1509 bp, Synechococcus sp; identical to SEQ ID NO: 32686
  CDS (1)..(1509): transl_table=11

SEQ ID NO: 84200 - protein, 502 aa, Synechococcus sp; identical to SEQ ID NO: 32687

SEQ ID NO: 84201 - DNA, 1509 bp, Thermotoga maritima; identical to SEQ ID NO: 32688
  CDS (1)..(1509): transl_table=11

SEQ ID NO: 84202 - protein, 502 aa, Thermotoga maritima; identical to SEQ ID NO: 32689

SEQ ID NO: 84203 - DNA, 1479 bp, Thermus thermophilus; identical to SEQ ID NO: 32690
  CDS (1)..(1479): transl_table=11

SEQ ID NO: 84204 - protein, 492 aa, Thermus thermophilus; identical to SEQ ID NO: 32691

SEQ ID NO: 84205 - DNA, 1500 bp, Thermoanaerobacter tengcongensis; identical to SEQ ID NO: 32692
  CDS (1)..(1500): transl_table=11

SEQ ID NO: 84206 - protein, 499 aa, Thermoanaerobacter tengcongensis; identical to SEQ ID NO: 32693

SEQ ID NO: 84207 - DNA, 1482 bp, Ureaplasma parvum; identical to SEQ ID NO: 32694
  CDS (1)..(1482): transl_table=4

SEQ ID NO: 84208 - protein, 493 aa, Ureaplasma parvum; identical to SEQ ID NO: 32695

SEQ ID NO: 84209 - DNA, 1518 bp, Vibrio parahaemolyticus; identical to SEQ ID NO: 32696
  CDS (1)..(1518): transl_table=11

SEQ ID NO: 84210 - protein, 505 aa, Vibrio parahaemolyticus; identical to SEQ ID NO: 32697

SEQ ID NO: 84211 - DNA, 1533 bp, Vibrio vulnificus; identical to SEQ ID NO: 32698
  CDS (1)..(1533): transl_table=11

SEQ ID NO: 84212 - protein, 510 aa, Vibrio vulnificus; identical to SEQ ID NO: 32699

SEQ ID NO: 84213 - DNA, 1482 bp, Wigglesworthia glossinidia brevipalpis; identical to SEQ ID NO: 32700
  CDS (1)..(1482): transl_table=11

SEQ ID NO: 84214 - protein, 493 aa, Wigglesworthia glossinidia brevipalpis; identical to SEQ ID NO: 32701

SEQ ID NO: 84215 - DNA, 1524 bp, Wolinella succinogenes; identical to SEQ ID NO: 32702
  CDS (1)..(1524): transl_table=11

SEQ ID NO: 84216 - protein, 507 aa, Wolinella succinogenes; identical to SEQ ID NO: 32703

SEQ ID NO: 84217 - DNA, 1518 bp, Xanthomonas campestris; identical to SEQ ID NO: 32704
  CDS (1)..(1518): transl_table=11

SEQ ID NO: 84218 - protein, 505 aa, Xanthomonas campestris; identical to SEQ ID NO: 32705

SEQ ID NO: 84219 - DNA, 1521 bp, Xylella fastidiosa; identical to SEQ ID NO: 32706
  CDS (1)..(1521): transl_table=11

SEQ ID NO: 84220 - protein, 506 aa, Xylella fastidiosa; identical to SEQ ID NO: 32707

SEQ ID NO: 84221 - DNA, 1518 bp, Yersinia pestis; identical to SEQ ID NO: 32708
  CDS (1)..(1518): transl_table=11

SEQ ID NO: 84222 - protein, 505 aa, Yersinia pestis; identical to SEQ ID NO: 32709

SEQ ID NO: 84223 - DNA, 23 bp, Primer
atgtctgaacaagaaacacgggg

SEQ ID NO: 84224 - DNA, 22 bp, Primer
ttatttctgtgggcgcatcgcc

SEQ ID NO: 84225 - protein, 561 aa, consensus; identical to SEQ ID NO: 32712
  MISC_FEATURE (1)..(561): consensus for the disclosure of xaa see table XV

SEQ ID NO: 84226 - protein, 34 aa, consensus; identical to SEQ ID NO: 32713
  MISC_FEATURE (1)..(34): consensus for the disclosure of xaa see table XV

SEQ ID NO: 84227 - protein, 46 aa, consensus; identical to SEQ ID NO: 32714
  MISC_FEATURE (1)..(46): consensus for the disclosure of xaa see table XV

SEQ ID NO: 84228 - protein, 135 aa, consensus; identical to SEQ ID NO: 32715
  MISC_FEATURE (1)..(135): consensus for the disclosure of xaa see table XV

SEQ ID NO: 84229 - protein, 62 aa, consensus; identical to SEQ ID NO: 32716
  MISC_FEATURE (1)..(62): consensus for the disclosure of xaa see table XV

SEQ ID NO: 84230 - protein, 45 aa, consensus; identical to SEQ ID NO: 32717
  MISC_FEATURE (1)..(45): consensus for the disclosure of xaa see table XV

SEQ ID NO: 84231 - DNA, 741 bp, Escherichia coli
  CDS (1)..(741)
atgttagatcaagtatgccagcttgcacggaatgcaggcgatgccattatgcaggtctacgacgggacgaaaccgatggacgtcgtcagcaaagcggacaattctccggtaacggcagcggatattgccgctcacaccgttatcatggacggtttacgtacgctgacaccggatgttccggtcctttctgaagaagatcctcccggttgggaagtccgtcagcactggcagcgttactggctggtagacccgctggatggtactaaagagtttattaaacgtaatggcgaattcaccgttaacattgcgctcattgaccatggcaaaccgattttaggcgtggtgtatgcgccggtaatgaacgtaatgtacagcgcggcagaaggcaaagcgtggaaagaagagtgcggtgtgcgcaagcagattcaggtccgcgatgcgcgcccgccgctggtggtgatcagccgttcccatgcggatgcggagctgaaagagtatctgcaacagcttggcgaacatcagaccacgtccatcggctcttcgctgaaattctgcctggtggcggaaggacaggcgcagctgtacccgcgcttcggaccaacgaatatttgggacaccgccgctggacatgctgtagctgcagctgccggagcgcacgttcacgactggcagggtaaaccgctggattacactccgcgtgagtcgttcctgaatccggggttcagagtgtctatttactaa

SEQ ID NO: 84232 - protein, 246 aa, Escherichia coli
MLDQVCQLARNAGDAIMQVYDGTKPMDVVSKADNSPVTAADIAAHTVIMDGLRTLTPDVPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAQLYPRFGPTNIWDTAAGHAVAAAAGAHVHDWQGKPLDYTPRESFLNPGFRVSIY

SEQ ID NO: 84233 - DNA, 852 bp, Mesorhizobium loti MAFF303099
  CDS (1)..(852): transl_table=11
atgagcgcgacattgccgaagaccaatatgaaagcggcggcggcatctgacgacaggtcgatgctcgacatcttggagcggctggccctggcggccggacgcgaggtgatgcgcgttttccacgccggctgcgccgtcgaccggaaatcagacgcctcgccggtgaccgaggcggaccgtgagagcgagaagatcattctctccggcctgcgcgccgcatttcccgagattccctgcgtggccgaagaggaagcggcggctggaatcatgccgaccgatctcggcgaggccttcttcctcatcgacccgctcgacggcaccaaggaattcgtcaatcgccgtaccgacttcaccgtcaacatcgcgcttgtccgccatggcgtgccagaagtcggcgtcgtcttcgcgccgtgcaccggccgcttcttttcgggacggccgggcagcgcggaagccctggaaatcgatgacgactatcagatcgtcggccgccggccgatttcggtgagagcggccgcatcaccgctggccgtggttgccagccgctcccacaacacaccggaaaccgaagcctatattcgcgacctaggcgccgccgagatcgtttccgttggctcgtccttgaaattctgtcttctcgccagcgccgaggcggatgtctatccgcggttcggccgcaccatggaatgggacaccgcggcgggcgacgcggtgctgcgcgcggcgggcggcacgacacgtacgctggacggcaagcccttggcctacggcaaacgcgaccaggccgacgacgaggatttcgccaacccgcatttcatcgccagcggcagggcaggggcaatccccgcctga

SEQ ID NO: 84234 - protein, 283 aa, Mesorhizobium loti MAFF303099
MSATLPKTNMKAAAASDDRSMLDILERLALAAGREVMRVFHAGCAVDRKSDASPVTEADRESEKIILSGLRAAFPEIPCVAEEEAAAGIMPTDLGEAFFLIDPLDGTKEFVNRRTDFTVNIALVRHGVPEVGVVFAPCTGRFFSGRPGSAEALEIDDDYQIVGRRPISVRAAASPLAVVASRSHNTPETEAYIRDLGAAEIVSVGSSLKFCLLASAEADVYPRFGRTMEWDTAAGDAVLRAAGGTTRTLDGKPLAYGKRDQADDEDFANPHFIASGRAGAIPA

SEQ ID NO: 84235 - DNA, 1041 bp, Arabidopsis thaliana
  CDS (1)..(1041)
atgttagctcagtcgcacttcttctctaagtccttcgatctgattccgccacagtctccggcgttgcggtctgcaaatccttctcttcgtatctcttcttcttatagtaacagccgcttatcctttctttcttcttctgcaattgctgttcccgtctcccgccgtcggttttgcctgactatggcttcaaactcaaaacggcctaacataagcaacgagtctccttcggaacttagcgacactgagctggatcgattcgccgctgtgggaaatgcattagctgacgcttccggcgaggttatcagaaagtatttccggaagaaattcgacattgttgataaagatgatatgagccctgttacaatcgctgatcaaatggctgaagaggcaatggtttccattatattccagaatctcccttctcatgctatatatggtgaggagaagggttggagatgcaaagaggaatctgcagactatgtttgggttttggacccaatcgacggaacaaagagctttattacagggaaacccgtgtttggtacgctgattgctctgctctacaaaggtaaaccgattctaggactgattgatcagcctattctaaaagagagatggataggaatgaatggaagaagaactaaactaaacggggaggatatctcaacgcgatcttgccccaaattatcacaagcatatttatacaccactagcccacatcttttcagtgaagaggcagaaaaggcatattctcgagttagagacaaggtgaaagtgcccttatacggctgtgattgttatgcttacgctctcctggcttctggatttgtcgatcttgttattgaatccggtctaaagccatatgatttccttgctctggtgcctgtaatagaaggcgctggaggtaccataaccgattggactggtaaacgatttctgtgggaagcttcatccagtgcagttgcgacaagctttaatgtagttgcagcaggagattcagacattcatcagcaggctttggagtcacttgagtggcattga

SEQ ID NO: 84236 - protein, 346 aa, Arabidopsis thaliana
MLAQSHFFSKSFDLIPPQSPALRSANPSLRISSSYSNSRLSFLSSSAIAVPVSRRRFCLTMASNSKRPNISNESPSELSDTELDRFAAVGNALADASGEVIRKYFRKKFDIVDKDDMSPVTIADQMAEEAMVSIIFQNLPSHAIYGEEKGWRCKEESADYVWVLDPIDGTKSFITGKPVFGTLIALLYKGKPILGLIDQPILKERWIGMNGRRTKLNGEDISTRSCPKLSQAYLYTTSPHLFSEEAEKAYSRVRDKVKVPLYGCDCYAYALLASGFVDLVIESGLKPYDFLALVPVIEGAGGTITDWTGKRFLWEASSSAVATSFNVVAAGDSDIHQQALESLEWH

SEQ ID NO: 84237 - DNA, 807 bp, Aquifex aeolicus VF5
  CDS (1)..(807): transl_table=11
atgttagaaaaggtgattaaagcctgcaaaaaagcaggtgaggaaattttagaagtttactcaaaggagttcacagttgaagaaaaggaagacaggactcccgttacggaagcggacagaagggctcacagaataataacggaagagttaaaggaaactagaatacctgtactctcggaagagggaaaggaaattccttttaaagagagaagaaaatggaaaaggttctggctcgttgatccactggacgggacgaaggagtttataaagaagaacggagagtttaccgtaaacgtagccctcgtagaggaaggagaacctgttctcggagtagtttacgcacctgccttagaagtgctttactttgccgagaaagggaacggagcttacagagaggtaaagggaaaaatggaaaaacttcccattggaaattggagtagggaaaacctcagggtcgtggcttcccgttcccacatgaacgaagaaaccaagaaattcctcgaaaatttagaaaagaaatttggtaaactccagttcctttcaaagggcagttcactaaagatatgtatggttgcggaaggaagtgcggatatatatccgagaattgccccaactatggagtgggacacgggagcggggcatgccgtagcaaaagaggcgggctgtgaactcttcgtttacgaagagggaaaactcagagaacctttgaggtacaacaaggaagacttgagaaatcccagttttgtttgtttatctttagaaatcaaggaattggtggaggcgacgggcggattcgaaccgccgtaa

SEQ ID NO: 84238 - protein, 268 aa, Aquifex aeolicus VF5
MLEKVIKACKKAGEEILEVYSKEFTVEEKEDRTPVTEADRRAHRIITEELKETRIPVLSEEGKEIPFKERRKWKRFWLVDPLDGTKEFIKKNGEFTVNVALVEEGEPVLGVVYAPALEVLYFAEKGNGAYREVKGKMEKLPIGNWSRENLRVVASRSHMNEETKKFLENLEKKFGKLQFLSKGSSLKICMVAEGSADIYPRIAPTMEWDTGAGHAVAKEAGCELFVYEEGKLREPLRYNKEDLRNPSFVCLSLEIKELVEATGGFEPP

SEQ ID NO: 84239 - DNA, 699 bp, Thermotoga maritima MSB8
  CDS (1)..(699): transl_table=11
gtggacaacgtcgagaaaaaaaccggtttcaaggacatagtcacagagatagacagagaagcccagagaatgatagtcgatgagataagaaaattcttccctgacgaaaacatcatggccgaagaaggaatattcgaaaaaggagacaggctctggataatagacccgatagatggaacgataaacttcgttcacggccttccgaacttttccatctctttggcctacgttgaaaacggagaagtcaagctaggggtcgtccacgcccctgctctcaacgaaacactctacgctgaggaaggaagcggtgccttcttcaacggtgagagaatcagagtgtctgagaacgccagcctcgaagagtgtgttggttccactggtagctacgtggatttcaccgggaaattcatcgagaggatggaaaagaggaccagaaggattcggattcttggaagtgccgcgctgaacgccgcttacgttggtgcaggaagggttgactttttcgtcacctggaggataaatccctgggatatagcagccggtctgataatcgtgaaggaagcgggaggaatggtcacggatttctccggaaaggaagcaaacgctttctcgaagaatttcatcttctcgaacgggttgatccacgatgaagtggtgaaagttgttaacgaggtggtagaagaaataggaggaaagtga

SEQ ID NO: 84240 - protein, 232 aa, Thermotoga maritima MSB8
MDNVEKKTGFKDIVTEIDREAQRMIVDEIRKFFPDENIMAEEGIFEKGDRLWIIDPIDGTINFVHGLPNFSISLAYVENGEVKLGVVHAPALNETLYAEEGSGAFFNGERIRVSENASLEECVGSTGSYVDFTGKFIERMEKRTRRIRILGSAALNAAYVGAGRVDFFVTWRINPWDIAAGLIIVKEAGGMVTDFSGKEANAFSKNFIFSNGLIHDEVVKVVNEVVEEIGGK

SEQ ID NO: 84241 - DNA, 828 bp, Pasteurella multocida subsp. multocida str. Pm70
  CDS (1)..(828): transl_table=11
atgttagcactttcaccatcattacttgaaaaaacacttgaaatcgcggatcaagcaggggattttttaacgcgattttataccgactcagggcaaaatgcgttagcaattcaaaccaaacaagataacacgccagtgactgccgtggatttatttttgagtcaatttttaattgaaaaattgacctcactgacacctgaggtcccgattctttccgaagagagttgtaaaatccccttacaagatcgtgcacattgggcagaatattggttaattgacccactcgatggaacccaacaatttattaatcgcaccgatcaattttccattttgattacacttgtccaacacaatcaacccgtcttaagcattacccatgcccctattttacaaacgacctattatgctatgcagggctttggtgcttacagaagacagggcaatcaacaagaaaagctaaacaaccaagcgcgacctgagcagcgaaaaatcaaaattgctgtgggagtcgggggcgttgaacggaaaattcagcccttgttaaatccagcttatcaatatgaatttttggtttatggttcaagtggcttaaaaggcggcttagtagccgatggcacttgtgattgctatattcgagtaggaaaaacgggtgaatgggatacgggggcggctgaaatcctcttacgtgaaatgggaggtgctgtgtttgactttgcttttcaaccgcttagctataatcagagagaaagttttattaatcccaattttgtgatggtggcgaatacagaatttgattggcagaaaatttttcaatttcattcgcactag

SEQ ID NO: 84242 - protein, 275 aa, Pasteurella multocida subsp. multocida str. Pm70
MLALSPSLLEKTLEIADQAGDFLTRFYTDSGQNALAIQTKQDNTPVTAVDLFLSQFLIEKLTSLTPEVPILSEESCKIPLQDRAHWAEYWLIDPLDGTQQFINRTDQFSILITLVQHNQPVLSITHAPILQTTYYAMQGFGAYRRQGNQQEKLNNQARPEQRKIKIAVGVGGVERKIQPLLNPAYQYEFLVYGSSGLKGGLVADGTCDCYIRVGKTGEWDTGAAEILLREMGGAVFDFAFQPLSYNQRESFINPNFVMVANTEFDWQKIFQFHSH

SEQ ID NO: 84243 - DNA, 1008 bp, Deinococcus radiodurans R1
  CDS (1)..(1008): transl_table=11
atgctttacgcccccgaactgcaaaccgccgtccgcctcgcccgtgaggcgggcgcgttgctgttgcgtcaccgcgccgccgggctgaccgtagaacacaaaaccagcgccgacgaccccgtgacggcggcagaccgcgaggcgtcggcgctgattgtggcgggcctgcatgccgcttttccaggtgatggcctgctcagcgaggaggaagtggactcgcctggacgcctgcggcacgagcgggtgtggattatcgaccccatcgacggcaccaaggaattcaccaccggcagccccgacttttgcgtgagcatcggcctcgcggtgcgcggtgaggcagtgatgggcgtggtctatgccccggccaccgacgaactgttcagcggcgtggtgggggagggggtgcagaaaaacagcgaacctgtcgagccatctacgcctaccactttccgcctgagcgtgtccgacaccgagtaccagcgcgaactgcaccgccacgacatccccggcatgttcccgagcggttccatcgccctcaagctggcgcgcatggcggcgggcgaggccgacgcgaccttttccatgtccccccgcgccgagtgggacatctgcgcgggcgacgccctactgagggcggcgggcggcgaactgcggcggcgcgacgggcggcccatcgtctacaacgcgccgcgccccagcctggaacagggcatcatcggcggcaccccggcggcgctggcgtggctcgaagaccaattgcgcgcccaccacctgcccaccgcccacctcggcctgacgccgcaagaccccgcctgggccgtgctgagcgacgctgaccgcaccgaactggccggccaccccggcgtctgcgtgcgctacagcggctccgacctgctcgccctgcttgtcatagacccccagacccacaccgtccagcgcgccgagggcgacgcccaccacctcgaccgcctgaccagagacgtggtgcgcgctggactggtcaagtga

SEQ ID NO: 84244 - protein, 335 aa, Deinococcus radiodurans R1
MLYAPELQTAVRLAREAGALLLRHRAAGLTVEHKTSADDPVTAADREASALIVAGLHAAFPGDGLLSEEEVDSPGRLRHERVWIIDPIDGTKEFTTGSPDFCVSIGLAVRGEAVMGVVYAPATDELFSGVVGEGVQKNSEPVEPSTPTTFRLSVSDTEYQRELHRHDIPGMFPSGSIALKLARMAAGEADATFSMSPRAEWDICAGDALLRAAGGELRRRDGRPIVYNAPRPSLEQGIIGGTPAALAWLEDQLRAHHLPTAHLGLTPQDPAWAVLSDADRTELAGHPGVCVRYSGSDLLALLVIDPQTHTVQRAEGDAHHLDRLTRDVVRAGLVK

SEQ ID NO: 84245 - DNA, 789 bp, Agrobacterium tumefaciens str. C58
  CDS (1)..(789): transl_table=11
atgatcgacatattgacgaaagcggcgcttgacgccggacaggcgatcatggtggttcaccgcgccggcccgcatgtgtcctataaggacgactgctcgccggtaaccgaagccgatcagcgcgccgagacgattattctcgaggcgctggctgcccatttccctgaaattcccgtggttgccgaagaggccgtgtcgaacggcatcctgccggaaaccggggcggagttctttctggtcgatccgcttgacggcacgaaggaattcatttccggcaaggacgatttcaccgtcaatatagcgctcatccgcaatggcgtgccggtggcaggcgttgtctacgccccctgtcgcggccaggcatggacgggcaaggacaacgccgccgaaaagctcgcaatatcaggcgacggcgcgatcctgtcgcgccaccccatccgggcccgccgacgcggcgcttcgcctgtggcgctgatcagccgctcgcattgcacggcaaagacggaagccttcgtggccgaacacgggctgaaagactgtatctcggtcggttcatcactgaaattctgcatgctggcggagggtgccgccgatatctacccccgcttcagccgcaccatgatgtgggacaccgccgccggcgacgccgtactgcgtgccgcaggcggccggacactcgattgcgacgggcagcttcttgcctatgaagttaggggcgacggcgaggatgcgctggccaatccggattttattgccgagggagcgatggcggtggagcaggccgggtaa

SEQ ID NO: 84246 - protein, 262 aa, Agrobacterium tumefaciens str. C58
MIDILTKAALDAGQAIMVVHRAGPHVSYKDDCSPVTEADQRAETIILEALAAHFPEIPVVAEEAVSNGILPETGAEFFLVDPLDGTKEFISGKDDFTVNIALIRNGVPVAGVVYAPCRGQAWTGKDNAAEKLAISGDGAILSRHPIRARRRGASPVALISRSHCTAKTEAFVAEHGLKDCISVGSSLKFCMLAEGAADIYPRFSRTMMWDTAAGDAVLRAAGGRTLDCDGQLLAYEVRGDGEDALANPDFIAEGAMAVEQAG

SEQ ID NO: 84247 - DNA, 819 bp, Sinorhizobium meliloti 1021
  CDS (1)..(819): transl_table=11
atgtcagaaacagccctttcgatcctcccggcctgggacgaggacctcgaactcattcttactgctgcagtcgcggcgggcgacactgcgctcggctatttccgcaagacgctggacgtccgctggaaaaatgagggccgttccccggtgagcgaggccgacctcgccgccaacgacatcctcaaggggcggctgctcggtgcacggccggactatggctggctttcggaggagaccgacgacgacgaaagccgcctcgtccgcgagaccgtctttgtcgtcgatcccatcgacggcacccgggccttcatcgccggcaaggatctctggtgcgtcagcgtcgccatcgtccaccgtggccagcctgtggccggcgttctctatgcgccctccctcaacgagatattccaggcgacccgcgatggcgaagcgcggaagaacggcaaggcgattgccgtgcgggaggcggaatccggcgcggtgctgaaggtggcggcggccgaggatgtcatgggcaggctggcattaccctatcgcaacacgatgatgcgcgtctcgcacgtaccgtcgctcgcctatcgtcttgcgatgatcgcggatggccgcatcgacggtacgatcgtcaagcggaattcgcacgattgggatttagcggccgccgacctcatcctttcgcgcgccggcggggcgctttgcggtctcgatggcgagcccctgtcctacaaccgcccgactgtcacccacggcgttctgggggccgcctcgggaaccgcgctgccggcattgctcgccgcctccaggccgcttgagccccattga

SEQ ID NO: 84248 - protein, 272 aa, Sinorhizobium meliloti 1021
MSETALSILPAWDEDLELILTAAVAAGDTALGYFRKTLDVRWKNEGRSPVSEADLAANDILKGRLLGARPDYGWLSEETDDDESRLVRETVFVVDPIDGTRAFIAGKDLWCVSVAIVHRGQPVAGVLYAPSLNEIFQATRDGEARKNGKAIAVREAESGAVLKVAAAEDVMGRLALPYRNTMMRVSHVPSLAYRLAMIADGRIDGTIVKRNSHDWDLAAADLILSRAGGALCGLDGEPLSYNRPTVTHGVLGAASGTALPALLAASRPLEPH

SEQ ID NO: 84249 - DNA, 777 bp, Sinorhizobium meliloti 1021
  CDS (1)..(777): transl_table=11
atgctggacatactggaaacatcggcactcgccgccggacaagccatcctggaaatttaccgtgccggtccggctgtcacctacaaggctgacgcctcgcccgtgaccgatgcggaccatcgtgccgagcggatcatccttgccgatctggcggccgcctttccggatattccgatcgtcgcggaggaggaggtcgccgcaggtcgcgttcccgatatcgccggaaagcggttcttcctcgtcgacccgctggacggcacgaaggaattcgtcgaacgcaacagccatttcaccgtgaatatcgggctcgtagaaaacggtgcacccgtcgtcggtgtcgtctatgcaccggctctcggcctcatctattcggcggccgccggcatggcgaagaaggcggtggtcgaggatggacaggtcacgggcgaatggaccaccatcggctgccgccgttgcggcgaccggccgatggcgcttaccagccgctggcacaacagccccgagacgatctccttcctcaccgatcagggcatcagcgatcatgaggccgtcggctcatcgctgaagttttgcctgctggccgaaggcattgcggacatctatccgcgcttcagccggacgatggagtgggacaccgcggcgggcgacgcgatcctaaggtcggcaggcggtgaaacactgacgatggcgggcaatccgcttggctacggcaagcgcaatcaatcggatgacagcgacttcgccaatccctggttcatctcgcgcggcaaggcgtga

SEQ ID NO: 84250 - protein, 258 aa, Sinorhizobium meliloti 1021
MLDILETSALAAGQAILEIYRAGPAVTYKADASPVTDADHRAERIILADLAAAFPDIPIVAEEEVAAGRVPDIAGKRFFLVDPLDGTKEFVERNSHFTVNIGLVENGAPVVGVVYAPALGLIYSAAAGMAKKAVVEDGQVTGEWTTIGCRRCGDRPMALTSRWHNSPETISFLTDQGISDHEAVGSSLKFCLLAEGIADIYPRFSRTMEWDTAAGDAILRSAGGETLTMAGNPLGYGKRNQSDDSDFANPWFISRGKA

SEQ ID NO: 84251 - DNA, 780 bp, Caulobacter crescentus CB15
  CDS (1)..(780): transl_table=11
atgaacgacctggacctgatcatcgccgcagcgcgggaggcgggcgaactggcgctcggcgcgcgcgagagcggcctgacgatctggtccaaggaaggcggctcgccggtgacggacgccgacctcgccgtcgacaccctgctgcgcaccgaactgcgcgccgaacgccccgactatggctggctgtcggaagagaccgccgacgacccggcgcgtctggcgaccggacgacagttcgtggtcgatccgatcgacggcacggtcgccttcatgaagggcaagccctggtttgcagtgtcgatcgccgtggtcgaggacggccagcccatcgccgccgtggtccacgccccggccctggacgagacctacgccgccaccctgcaggggccggccactctgaacggcgcgccgatcgcccccagcgatacggacgccctggaaggcgcggccatgctgggcgacgccaagatgttcgcccaccccgcctggcgcgagccgtggcccacgatgcggatcgagacccgcaactcgatcgcctatcgggcgtgcctcgtcgccgccggcgcgttcgacgccgccgtggcgctgtcccccaaaagcgagtgggacgtggcggccgccgacctgatctgccagcgcgccggcgcggcgctcagtgatcacaagggccgcccctacgcctataatcggcccgttccgcaggttccgagcctggtttgcgccaatcgcgcgcttgcgccattgatccttaaccgtgtcgggcatatcgagctgccataa

SEQ ID NO: 84252 - protein, 259 aa, Caulobacter crescentus CB15
MNDLDLIIAAAREAGELALGARESGLTIWSKEGGSPVTDADLAVDTLLRTELRAERPDYGWLSEETADDPARLATGRQFVVDPIDGTVAFMKGKPWFAVSIAVVEDGQPIAAVVHAPALDETYAATLQGPATLNGAPIAPSDTDALEGAAMLGDAKMFAHPAWREPWPTMRIETRNSIAYRACLVAAGAFDAAVALSPKSEWDVAAADLICQRAGAALSDHKGRPYAYNRPVPQVPSLVCANRALAPLILNRVGHIELP

SEQ ID NO: 84253 - DNA, 798 bp, Caulobacter crescentus CB15
  CDS (1)..(798): transl_table=11
atgagcgacgataagcggacggttcaagatctcgcggactggggcaggaccctcgccaagatcaccgaggaggccgccgtggtcatcctgccgttctggcgcaccgaactggccgtcgcccagaaggccgacgagagcccggtgaccgaggccgatcgcgccggcgagcgcctgatcctggagcgcctggcggcgctctaccccgctatcccggtgatctcggaagaagacgccagcgagttcggtacgcccgagtccgtcggaccgcgtttctttctggttgatccggtcgacggcactaaggccttcgtgcgcggcgatccgaacttcacggtcaatatcggcctgattgagcacggcgttccggtcgcgggcgcggtctgcgccccggccaccggcgaggtgtggttcaccacggctgacggcgccgccaagcgcgctggacccgacgcggctgaggcgccgatccgggttcgtccctggccgaccggtcaggcgctgggcctgatcagccacaccatgcgcgaggaaaaggccacggagttggccgccgagtacggctttgacctgcgcacgccgatggacagctcaatcaagatgtgccggatcgccgaaggctcggccgacatctatccgcgccacggcccgacctcggagtgggacaccgccgccggccacgccgtgctggtcgccgcgggcggcgccttcacccagcccgacggttcgccgttcctctatggcaaggccgaccagagcttccgcaacggctggttcgtcgcacgcggcggacgaccctag

SEQ ID NO: 84254 - protein, 265 aa, Caulobacter crescentus CB15
MSDDKRTVQDLADWGRTLAKITEEAAVVILPFWRTELAVAQKADESPVTEADRAGERLILERLAALYPAIPVISEEDASEFGTPESVGPRFFLVDPVDGTKAFVRGDPNFTVNIGLIEHGVPVAGAVCAPATGEVWFTTADGAAKRAGPDAAEAPIRVRPWPTGQALGLISHTMREEKATELAAEYGFDLRTPMDSSIKMCRIAEGSADIYPRHGPTSEWDTAAGHAVLVAAGGAFTQPDGSPFLYGKADQSFRNGWFVARGGRP

SEQ ID NO: 84255 - DNA, 876 bp, Synechocystis sp. PCC 6803
  CDS (1)..(876): transl_table=11
atggtcataagcgagcttttacccaacctagattccggcttaactactctccgcaccgccggctggggcgcaatggaaattcttcagtcctactacagtggccagaatcagaccaatttaaatgccaacgaagataaacaggatggccccgtaacagcggcggatttggcggccaatcaatatattttggctactttgcaagctacctttaacccggaagaatttggctatctaagcgaagaaacccaccagggcaacgaaccattaccccaggattgggtttggattattgaccccctcgatggcaccagggacttcattgataaaaccggggaatatgccctgcatattgctttgacctatcgccagcggccggtgttggccctagtgggcatgccggaagcccaaaagctttactatgccatccaaggtcagggctgttttcgagaaaccaaagccggggcaataaccccagtgaaggtgaagcctaaaactgaattagaatctttaaccctagtagtgagccgtagccatcgggaccaacgtttccaagatttgattgaccgtttaccctttggcgatcgccattatgtgggcagtgtgggctgtaaaatcgtcacgattttggagggacagagcgatgtgtacatttccctctccggtaaatccgccgctaaggattgggactttgcggccccggagttgattctcaccgaagcggggggagagtttacctattttgaccagacccctgtgttgtataaccggggcgacgtgcggcaatggggcggtatcctggctagcaatggttcccaccatggagctttgtgtgagcaagccgtggaaattttagctgaactagatcaaaataattaa

SEQ ID NO: 84256 - protein, 291 aa, Synechocystis sp. PCC 6803
MVISELLPNLDSGLTTLRTAGWGAMEILQSYYSGQNQTNLNANEDKQDGPVTAADLAANQYILATLQATFNPEEFGYLSEETHQGNEPLPQDWVWIIDPLDGTRDFIDKTGEYALHIALTYRQRPVLALVGMPEAQKLYYAIQGQGCFRETKAGAITPVKVKPKTELESLTLVVSRSHRDQRFQDLIDRLPFGDRHYVGSVGCKIVTILEGQSDVYISLSGKSAAKDWDFAAPELILTEAGGEFTYFDQTPVLYNRGDVRQWGGILASNGSHHGALCEQAVEILAELDQNN

SEQ ID NO: 84257 - DNA, 813 bp, Ralstonia solanacearum GMI1000
  CDS (1)..(813): transl_table=11
atgcatccgatgctcaatatcgccgtcaaggctgcccgcaaagccgggaccgtcatcaatcgcgccacgctccagggcgattcccggcagatcgagcgcaaacaacacaacgatttcgtcaccgacgtcgatcgcgcggccgaagccacgatcatcgagatcatcaagacagcgtatccggatcacgcgattctagcggaagagtccggtcgctcctgggccgacggcgaaaccgccagcgaaaacgtctgggtgatcgacccgctggacggcaccaccaacttcatccacggcttcccgcaattcgcggtgtcgatcgcgctgatgcagcgcaacgtcgtcacccaggccgtggtctacgacccgacccgcgacgaactgttcaccgcctccaagggcgcgggcgccttcctcaacaaccgccgcatccgcgtcacgcgccgcgacaagctggccgactgcctgatcggcaccggcttcccctaccgcgacatggaaggcctggacgactacgtcaagctgttcgccaccatgaccgagaactgcgccggcctgcgccgcccgggcgccgccgcgctggacctggcctatgtggccagcggccgcctcgacggcttcttcgagcagggcctcaacgcgtgggacatggctgcgggctcgctgctgatcaccgaggccggcggcctggtgggcaactactgcggcgaggccggctacctggaccagggcgagatcctggccggcaacccgaaggccttcgtgcagatgatcaagctgaccacgccgttctcgcgctcgcaggccgtggtctga

SEQ ID NO: 84258 - protein, 270 aa, Ralstonia solanacearum GMI1000
MHPMLNIAVKAARKAGTVINRATLQGDSRQIERKQHNDFVTDVDRAAEATIIEIIKTAYPDHAILAEESGRSWADGETASENVWVIDPLDGTTNFIHGFPQFAVSIALMQRNVVTQAVVYDPTRDELFTASKGAGAFLNNRRIRVTRRDKLADCLIGTGFPYRDMEGLDDYVKLFATMTENCAGLRRPGAAALDLAYVASGRLDGFFEQGLNAWDMAAGSLLITEAGGLVGNYCGEAGYLDQGEILAGNPKAFVQMIKLTTPFSRSQAVV

SEQ ID NO: 84259 - DNA, 807 bp, Agrobacterium tumefaciens str. C58
  CDS (1)..(807): transl_table=11
atgaacgatatggctgaggcccgctgggcctccgatttgaggctggttctcggagccgcccgcaaggcgggcgagacggcgctgggtttcttccgcaaggaccccgaggtctggtggaagaatggcgggctttcgccggtcagcgcggcggattatgccgccaacgacattctcgcaaccattcttcgctccgcccggcctgactatggctggctttccgaggagacggatgacgatacggagaggctgtcgcgctccaccgtcttcgtcgtcgatcccattgacggaacccgcgccttcatcggcggtcgggatacctggtgcgtcagcgttgcggtggtccatgagggtcggccggtcgtcggcgtgctcgtcgcgccggcgctggcggaggagttcaccgcggtggaaggcggcatggcgttgaagaacggagccgccatctcggcaacccgtgacaatggcggaaccttccatcttgccgcagcggcggaagcgatcgcgcacctgccggaagcgttgcgcaacaccgtcgagcgcattccgcacgtcccttcgcttgcctaccggctggcgatggtagcggatggccgcatcgatggaacgctggtcaaggcgaactcgcatgagtgggatctcgccgccgccgatctcatccttgagcggtccggcggccagcttgtcggcctcgatggcaaacctctgatgtataatcgccgcgaggtgaaccaccccgcattgtgcgccgcagcagattatgcgctgcctgcacttttgaaagcgttttcacatctgtctgacggttga

SEQ ID NO: 84260 - protein, 268 aa, Agrobacterium tumefaciens str. C58
MNDMAEARWASDLRLVLGAARKAGETALGFFRKDPEVWWKNGGLSPVSAADYAANDILATILRSARPDYGWLSEETDDDTERLSRSTVFVVDPIDGTRAFIGGRDTWCVSVAVVHEGRPVVGVLVAPALAEEFTAVEGGMALKNGAAISATRDNGGTFHLAAAAEAIAHLPEALRNTVERIPHVPSLAYRLAMVADGRIDGTLVKANSHEWDLAAADLILERSGGQLVGLDGKPLMYNRREVNHPALCAAADYALPALLKAFSHLSDG

SEQ ID NO: 84261 - DNA, 819 bp, Agrobacterium tumefaciens str. C58
  CDS (1)..(819): transl_table=11
atggctgatcgggacacatcgacctctcacgcaggagaaacagcttcgattgtggaagagatcgcgcgcaaggcaggcgaccttgccctcgctcatttccgctccctatcgagcctgtcggtcgagaccaagggacatctcgatcttgtgacgaaggcggacaaggaggtcgaaacatttcttatcgcgcagttgcgggaggcgtttcccgcagacggcatatttggagaagaagggggcgaaatcaaagggcgttcaggtcgtatctgggtgatcgatccgattgatggaacattcaatttcgtccgcggcggtcagaactgggcaatttccatcggtctctatgaaaacaagcgtcctacattcggggttatcttcgctccagtccgaaacctgatgtttgttggagggaaaacggtggagacgaagctcaacggcatggcggtcaagccacttccgccgctcgatatgtcgcgtgcatcgaccgggttcagctaccatccttcggcttcgacagcggacaggctcgaagtcatccgttatatctcggatgatctcaatatcagcttccgtttctgcggcgctgcgacactctcgatggtcgaggtggccatgggcgagacagatggctacgtttcattgggagactcgacgtgggacgttatggcagcgttgcctattttgagcaatctgggtgttgcggatacgatcgactgggacaggaccgacttgtcggccaaactccggtttgcttgtggcagccacgacttcctggagaaggtgaagccgttgctcgataaagtggcgctggccgcataa

SEQ ID NO: 84262 - protein, 272 aa, Agrobacterium tumefaciens str. C58
MADRDTSTSHAGETASIVEEIARKAGDLALAHFRSLSSLSVETKGHLDLVTKADKEVETFLIAQLREAFPADGIFGEEGGEIKGRSGRIWVIDPIDGTFNFVRGGQNWAISIGLYENKRPTFGVIFAPVRNLMFVGGKTVETKLNGMAVKPLPPLDMSRASTGFSYHPSASTADRLEVIRYISDDLNISFRFCGAATLSMVEVAMGETDGYVSLGDSTWDVMAALPILSNLGVADTIDWDRTDLSAKLRFACGSHDFLEKVKPLLDKVALAA

SEQ ID NO: 84263 - DNA, 846 bp, Brucella melitensis 16M
  CDS (1)..(846): transl_table=11
atgaaaatttccgcctctccaaaagcaggccttgatggcacagccttgcgagccgtccttcgcgacgctgcgcttgaggctggccgcagcatcatgaagcattatgtcaatggatgcgcggtgcagagcaagaaggatgcctcgcccgtaaccgaggcggatcacgcagcggaagccattattcttgcggccctgtcgtcggcctgccccgatgtgccggtggtggcggaggaagaagttgcagcagggcgcttgccggatcatctggggcgcaaattccttctggtcgatccgctggacggaacccgggaattcctgctgcgcaacggcgattttacggtcaatatcggccttgtcgaagagggcgcgccagtactgggtatcgtctatgcaccggcccgcaatctgctgtttatcggtagcgatgcgggtgcatgggcaatggaaaccacaccggaccatggcgcaggccaggaccagcggatttttgcgcgggtttcgcccgccgaaaaagtggctgtctgtagccgctcgcacctgacgcctgaaaccgaacgatttctcgctgaaaaccgcatcgcaagcagcgtttcggttggttcctcgcttaaattctgcattcttgccaagggtgaggcggatatttatccgcgtttcggcccgacgatggaatgggacacggcggcgggcgatgcggtgctgcgcgcggcgggcggcatgaccgccactctcgacggcaggccgatgatctatggccagcgcctccgtgcaggggcggcgggtttcgccaatcccgatttcgtggcctatggggcgggtgaggcgcctgttttcaccacggcctga

SEQ ID NO: 84264 - protein, 281 aa, Brucella melitensis 16M
MKISASPKAGLDGTALRAVLRDAALEAGRSIMKHYVNGCAVQSKKDASPVTEADHAAEAIILAALSSACPDVPVVAEEEVAAGRLPDHLGRKFLLVDPLDGTREFLLRNGDFTVNIGLVEEGAPVLGIVYAPARNLLFIGSDAGAWAMETTPDHGAGQDQRIFARVSPAEKVAVCSRSHLTPETERFLAENRIASSVSVGSSLKFCILAKGEADIYPRFGPTMEWDTAAGDAVLRAAGGMTATLDGRPMIYGQRLRAGAAGFANPDFVAYGAGEAPVFTTA

SEQ ID NO: 84265 - DNA, 1068 bp, Drosophila melanogaster
  CDS (1)..(1068)
atgagcgaagacaagatgaacggacgctccattcgcatcaaccggctgccggccaccattgtggccatcctgctgacctttgtcctggtctacttcctcaatttccatcaggaggagcggccagcgatctacggcatgctgcgcagtgagaatcccagccgcgtcaatctacgcaagatgctaatagccgccatacaggccgcccagcgtggcggtctcgaggtactggacgtggcccggagtcgccagctgaaggagcgcagcaagggcaagacggacgagggcgtcaatgatcccttcacggatgccgacggccggtcacattgtgtgatgaagcagggcctgcagcgaatctttccccgcgtacaaatcttctccgaggaggacaaggagcactgcaagcaggcacacggctatgatctagatccaacggtcctccacgagaccgcacagataccggatgtgaccgtaaatgcccaggatgtcactgtttgggtagatccgttggatgccaccaaggagttcaccgaggagctatacgagtacgtgaccaccatggtgtgcgtggcagtggccggaaggcccatcattggcgtgatccacagcccgttcaatggacaaaccgcgtgggcgtgggtgggcaactcgatgtctgagtacctatccaatctgcatccgcagcattcgccaaacaatcaggcgcccatcattacagtctcgcgatcccacacggcaggtgccaaggatctggcgaggggcatctttggcgagaatgtcagcctgctgacggcggcgggagctggctacaaggtgctccaggtggtggccaacaatgccaccgcctatttgcacacgtcgaagatcaagaagtgggacatttgcgccggcgatgctattctgcacgcattgggcggcacaatgaccacgctgaacgatcagttgattaactacggaccagaggaatcgccagtcaatacggagggcctgctggccaccttggagcagcatgacgagtacatggacaagctgtccaaatatcgcgaggcgcacaatggcaagctggcgtag

SEQ ID NO: 84266 - protein, 355 aa, Drosophila melanogaster
MSEDKMNGRSIRINRLPATIVAILLTFVLVYFLNFHQEERPAIYGMLRSENPSRVNLRKMLIAAIQAAQRGGLEVLDVARSRQLKERSKGKTDEGVNDPFTDADGRSHCVMKQGLQRIFPRVQIFSEEDKEHCKQAHGYDLDPTVLHETAQIPDVTVNAQDVTVWVDPLDATKEFTEELYEYVTTMVCVAVAGRPIIGVIHSPFNGQTAWAWVGNSMSEYLSNLHPQHSPNNQAPIITVSRSHTAGAKDLARGIFGENVSLLTAAGAGYKVLQVVANNATAYLHTSKIKKWDICAGDAILHALGGTMTTLNDQLINYGPEESPVNTEGLLATLEQHDEYMDKLSKYREAHNGKLA

SEQ ID NO: 84267 - DNA, 783 bp, Corynebacterium glutamicum ATCC 13032
  CDS (1)..(783): transl_table=11
atgagcaaatatgcagacgatttagccttagccctcgaacttgccgaacttgccgattccatcaccctcgaccgcttcgaagcctctgacctggaagtatcctccaagccagacatgactcccgtcagcgatgccgacctggcgaccgaagaagcactccgtgagaaaatcgccaccgcccgccccgccgactccatcctcggtgaagaattcggtggcgacgtagaattcagcggccgccagtggatcatcgaccccatcgacggcaccaaaaactacgtccgcggcgtccccgtatgggcaaccctgatcgcgctgctcgacaacggcaaacccgtcgcaggtgtcatctccgcacccgcactggctaggcgttggtgggcatccgaaggggccggcgcatggcgcaccttcaacggcagctccccacgcaaactgtccgtgtcccaggtgtccaagcttgacgacgcctccctctccttctcctccctctccggctgggccgaacgagatttgcgcgatcagttcgtctccctaactgataccacctggcgactccgcggctacggcgacttcttctcctactgcctcgtcgccgaaggtgccgtcgatatcgccgctgaaccagaagtcagcctctgggatcttgctcccctgtccatcctggtcaccgaagccggaggaaagttcacctcactggctggcgtcgatggaccacacggtggcgatgcagtagccaccaacggcatcctgcacgatgagacgctggatcgtttaaaatag

SEQ ID NO: 84268 - protein, 260 aa, Corynebacterium glutamicum ATCC 13032
MSKYADDLALALELAELADSITLDRFEASDLEVSSKPDMTPVSDADLATEEALREKIATARPADSILGEEFGGDVEFSGRQWIIDPIDGTKNYVRGVPVWATLIALLDNGKPVAGVISAPALARRWWASEGAGAWRTFNGSSPRKLSVSQVSKLDDASLSFSSLSGWAERDLRDQFVSLTDTTWRLRGYGDFFSYCLVAEGAVDIAAEPEVSLWDLAPLSILVTEAGGKFTSLAGVDGPHGGDAVATNGILHDETLDRLK

SEQ ID NO: 84269 - DNA, 759 bp, Corynebacterium glutamicum ATCC 13032
  CDS (1)..(759): transl_table=11
atgactgctcagattgatgattcgatcctcacccatcgtctcgcccaaggcaccggagaaatcctcaaaggtgtccgcaatgttggggtgttaagaggtcggaatctcggtgatgccggcgacgaactcgcacaaagttggattgctcgagtgttggagcagcaccgccccaacgatggattcctgtctgaagaagccgccgacaacccagaccgcctatccaaggaccgcgtgtggatcatcgatcccctcgacggcaccaaagaattcgccaccggccgccaggactgggcagtacacatcgcactggtagaaaacggtgttcccacccacgccgctgttggcctccccgaccttggcgtggtgttccactccgctgatgcccgcgccgtgactggcccttactccaaggtcatcgccatctcccacaaccgcccaccaaaggttgctctatcttgcgcagagcagctcggctttgaaaccaaggcccttggatccgcaggcgctaaagcaatgcacgttctcctcggtgactacgacgcctacatccacgccggcggccaatacgagtgggattccgcagcaccagtcggcgtctgcaaggcagcaggcttgcactgctccaggctcgacggttccgagctgacctacaacaacaaagacacctacatgccagacatcttgatctgtcgccctgaacttgcagatgaacttctcgagatgtgcgcgaagttctacgaggagaatggaacttactaa

SEQ ID NO: 84270 - protein, 252 aa, Corynebacterium glutamicum ATCC 13032
MTAQIDDSILTHRLAQGTGEILKGVRNVGVLRGRNLGDAGDELAQSWIARVLEQHRPNDGFLSEEAADNPDRLSKDRVWIIDPLDGTKEFATGRQDWAVHIALVENGVPTHAAVGLPDLGVVFHSADARAVTGPYSKVIAISHNRPPKVALSCAEQLGFETKALGSAGAKAMHVLLGDYDAYIHAGGQYEWDSAAPVGVCKAAGLHCSRLDGSELTYNNKDTYMPDILICRPELADELLEMCAKFYEENGTY

SEQ ID NO: 84271 - DNA, 786 bp, Xanthomonas campestris pv. campestris str. ATCC 33913
  CDS (1)..(786): transl_table=11
atggaattgcgcgagaccgtgatcgcgatcgcgcgccaggccggcgacgccatcatggaggtgtacgcgcaggatttcgctgtcgagatcaaggccgacgccagcccgttgacccaggccgacctggccgccaaccgcgtcatcgtggaaggcttgcgccgggtcacgccggatgtgccggtgttgtcggaagagtctgtccacgtggcctgggaagaacgccagtactggaccagctattggctggtcgacccgctggatggcacgcgcgagttcgtcaagcgcaacggcgagttcagcgtcaacatcgccctgatccacatgggcgcgccggtgctcggcgtagtgcaggcgccggtcgatggacgggtctggtatgcggcgcgcggtgagaacgcctaccgccgcgatggcgaccgcgacgaaatgctgcattcgcgcacgcccgctgctgccccgctgcgggtcgccgccagccgctcgcatcgcgatgcacgcacagccgcagcgctggaacgcatgggccagatcgacgtggtggcgcagggttcctcattgaagttctgccgcatcgccgaaggcgagctggatgtgtacccgcgcttcggtcccacctccgagtgggacaccgccgctggccagtgcgtgctgcatgccgccggtggcgcgttgctcgcggccggcaccggcaagccgttccgctacaaccgccgcgacaccttgctcaatggcgacttcatcgccctgggcgaccccggcctgccgtggcgcgactggctggtgtaa

SEQ ID NO: 84272 - protein, 261 aa, Xanthomonas campestris pv. campestris str. ATCC 33913
MELRETVIAIARQAGDAIMEVYAQDFAVEIKADASPLTQADLAANRVIVEGLRRVTPDVPVLSEESVHVAWEERQYWTSYWLVDPLDGTREFVKRNGEFSVNIALIHMGAPVLGVVQAPVDGRVWYAARGENAYRRDGDRDEMLHSRTPAAAPLRVAASRSHRDARTAAALERMGQIDVVAQGSSLKFCRIAEGELDVYPRFGPTSEWDTAAGQCVLHAAGGALLAAGTGKPFRYNRRDTLLNGDFIALGDPGLPWRDWLV

SEQ ID NO: 84273 - DNA, 744 bp, Yersinia pestis KIM
  CDS (1)..(744): transl_table=11
atgatgttagagcaaattggccagttggcccgtgaggcaggcgtggcgattatggcggtctatcagggcgacaaaccccttgatattgcgcataaaaaggatgattcaccggtgacggcggctgatttggcggctcaccagattatcaaagctgggttggcgcgattaaccccggatattccgctactctctgaagaggatccacccgcttgggatgtgcgccagcactggcaacgctactggctggttgacccgctggacggtactaaagagttcctcaatcgtaacggtgaattcaccgtcaacatcgctttgattgaccaaggtgaaccggtactgggcgtcgtctatgtaccggtaaccgaagtgatgtacagcgcggcaaacggacaggcttggaaagaagagtgtggcagacgtatgcagattcaggtgcgtgatgcccagcctccgttggtcgtggtgagccgctctcacagcgatgctgaattggaagactatttatcacaactgggggagcatcaaactatttcggtgggctcatcacttaaattctgcttggtggcggaagggaaagcgcaactgtacccgcgttttgggccaactaacgtctgggatacggcggctggtcatgccgtcgccatcgctgccggggcgcaagtacacgattggcagggaaagacactgtcttataccccacgtgaatctttcttgaaccccggtttcagagtttcgttattttag

SEQ ID NO: 84274 - protein, 247 aa, Yersinia pestis KIM
MMLEQIGQLAREAGVAIMAVYQGDKPLDIAHKKDDSPVTAADLAAHQIIKAGLARLTPDIPLLSEEDPPAWDVRQHWQRYWLVDPLDGTKEFLNRNGEFTVNIALIDQGEPVLGVVYVPVTEVMYSAANGQAWKEECGRRMQIQVRDAQPPLVVVSRSHSDAELEDYLSQLGEHQTISVGSSLKFCLVAEGKAQLYPRFGPTNVWDTAAGHAVAIAAGAQVHDWQGKTLSYTPRESFLNPGFRVSLF

SEQ ID NO: 84275 - DNA, 804 bp, Yersinia pestis KIM
  CDS (1)..(804): transl_table=11
atgcatccgatgctgactatcgccatacgcgctgcgcgtaaggccggtaacctgattgccaaaaattatgaaaccccggacgctgtcgaagcgagccagaaaggcagtaatgactttgttactaacgttgaccgcgatgcagagcatctgatcattgacgttatccgtaaatcttacccaaaacacactattattagtgaagaatgcggtgagttggtcggcgaagatgatgatgtacaatgggttattgatccactggatggcactaccaacttcatcaaacgcctccctcactttgcagtctctattgccgtgcgcattaaaggccggacagaagtcgccgtggtttacgatccaatgcgtaacgaactgttcaccgccagccgtggtcaaggcgcccagttaaatggttatcgtctgcgtggtaccaacgctaaagatttagatggcactattctggctaccggtttcccattcaaagtgaagcaacacgcccctgcttatattcgcgtcgtcggtaagctatttgagcagtgtgcagatttccgtcgcaccggttcagccgcattggatctggcttatgtcgcagcaggccgtgttgatggcttctttgagattgggttgaaaccgtgggatttcgcaggtggcgagctattggttcgtgagtctggtggtatcgtgactgactttgccggcggccataaccatttcagctctggcaatatcgtggccggtaatccacgtattgttaaatctatcgttcaagccatgagcaacgaaatcagtgatgcgttaaagcgttaa

SEQ ID NO: 84276 - protein, 267 aa, Yersinia pestis KIM
MHPMLTIAIRAARKAGNLIAKNYETPDAVEASQKGSNDFVTNVDRDAEHLIIDVIRKSYPKHTIISEECGELVGEDDDVQWVIDPLDGTTNFIKRLPHFAVSIAVRIKGRTEVAVVYDPMRNELFTASRGQGAQLNGYRLRGTNAKDLDGTILATGFPFKVKQHAPAYIRVVGKLFEQCADFRRTGSAALDLAYVAAGRVDGFFEIGLKPWDFAGGELLVRESGGIVTDFAGGHNHFSSGNIVAGNPRIVKSIVQAMSNEISDALKR

SEQ ID NO: 84277 - DNA, 861 bp, Thermosynechococcus elongatus BP-1
  CDS (1)..(861): transl_table=11
atgttctcctcccttgatcttaagaagacccttgccaccctgcgccccattctttggcaggcccttgagcaactgcgccagttttaccgccaggtgaaggatctaacggtgcaggataaaggcggtgatcccgtcaccctagcggatcagcaaattgatgcctttttgcgccatgccctccaagagcattttccggcctcggagtttggctatctcacagaagaaacctacacagccggtcagtccctatcgcagccctatgtgtggatcattgatcctttggacggcacctccgactttctgcaacagacgggggagtacgcaattcacgttgcccttgtccgtgaacaccgcccctgtttagctgctgtggtctggcccgaacaggaggtgatctacaccgccattgccggtggtggcacctatcgagaaacccgccaccgttcaacacgcctgcaagttcagccccccacccctgaccagcccctgcgggtggtgatgagccgtagccatgggggcgatcgcctcgaggcctttttaagcagcttaggatcagtacagctaatgccgatggggagtatgggctgtaaaacggctagcatttgccaaggggatgcccatctgtacgttagccttgcagggcgcactgccccaaaagactgggacttggcagcaccggatttgatcatgcaggaggcagggggcgcctttacctatgccaatggcaagttaccccactacaatcgcactgatgtgcagcactgggaaccgttggtggtgtgtcatcctgccttgagtcgcagggtgggcgatcgcctgcaagcctttttacaggaaaatcaaggctattctggaaaatag

SEQ ID NO: 84278 - protein, 286 aa, Thermosynechococcus elongatus BP-1
MFSSLDLKKTLATLRPILWQALEQLRQFYRQVKDLTVQDKGGDPVTLADQQIDAFLRHALQEHFPASEFGYLTEETYTAGQSLSQPYVWIIDPLDGTSDFLQQTGEYAIHVALVREHRPCLAAVVWPEQEVIYTAIAGGGTYRETRHRSTRLQVQPPTPDQPLRVVMSRSHGGDRLEAFLSSLGSVQLMPMGSMGCKTASICQGDAHLYVSLAGRTAPKDWDLAAPDLIMQEAGGAFTYANGKLPHYNRTDVQHWEPLVVCHPALSRRVGDRLQAFLQENQGYSGK

SEQ ID NO: 84279 - DNA, 846 bp, Leptospira interrogans serovar Lai str. 56601
  CDS (1)..(846): transl_table=11
ttgaattcgattctatatcttcagtctgccgtagattctgtactagaggctggcaaaattgtattagaaatttatcattccgattttaaggtcaaggataaaggaaaaaacgatccagtaaccgaagcagatctgaaagcaagttctcatatttcggaaagtttacgttttttgaatattccaattctttccgaagaggactctgaaaagaaggatgtttccaaattacaaacagtttggattttggatccaattgacggaaccagggaatttatacataaaaatccggagtttgcgatcagtctcggtttgtctattcttggaaaagcggttttaggagtggtttttaacccggttaccttagaattgatctatggagcagaggatttaggagtagtttatcaaaagttggaaaatatacctgattttttttcagttaaactccagaactttacaaaaatattaagtgattttaaacctattcagaaagttcttatttccagaaccgaagaaaaagaaggtcttttttcttcttctatgattcctttcggttgggaatttgtggcaatgggctcgatagcgtataaacttggtttggtggcggcgggaaaagcggctctttccatttctttaaaaccaaaaaatgattgggacatttgtgcgggaattgcgcttataaattcttcgggaggctccgatctagaaattagaaccggtgaaccctataaatttcaaactttaaatggaaagggagaggggcttatcgcaggacatactcgttcccttacccaggtttgggaaaattctaaatcgtattttcaatccagtttacgggattggaattaa

SEQ ID NO: 84280 - protein, 281 aa, Leptospira interrogans serovar Lai str. 56601
MNSILYLQSAVDSVLEAGKIVLEIYHSDFKVKDKGKNDPVTEADLKASSHISESLRFLNIPILSEEDSEKKDVSKLQTVWILDPIDGTREFIHKNPEFAISLGLSILGKAVLGVVFNPVTLELIYGAEDLGVVYQKLENIPDFFSVKLQNFTKILSDFKPIQKVLISRTEEKEGLFSSSMIPFGWEFVAMGSIAYKLGLVAAGKAALSISLKPKNDWDICAGIALINSSGGSDLEIRTGEPYKFQTLNGKGEGLIAGHTRSLTQVWENSKSYFQSSLRDWN

SEQ ID NO: 84281 - DNA, 813 bp, Shewanella oneidensis MR-1
  CDS (1)..(813): transl_table=11
atgaagcctgaagagttaatcgacgaggtgattgcgatagcaaccgatgcgggtcgcactattcgtgatatttaccttaagggtaattttgagcgagaaactaagtctgataatacccctgtcacctcggcagatttagcggcgaataaactgatttgtgaacgcttagcagccttgacgcccgatatccctattttgtcagaagaggctgccgacattcccttaagtgtgcgtgaagtgtggaaatgctattggctagtcgatccactcgatgggacgggggagtttattgctggcagtggcgatttttcagtgatcgttgcgctggtggagcataaccgtcctgtaatgggtgtagtctatgtgccgatgacgcaggtgtgttattacgccattgcgggcttaggggcctataaacgtactgataaacaggaagtgaggatcagtagccgacaaattcagcaccgcgagcaagtgtccttaaggttagcggtgagtcgccgtcaagatccccaatccgtgttgaccctattcaaccagcctaaacattgcgaattagtggtgatgggtggtgcggccttaaagagttgtttggttgctgaggggcgtgccgattgctatgtgcgagtgggaccgacgggtgagtgggacacgggcgctgcgcagatcattatcgaggaagcgggcgggcagatgatggatactgagctgcaacctttaacttacaatgaacgcgagacgcttgaaaatcctaattttattgtagttggcgcgcccaatttagcgtgggataaaattttaattggtgaataa

SEQ ID NO: 84282 - protein, 270 aa, Shewanella oneidensis MR-1
MKPEELIDEVIAIATDAGRTIRDIYLKGNFERETKSDNTPVTSADLAANKLICERLAALTPDIPILSEEAADIPLSVREVWKCYWLVDPLDGTGEFIAGSGDFSVIVALVEHNRPVMGVVYVPMTQVCYYAIAGLGAYKRTDKQEVRISSRQIQHREQVSLRLAVSRRQDPQSVLTLFNQPKHCELVVMGGAALKSCLVAEGRADCYVRVGPTGEWDTGAAQIIIEEAGGQMMDTELQPLTYNERETLENPNFIVVGAPNLAWDKILIGE

SEQ ID NO: 84283 - DNA, 762 bp, Shewanella oneidensis MR-1
  CDS (1)..(762): transl_table=11
ttgttgcggctagtgaatatagcccatgcggcaggtgatgccattatggcgatttacgcgcaagagcatattgctgttacacaaaagagtgatgagagtcctgtaaccgctgccgatcttgcggcccatagggtgattgtcagtcaattagctgagcaatttgcgggcattgctgtgatgtcagaagaagccgccgatattgcttgggatgagcgtgagcaatggcaaacttactggcttatcgatcctttagacggcactaaggaatttattaagcgaaatggtgagtttaccgtcaatatagcgctcattcatcaaggcgaagctatcgcgggtgtggtttatgctcctgtgttgaacacgacttattatggggcgagacacttaggtgcgtggcgacaggatggacagcaagaacagctgctgcagggctgcaagataccaagacaggtgccgatagtggtgggcagtcgttcgcacttaagcccagatgtggctgattatttgaacaatattggccaacatgaaatgttaagcgtgggaagctcgctgaagttttgtatgttggcagaaggtaaggccgatctctatccaagattggggcctaccagcgaatgggacacggcggcggcgcaggcggtacttgaaagcgcaggcggaaaagttgtgtgttatgactcaggtttacccttaacctacaatcaaaaacctgacatattaaacccttattttattgccacagcgcctggctgggcaaaataa

SEQ ID NO: 84284 - protein, 253 aa, Shewanella oneidensis MR-1
MLRLVNIAHAAGDAIMAIYAQEHIAVTQKSDESPVTAADLAAHRVIVSQLAEQFAGIAVMSEEAADIAWDEREQWQTYWLIDPLDGTKEFIKRNGEFTVNIALIHQGEAIAGVVYAPVLNTTYYGARHLGAWRQDGQQEQLLQGCKIPRQVPIVVGSRSHLSPDVADYLNNIGQHEMLSVGSSLKFCMLAEGKADLYPRLGPTSEWDTAAAQAVLESAGGKVVCYDSGLPLTYNQKPDILNPYFIATAPGWAK

SEQ ID NO: 84285 - DNA, 804 bp, Shewanella oneidensis MR-1
  CDS (1)..(804): transl_table=11
atgcatccgatgctgacgattgctgttcgcgctgcccgcgcggccggccaaactattatgcgtgcctacactgaacttgaccgagttgaagtcagtgctaaaggtatcaacgattttgttaccagtgtagacaaggaagcagaagccgctattacctatcaaattcgtaaatcttaccctgatcacactatcgtgggtgaagagaaaggcgaaaaccgcggtgaaaacaaagactatatttggatagtcgatcctctggatggcactaacaactttgttagaggcattccccacttcgcggtttctatcgcgctccaatacaaaggcaaaactgaagttgccgttgtatatgatccagttcgtgaagaattatttaccgctatccgtggtaaaggcgccaaattaaacgatttccgcattcgcgtgaccaatgtaaatgaactagcaccaaccattatcgggacaggttttccatttaaagcccgtcaacataccgaaacctatatggccattttcggcgaagtgtttggtcattgttcagacttacgtcgcacgggttctgcagcattagatttagcctatgtggccgcaggccgtttagacggtttctttgaaattggcttaaagccatgggatatcgctgctggcgatctgttatgtcgtgaagcgggtggcacagtcactgactttactggcggtcataactacttgatctctggcaatatcgttgcgggttctccgaaagtgactaccgaattagtaaaaaccatgcgtcctttactaaacgaaggcttaaagcgttaa

SEQ ID NO: 84286 - protein, 267 aa, Shewanella oneidensis MR-1
MHPMLTIAVRAARAAGQTIMRAYTELDRVEVSAKGINDFVTSVDKEAEAAITYQIRKSYPDHTIVGEEKGENRGENKDYIWIVDPLDGTNNFVRGIPHFAVSIALQYKGKTEVAVVYDPVREELFTAIRGKGAKLNDFRIRVTNVNELAPTIIGTGFPFKARQHTETYMAIFGEVFGHCSDLRRTGSAALDLAYVAAGRLDGFFEIGLKPWDIAAGDLLCREAGGTVTDFTGGHNYLISGNIVAGSPKVTTELVKTMRPLLNEGLKR

SEQ ID NO: 84287 - DNA, 786 bp, Corynebacterium efficiens YS-314
  CDS (1)..(786): transl_table=11
atgagcaactacgcagacgatttagccctcgccctcgaactggctgaactggccgattccatcaccctcgaccgtttcgaggccaccgatttagatgtctcctccaagccggacatgaccccggtcagcgacgccgacctggccgtggaaaccgcgctgcgcgagaaactcgccaccgcgcgcccctccgacgccatcctcggtgaggaattcggcggcgagacggaattaaccggacgccagtgggtcatcgaccccatcgacggcaccaagaacttcgtccgcggtgttcccgtgtgggccaccctcatcgccctgcttgacgacggccgccccgtcgccggtgtcatctccgccccggcactcgcccgccgctggtgggcctccgaaggatccggtgcgtggcggaccttcaacggcagctccccccgcaaactgtgtgtgtcctccgtgaccaagcttgcggatgcgtcggtctccttctcctccctggagggttggaaggcccgtgacctgcgcaagaacttcatcgaactctcagacgacacctggcgcctgcgcggatacggtgatttcttctcctactgcctggtcgcagagggtgccgtggacatcgccgctgaacccgaggtctccctctgggatcttgctcccctgtccatcctggtcaccgaggccggcgggcggttcagctccctggccggggaggacggcccccacggcggcgacgctgtggccaccaacggcgcacttcacgatgaggtgctgaagcgcctgcggggctaa

SEQ ID NO: 84288 - protein, 261 aa, Corynebacterium efficiens YS-314
MSNYADDLALALELAELADSITLDRFEATDLDVSSKPDMTPVSDADLAVETALREKLATARPSDAILGEEFGGETELTGRQWVIDPIDGTKNFVRGVPVWATLIALLDDGRPVAGVISAPALARRWWASEGSGAWRTFNGSSPRKLCVSSVTKLADASVSFSSLEGWKARDLRKNFIELSDDTWRLRGYGDFFSYCLVAEGAVDIAAEPEVSLWDLAPLSILVTEAGGRFSSLAGEDGPHGGDAVATNGALHDEVLKRLRG

SEQ ID NO: 84289 - DNA, 807 bp, Corynebacterium efficiens YS-314
  CDS (1)..(807): transl_table=11
atgctgttggccatgccccaatgtaaccaaaagtctagaatcagtgtcatgactgctcagatcaatgattccattctgaccaagcgcctggcgcagggaaccggtgaaattctcaagggtgtccgcaacgtcggtgtgttgcggggacgcaacctcggtgatgccggtgatgacctggcccagaactggatcgcccgggttctggagcagcaccgccccgatgacggtttcctctccgaggaggccgccgacaacctggagcgtctgaacaagaaccgcgtctggatcatcgatcccctggacggcaccaaggagtttgccacgggacgtcaggactgggcggttcacatcgcactggtggagaacggcatccccacccacgccgccgtcggtctgcccgacctgggtgtggtcttccattccgccgatgcccgcgcagtctccggccccttctccgggaaggtggccatctcccacaaccgtcccccgcaggtggcggaacatatcgccgcacagctcggcttcgataccgaggcactcggatccgccggtgccaaggccatgcacgttctgctcggtgactatgatgcctacatccacgccggtggcatgtacgaatgggactccgccgccccggtgggtgtgtgcaaggccgcgggcctgcactgctcccgcctcgatggctccgaactgacgtacaaccacaaggacaccttcctgcctgacgtgctcatctgccgcccggagctggccgaggagatcctcgacctggccgcgaaataccgcgaggagaacggggcctactag

SEQ ID NO: 84290 - protein, 268 aa, Corynebacterium efficiens YS-314
MLLAMPQCNQKSRISVMTAQINDSILTKRLAQGTGEILKGVRNVGVLRGRNLGDAGDDLAQNWIARVLEQHRPDDGFLSEEAADNLERLNKNRVWIIDPLDGTKEFATGRQDWAVHIALVENGIPTHAAVGLPDLGVVFHSADARAVSGPFSGKVAISHNRPPQVAEHIAAQLGFDTEALGSAGAKAMHVLLGDYDAYIHAGGMYEWDSAAPVGVCKAAGLHCSRLDGSELTYNHKDTFLPDVLICRPELAEEILDLAAKYREENGAY

SEQ ID NO: 84291 - DNA, 801 bp, Pseudomonas putida KT2440
  CDS (1)..(801): transl_table=11
atgcatgaagtggtcaagctggcgctgacggcaggcgaggcgatcctgccattctggcgcgccgatgtcgcggtaaccaacaaggccgacgattcgccggttaccgccgccgacctagccgcgcaccgggtaatcgccgatggtctgctggcgctggcgccgcagattccggtgctgtccgaagaggactgcaatattgcgctggccgagcggcaaaactggagccgctggtggctggtcgatccgctggatggcaccaaggaattcattgccggcagtgaagagttcacggtcaacatcgccctgatcgagaacggcgaggtggtgtttggcgtggtgtcgatgcccaccaatgggcgctgctattttggtggacgcggcatgggggcctggcgtgcagatgccggtgaggcagcccagctgatccaagtacgcaacgcacccgcgcagggcgagcgttttaccgtggtggccagccgtcggcattccagcccggagcaggaagcgctgttggccggccttggggctgcggtgggcgagctggagctggccaatatcggcagctcgttgaagttctgcctgttggccgagggcagcgccgattgttatccgcgcctggcgccgacttcgcagtgggatactgctgcggcgcagggtgtggtggagggggccggtggcgaagtgatcgggctggatggcttgccgttccggtatccgccgcgcgagtcgctgcttaacccgtacttcctggcgttgccggtaaatgctgaatggcgccaggccttcctgaacctcatctaa

SEQ ID NO: 84292 - protein, 266 aa, Pseudomonas putida KT2440
MHEVVKLALTAGEAILPFWRADVAVTNKADDSPVTAADLAAHRVIADGLLALAPQIPVLSEEDCNIALAERQNWSRWWLVDPLDGTKEFIAGSEEFTVNIALIENGEVVFGVVSMPTNGRCYFGGRGMGAWRADAGEAAQLIQVRNAPAQGERFTVVASRRHSSPEQEALLAGLGAAVGELELANIGSSLKFCLLAEGSADCYPRLAPTSQWDTAAAQGVVEGAGGEVIGLDGLPFRYPPRESLLNPYFLALPVNAEWRQAFLNLI

SEQ ID NO: 84293 - DNA, 831 bp, Bradyrhizobium japonicum USDA 110
  CDS (1)..(831)
atgcaggtgaagcggatcatcgacggcgcggccgcatccggcctgatggagccgctcaccgcgctggtggtgaaggcgggcgaagcgatcctcgcggtcaaccgcgcggcgatgcgggtcgacggcaagcaggacggctcgccggtgaccgaggccgaccttgccgccgaccgcgtcattgcggacggcctggcgcagctcgcgggcgacatcccgacgctgtcggaggaacggacccagctcgccgctccgccgttccgcgacagcttcttcctgatcgatccgctcgacggcaccaaggagttcgtggccggccgtgacgagttcaccgtcaacctcgccctcgtcactcacggggtgccgctgctcggcatcgtcagcgcacccgcactcgggctgctctggcgcggcatcgtcggccgcggcgccgagtgtgtcagatttgacggcgctaccatcggtgccgccgagccggtccatacccgcaagctgccggcgccgggcgagccctgggtcgcggcggtgagccgctcgcacggcgatcccaaaagcgaagcgttcatcgacaacaggcccaatgccgtcagaaggacggtcggctcggccgtgaaattcggccggatcgcggaaggcagcgccgacatctatccccgcttcgggcccacttcggagtgggatgtcggggccggctgcgcggtcgtgaccgcggccggcggcaaggtcaccgacggcaagggcggcgagatcctgttcggccagcggcaggacaccggcttcatcatcccggagttcatcgcctggggcgacccgcaggcggtagaccgctactga

SEQ ID NO: 84294 - protein, 276 aa, Bradyrhizobium japonicum USDA 110
MQVKRIIDGAAASGLMEPLTALVVKAGEAILAVNRAAMRVDGKQDGSPVTEADLAADRVIADGLAQLAGDIPTLSEERTQLAAPPFRDSFFLIDPLDGTKEFVAGRDEFTVNLALVTHGVPLLGIVSAPALGLLWRGIVGRGAECVRFDGATIGAAEPVHTRKLPAPGEPWVAAVSRSHGDPKSEAFIDNRPNAVRRTVGSAVKFGRIAEGSADIYPRFGPTSEWDVGAGCAVVTAAGGKVTDGKGGEILFGQRQDTGFIIPEFIAWGDPQAVDRY

SEQ ID NO: 84295 - DNA, 717 bp, Bradyrhizobium japonicum USDA 110
  CDS (1)..(717)
atgttccgcaccgagctgaagacatggaccaagggcgcgtcctcgccggtgtcggaagccgacatcgccgtcaacgacctgctcgaagcgcgcctgcgcagtgccacgcccgactatggctggctgtcggaggagagcgccgacgattccacgcggctgtcgcggcggctggtctgggtggtcgatccgatcgacggcacgcgcaattatctgggcggccacgacgaatggtgcgtcagcgtggcgttggtcgaggacgccgcgccgctgctggccgcggtgttcgcgccggccagcggcgagttcttcttcgcggcccgcggccagggtacgctgctcaacgacaagccggtgcgggcgacgcccgggtccacgctcgatttctcccgcatggccggccccaagccgatggtcgagcgtctcaataccgccggcggcgacatcaagctgcacccgcgaatcggctcgctcgcgctccggctctgccgggtcgcccacggcgcgctggatgcggcttttgcgggcggcaacagccatgattgggatcttgcggcggccgatttgatcgtgcaggaagcggatggtaggatgagcgacctctccggagatcccatcctctataaccgccgggaagtggcgcacggggtgctggtggcagcgggtcgcgatcgtcatgcgagcattgtcgcgcattttcgaaatcgtcccttgccctga

SEQ ID NO: 84296 - protein, 238 aa, Bradyrhizobium japonicum USDA 110
MFRTELKTWTKGASSPVSEADIAVNDLLEARLRSATPDYGWLSEESADDSTRLSRRLVWVVDPIDGTRNYLGGHDEWCVSVALVEDAAPLLAAVFAPASGEFFFAARGQGTLLNDKPVRATPGSTLDFSRMAGPKPMVERLNTAGGDIKLHPRIGSLALRLCRVAHGALDAAFAGGNSHDWDLAAADLIVQEADGRMSDLSGDPILYNRREVAHGVLVAAGRDRHASIVAHFRNRPLP

SEQ ID NO: 84297 - DNA, 828 bp, Vibrio parahaemolyticus RIMD 2210633
  CDS (1)..(828): transl_table=11
atgccaatgacaaaagatctatctcacctgcttcctcaagttatcgaaattgcccgcagtgcgggacaaatgattctcgatatctacgagaaaaagcaatatgaagcgtacaccaaaagtgatgaaacaccggtcacaagcgccgatattgccgcgcacaaactcatcactgaacgtttaagtgaactgacgccagacatccccgtgttatctgaagaagctgccgacatcagcttagagcagcgcgcacaatggcagcgttattggttggtcgacccactagatggcacacaagaattcatcgcacgcagtggcgactttgcgaccatcattgcattaattgacaacaacaagccagcgatgggcgtggtgtatgggcctgtttctggcgtcacgtattacgcatacagcggcaaaggtgcgtggaaaatcccagacatgtctgaaagcgtgaaaatccacacgcacaaacatgaacaagcaggacaaaacattgccattgctatcagccgtcgccaagacattaatcgcatcaccagccgcatgagtagcgcttggaattacgacttaattcctctcggttctgcagcgttaaaagcgtgtttggtggcggaaggagcggtcgattgctatttacgtttgggccctactggcgaatgggatacagcagcaacgcaatgcatcgtggaagaagcgggcggacgcattctcagcactcacctcgaacctttgtcttacaacgaacgggaaacgctagagaacccgaactttatcgtgctgggcgatacgaatttgccttgggatgacatcctgcaacgcaaagattaa

SEQ ID NO: 84298 - protein, 275 aa, Vibrio parahaemolyticus RIMD 2210633
MPMTKDLSHLLPQVIEIARSAGQMILDIYEKKQYEAYTKSDETPVTSADIAAHKLITERLSELTPDIPVLSEEAADISLEQRAQWQRYWLVDPLDGTQEFIARSGDFATIIALIDNNKPAMGVVYGPVSGVTYYAYSGKGAWKIPDMSESVKIHTHKHEQAGQNIAIAISRRQDINRITSRMSSAWNYDLIPLGSAALKACLVAEGAVDCYLRLGPTGEWDTAATQCIVEEAGGRILSTHLEPLSYNERETLENPNFIVLGDTNLPWDDILQRKD

SEQ ID NO: 84299 - DNA, 804 bp, Salmonella enterica subsp. enterica serovar Typhi Ty2
  CDS (1)..(804): transl_table=11
atgcatccgatgctgaccatcgccgtgcgcgcagcgcgcaaggcgggtaatgtaattgccaaaaactatgaaactccggacgctgcagaagcgagccaaaaaggcagtaacgattttgtgaccaacgtagataaggccgctgaagcggtaattatcgacaccattcgcaaatcttacccgcaacacactattatcaccgaagaaagcggtgagcacgttggcacagatcaggatgttcaatgggttatcgatccgctggatggcaccaccaacttcatcaaacgtctgccacacttctctgtttccattgctgtacacattaaaggccgtactgaagtggctgtcgtttacgatccgatgcgtaacgaactgttcaccgccacccgcggtcagggcgcgcagctgaacggctaccgtctgcgcggcagtaccgcgcgcgatctggacggcactatcctcgctaccggcttcccgttcaaagccaaacaatacgcgaccacctacattaatattatcggcaagctgttcaccgaatgcgccgatttccgccgcaccggttccgccgcgctggatctggcctatgtggctgcaggtcgtgtcgatggtttctttgaaattggccttcgtccgtgggatttcgccgcgggcgaactgctggttcgtgaagcgggcggtatcgtcagcgatttcaccggcggtcataactacatgatgaccggtaatatcgtggcggggaatccgcgcgtcgttaaagccatgctggcgaatatgcgcgacgaactgagcgatgcgctgaagcgctaa

SEQ ID NO: 84300 - protein, 267 aa, Salmonella enterica subsp. enterica serovar Typhi Ty2
MHPMLTIAVRAARKAGNVIAKNYETPDAAEASQKGSNDFVTNVDKAAEAVIIDTIRKSYPQHTIITEESGEHVGTDQDVQWVIDPLDGTTNFIKRLPHFSVSIAVHIKGRTEVAVVYDPMRNELFTATRGQGAQLNGYRLRGSTARDLDGTILATGFPFKAKQYATTYINIIGKLFTECADFRRTGSAALDLAYVAAGRVDGFFEIGLRPWDFAAGELLVREAGGIVSDFTGGHNYMMTGNIVAGNPRVVKAMLANMRDELSDALKR

SEQ ID NO: 84301 - DNA, 807 bp, Bacteroides thetaiotaomicron VPI-5482
  CDS (1)..(807): transl_table=11
atggctgctatcgatgcagcgttgaaagcgggtgaaaaaatcctttctatctatgaagatccgaagtcggattttgaaatagagaggaaggcggataactctcccttaacgatagcagacaggaaagcccacgaggcgattgtggccattttgaatgaaactccttttccggttcttagtgaagaaggaaagcatatggactatgcagtgcggcgaggctgggatactttatggattgtagacccgctggacggaacgaaggagttcatcaagcgtaacggagaatttacggtaaatatagctttggtgcagaacgctgtacctgtaatgggtgttatttacgtgcctgtaaaaaaagaactttattttgcagtggaggggacaggtgcctataagtgttccggcattgtcggtctggaagacgagggagtgaccttacagcagatgattgagaaatcggaacggatgccattggcggatgcgcgcgaccattttattgctgtcgcttcccgttcacacctgacgcctgaaactgaaacatatattgcagacttaaaaaagaaacacggcaatgtggaactgatatcaagcggaagttccattaaaatctgtctggttgccgaaggaaaggcggatgtctatccgcgttttgctccgacgatggaatgggatacggctgccggacatgcgatagcccgtgccgcagggatggaagtatatcaggcagggaaggaggaacctttgcgatataacaaagaggatctgctgaatccgtggtttatcgttgaagcaaaaagagaacgctaa

SEQ ID NO: 84302 - protein, 268 aa, Bacteroides thetaiotaomicron VPI-5482
MAAIDAALKAGEKILSIYEDPKSDFEIERKADNSPLTIADRKAHEAIVAILNETPFPVLSEEGKHMDYAVRRGWDTLWIVDPLDGTKEFIKRNGEFTVNIALVQNAVPVMGVIYVPVKKELYFAVEGTGAYKCSGIVGLEDEGVTLQQMIEKSERMPLADARDHFIAVASRSHLTPETETYIADLKKKHGNVELISSGSSIKICLVAEGKADVYPRFAPTMEWDTAAGHAIARAAGMEVYQAGKEEPLRYNKEDLLNPWFIVEAKRER

SEQ ID NO: 84303 - DNA, 816 bp, Coxiella burnetii RSA 493
  CDS (1)..(816): transl_table=11
gtgggcgatgattggttaaaaccccttgttttattggcaaaaaaagccggtgctgaaattttgaaatatttcggattgtctaaagaagacctgcatgtcatgcaaaaagaagaccgaacaccggttaccgaggccgatctttccgcgcataaaattctccaaaaagggctaaccgcgttaacgccgactattccgattttatcggaagaagggaagattcccccttacgccgagcgtcagaaatgggaccggtattggttattagatcctttagatggtacgcgaggatttatagagaatcgcgatgaattcaccgttaatatcgctttaattgagcgacacgagcccgtgatgggtgtggtttacgcgcccgtatttgatttatgttacttcgcctctcgcggacaaggtgcttttaagcaagttgccgaagaaacacccatctctattcaaacgaggaagatggacgaagattcgttttctgttttattgggccaatacttacgctcgccccgcctcccggagctatttaacgctatctctggttgtgagatcgttcgattaaacagttctttaaaattttgttggatcgcggaaggaaaaggcgatttgtaccctcgccttggcgacaccagtgaatgggatacgggggcaggtcattgcgttctaaacgaggcgggcggtacgatccttgagttaaatgggaaagaattgcgatacaacgagaagaattcccttatgaatccagcctttgtagcgatcggggatgtggctcaaaaagagaaagtattcgaattactcgaaagaactccataa

SEQ ID NO: 84304 - protein, 271 aa, Coxiella burnetii RSA 493
MGDDWLKPLVLLAKKAGAEILKYFGLSKEDLHVMQKEDRTPVTEADLSAHKILQKGLTALTPTIPILSEEGKIPPYAERQKWDRYWLLDPLDGTRGFIENRDEFTVNIALIERHEPVMGVVYAPVFDLCYFASRGQGAFKQVAEETPISIQTRKMDEDSFSVLLGQYLRSPRLPELFNAISGCEIVRLNSSLKFCWIAEGKGDLYPRLGDTSEWDTGAGHCVLNEAGGTILELNGKELRYNEKNSLMNPAFVAIGDVAQKEKVFELLERTP

SEQ ID NO: 84305 - DNA, 822 bp, Nitrosomonas europaea ATCC 19718
  CDS (1)..(822): transl_table=11
atggcgggaagattgaacgtgctggaacgtgtcatcaaggctgtgagggaagttgctcgtgatgagatcatgtcgcgttatctgcaggtggaacgtatctataaggcagatggcagtttttataccgaagcggatctggctgctcaggtaagtctgctggggcggctgcatgaaattgcgcctgttgcgatgatcggcgaagaaatgtcggaatcagagcagctggcgcaatgggaagcagggcaggacggattgtggagtatcgatccgatcgacggcacctccaattttctgaacggattgccttattttgcggtttctgtggcgctgatgcggggcggcagaagtgtgctgggtgtggtctacaatccggcaacggatgaaatgttctacgccgagcaggggaagggggcttttctcaacggtaaggcattgcctttttccagacgaaaaattccattgaacaaagcaatagccaatgtcgatttcaagcggctggatcgccggctggctgtggaaatcgtttccagacctccctattcctcacagcgtaattacggtacctgcacactggaatggtgctataccgctgcgggatattttgatctgtatctgcatggtggccaaaagccgtgggattatgccgccggctgtctgattctcgaagaagccggggggcatcgctgcacgctgagcgaggatgattactggtccggtaatccttggcgccgttcagtcattggtgcgcttgatgaagatttgtttgtgctgtggcgcgactggatcagatcgcgcgtatcggatatcgacaatctccgttga

SEQ ID NO: 84306 - protein, 273 aa, Nitrosomonas europaea ATCC 19718
MAGRLNVLERVIKAVREVARDEIMSRYLQVERIYKADGSFYTEADLAAQVSLLGRLHEIAPVAMIGEEMSESEQLAQWEAGQDGLWSIDPIDGTSNFLNGLPYFAVSVALMRGGRSVLGVVYNPATDEMFYAEQGKGAFLNGKALPFSRRKIPLNKAIANVDFKRLDRRLAVEIVSRPPYSSQRNYGTCTLEWCYTAAGYFDLYLHGGQKPWDYAAGCLILEEAGGHRCTLSEDDYWSGNPWRRSVIGALDEDLFVLWRDWIRSRVSDIDNLR

SEQ ID NO: 84307 - DNA, 801 bp, Helicobacter hepaticus ATCC 51449
  CDS (1)..(801): transl_table=11
ttggtattaaaatattatggtttggaggagtttgcgttaaagtcggattcttcgccacttacaaaggcggatttagaatctaatacgtttattacgcaagaattgcaagaaaattctccttataaggtatgctctgaagaagcagtattagaatatgaagagcgcaaagatttagaatattattggctaattgacccgcttgatggaacaaaggattttttggcaaaaaatggcggtttcacgattaatattgccctaatccacaagaatcgcccgattttgggggtcgtgtatgctcctgcattttatcagctttattttgcgttgaaaggctttggtagctttacttatacacctcaaacgctaaaagacgcactagattctaaaactctaaatcctgcttggctagaacaaaacaaacaaaggttaagtggagagagaattgcaaaagaggagcagattatcgcttgcgattcgctttttcatagtacgaaagaaacgcaagattttatcgcaaaatatcacttaaaagtgcaaaagtatggctcatcgcttaaagtctgcgcacttgcagagggtaaggcagatatttatccgcgcttgaatggcacgagcgaatgggatagcgcagcatcggacattgtgctagaagaagcaggcggtgtgatattagattgtgagagtaagaaacctttgcagtataataagccaagtgtgaggaatccctattttctagcttttgcaaagtcgcaagtgggaggggcgatttataaagacattttggcttctccatacgcttga

SEQ ID NO: 84308 - protein, 266 aa, Helicobacter hepaticus ATCC 51449
MVLKYYGLEEFALKSDSSPLTKADLESNTFITQELQENSPYKVCSEEAVLEYEERKDLEYYWLIDPLDGTKDFLAKNGGFTINIALIHKNRPILGVVYAPAFYQLYFALKGFGSFTYTPQTLKDALDSKTLNPAWLEQNKQRLSGERIAKEEQIIACDSLFHSTKETQDFIAKYHLKVQKYGSSLKVCALAEGKADIYPRLNGTSEWDSAASDIVLEEAGGVILDCESKKPLQYNKPSVRNPYFLAFAKSQVGGAIYKDILASPYA

SEQ ID NO: 84309 - DNA, 888 bp, Rhodopirellula baltica SH 1
  CDS (1)..(888): transl_table=11
gtggttggaagagcttcgccggttggaaaacgactgacggcttccgacccatcggaccgcctccaaccaacccccaagacaaactccatggacagtgcccacttgaggctggccgtcgacgcggcgcgtgccggtgccgctgaattgatgtcgcgacgcgatcaccgtgttgtgagtgagaaaggccccaaagatctggtgaccgatgccgacttggcatcccaaaaagccattcgcgacatgctggtcggggcttacccagactatgccttcgttggtgaagaagagggcgaaaatgatccgcccgccagcgtgcgagccggtgaccctgatgctccgccttgctgggtggtcgaccctttggatggaacggtcaatttcgttcaccgcctgcaaagctttgcggtatcgatcggcctgtacgcggctggcaagatgcggttgggtgtgatctacgatccgacgcgagacgaaatgttcaccgcgattgatggacaaggcgcccactgcaacgaccaaaagatgtccgccagtggttgcaccgcgatcgaggaaagcttggtcgcgtgcagttttcgagcgggtgtcaccgctgactcgcccgaagtgacgcgttttgtaaaggtactcgagaagtgccgctcgttgcgacgtttgggttcgtgcgcgctgaacatgtgctacgtcgccgatggtcgactggatggatactgggcgaccaatgtcgccgcctgggattctgccgccggcaccgtgatcgctcgtgaatccggtgcgattctagaaggctacggtggcgaggaattcgatgactggaaccccaagttttgcgtttcggcaacgcccgaactgcaatcgcttttgacaaagcaactgagaggcacatga

SEQ ID NO: 84310 - protein, 295 aa, Rhodopirellula baltica SH 1
MVGRASPVGKRLTASDPSDRLQPTPKTNSMDSAHLRLAVDAARAGAAELMSRRDHRVVSEKGPKDLVTDADLASQKAIRDMLVGAYPDYAFVGEEEGENDPPASVRAGDPDAPPCWVVDPLDGTVNFVHRLQSFAVSIGLYAAGKMRLGVIYDPTRDEMFTAIDGQGAHCNDQKMSASGCTAIEESLVACSFRAGVTADSPEVTRFVKVLEKCRSLRRLGSCALNMCYVADGRLDGYWATNVAAWDSAAGTVIARESGAILEGYGGEEFDDWNPKFCVSATPELQSLLTKQLRGT

SEQ ID NO: 84311 - DNA, 813 bp, Haemophilus ducreyi 35000HP
  CDS (1)..(813): transl_table=11
atgaacccaatgttaaacattgctattcgtgcagcacgaaaagcaggcaatattattgcaaaaggctatgagcaagcgatcattgaaacagaagttgttcaaaaaggtataaatgattacgtaacggatattgataaagcggctgaagcggcaattattgatgttattcgtaaatcttatcctgatcacggaattatctgtgaagaagcgggcattttggctggaaaaaatgagaatgtacaatgggtgattgatccattagatggcacaactaatttcgtgaagcgtttacctcatttttctgtatcaattgcaatccgtgaaaatggccgtactacggtaggtgtcgtatatgatcctattcgtaatgagctttttactgcggtacgtggtgaaggtgcaaaattgaatgaattccgtttacgtgtaaatgcagagcgtcgtgatttaaccggtgctattcttgcgacaggttttccattcaaatcctctcaacatcgtgttgcccatttaaatatgctagaagcattagtgaataatggcgttgcagatttccgtcgcactggttcagcagcattagatctggcgtatgtagcggcaaatcgagtagatggtttttttgagattggtttaaaaccttgggattgtgcagcgggcgatttaattgcgcgtgaagcgggcgctattgtgagcaattttgtaggcggtactgattatttaaaatcaggcaatattattgcaggccaatcacgagttgtgaaagaaattttaaattatattcagccaacattaacggcagatcttaaaaactaa

SEQ ID NO: 84312 - protein, 270 aa, Haemophilus ducreyi 35000HP
MNPMLNIAIRAARKAGNIIAKGYEQAIIETEVVQKGINDYVTDIDKAAEAAIIDVIRKSYPDHGIICEEAGILAGKNENVQWVIDPLDGTTNFVKRLPHFSVSIAIRENGRTTVGVVYDPIRNELFTAVRGEGAKLNEFRLRVNAERRDLTGAILATGFPFKSSQHRVAHLNMLEALVNNGVADFRRTGSAALDLAYVAANRVDGFFEIGLKPWDCAAGDLIAREAGAIVSNFVGGTDYLKSGNIIAGQSRVVKEILNYIQPTLTADLKN

SEQ ID NO: 84313 - DNA, 813 bp, Haemophilus ducreyi 35000HP
  CDS (1)..(813): transl_table=11
atgcttatactcaattcttctctactgaatgcagtaaaagatattgctcatcaggcaggtgaacaccttaaacggttttatgcacattccgttgaaataaaaattaaagcagataatacgcctgtaacggaagcggatctttttctcagtcaatttattatccagcaacttcaacaattaacgcccacgattcctgtgttatcggaagaaaattgtgccattccattaacagaacgggcaaattggcaagaatattggattattgacccacttgatggtacccaacaatttatcaatcgaaccgatcaattttccattgcgattagcttagtacaacacaatcagcctgtaatcggcattatttatgcgcccatattagccaaaacttattttgcaatgcgaacaagcggtgcttttttgcaagaaaatggcataattcgcccgcttactcctcacaaaattatggccaataatgagcgcttacgcatcgcaatgggagcaaccaataggacgacagtagcccaatgcctacaacaacctctacaagcagatatctttcaatatggctcgagtagcttaaaagccggtttagtcgcagaaggcaaagccgactgttacattagattaggcgatactggcgaatgggatactgccgccgctgaagtgctattaaatgaaatcggtggcaagatttttgatcttaattttcaaccgcttagctataatcagcgacaacattttattaacccgcattttgtaatggtggcagacaaacaggctgactggcaaaaaatctttcaattcaatgagtga

SEQ ID NO: 84314 - protein, 270 aa, Haemophilus ducreyi 35000HP
MLILNSSLLNAVKDIAHQAGEHLKRFYAHSVEIKIKADNTPVTEADLFLSQFIIQQLQQLTPTIPVLSEENCAIPLTERANWQEYWIIDPLDGTQQFINRTDQFSIAISLVQHNQPVIGIIYAPILAKTYFAMRTSGAFLQENGIIRPLTPHKIMANNERLRIAMGATNRTTVAQCLQQPLQADIFQYGSSSLKAGLVAEGKADCYIRLGDTGEWDTAAAEVLLNEIGGKIFDLNFQPLSYNQRQHFINPHFVMVADKQADWQKIFQFNE

SEQ ID NO: 84315 - DNA, 915 bp, Prochlorococcus marinus subsp. marinus str. CCMP1375
  CDS (1)..(915): transl_table=11
atgaaaaaagaggttgaacttcctaatggagttaatttgaataatttgttggagaaacttagagagttgagttggggcgctgcagatattctgaaggcatatgcaagaggagaaaagcctccttatgatttccctgaagttttgagtgttcaagaaggaggagatggacctgtatctgctgcagaccttgcagttaatagctggctaattgaaggcttgaaggcaagtttcgcatctgtaaaatgggcgttaattagtgaggaaacggctaaggaacagcttgtgataggggagcctttgaacaatcaatgggtgtggatattagatcctttagatggaaccaaagatttcctacaaggcaccggagaatatgcagtgcatttggctttagttaatggtaataatcctgttttaggagtggttttgatacctgaattagaagaactttggattggattggtaggctcaggatcatggtgcgaggaccgttttgggaataaaaaacctgctgtttttagtagtcgaaaagaaattagtgaaatgactcttgtagcaagcagaagtcacagagacgaaaagctagagaagttgattaactcacttccttttgctcagaagcaaatagtaggaagtgtcggttgtaaagttgccaaaattcttaaaggggaagcggatttctatatatctttatcagctaaaacagctcctaaagattgggatatggctgctcctgaagctgttttaaaagctgctggaggtagtttcacccacgcaaataacaaacctttgaaatacaacactggagaaataaatcaatgggggtgtttgatagcaagccatggtagaaatcatgacttgttatgtagtgttattcaaaatgaattgttatctattgacccttctttttcagtatga

SEQ ID NO: 84316 - protein, 304 aa, Prochlorococcus marinus subsp. marinus str. CCMP1375
MKKEVELPNGVNLNNLLEKLRELSWGAADILKAYARGEKPPYDFPEVLSVQEGGDGPVSAADLAVNSWLIEGLKASFASVKWALISEETAKEQLVIGEPLNNQWVWILDPLDGTKDFLQGTGEYAVHLALVNGNNPVLGVVLIPELEELWIGLVGSGSWCEDRFGNKKPAVFSSRKEISEMTLVASRSHRDEKLEKLINSLPFAQKQIVGSVGCKVAKILKGEADFYISLSAKTAPKDWDMAAPEAVLKAAGGSFTHANNKPLKYNTGEINQWGCLIASHGRNHDLLCSVIQNELLSIDPSFSV

SEQ ID NO: 84317 - DNA, 789 bp, Candidatus Blochmannia floridanus
  CDS (1)..(789): transl_table=11
atgatagtagatcaaataatttatattgctcgtatagctggaatggaaataatgagaatttatacagggtttggacatcgtaaaatatatgtacaacaaaaaatggatcagtctcctgtaaccaatgctgatttaattgcgcatcaagttatcgtatatttattacggaatttaactcctaatattcctattatatcagaagagtgtattccagagtggagagactgtaggcattggaataatttttggttaattgatcctctagatggaactaaagaatttttatctcgtaatggtgaatttactgtaaatattgcttttatacaaaatggagaacctaccataggagtagtatatgttccagtgtatgatgtgttgtatgttgctaattatggtcaagcttggaaaattaattccattgggaaacaagaattattaaatattactgattatacttatatgtctagatataaaaatccccttgtcgtaatgagtagaacgtgtatatctgagtatgatcaaaagttattaaatgattatttaatgcagattaaaaattataaaattgttaatattggttcatcgtttaaattttgtttagtagcagaagggatagcacatttttatccgcggttttcctcgactaaaatttgggataccgctgctggacatgctattgctaaagcagctggagctttagttaatgattggaatggatatcctttaaattatagtagtattaataaatattttttaaatcctggatttcaagtatcactgtgtagttaa

SEQ ID NO: 84318 - protein, 262 aa, Candidatus Blochmannia floridanus
MIVDQIIYIARIAGMEIMRIYTGFGHRKIYVQQKMDQSPVTNADLIAHQVIVYLLRNLTPNIPIISEECIPEWRDCRHWNNFWLIDPLDGTKEFLSRNGEFTVNIAFIQNGEPTIGVVYVPVYDVLYVANYGQAWKINSIGKQELLNITDYTYMSRYKNPLVVMSRTCISEYDQKLLNDYLMQIKNYKIVNIGSSFKFCLVAEGIAHFYPRFSSTKIWDTAAGHAIAKAAGALVNDWNGYPLNYSSINKYFLNPGFQVSLCS

SEQ ID NO: 84319 - DNA, 942 bp, Prochlorococcus marinus subsp. pastoris str. CCMP1986
  CDS (1)..(942): transl_table=11
atgagaagatggttgtttaatattcatttagtgattaaattaccctctggtgtttatcttgaaaatcttatcgatgatttacgggcttttagctgggaagcttatgaaaccttaatttattactctaaaatagtaaaagattcaaacaacaaaagcaatatactaaaaaatgataatttagatgatccagtaacaaaggcagatttaaaagttaatgaggtaatcattaaaagaattaatgaaaaatataaagacattaattgggaaattttaagtgaggaaaacgtaaaattaacctctgaaagttgtaataataatgctgattggatttgggttcttgaccctcttgatgggactaaggattttattcaagggacagggaactatgcaatgcatctagctttaaattataagaataagccatatattggaattgttttaataccagataaagatgaattatggattacggatggagaaaaagtttggggagaaaaaaaagatggatcaaaaattaaacccaatttatctacaaacaaaagtcttaaagatatgagtttagtaacaagtaaaaatcatagaaatgaaataataaaaaaattaattcaaaaaattgatttttataaagtaattacaatgggaagtataggctgtaagatcgcatcaatcatcagaggagaaagcgatatttatataagtttgagcctaatggggaaaagctcccctaaagattgggattttgctgcaccagaagctattttaaaaacagcaggaggagtaattacaaatttagataatcaagaacttatttacgggaaatcaaatttcgagcaagggggtatcatcgttgcatccagtaatatcaatactcataaagatatatgtactgaaattaaggaaattatcaaaaaatacgatatataccctttaagaattaattaa

SEQ ID NO: 84320 - protein, 313 aa, Prochlorococcus marinus subsp. pastoris str. CCMP1986
MRRWLFNIHLVIKLPSGVYLENLIDDLRAFSWEAYETLIYYSKIVKDSNNKSNILKNDNLDDPVTKADLKVNEVIIKRINEKYKDINWEILSEENVKLTSESCNNNADWIWVLDPLDGTKDFIQGTGNYAMHLALNYKNKPYIGIVLIPDKDELWITDGEKVWGEKKDGSKIKPNLSTNKSLKDMSLVTSKNHRNEIIKKLIQKIDFYKVITMGSIGCKIASIIRGESDIYISLSLMGKSSPKDWDFAAPEAILKTAGGVITNLDNQELIYGKSNFEQGGIIVASSNINTHKDICTEIKEIIKKYDIYPLRIN

SEQ ID NO: 84321 - DNA, 918 bp, Synechococcus sp. WH 8102
  CDS (1)..(918): transl_table=11
atgatgccaagccctgccgtcctgcctgccggcgtcaaccaggacgttctgttgtcagaactccgtcgcctcagctggggggctgccgacatcctcagggcctatgcccgcggcgagcaaccgccccatggcttccccaaggctctcagcgtcgacgatggcggtgaaggccctgtttctgctgctgatctggccgtgaaccaatggctgctggatggcttgtcagctgcgtttcccaaggctgactggaccctgctcagtgaagaaacggccaaggagcagctcacggaaggccaaccgctgcaggcggagtggctctggatcctggatcccttggacggcaccaaggatttcctccagggcactggcgaatacgccgttcatctggcactggtgcgggggcaacgtcccgtgctaggggtggtgctgctgccggaagccgacgaactctggatcggcatcgtcggcgagggcgcctggtgcgaggaccgtcagggtgagcgctcgcccgttcgcttcagcgatagaaccgctgtttcggatctgatcctggtggccagtcgcagccaccgcgacgaccgtctggtgaagctgattgacgctctcgcgcttggaggttccaaggcggtgggcagcgttggctacaaggtcgccaccatcctgcggggcgaaactgatctctacgtctccctgtccggacgcagtgcccccaaggattgggacatggcggcccctgaggccgtgttgctggcggccggtggacgcttcacgcatgctgatcagacggacctcgcttacaacactggcgatgtgcgtcaggccggttgcctgatcgccagccatggaaaagcccacgccgagctcggagagcgtgcgacgcgggcgatggccgagatcgatcccggctttcaggtttga

SEQ ID NO: 84322 - protein, 305 aa, Synechococcus sp. WH 8102
MMPSPAVLPAGVNQDVLLSELRRLSWGAADILRAYARGEQPPHGFPKALSVDDGGEGPVSAADLAVNQWLLDGLSAAFPKADWTLLSEETAKEQLTEGQPLQAEWLWILDPLDGTKDFLQGTGEYAVHLALVRGQRPVLGVVLLPEADELWIGIVGEGAWCEDRQGERSPVRFSDRTAVSDLILVASRSHRDDRLVKLIDALALGGSKAVGSVGYKVATILRGETDLYVSLSGRSAPKDWDMAAPEAVLLAAGGRFTHADQTDLAYNTGDVRQAGCLIASHGKAHAELGERATRAMAEIDPGFQV

SEQ ID NO: 84323 - DNA, 786 bp, Chromobacterium violaceum ATCC 12472
  CDS (1)..(786): transl_table=11
gtgctagaacaggtgatgcagctggtacgcgacgtggccgcccgcgaggtgatgccgcgctttctgcgcgtcggcaaaagccgcaaggacgacggcaccctgttcaccgaagccgacctcgcctgccaggaagaactgcagcggcgcctgccggccatcctgccgcacccggtgctgggcgaggaaatggagcgcgaggagcaggacgcgctgtgggccgccaacaaggatgggctgtgggtggtggacccgatagacggcaccaccaacttcgtcaacggcctgccctatttcgcgatctcggtcggcctgatggtggacggcaaaagcgagctgggcgtgatctacaacccggtgtcggacgagatgttctacgcccgccgcggccagggcgcgtggctgaacggccaccggctgccgctgaagaccatcaacaactgcatgggcgacgccatcgccagcgtcgaggtcaaatacctgcgctccggcaagctggccgcccgcatcggcagcgtggcgccctgcggcagccagcgcaatatgggctccagcacgctggactggtgcttcctggccgccggccgctacgacctttacctgcatggcggccagcgattgtgggactacgccgccggcgccgtcatcgccgaggaagccggcgcctgcctggccagcctcaacaccgacgactactggagcgacgtggtgtggaagcgctcggtgatcggcgcgatcacgccggaactgttcgcgcagtggcaccgctgggtgcgcgccaaccaatag

SEQ ID NO: 84324 - protein, 261 aa, Chromobacterium violaceum ATCC 12472
MLEQVMQLVRDVAAREVMPRFLRVGKSRKDDGTLFTEADLACQEELQRRLPAILPHPVLGEEMEREEQDALWAANKDGLWVVDPIDGTTNFVNGLPYFAISVGLMVDGKSELGVIYNPVSDEMFYARRGQGAWLNGHRLPLKTINNCMGDAIASVEVKYLRSGKLAARIGSVAPCGSQRNMGSSTLDWCFLAAGRYDLYLHGGQRLWDYAAGAVIAEEAGACLASLNTDDYWSDVVWKRSVIGAITPELFAQWHRWVRANQ

SEQ ID NO: 84325 - DNA, 750 bp, Chromobacterium violaceum ATCC 12472
  CDS (1)..(750): transl_table=11
atgccggacgaccatcagctcgccgcccacatcgcggcagccgccgcccaacgattgctcgacctacgccgccgccatccggaaggcggcaaggcgctgggcgcgcgcggcgacgccgaagccaacgccctgattctggatatgctgcgcgcggcgcggccggatgacggcctgctgtccgaggaatccatgccggatcccgcccgcctgggccagcgtcgggtgtggatcgtcgacccgctggacggcacccgcgaatattgcgagccaggccgcgacgactgggcggtgcacgtcgcgctggcgctggacggcgcgcccgccgccgccgccgtggcgctgcccgcgcgcggcgagttgttctccacgcccgacccccggcttgccgccgcgccgccaggccggctgaaaatcctggtcagccgcagccgcgcgccggcgctggccgaacgcgtcgccgcccggctggacgccgagctggtcccgatgggatcggccggcgccaaggcgatgtcggcgctgcgcggcgaagcccacgcctatctgcacgccgggggcatgaacgaatgggacacctgcgcgccggtgggcgtggcgctggccgccggcctctacgcgtcgcggatagacggctcgccctgcgcgttcaaccaggcggacgtgaagatgccggacctgctgatctgccggccggaactggcggagacgctgctggcggcgataacggcggagcggatgccgggcgattga

SEQ ID NO: 84326 - protein, 249 aa, Chromobacterium violaceum ATCC 12472
MPDDHQLAAHIAAAAAQRLLDLRRRHPEGGKALGARGDAEANALILDMLRAARPDDGLLSEESMPDPARLGQRRVWIVDPLDGTREYCEPGRDDWAVHVALALDGAPAAAAVALPARGELFSTPDPRLAAAPPGRLKILVSRSRAPALAERVAARLDAELVPMGSAGAKAMSALRGEAHAYLHAGGMNEWDTCAPVGVALAAGLYASRIDGSPCAFNQADVKMPDLLICRPELAETLLAAITAERMPGD

SEQ ID NO: 84327 - DNA, 804 bp, Gloeobacter violaceus PCC 7421
  CDS (1)..(804): transl_table=11
atggagcggtttttggatatcgcctgtgtggcggcgcgggcggcgggggcagtgctgttgggctatctgggcaagctcgcggatttcgacgagaagacccccggcaatctggtcaccgacgccgatcgcgccgcggaggcggtgatcctcgctaccctcaagcgccactaccccgaccacggcatcctcgcagaggaatcggggctggccggtatcgaggagagcccctttttgtgggccgtggatccgctggatggcacgacgaactttgcccaccgctacccggttttttgcgtatcgatcggcctgctcatcgacggcaccccggtggtgggggcggtttttgacccggtgtcaggtgaactgttctcggccgcgcggggattgggggcattttgcaaccaccggccgattgccgtctcgactaccgaaaagctgggtcgcagcctgcttgccaccgggttcgcctacgaccggcgcgagacgcccgacaataactacgccgaattttgccagttcacccacctcacccagggggtgcgccggggcggctcagcggcgctggatctggcctacgtggcggcaggacgcttcgacggcttctgggagcggggcctctcgccctgggacatggtggccgggatcgtgctggtgagggaggcgggcggcacggtgagcgcctacgacggctcgccgctggatctgcgctcgggccgggtgctcgccaccaacggcgctgtgcacgcggcgatggtcgagcaactcggccgggtccaaccgctgactaccgcatttccggtgtaa

SEQ ID NO: 84328 - protein, 267 aa, Gloeobacter violaceus PCC 7421
MERFLDIACVAARAAGAVLLGYLGKLADFDEKTPGNLVTDADRAAEAVILATLKRHYPDHGILAEESGLAGIEESPFLWAVDPLDGTTNFAHRYPVFCVSIGLLIDGTPVVGAVFDPVSGELFSAARGLGAFCNHRPIAVSTTEKLGRSLLATGFAYDRRETPDNNYAEFCQFTHLTQGVRRGGSAALDLAYVAAGRFDGFWERGLSPWDMVAGIVLVREAGGTVSAYDGSPLDLRSGRVLATNGAVHAAMVEQLGRVQPLTTAFPV

SEQ ID NO: 84329 - DNA, 855 bp, Gloeobacter violaceus PCC 7421
  CDS (1)..(855): transl_table=11
atggctcccgtgcaaaggtcacccgaatatctgcttgaagtggcccggcgcacggcttggggggcggcggatattttgttggactattacaggcgaccgctcaagattcgccagaaaaacggcggcccagtcaccgacgcggatctggccgccgaccgctttattttgagtgagttgcgctctgcctgcggcaacgaagcgtttgcgtatttgagtgaggagacgatcggtggtctggagcgcttcgagcgcccctttttgtgggtagtggatccgctcgacgggacgcgcgattttatcgaccacacgggcgaatttgctgtgcacatcgcgctggtggaatcgggccggccggtcctggcggcggtggcctggccggtgcgcgagcgcgtctactttgcccgcaaagggtgcggggcttactctgagaaccgcgccggggtgcgcgaacgcctacaggtcagccagatcagccagctcgaccagtgccggattatcgtgagccgcgtccaccgcgactggcggctcgacgcgctgttggcgcggttgccgaaaagggagcgcatcgtccacggtggcttgggctgcaagctgtgcgccatcgccgcaggtgaggcggagatgtacgtggggctttcggggcgcagcgccccatgcgactgggatctggcagcaccgcagatcgtcttgaccgaggcgggcggtgcgatgagccgtttcgacggcggcgatttgctctacaaccagccggacttgcacctgtggggcggtctgattgccgacaacggtgttacccacggcagttggtgcaagctgttgccggatgtgctctcccaggtcgaacaactagattga

SEQ ID NO: 84330 - protein, 284 aa, Gloeobacter violaceus PCC 7421
MAPVQRSPEYLLEVARRTAWGAADILLDYYRRPLKIRQKNGGPVTDADLAADRFILSELRSACGNEAFAYLSEETIGGLERFERPFLWVVDPLDGTRDFIDHTGEFAVHIALVESGRPVLAAVAWPVRERVYFARKGCGAYSENRAGVRERLQVSQISQLDQCRIIVSRVHRDWRLDALLARLPKRERIVHGGLGCKLCAIAAGEAEMYVGLSGRSAPCDWDLAAPQIVLTEAGGAMSRFDGGDLLYNQPDLHLWGGLIADNGVTHGSWCKLLPDVLSQVEQLD

SEQ ID NO: 84331 - DNA, 825 bp, Gloeobacter violaceus PCC 7421
  CDS (1)..(825): transl_table=11
atgcaaagcttgacactatctacccaactgattcagcaggtcgtcgatctcgccaggcgggcgggagcagcgattatggaaatttataaccaggcggatgtcggtacagtctacaaggaggacaactcgcccctgacccaggcggacctggtgtcccaccggctgattgtcggcgagctgaccaaactgaccccggatctgcccgtgctctccgaggaatcccgctcgaagccctatgaggagcgccggacctggtcgcgcttctggctggtcgatccgatcgacggcaccaaagaatttatcaagcgcaacggcgaattcaccgtcaacatcgccttgatcgaggacggcgagccggtggcgggggtggtgcacgcgccggccgtccagacgacctactggtcggcccgcggcctgggcgccttcaagcaaaccgccgcggccgcggcccagcccatccgggcggccgtacccgcgagcgccccgatgctggtggtcgccagccgttcccacagtggtgctgagaccgaggcatttcttgccaaactgcgcgaactgggcgatatcgatgtcatctccatcggcagttccctgaaactgtgcctggtggccgaaggggccgcgcacctctatccgcgctacggcccgactatggaatgggacaccgccgccgcccacagcgtcgtggtcgaggccggcggcaccgtcaccaacctcaaaggtgaaacgctccagtacaacaaagccgacctgctcaatccgtattttgccgtgctgggcgatctgccccctgaactgagagcccagatcgtcgaacggctctga

SEQ ID NO: 84332 - protein, 274 aa, Gloeobacter violaceus PCC 7421
MQSLTLSTQLIQQVVDLARRAGAAIMEIYNQADVGTVYKEDNSPLTQADLVSHRLIVGELTKLTPDLPVLSEESRSKPYEERRTWSRFWLVDPIDGTKEFIKRNGEFTVNIALIEDGEPVAGVVHAPAVQTTYWSARGLGAFKQTAAAAAQPIRAAVPASAPMLVVASRSHSGAETEAFLAKLRELGDIDVISIGSSLKLCLVAEGAAHLYPRYGPTMEWDTAAAHSVVVEAGGTVTNLKGETLQYNKADLLNPYFAVLGDLPPELRAQIVERL

SEQ ID NO: 84333 - DNA, 804 bp, Photorhabdus luminescens subsp. laumondii TTO1
  CDS (1)..(804): transl_table=11
atgcatccgatgctgactatcgccatacgcgcagcgcgtaaagccggcaacctaattgccaaaaattatgaaactcccgatgcggttgaagctagccaaaaaggcagtaacgattttgttaccaatgttgacaaagccgcagaagcactcattatcgacgttattcgcaaatcttatcctaaacactcgattattaccgaagagagtggcgagcttttaggcgaagaggctgatattcaatgggtaatcgatccactggatggcacgactaactttatcaaacgcctccctcacttcgccgtctctattgcggtacgcattaaaggccgtactgaagttgcagttgtttatgacccaatgcgtaatgagcttttcaccacaacccgaggtcaaggggcacagttgaatggctaccgtctacgtggtaccaatgcccgtgatctggatggcaccattctggcaacaggtttcccatttaaagcaaaacatcattccactgtttttattaatactttaggtaaattatttgttcgttgtgctgacttccgtcgtacaggctccgccgcactggatctggcttatgttgcggctggtcgggtggatggttactttgaaattggcctaaaaccgtgggattttatgggtggcgaactgttagttcgtgaatctggcggtatcgtaactgatttcgttggcggtcataattatattcattccggcaacattgttgcaggtaatccacgcgttgttaaagatattttggctgaaatgcgtgatgaattatcagaagcattgaaacgttaa

SEQ ID NO: 84334 - protein, 267 aa, Photorhabdus luminescens subsp. laumondii TTO1
MHPMLTIAIRAARKAGNLIAKNYETPDAVEASQKGSNDFVTNVDKAAEALIIDVIRKSYPKHSIITEESGELLGEEADIQWVIDPLDGTTNFIKRLPHFAVSIAVRIKGRTEVAVVYDPMRNELFTTTRGQGAQLNGYRLRGTNARDLDGTILATGFPFKAKHHSTVFINTLGKLFVRCADFRRTGSAALDLAYVAAGRVDGYFEIGLKPWDFMGGELLVRESGGIVTDFVGGHNYIHSGNIVAGNPRVVKDILAEMRDELSEALKR

SEQ ID NO: 84335 - DNA, 744 bp, Photorhabdus luminescens subsp. laumondii TTO1
  CDS (1)..(744): transl_table=11
atgctagaacaaatctgccaactggctcaggaagctggtgcggctattatgacaatttatcaggatgaacatcccctgaaagttgatcataagcaagatgattcaccggttactatggctgatattgtggctcataaaataattaaagccggattatcccgtatcgccccagaaattccactgttgtcggaagaagagcttcctacttgggaagagaggcgtgattggaagcgctattggttagttgatcctctggatggtaccaaggaatttattaatcgtaacggtgaatttacggttaatatcgccttgattgatgagggcgttcctgtgatgggcgttatatatgctcctgtgcaggatacgctttattccgggcaagggcggcaggcatggaaaaaagcctgtggaggtcaatgtttgccgattaagattcgtgatgctaatccaccaatggtcgttgttagccgctctcatatggatacagaattagaagattatctcaatcaattaggtgaacatcagacggtttctgtagggtcttcactaaagttctgtttggtggcggaaggaaaagcgcaactttatcctcgctttgggcccactcatatctgggatactgcggcgggtcacgctatagccattgctgctggtgctcacgtgacgaactggaaaggtcagacgctagattatacgcctcgtgaatcattcctgaatccgggatttagagtaacgattttttaa

SEQ ID NO: 84336 - protein, 247 aa, Photorhabdus luminescens subsp. laumondii TTO1
MLEQICQLAQEAGAAIMTIYQDEHPLKVDHKQDDSPVTMADIVAHKIIKAGLSRIAPEIPLLSEEELPTWEERRDWKRYWLVDPLDGTKEFINRNGEFTVNIALIDEGVPVMGVIYAPVQDTLYSGQGRQAWKKACGGQCLPIKIRDANPPMVVVSRSHMDTELEDYLNQLGEHQTVSVGSSLKFCLVAEGKAQLYPRFGPTHIWDTAAGHAIAIAAGAHVTNWKGQTLDYTPRESFLNPGFRVTIF

SEQ ID NO: 84337 - DNA, 870 bp, Vibrio vulnificus YJ016
  CDS (1)..(870): transl_table=11
ttgggttttctctggtatactccccgccgcttttatttgttctttaacatccgttgggaaaatcgtatgcatccaatgctaaacattgctattcgcgctgcgcgaaaagcaggtaaccatattgctaaatcactagaaaacgttgagaagattgaatctacactaaaaggcacaaacgactttgtgactaacgtagataaagaagctgaaacaatcatcatcgacaccatcaagagctcataccctgagcattgcatcgtggctgaagaaaacggcctgatcaacggtaaagataaagatgtgcaatggatcatcgacccactggatggcacgacaaactttgtaaaaggtttgcctcacttcgctgtttcaatcgctgtacgcatcaaaggcaaaaccgaagttgcttgtgtatacgacccaatgctaaacgagctattcaccgctcaacgtggtgctggcgctcaacttaacaacgcacgtatccgcgttaaacaaccaaaagaccttcaaggcgcaatcatcgcaacaggtttcccattcaagcaaaagcaacactcagagtcttacttcaagatcatgtctgcgatgtttgtagaagtggcggatttccgccgcgctggctctgctgcacttgatctctgttacgtggcagctggccgcgtagatggttactttgagctaggcttaaaaccttgggatatcgcagcgggtgagcttattgctcgtgaagcaggcgcgatcatcaccgactttgctggcggtacagaatacatcaagtcaggtaacgttgttgcatcaagtgctcgtggtgttaaatcactactgaaacacatccgtgaaaacggcaacgaagcgattcttaagtaa

SEQ ID NO: 84338 - protein, 289 aa, Vibrio vulnificus YJ016
MGFLWYTPRRFYLFFNIRWENRMHPMLNIAIRAARKAGNHIAKSLENVEKIESTLKGTNDFVTNVDKEAETIIIDTIKSSYPEHCIVAEENGLINGKDKDVQWIIDPLDGTTNFVKGLPHFAVSIAVRIKGKTEVACVYDPMLNELFTAQRGAGAQLNNARIRVKQPKDLQGAIIATGFPFKQKQHSESYFKIMSAMFVEVADFRRAGSAALDLCYVAAGRVDGYFELGLKPWDIAAGELIAREAGAIITDFAGGTEYIKSGNVVASSARGVKSLLKHIRENGNEAILK

SEQ ID NO: 84339 - DNA, 921 bp, Rhodopseudomonas palustris CGA009
  CDS (1)..(921): transl_table=11
gtgcggcttattgccgacgattcagactatggaccgggagtcacccgccataataaaggagcaagggttcggccgctcccgtctaagatgacggttcggttccatgtcccgcccgcaatgctcgcaaaggatcgctccgtgacggtcatcgatttcgccgcctttatcggccgccttgcgacctcgtcgggcgacaccatcctgccgttctttcgcacatcgctcacgatcgacaacaagcagcccggccgtgatttcgacccagtgaccgaggccgatcgcgccgccgaggcggtgatgcgccggctgatcaaggcgagctttccccagcacggcatcatcggtgaagagttcggcaacgagcgcgaggacgctgattacgtctgggtgctggatccgatcgacggcaccaaatccttcatcgccggctttccagtgtggggcacactgatcgcgctgctgcacaagggcgcgccggtgttcggcatgatgcatcagcccttcattggcgaacgcttctccggcgacaatggttcggcgacgtacaaaggcccgtccggcgagcgcaagctcggcgtgcgccgctgcgccgccatcaaggacgccacgctgttcaccacctcgccgctgctgatgaatgacggtgatcgcggcatcttcgagaaggtgcaggccgaggcgcggctgacccgctacggcggcgactgctattcctattgtatgctggccgccggtcagctcgatctggtgatcgagaccgagctgaagccctacgacgtcgcggcgctgatcccgatcatcaccggcgccggcggcatcatcaccacctgggacggcaagccagcgcagaatggcggccgcatcgtcgcagccggcgacaagcgcgtgcacgaagccgcgatgaagatcctcaacgcctga

SEQ ID NO: 84340 - protein, 306 aa, Rhodopseudomonas palustris CGA009
MRLIADDSDYGPGVTRHNKGARVRPLPSKMTVRFHVPPAMLAKDRSVTVIDFAAFIGRLATSSGDTILPFFRTSLTIDNKQPGRDFDPVTEADRAAEAVMRRLIKASFPQHGIIGEEFGNEREDADYVWVLDPIDGTKSFIAGFPVWGTLIALLHKGAPVFGMMHQPFIGERFSGDNGSATYKGPSGERKLGVRRCAAIKDATLFTTSPLLMNDGDRGIFEKVQAEARLTRYGGDCYSYCMLAAGQLDLVIETELKPYDVAALIPIITGAGGIITTWDGKPAQNGGRIVAAGDKRVHEAAMKILNA

SEQ ID NO: 84341 - DNA, 828 bp, Rhodopseudomonas palustris CGA009
  CDS (1)..(828): transl_table=11
atgactgccgcgttcgaacagcccgccgtcgtttcggccgagcacgccgccgctttgctcgaaccgctcaccaagctggtgctgcgcgccggggcggcgatcatggtgatcccgcgcgacgccaaggtcactcagaagccggacggctcgccggtgacgcccgccgatctcgccgctgaccaggtgatcgccgaggggctggctcagatcgctccgcacgtcccggtgctgtccgaagaatgttgcggcaatggacgaccgacgtcgggcagcttcttcgtggtcgatccgctcgacggcaccaaggagtacatcgccggccgcgacgaattcaccgtcaacctggcgctggtgtgcgacggggtgccggtgctcggcatcatcggcgcgccggctctagggctggcgtggcgcggcgtggtcggccatggcgctgagcaactgactgtcgccgcggacggggtcagctttgcagccaccgccatccgcacgcggccgctgccgcagccgggcgagccgtggactgcaacggtcagccggtcgcatctcgatgccgccaccgtcgccttcatcgacgcccgcccgggcgccgtacatgcgacgctggggtcgtcgctgaaattctgccggatcgccgaaggcaaggccgacatctacccgcggctggcgccgatctgcgagtgggatatcgcggcaggcgctgcgctggtcatcgccgcgggcggcaaggtgaccgacgcggccggcgcgccgttgcggttcgacgcaccgcggccgaacttcatcgtgccggaattcatcgcctggggcgaccctgacggtcgctag

SEQ ID NO: 84342 - protein, 275 aa, Rhodopseudomonas palustris CGA009
MTAAFEQPAVVSAEHAAALLEPLTKLVLRAGAAIMVIPRDAKVTQKPDGSPVTPADLAADQVIAEGLAQIAPHVPVLSEECCGNGRPTSGSFFVVDPLDGTKEYIAGRDEFTVNLALVCDGVPVLGIIGAPALGLAWRGVVGHGAEQLTVAADGVSFAATAIRTRPLPQPGEPWTATVSRSHLDAATVAFIDARPGAVHATLGSSLKFCRIAEGKADIYPRLAPICEWDIAAGAALVIAAGGKVTDAAGAPLRFDAPRPNFIVPEFIAWGDPDGR

SEQ ID NO: 84343 - DNA, 729 bp, Mycobacterium avium subsp. paratuberculosis str. k10
  CDS (1)..(729): transl_table=11
atgaatgaccatgagctggccgcgcggttggccaccgaggccggtcggctgctgctgggggttcgagacgagttcgccgacgctccggcaagcgagcggaaagcggcgggggacaagcgatcccacgattttctgatcgaggcgctggctgccgaacggcccggcgatgccgtgctgtccgaggagggcgccgacgacccggtgcgattgcgctccgagcgggtctggatcgtcgacccgctggacggcacgcgggagttctccgagctcggccgcgacgactgggcggtgcacgtcgcgctctgggaggccggcgagctggtggccggcgcggtggcactgccggcgcagggcgtcacgttcgcgacccccgaggtcgcgtcaccccccgtcgcgccgggcaagccgcgcatcgtggtgtcgcgcacccgcccgcccgccatcgcgttgaacgtgcgggacgcgttggacggtgttctggtggaaatgggttcggccggcgccaaggtggcctcggtcgtccaggggctctccgacgtgtacgtgcacgccggcggccagttcgaatgggactcggccgcgcccgttgcggtggcgcgggccgccggattgcacacgtcgcgcatcgacgggtcgacgctggcctacaaccaacccgacccgaagctgcccgatctggtggtctgccgtcccgagctggccgacgccgtcctcgcggtcacccgctga

SEQ ID NO: 84344 - protein, 242 aa, Mycobacterium avium subsp. paratuberculosis str. k10
MNDHELAARLATEAGRLLLGVRDEFADAPASERKAAGDKRSHDFLIEALAAERPGDAVLSEEGADDPVRLRSERVWIVDPLDGTREFSELGRDDWAVHVALWEAGELVAGAVALPAQGVTFATPEVASPPVAPGKPRIVVSRTRPPAIALNVRDALDGVLVEMGSAGAKVASVVQGLSDVYVHAGGQFEWDSAAPVAVARAAGLHTSRIDGSTLAYNQPDPKLPDLVVCRPELADAVLAVTR

SEQ ID NO: 84345 - DNA, 1032 bp, Anopheles gambiae str. PEST
  CDS (1)..(1032)
atggcaccagccaacatgaacttgggcagatcgatacgcatcaataagtgtggcgtggtgatactgggcctgctgtttatgtgcattctgtactatctctggagcagcaacagtgcgaatgcggccagctatgcgttcagcaagaatccgaacgagatcaacctgcgcaagctgctgatcggttcgatacaggctgcccagcacggtggcttcgaggtggtggccgtgtccaagtcgcgcgatctgcacgagcaaagcaagggcaagacgaaggagggcgccaacaacccggtgaccgatgcggactaccggtccaactgtgtgatgaagaatgggctgctgcgaattttccccaagctgaaggtgatctccgaggaggacgaccggcaggagcagtgcgcggatgtgcagctgttcgatcttgaccccacggtgctgccggagagtgtgaccgtgccagacgaacgtgtctccattgacgaggtggatgtgtggatagacccgctggacgcgacccaggaatacaccgagcgactccacgaatacgtcaccacgatggtgtgcgtggcggtgaagggcgttccaacgatcggcatcatacacaatcccttctcgatgaagacgacctgggcgtggcgcggcaaggcactgtccgagtcgctcgtcaacctgaagcacgatgcggacgtgaagcatccaaccatcatcgtgtcccggtcgcatgcgggcgctgtgaaggaacagtcgaagcaaatattcggcgaaaacgcacaagtcataacggccggcggtgctggcttcaaagtgctgcaggtgatacagaacaacgcgacggcgtatctgcacacgacgcacatcaagaagtgggacatttgtgccggcgacgcaatactcggcgcgatcggtggcagaatgagcgatttgcacaatgaaaacatcgcgtaccatcgggatacgccggcgctcaacccgaacgggctgctggcggcggccctttcctcgacgcacgaagcgtacattaagcggatatag

SEQ ID NO: 84346 - protein, 343 aa, Anopheles gambiae str. PEST
MAPANMNLGRSIRINKCGVVILGLLFMCILYYLWSSNSANAASYAFSKNPNEINLRKLLIGSIQAAQHGGFEVVAVSKSRDLHEQSKGKTKEGANNPVTDADYRSNCVMKNGLLRIFPKLKVISEEDDRQEQCADVQLFDLDPTVLPESVTVPDERVSIDEVDVWIDPLDATQEYTERLHEYVTTMVCVAVKGVPTIGIIHNPFSMKTTWAWRGKALSESLVNLKHDADVKHPTIIVSRSHAGAVKEQSKQIFGENAQVITAGGAGFKVLQVIQNNATAYLHTTHIKKWDICAGDAILGAIGGRMSDLHNENIAYHRDTPALNPNGLLAAALSSTHEAYIKRI

SEQ ID NO: 84347 - DNA, 861 bp, Acinetobacter sp. ADP1
  CDS (1)..(861): transl_table=11
atgtttattcagactgatcaatcaataacaggtaatttaattaatcaattattgccgattttagagcaagcttctaatttgttaaataacgagtatgaaaattatatttcaggaaatcagttagatatccaaaaaaaaacagatgaatctcctgtaacgcaagctgatcttaaaataaatcattttctagtaacagagttggccagaataacacctgattaccctgtattatctgaggaaggtgacaatactcagcgatgttcatggaatatttgctggatgttggatcctttagatgggacaaaagagtttattcagcaaagagatgagttcactatcaatctgagtttaatcgaagattcatatacttcattttctgtgattgttgttccgcgtgagcaacagatgtatataggatatacacatgaattgccgtataaatatcagtttaattctaaacaatggtggcgatatcatcattcaattgagagcctgaataatacgattcaagttggactaagccatcgaagtaagagtagtaaatatcaaaaatttatagagtacttagagagtgactataagattgtttgtcgtgaggctgggagtgcttataaattttgtatgatgctagaaggtaaaattgatttctatccgagatttcatccaacatctgaatgggatacaagtgctggacaggcattgctggaaagtattgggggaggcttagtctctttaaacggtattccatttaaatataatgtacgtaccaccgttttaaaccaaggcttcattgcgtattcaaaatctgagtataggcatttggtattggagctattacaacaaatagatttttcaaattga

SEQ ID NO: 84348 - protein, 286 aa, Acinetobacter sp. ADP1
MFIQTDQSITGNLINQLLPILEQASNLLNNEYENYISGNQLDIQKKTDESPVTQADLKINHFLVTELARITPDYPVLSEEGDNTQRCSWNICWMLDPLDGTKEFIQQRDEFTINLSLIEDSYTSFSVIVVPREQQMYIGYTHELPYKYQFNSKQWWRYHHSIESLNNTIQVGLSHRSKSSKYQKFIEYLESDYKIVCREAGSAYKFCMMLEGKIDFYPRFHPTSEWDTSAGQALLESIGGGLVSLNGIPFKYNVRTTVLNQGFIAYSKSEYRHLVLELLQQIDFSN

SEQ ID NO: 84349 - DNA, 804 bp, Erwinia carotovora subsp. atroseptica SCRI1043
  CDS (1)..(804)
atgcatccgatgctcaacatcgctatacgcgctgcgcgtaaagccggcaatttgattgccaaaaactatgaaacaccagacgccgtcgaagctagccagaaaggcagcaacgattttgtgaccaacgtcgatcgggatgcagaacgtctgatcattgaagtcatccgcaagtcttacccacagcacaccattattggtgaagaatgtggtgagctggcaggtgaagatccggcagtacaatgggttatcgatcctctggatggcaccaccaacttcatcaagcgtttaccccacttcgccgtttctatcgcggtccgcattaaaggccgtaccgaagttgccgttgtttatgatcctatgcgtaatgagctgtttagtgctacccgtggtcagggcgcacaactgaacggctatcgtctgcgcagcagtactgcccgcgatcttgaaggcaccgtactggcaacaggtttccccttcaaattaaaacaacacagcaaaagttatatcaacgtcgttagcgcactgttcacccaatgtgcggatttccgtcgcacgggttctgccgcactggatctggcctatgtggccgcgggtcgcgttgatggtttctttgagatcggtctgaagccgtgggattttgccggtggcgaactgctggtacgtgaagcaggcgggatcgtgacggacttcgttggcggccataactatctggcatccggcaatctggttgcaggcaacccgcgtgtggtgaaatctattctgggcaccatccgtgaagaactgagcgacgcgctgaaacgctaa

SEQ ID NO: 84350 - protein, 267 aa, Erwinia carotovora subsp. atroseptica SCRI1043
MHPMLNIAIRAARKAGNLIAKNYETPDAVEASQKGSNDFVTNVDRDAERLIIEVIRKSYPQHTIIGEECGELAGEDPAVQWVIDPLDGTTNFIKRLPHFAVSIAVRIKGRTEVAVVYDPMRNELFSATRGQGAQLNGYRLRSSTARDLEGTVLATGFPFKLKQHSKSYINVVSALFTQCADFRRTGSAALDLAYVAAGRVDGFFEIGLKPWDFAGGELLVREAGGIVTDFVGGHNYLASGNLVAGNPRVVKSILGTIREELSDALKR

SEQ ID NO: 84351 - DNA, 741 bp, Erwinia carotovora subsp. atroseptica SCRI1043
  CDS (1)..(741)
atgctagaacctatttgccaactggcccgtgatgccggtgctgccattatgcaggtttacgacgggcagcatcccgtagatgtcgcgcacaagaaagatgattcgccagtgaccgcagccgatctcgcggctcatcgggtcattaaggaaggactggcggcggcgtttcctgatattcctttgctgtcagaagaagatccgccggagtgggaagtccgtcggcactggcagcgctattggctggtcgatccgctggatggcacgaaagagttcctcaaccgcaacggcgagtttacggtcaatattgcgctgatcgaaaacggccaagccgtgatgggtgtggtttatgtaccggtcacgggcgtgatgtattccgcggcggatggtaaagcctggaaagaagataacggccagcgccagcaaatttcggtgaagcaggcgtatccgccgctggtggtagtcagccgctctcatgccgatcgtgaactgaaagattatcttagccagttgggtgagcaccagacggtggcgattgggtcatcgctaaaattttgtttggtggcagaaggtgaagcgcagctttacccacgcttcgggccgactaacatttgggatacagcggcgggccatgcggtggcggtggcagctggggcgcagattcacgattggcaggggcagcctctgtcttacacgccgcgtgaatctttcctcaaccccggttttcgcgtctctttattttag

SEQ ID NO: 84352 - protein, 246 aa, Erwinia carotovora subsp. atroseptica SCRI1043
MLEPICQLARDAGAAIMQVYDGQHPVDVAHKKDDSPVTAADLAAHRVIKEGLAAAFPDIPLLSEEDPPEWEVRRHWQRYWLVDPLDGTKEFLNRNGEFTVNIALIENGQAVMGVVYVPVTGVMYSAADGKAWKEDNGQRQQISVKQAYPPLVVVSRSHADRELKDYLSQLGEHQTVAIGSSLKFCLVAEGEAQLYPRFGPTNIWDTAAGHAVAVAAGAQIHDWQGQPLSYTPRESFLNPGFRVSLF

SEQ ID NO: 84353 - DNA, 777 bp, Rickettsia typhi str. Wilmington
  CDS (1)..(777): transl_table=11
atgaatgacaatttaattaatgctttaaaagatttaattattaatactggtaaggttgcactagatatcaaaaaaacaggaatattgattgatactaaatcagatggttctgtggtcacgaatgcagatcaggaaattagtaaaataatttatcagactttacaaagcttaacatctcaaatagcaatagtatgtgaagagcagccactacctatattaaacagtgatactttttggttaatcgatcctattgatgggacacggagctatgtagatggtaaaaatacatatacggtaaatataggcctgattgaaaatggttttccgactatcggtttgatatatcatcctgaaacagcaaagctgtattatactgatgtaaacggtcgattaaaaatcgaacagaattctcaagaaatatttgtgaagcatgcacctaaacataaagagcctaatgctgtagtaggtttttataattcaaataaagctactaaagaatttttaaggagttattcattcggtaaaataaatacaataagtagttcaattaaattatgtttaattgctgaaggtgaagctgatatatatcccaaatttggtcaaactatggagtgggatatagctgcaggtcatgcattaattaaagctagcggcggtaatattttagattgtgacggacaagaagtgacttacggtaaagtaaattttgctaatcctcatttttttgcatgtagtaaatattggttggaaatggattatattttttgtatacgctaa

SEQ ID NO: 84354 - protein, 258 aa, Rickettsia typhi str. Wilmington
MNDNLINALKDLIINTGKVALDIKKTGILIDTKSDGSVVTNADQEISKIIYQTLQSLTSQIAIVCEEQPLPILNSDTFWLIDPIDGTRSYVDGKNTYTVNIGLIENGFPTIGLIYHPETAKLYYTDVNGRLKIEQNSQEIFVKHAPKHKEPNAVVGFYNSNKATKEFLRSYSFGKINTISSSIKLCLIAEGEADIYPKFGQTMEWDIAAGHALIKASGGNILDCDGQEVTYGKVNFANPHFFACSKYWLEMDYIFCIR

SEQ ID NO: 84355 - DNA, 804 bp, Mannheimia succiniciproducens MBEL55E
  CDS (1)..(804): transl_table=11
atgcaaataactcaacaacttctcgatgacgtattgaaaatcgcctcattagcgggcgaacatctaaaaacattctatgcaaaatccgtgaacgtagaaataaagacggacaatacacccgttacggaagccgatttatttttgagccaatttctaatcgaaaaattaaccgtactaacgccggatattcccgtgctctcggaggaaaactgcaacattccgctggccgaacgtcaaaaatggcagtcttactggttaattgatccggtggacggtacacaacaatttatcaatcataccgggcaattttccattatgatttgcctggttcaggataatcaaccgcaactcggcattatccatgccccaatcataggaaaaacctattatgcccgtcggggactaggcgcttttctgattgaaaacggctgttgccgaaaacttccgccgcttcaaccacacaatcatcagcacatcaaaattaccatcggttcgtctaatccggaaaaaatccgccaatccgtacaaccgccttataaggcggatctgttattgtacggatccagcagtttgaaatccggccttgttgccgaaggcgtggcggactgttacgttcgtttgggcaatacgggtgaatgggataccgcagcggcagaagtattgctgaatgaagtgggcggcaaaatttttaatttacaataccggcctctcacttataatcagcgagaaacattagtgaatccccattttgtcatggctaatgcacaattggattggaaaaaaatctttcgatttgatttgtaa

SEQ ID NO: 84356 - protein, 267 aa, Mannheimia succiniciproducens MBEL55E
MQITQQLLDDVLKIASLAGEHLKTFYAKSVNVEIKTDNTPVTEADLFLSQFLIEKLTVLTPDIPVLSEENCNIPLAERQKWQSYWLIDPVDGTQQFINHTGQFSIMICLVQDNQPQLGIIHAPIIGKTYYARRGLGAFLIENGCCRKLPPLQPHNHQHIKITIGSSNPEKIRQSVQPPYKADLLLYGSSSLKSGLVAEGVADCYVRLGNTGEWDTAAAEVLLNEVGGKIFNLQYRPLTYNQRETLVNPHFVMANAQLDWKKIFRFDL

SEQ ID NO: 84357 - DNA, 816 bp, Mannheimia succiniciproducens MBEL55E
  CDS (1)..(816): transl_table=11
gtggaaattattatgaatccaatgttaaatattgctattcgtgcggcacgaaaagcaggcaatgtaattgctaaaagttatgaacgccgcgatgatattcaaacaaccttaaaaagcgctaatgattacgtaacaaatgtagataaagctgctgaacaggcaattatcgacgttattcgtacatcttatccggaccataccatcattaccgaagaaagtggggcgttagaaggtaaagatagcgatattcaatgggtaattgatccgctagatggcacaacaaactttgtaaaaggtttacctcatttttccgtttctatcgctattcgtgtaaaaggccgtaccgaagtcggcgttgtttacgatcctattcgtaatgaactatttactgccgtgcgcggtgaaggcgctaaattaaacgatcttcgcttgcgtgttgatgcaaaacgcgaattggaaggtgcaatattagcgaccggtttcccattcaaacaagctcgtcatatgccgttacatttcgcggtaatgaatagtttaattgaaagctgcgcggatttccgtcgtacgggatcggcggcgttagatttatgctacgtggcggcaaaccgtgtggacggtttcttcgaaatcggtttaaaaccctgggattgtgcagccggcgacctgattgtacgtgaagcgggcggtttggttaccgattacaacggcggccatagctatttaacttccggtcatattgttgcggcatcagcccgtgtagtaaaagaaattctaaatcgcttgcaaccgctgttaggcgatgaattcaaaaaataa

SEQ ID NO: 84358 - protein, 271 aa, Mannheimia succiniciproducens MBEL55E
MEIIMNPMLNIAIRAARKAGNVIAKSYERRDDIQTTLKSANDYVTNVDKAAEQAIIDVIRTSYPDHTIITEESGALEGKDSDIQWVIDPLDGTTNFVKGLPHFSVSIAIRVKGRTEVGVVYDPIRNELFTAVRGEGAKLNDLRLRVDAKRELEGAILATGFPFKQARHMPLHFAVMNSLIESCADFRRTGSAALDLCYVAANRVDGFFEIGLKPWDCAAGDLIVREAGGLVTDYNGGHSYLTSGHIVAASARVVKEILNRLQPLLGDEFKK

SEQ ID NO: 84359 - DNA, 819 bp, Bacteroides fragilis YCH46
  CDS (1)..(819): transl_table=11
atggaacataaatacttatttgtcgctgttgatgcagccctgaaggcgggggaggaaatattgtctatttataccgatccggcttcggacttcgaaatagagcggaaagcggatcactctcctttgactattgctgaccggaaagcacacgtaacaattgccaccattctgaacgaaactccttttcccgtactgagcgaagaggggaaacatttagagtatgatacccgtcgcaattgggatgtgatgtggattgtcgatccattggatggtacgaaagagtttatcaagcgaaacggtgagtttacggtaaatattgcgttagtgaaagccggagttcccattatcggagtgatttatttaccggtcaaaaaagaactttactttgccggtcaggaaatcggtgcctacaagctgtcgggcattacgactttagaagacgatgcaacactcgataagctggtagctgcttccgtacggttgccgcaagacctgcagcgggatcgatttgtagtagtggcttcccgttcacacctgactccggagaccgaagcgtacattgatgcggtgaagcaagaacacaaacatgtcgagttgatttccagcggcagttctattaaaatatgtttggttgccgaaggtaaagcggatgtttatccccgttttgctcctacgatggagtgggatactgctgccgggcatgccattgcgcgcgctgcgggaatggaaatttatcaggcggataaaaaagatgttcctttgcagtataataaagaagatttactgaatccctggtttattgttgagaagagaaggtaa

SEQ ID NO: 84360 - protein, 272 aa, Bacteroides fragilis YCH46
MEHKYLFVAVDAALKAGEEILSIYTDPASDFEIERKADHSPLTIADRKAHVTIATILNETPFPVLSEEGKHLEYDTRRNWDVMWIVDPLDGTKEFIKRNGEFTVNIALVKAGVPIIGVIYLPVKKELYFAGQEIGAYKLSGITTLEDDATLDKLVAASVRLPQDLQRDRFVVVASRSHLTPETEAYIDAVKQEHKHVELISSGSSIKICLVAEGKADVYPRFAPTMEWDTAAGHAIARAAGMEIYQADKKDVPLQYNKEDLLNPWFIVEKRR

SEQ ID NO: 84361 - DNA, 804 bp, Methylococcus capsulatus str. Bath
  CDS (1)..(804): transl_table=11
atgtttcccgaaatcgcaaccctggagaccttgctgagggatgtcgcccgcgaggaactgctcccccgtttcgcccgcgcccagcggtcggtcaagcccgacggcagcatcgtgacggaggccgatctggcggtacaggagcggttggccggagagcttcgcaaactgacacccgacgtcgaggtgctcggggaagaaatgagccgggacgagcaagagagcctcgtggcgcgtgccggcgccggcctgtggtgtctggatcccctggacgggaccagcaatttcgccgctggaattccgttcttctccatatcactggccttgatcagggaagggggttcggtgctcggtctggtgtacgatcccgtgcgcggcgaatgcttcgtcgccagcgctggcgagggggcctgggtgaacggcgagcgcctgttgccgcggcgtgtcggcctgtccctgcggcgctgcatcgccgtggtcgatttcaagcgccttgatcgtgccttgagacgccggctggtggatgagccgccattcagctcgcaacgcaacttcggttccacggccctcgaatggtgttggctggcggcgggccgttaccatctttacctgcacggtggccagaaactgtgggactatgcggctggcatgctgattctggccgaggccggcggccgggcgacacgtctcgcccgggaggtgtccgtcgcggcggacatgggggtgcggtccgccgtggccgctctggatcccgagctgttcggtcagtgggtggcgtggctcggcgcaatgccgggggaggagtga

SEQ ID NO: 84362 - protein, 267 aa, Methylococcus capsulatus str. Bath
MFPEIATLETLLRDVAREELLPRFARAQRSVKPDGSIVTEADLAVQERLAGELRKLTPDVEVLGEEMSRDEQESLVARAGAGLWCLDPLDGTSNFAAGIPFFSISLALIREGGSVLGLVYDPVRGECFVASAGEGAWVNGERLLPRRVGLSLRRCIAVVDFKRLDRALRRRLVDEPPFSSQRNFGSTALEWCWLAAGRYHLYLHGGQKLWDYAAGMLILAEAGGRATRLAREVSVAADMGVRSAVAALDPELFGQWVAWLGAMPGEE

SEQ ID NO: 84363 - DNA, 819 bp, Methylococcus capsulatus str. Bath
  CDS (1)..(819): transl_table=11
atgcccatcatgaaggagccttcccgcctgctcgaatccgtggtcgcgctggccaaggaggccggccgggctatcctcgcgatctatgactcggagttcagcgtcacgcagaaatccgaccaatcaccactgacggcggcggatctggcatcgcatgagttgattgtagccggactggctcgtctgagaccccaatttccggtactttcggaagagtcagcggctcacgcgttcgaagacaggaaaaactggtcttcgctctggctggtcgacccgctggacggcaccaaggaattcgtgaaaagaaacggggaattcacggtgaacatcgccctgatccatgaacacgcgcccgtcctgggcgtcgttcacgcccctgcgctggacctgacgtatttcgccgccgaaggttgtggcgcctttcgccagcacggcgaccagacaccgcaacgcatccgggtgcgcgcccaggcaccgctgcatcccgtcgtcgtcggcagccggtcgcacgtgaatgctgcaatggagacttatctgaaccggctgggagaatatgaattgcggccgatgggcagttcgctcaagctctgtctggtggcggaaggaaccgccgatctgtatccccggatcggtccgacttccgaatgggatacggcggcggcacattgcgtcgtcaccgaggccggcggcgcggtgaccgacctcacgggcgccccgctcgtgtataacgcaagagacagtctgttgaatccttacttcctggtgttcggcgacaagagccgtccctggctcgactacacgcgaggaatcgaaggctag

SEQ ID NO: 84364 - protein, 272 aa, Methylococcus capsulatus str. Bath
MPIMKEPSRLLESVVALAKEAGRAILAIYDSEFSVTQKSDQSPLTAADLASHELIVAGLARLRPQFPVLSEESAAHAFEDRKNWSSLWLVDPLDGTKEFVKRNGEFTVNIALIHEHAPVLGVVHAPALDLTYFAAEGCGAFRQHGDQTPQRIRVRAQAPLHPVVVGSRSHVNAAMETYLNRLGEYELRPMGSSLKLCLVAEGTADLYPRIGPTSEWDTAAAHCVVTEAGGAVTDLTGAPLVYNARDSLLNPYFLVFGDKSRPWLDYTRGIEG

SEQ ID NO: 84365 - DNA, 807 bp, Nocardia farcinica IFM 10152
  CDS (1)..(807): transl_table=11
gtgaccagttctgctcagctcatggatgtggcgcgagaagcggtttcgaaaggatcgaagctcctgctcaacgccccggcaggaaaggtgagcgccaagagcgaccgcgattacgtcaccgaattggacgtcgagattcagatggtggtccaggagttcttggcgcggcacacgccggagatcggcttcctcggggaggaggcgaaccccgcaccagacttttcggaacagtctcgctggtggaccttggaccccatcgacggcacctcgaacttcgtccacggactccctctctgcgccgtctcgctcgccctggtcgagcacgggcgttccgtgctcggcgtcgtcaacgcaccattcctcgacctcgagtaccacgccaccctcgatgccggggcctctgtgaacgacgcgccgatgaccgcgagtaccgtcacccgcctctccgacgccgtgatctctctcggcgactacgcggtcggtgcaggggccgcgcggaagaaccgggagcgcctggcgatcacggccgcactcgcggagcgggtcgagcgggtgcggatgttcggttcggcggcactcgacctcgtgtgggtggccgagggacgcaccgacggctgcgtcatgctgtccaacaacccctgggacaccgccgccggtgctctgatcgccgcagagagcggcgcactggtcaccgacaccgacggcagcccgcacaccgtgggatcgaaacacaccgtcgccgctgcgccgggcctgtctgccgagctactccgtctggtggccgatgcgagagcaggccatcactga

SEQ ID NO: 84366 - protein, 268 aa, Nocardia farcinica IFM 10152
MTSSAQLMDVAREAVSKGSKLLLNAPAGKVSAKSDRDYVTELDVEIQMVVQEFLARHTPEIGFLGEEANPAPDFSEQSRWWTLDPIDGTSNFVHGLPLCAVSLALVEHGRSVLGVVNAPFLDLEYHATLDAGASVNDAPMTASTVTRLSDAVISLGDYAVGAGAARKNRERLAITAALAERVERVRMFGSAALDLVWVAEGRTDGCVMLSNNPWDTAAGALIAAESGALVTDTDGSPHTVGSKHTVAAAPGLSAELLRLVADARAGHH

SEQ ID NO: 84367 - DNA, 801 bp, Photobacterium profundum SS9
  CDS (1)..(801): transl_table=11
atgcatccgatgcttaatatcgccattcgcgctgcgcgaaaggctggtgaccatgtcattaaatcgttagaaaaacctcaaggcattgaagttgccaataaaggcagtgacgtcgttactaatattgatcatgaagctgaagctatcatcatcaattctattcttaaatcttaccctgatcactgcattcttgcagcagagtctggtactaaagaaggccgtgacaaagagtgtcagtggatcatcgacccagtggatggcaccaaaaacttcgtacgtggtttgcctcattacgctatttcaattgcactacgcatgcgtggtcgtactgaagtttctgtagtatacgatccatctcgtaacgaactcttcactgcaacacgtggttctggcgcacagcttaacagccaacgtctacgtacatcacagcctcgtgaccttagcggtactattattgctactggtttaccattcgcagctaagcaacacgctgaagcgcttaacaaagtacaatcagcaatttttgttgagtgtgacgatatgcgtcaatctggttgttcagcactagacctttgttacctagcagcaggtcgtgttgatggcgtagttaaactaggtcaaaagccttgggaactagcagctggtgaactaattgcacgtgaagcgggcgctatctgtactgactttactggtaacactaactacctaacatctggcaacattgttgctggtaatgcacgcgtagttaagccaatcatcgctaaaatccgtgaacacggtggcgaagcattagctaaataa

SEQ ID NO: 84368 - protein, 266 aa, Photobacterium profundum SS9
MHPMLNIAIRAARKAGDHVIKSLEKPQGIEVANKGSDVVTNIDHEAEAIIINSILKSYPDHCILAAESGTKEGRDKECQWIIDPVDGTKNFVRGLPHYAISIALRMRGRTEVSVVYDPSRNELFTATRGSGAQLNSQRLRTSQPRDLSGTIIATGLPFAAKQHAEALNKVQSAIFVECDDMRQSGCSALDLCYLAAGRVDGVVKLGQKPWELAAGELIAREAGAICTDFTGNTNYLTSGNIVAGNARVVKPIIAKIREHGGEALAK

SEQ ID NO: 84369 - DNA, 744 bp, Photobacterium profundum SS9
  CDS (1)..(744): transl_table=11
gtgagtattttacttgagtctatttatgagattgctttggatgcaggcaaagtgatcatgaaccactaccactcaggtgttcatgttgaagaaaaagcggatcacagtccagttactgctgccgatatagctgcgaatgatattattgttgagcgtttaatgatgctaacacctgacattcccattttatctgaagagtcagcactctcttcttggtctgaaaggcagggctggaccgcattttggctggtggatccattagatggtactaaagagttcttgcgtcaaaatggtgaatttaccgttaacatcgccttaatagaaggagggaaaccaactctttccgttgttcatgcgccagcattaaataaaagttggcttgctgacggttcgacagcgtggctagaaacaatgtctggacgcgatgaaattaaagcgatacccgcaatgataccgactattgttggaagtcgatctcatccaagccctgatatggcgaactatctacaagaagtgggtgagcataagatggtagaagtcggctcttcgttaaaattctgccttattgcagaaggggtagctcagtcttatcctcggttaggaccaacaatgatgtgggatacagccgctgggcaatgtgttgcagaaagtgcgggagctgccgttttacaattagatggcgaagagcttcagtatcatagagacaaattattaaacccatcctttatagtctccatcatttaa

SEQ ID NO: 84370 - protein, 247 aa, Photobacterium profundum SS9
MSILLESIYEIALDAGKVIMNHYHSGVHVEEKADHSPVTAADIAANDIIVERLMMLTPDIPILSEESALSSWSERQGWTAFWLVDPLDGTKEFLRQNGEFTVNIALIEGGKPTLSVVHAPALNKSWLADGSTAWLETMSGRDEIKAIPAMIPTIVGSRSHPSPDMANYLQEVGEHKMVEVGSSLKFCLIAEGVAQSYPRLGPTMMWDTAAGQCVAESAGAAVLQLDGEELQYHRDKLLNPSFIVSII

SEQ ID NO: 84371 - DNA, 834 bp, Photobacterium profundum SS9
  CDS (1)..(834): transl_table=11
atggaattatctcacctcattccctcggtggtcgatatcgctcgcgaatctgggcaagtgattttagatatttatcaacgtggtcagtttgaaaaatacataaaacaagataacacgcctgttacgagtgctgacttagcggctcataaattagtcgttgagcggctcacagaacttactcctaatattccagtattgtctgaagaagatgccactgtaccgctaaaagagcgtagtaaatgggatcgctattggttggtcgacccattggatggtacgcaagagtttattgctggcagtggtgatttcgcgacgattattgctttggttgaaggtaataagccaattatgggtgtagtatacgcccccgtttctggggtcgtttattatgcatatagtgggaaaggcgcatggaagattacacctgagggtgaaaccgttcgtatttcgacacataagcatgaattgccgacccaatcaatagctgttgcgattagtcgccgccaagatatcagtgcgattactaatcgcttagatccagcattgaactatgaattggtaccgcttggctctgcggcattgaaagcctgcttggtcgctgaaggggctgtagattgttatttacgtcttggtccaactggtgagtgggataccgccgcgacgcaatgtattgttgaagaggctggtggacgcatattgaatacgcatcttaacccgctgtcttataacgagcgtgatacgttagaaaatccgaatttcattacactcggtgacgaatctttgccatgggcagatattctaacgccagacaatcgcttgattgatgtccagtaa

SEQ ID NO: 84372 - protein, 277 aa, Photobacterium profundum SS9
MELSHLIPSVVDIARESGQVILDIYQRGQFEKYIKQDNTPVTSADLAAHKLVVERLTELTPNIPVLSEEDATVPLKERSKWDRYWLVDPLDGTQEFIAGSGDFATIIALVEGNKPIMGVVYAPVSGVVYYAYSGKGAWKITPEGETVRISTHKHELPTQSIAVAISRRQDISAITNRLDPALNYELVPLGSAALKACLVAEGAVDCYLRLGPTGEWDTAATQCIVEEAGGRILNTHLNPLSYNERDTLENPNFITLGDESLPWADILTPDNRLIDVQ

SEQ ID NO: 84373 - DNA, 825 bp, Idiomarina loihiensis L2TR
  CDS (1)..(825): transl_table=11
gtggcagaaacaatgctggagaaactgaaggaaatagcattcgaagcaggtggcgttattctgtcaatgtacgagcggcgtgactataaaacggccgagaaaaaagacgattctccagtgactaccgcagatcttgttgccagcgaactaatagaagatcgactcaagcagtcattccctgatattccggttatttctgaagaaagcgagcatcaggactataatgagcgccgtcagtggagagcctattttattatcgacccgatagatggtactcaggagtttatttcccgctccggagactttgctgtcaacattgcttacgtagaaaacaacgagcctgtcattggcgttattttctggccggtcggggaaacgctttactatgctcgcaaaggtgctggcgcctttaaacaaaaagagaacgaaaagcagtccataagcgtgcgcaagtttagtgaccctcaggctgaccctattattattgcaataagtcggcaacaggcacgagagcctgtgtttaatcgtttgcagacaaaacgtgatattcagcctttaccaacgggtagctgttcactaaaagcctgttttattgccgagggcaaagccgattgttttttacgtctgggacctaccggagaatgggataccgctgcatcgcaagttattgtaggagaagctggcggtcgcatagtgaatgagaactttgagcccattacctacaaccgcacggttagcctgctgaacccgaacttcttagttctgggtgaccaaaatgttccctgggaagaagtctttattgcccgtcaggctcgtttccggtaa

SEQ ID NO: 84374 - protein, 274 aa, Idiomarina loihiensis L2TR
MAETMLEKLKEIAFEAGGVILSMYERRDYKTAEKKDDSPVTTADLVASELIEDRLKQSFPDIPVISEESEHQDYNERRQWRAYFIIDPIDGTQEFISRSGDFAVNIAYVENNEPVIGVIFWPVGETLYYARKGAGAFKQKENEKQSISVRKFSDPQADPIIIAISRQQAREPVFNRLQTKRDIQPLPTGSCSLKACFIAEGKADCFLRLGPTGEWDTAASQVIVGEAGGRIVNENFEPITYNRTVSLLNPNFLVLGDQNVPWEEVFIARQARFR

SEQ ID NO: 84375 - DNA, 735 bp, Idiomarina loihiensis L2TR
  CDS (1)..(735): transl_table=11
atgcttaaagaagtaaaggatatagcccacgacgctggcgctgccattatggatatttaccaaagcaacgactttgatgtgcagaaaaaggccgatgacagtccgctgaccaaagcagatttagcggcgcataacatcatttgtgagggtttgcgtgcgctggatattcagtacccggttatttcggaagagtcgtcagacattagttgggcgcagcgcaagcactggtgccgctattggctggttgacccgttggacggcaccaaggaatttattaagcgaaatgacgaattcaccgtgaacattgccctgatagaaaagggcgtgcccattttaggtgtggtgtatgctccggcgttagacgccatgtataccggcgagcgtgaccgcggtgcgtttttaaacgacaaagcgatttcggttgccacgcaggaacctgaagctttgcgcgttgtaggctcgcgctcacacccctcacaggaaacgaccgactggttagatgctcagggcaaatcctacgagatgctggcggtaggcagttcactgaagttttgcctggtagccgaaggtaaagccgacatttatccccgcttaagccccaccagcgagtgggacaccgccgcagcccatgcggtattaagtgcagcaggtggggacgtactgacccttaacggggaaccgctgctgtacaaccaaaaagcagactacctcaacccgcactttattgcccggtga

SEQ ID NO: 84376 - protein, 244 aa, Idiomarina loihiensis L2TR
MLKEVKDIAHDAGAAIMDIYQSNDFDVQKKADDSPLTKADLAAHNIICEGLRALDIQYPVISEESSDISWAQRKHWCRYWLVDPLDGTKEFIKRNDEFTVNIALIEKGVPILGVVYAPALDAMYTGERDRGAFLNDKAISVATQEPEALRVVGSRSHPSQETTDWLDAQGKSYEMLAVGSSLKFCLVAEGKADIYPRLSPTSEWDTAAAHAVLSAAGGDVLTLNGEPLLYNQKADYLNPHFIAR

SEQ ID NO: 84377 - DNA, 777 bp, Idiomarina loihiensis L2TR
  CDS (1)..(777): transl_table=11
atgcatccgatgttaaatattgcggtgcgcgcagcgcgtgcggccggcaaaattttagttaaaaatttcgaccagggcagtcctgttgaagccgaatcaaaaggtttgaacgactgggttactgatatggataaagccgcagagcaggctattatcaacaccatcaaaaagtcttaccctgatcacggcatcatcgcagaagaaagcggtactcaggctggaaaagaaaacgacttccagtgggttattgatccgctagacggcacgaccaattacatgcgcggtatcccccatttttgtatctctatagcgttgcttcacaaaggctctgttcaacaggccgttgtttatgatcctatgcgcgaagaattatttaccgctacccgcggcgccggtgcgcagctaaatggtcgtcgtttacgtatttcacctaaagtggaattaaaaggcgctattttagcaacgggtttcccgttcaaaatgaaaaaccgtttaccggaatacctggaaatgttcagcaagttgtttgagcactgtgccgacgttcgtcgcgcaggcgcagcagcactagatttagcttatgttgcggcagcacgccacgatgcattctgggaaatgggtcttaagccctgggatatgttggctggcgaattattggttcgcgaagccggtggcatagtcagtgactttcagggtggccacaactacattcagtcgggcaatatagcagccggtgcgccaaaagcattaaaacaaatgctggcacaaattcgctaa

SEQ ID NO: 84378 - protein, 258 aa, Idiomarina loihiensis L2TR
MHPMLNIAVRAARAAGKILVKNFDQGSPVEAESKGLNDWVTDMDKAAEQAIINTIKKSYPDHGIIAEESGTQAGKENDFQWVIDPLDGTTNYMRGIPHFCISIALLHKGSVQQAVVYDPMREELFTATRGAGAQLNGRRLRISPKVELKGAILATGFPFKMKNRLPEYLEMFSKLFEHCADVRRAGAAALDLAYVAAARHDAFWEMGLKPWDMLAGELLVREAGGIVSDFQGGHNYIQSGNIAAGAPKALKQMLAQIR

SEQ ID NO: 84379 - DNA, 819 bp, Zymomonas mobilis subsp. mobilis ZM4
  CDS (1)..(819): transl_table=11
atgcttttatcatcactttcgccgcaggctgcgttattagaaggtctggtacaaattgcgctacaggccggaaaacgggcgctcgaaatttatcatggtgatttcaccgtgatgaagaaagatgacgatagccccgtaacgcaggcggatcgggaagctgaagcgattattttacagggattgaaaaagctgcaacccggtgttgccgtcatcgcagaagaagaatacgccaaaaccaagaaggggtataataccgacagctttttcttggttgatcccattgatggcacgcaggaatttgtgaataagcgtgatgaattcacggtcaatattgccctgattaaaaaggcctatcctattttaggtgtgatctatgcgccggcaatcaaccgcctttatgtcggcgatgtgttggctaaaacggcatgggccgctgatacgactgaagatttccagattgaaaaccggaatagcattcaaatccgtgaagcgggtgaaaaatgggatgtaatgacctctttttcccataataaccctgcaaccgaggcctatttgaagcagttaccgatcgaaaatcggattaaggccggttcttctttgaaattatgtttattggcagaaggaaaagcggatatttatccccggttatcgcctacccatgaatgggatacgtttgcgggtcatgccattattttggccgcagggggtaatgtgatcgacgagacgggggaaaatctgacctatgggaaaccgggttatcgcaaccccggctttatcgcctatggatcggagcagccgcctttacctgtagaaaaataa

SEQ ID NO: 84380 - protein, 272 aa, Zymomonas mobilis subsp. mobilis ZM4
MLLSSLSPQAALLEGLVQIALQAGKRALEIYHGDFTVMKKDDDSPVTQADREAEAIILQGLKKLQPGVAVIAEEEYAKTKKGYNTDSFFLVDPIDGTQEFVNKRDEFTVNIALIKKAYPILGVIYAPAINRLYVGDVLAKTAWAADTTEDFQIENRNSIQIREAGEKWDVMTSFSHNNPATEAYLKQLPIENRIKAGSSLKLCLLAEGKADIYPRLSPTHEWDTFAGHAIILAAGGNVIDETGENLTYGKPGYRNPGFIAYGSEQPPLPVEK

SEQ ID NO: 84381 - DNA, 798 bp, Silicibacter pomeroyi DSS-3
  CDS (1)..(798): transl_table=11
gtgacctacgaggaactaattcccgtcattcgccgtctcgcgcttgaggcgggcgatgtgatcatgtccatctacaacgccgacgatttcggcgtgaaggtcaaatcggactccagcccggtgaccgaggcggacgaggcagccgacgcgctgatctcggcgggcttgcgcgcggccttccccgatatcctgctggtgaccgaggaacaggcggcctcgcacagccagacgggcgacaccttcctgatcgtcgatccgctggacgggaccaaggaattcatcaaccggcgcggcgatttcaccgtcaatatcgcgctggtggaaaacggcacgcccacgcgtggcgtggtctatgccccggccaagggacggatgttctatactctggcggatggcagctcggtcgaggagaccggcggactggacaaggaaacgcccggtgacctctctccgatccgggtggccgaggccgacaatgccgcgctgctggtggtggcgtcgaaatcgcaccgcgaccaggcgaccgaggattacatcggcaaatacgccgtcaaggacagcaagagcgccggatcctcgctgaaattctgtctggtggccacgggcgaggccgatctttacccgcgtgttggccgtaccatggaatgggacactgccgccggtcacgcggttctggccggagccgggggcaaggtggtacgtttcgacaatcaccagccgctgacctatggcaaggacggctatgccaacccgttcttcatcgcctacgcccccagcgtcaccctcaaggaagcctga

SEQ ID NO: 84382 - protein, 265 aa, Silicibacter pomeroyi DSS-3
MTYEELIPVIRRLALEAGDVIMSIYNADDFGVKVKSDSSPVTEADEAADALISAGLRAAFPDILLVTEEQAASHSQTGDTFLIVDPLDGTKEFINRRGDFTVNIALVENGTPTRGVVYAPAKGRMFYTLADGSSVEETGGLDKETPGDLSPIRVAEADNAALLVVASKSHRDQATEDYIGKYAVKDSKSAGSSLKFCLVATGEADLYPRVGRTMEWDTAAGHAVLAGAGGKVVRFDNHQPLTYGKDGYANPFFIAYAPSVTLKEA

SEQ ID NO: 84383 - DNA, 786 bp, Silicibacter pomeroyi DSS-3
  CDS (1)..(786): transl_table=11
atgattggcagtgcgaacctcaacatcatgatcaaggccgcccgcaaggcaggccggtcgctggtgaaggacttccgcgaggtcgagaacctgcaggtgtcgatgaagggcgcgggtgatttcgtgtccaaggccgatatcgccgccgaggcgatcctcaaggaagagctgcgcaatgcccgcccgacttatggctggattgccgaggaaggtggcgtcgaggagggcgaggacccgacccggcgctggatcgtcgatccgctggacggcaccaccaacttcctgcacggcctgccgcattgggcgatctccatcgcgctcgagcacaagggcaaggttgtcgcgggtgtcatctatgacgccgccaaggacgagatgttctttgccgaaaagggcgaaggcgcctggatgaacgaccagcgcatccgcgtctcgggtcggcatcggatgatcgaggcggtttttgccaccggcctgccctttggcgggcgtgccgacctgccgttgacgctgcaggatctggcgcggctgatgccggtttgcgccggtgtgcggcgctggggctcggccgcgctcgacatggcctatgtggcggcgggccgctacgaaggcttctgggaacggcgcctcaatgcctgggatgtggcggcgggcatcatcatcgtcaaggaggccggcggcctgatcgaggcgctcgatcccgaggactcgatcctcgacagcggcgaggtgatctgcgccaatggcaatatcttcgatcctttcgccaaggtgatccgcggctga

SEQ ID NO: 84384 - protein, 261 aa, Silicibacter pomeroyi DSS-3
MIGSANLNIMIKAARKAGRSLVKDFREVENLQVSMKGAGDFVSKADIAAEAILKEELRNARPTYGWIAEEGGVEEGEDPTRRWIVDPLDGTTNFLHGLPHWAISIALEHKGKVVAGVIYDAAKDEMFFAEKGEGAWMNDQRIRVSGRHRMIEAVFATGLPFGGRADLPLTLQDLARLMPVCAGVRRWGSAALDMAYVAAGRYEGFWERRLNAWDVAAGIIIVKEAGGLIEALDPEDSILDSGEVICANGNIFDPFAKVIRG

SEQ ID NO: 84385 - DNA, 789 bp, Francisella tularensis subsp. tularensis Schu 4
  CDS (1)..(789): transl_table=11
atgaaacctattcttaattctgtaacaactatcgctagaaaagctggtaaaattattcttcaagcacaaaatgatctaagctctatcaagatttctcaaaagcttgataacacaactgtatcaaatattgatattgctgttgagaactttattattgataatatcaaaaaatcaggctttaatgactacttcataactgaagaaaatggtgagtttggtaacaaagatagtcgttttacatggattattgatcctattgatggtactaataactttgttcatggcttaccgcattgttgtatatcaattgctgctaagaaagatgatgatatagttttaggagttatttataatccttttttagatctaatgttttgtgcttacaaaggtcaaggtgctcttcttaacggtaaaaagataagagttgctcaaaatcaagacttaaaaaacactttaatttcagcatcattaaaatactcacgtagaatatttaatgacagctatgtagcagaacttatcaaacttcaacaaacaatttctggttatagatattctggaagtattgctatggatatggcatatctagcagcaggatatatagatggtctatgggcttgtggtaatgtcaaaatatgggatttagcagcgggatatataatcatgaaagaagctggagctgtagttactaacatccatggtactagtgaccttgactctggtttgatcgttgctggtaataaaaaaatccaaccaaaacttattaaaattctagcaaaacatatcaaataa

SEQ ID NO: 84386 - protein, 262 aa, Francisella tularensis subsp. tularensis Schu 4
MKPILNSVTTIARKAGKIILQAQNDLSSIKISQKLDNTTVSNIDIAVENFIIDNIKKSGFNDYFITEENGEFGNKDSRFTWIIDPIDGTNNFVHGLPHCCISIAAKKDDDIVLGVIYNPFLDLMFCAYKGQGALLNGKKIRVAQNQDLKNTLISASLKYSRRIFNDSYVAELIKLQQTISGYRYSGSIAMDMAYLAAGYIDGLWACGNVKIWDLAAGYIIMKEAGAVVTNIHGTSDLDSGLIVAGNKKIQPKLIKILAKHIK

SEQ ID NO: 84387 - DNA, 963 bp, Synechococcus elongatus PCC 6301
  CDS (1)..(963): transl_table=11
gtgaccttgctgcctgactgtcttgaactccacgccgctctgactgcggtgcaagcggctgcccacctctgccaaacggtgcgccacgatcgccaagccaccgccctgcgcaaacccgatcaaagtccggtgactgtagcggactacggtgcccaagccctgattgcggcgcatctcagtgaaactttccctgcggatccgctggtgggagaagaagatgccagtttgctagcagacgatgtgctggatcagattaccgactatgtccggctacagcgatcgcaagtctctgctgaaactgtggcggcttggattcagcaaggcaaaggtcaacccggcgatcgcttctggactctcgaccctattgacggcaccaaaggctatgtacgcggcgatcagtatgcgatcgcgctggctttgattgtggacggacaggtagaagtagcggcgatcgccgcgccggccctcgatggcccagatggggctctctttgctgccgtacggggtcaaggtgcttggcaaatccaaggcgatcacgtcattccactgcaagttagcgatcgccaggctgctgctgccctccgcctcgaaagtgtggaacgggaacacggccatcctgcttggcaggatgcgatcgccactcgggcgggattggtgaccccagcgcgagccgtcgatagcttggtcaaatacgcgctgattgcccgcggtgaagcagacctctacttacggctggtcaatcccgcaagcgatcgccgcgagaacatttgggaccatgcagcgggggtgttgctgctccaagaagcgggcggccgtgttagcgatcaaactgggcgatcgctagactttggggcgggcagcaagctcttcaataaccagggcatcgccgccagcaatgccgcctgccacgaggcaattgtggcagcgctacaggctcagcaacccctgcttgaactggtttag

SEQ ID NO: 84388 - protein, 320 aa, Synechococcus elongatus PCC 6301
MTLLPDCLELHAALTAVQAAAHLCQTVRHDRQATALRKPDQSPVTVADYGAQALIAAHLSETFPADPLVGEEDASLLADDVLDQITDYVRLQRSQVSAETVAAWIQQGKGQPGDRFWTLDPIDGTKGYVRGDQYAIALALIVDGQVEVAAIAAPALDGPDGALFAAVRGQGAWQIQGDHVIPLQVSDRQAAAALRLESVEREHGHPAWQDAIATRAGLVTPARAVDSLVKYALIARGEADLYLRLVNPASDRRENIWDHAAGVLLLQEAGGRVSDQTGRSLDFGAGSKLFNNQGIAASNAACHEAIVAALQAQQPLLELV

SEQ ID NO: 84389 - DNA, 870 bp, Synechococcus elongatus PCC 6301
  CDS (1)..(870): transl_table=11
atgtcccctctccagtcgatcgccggtcaacccgtcgagtcagttctcgcgatcgcccgtcaagtcggctgggaagcggcagacattgcactgcagttctacaccgctcagtctgaagcagcaccgaagctgtggcaggagggggatgaccccgtcacggcagcggatttggcaattcatcgccacgttctggaacggctacaaaccgcttttgccgatcagcccttcggctacctcagcgaagagagcgatcgcaccgcgctgactttgccactgccggaagagtgggtttggatcatcgaccccttggatggcacccgcgatttcatcgatcacaccggcgaatttgcggtgcagattgccctgacctaccaacagcgcccggtcttggcggtcgtcgcaatacccgctcagcagttgctttattgggcggtacaaggccagggctgctaccgcgaaacgcaagacggcactcagacgaaattgacggtttccgatcgccaagaggatctgattctggttgccagccgaacccatcggggcgatcgcttccagcaattgctcgatcgcctttctttgccgcagcagatttatgtgggcagtgtcggcgtcaaaattgtcgcgatcgcagaacaacgcgccgatgtttacctctctctctcgggtaaatcagccccgaaagattgggacatggccgcccccgagctactcctgctcgaagccggtgggcgcttcagccatgccgatggttctgctcttcgctacaacaccggcgatatcagccagtggggttgcttgattgccagcaacggtcccgcccacgatcgcctctgtcaagaagccaccgcactccttgccagcttggactag

SEQ ID NO: 84390 - protein, 289 aa, Synechococcus elongatus PCC 6301
MSPLQSIAGQPVESVLAIARQVGWEAADIALQFYTAQSEAAPKLWQEGDDPVTAADLAIHRHVLERLQTAFADQPFGYLSEESDRTALTLPLPEEWVWIIDPLDGTRDFIDHTGEFAVQIALTYQQRPVLAVVAIPAQQLLYWAVQGQGCYRETQDGTQTKLTVSDRQEDLILVASRTHRGDRFQQLLDRLSLPQQIYVGSVGVKIVAIAEQRADVYLSLSGKSAPKDWDMAAPELLLLEAGGRFSHADGSALRYNTGDISQWGCLIASNGPAHDRLCQEATALLASLD

SEQ ID NO: 84391 - DNA, 765 bp, Campylobacter jejuni RM1221
  CDS (1)..(765): transl_table=11
atgcttaatcttgataaatttttagaaattgctataaatgctagcaatcaagcttctaaagctattttggaagagagaaaaaatttcaaaacttgggaaaaagaagataaaagcccgattacatcagcagatcttgcttctaataaaattctaaatgatattttgggttctacggatattaaaattctatcagaagaaaaattactcagcaaagaagagtgtgaagaattaaaaactttttggcttatcgatcctcttgatggaacaagtggttttttaaaaggcagtgatgaattttgcgttatgataagtttggttcatgacaatcgccctgttttatcactcatacaaaatccatcaaaaggtgatatattctatgctcatgcaaaaaccaaggtttataaaaacgataaacctttgcaaattgaccagcaagaatacgagaaaaataaatataaagccttattgagtgttaatcatcttagcaaagaagatgaagactttgcaaaagagcatcaattagaagctattaatataggctctggattgaaattttgtgctattttagaggctagggcaggagtttataaaagatttgaaaagcttaatatttgggatattgtagcaggagattttttgattaatcaaaatggaggatttatgggggatttttctaaaaaatacattttatataaccctttaaattataaatccagtccttttatttgtgtttcatctaggaattttttacaagattttttataa

SEQ ID NO: 84392 - protein, 254 aa, Campylobacter jejuni RM1221
MLNLDKFLEIAINASNQASKAILEERKNFKTWEKEDKSPITSADLASNKILNDILGSTDIKILSEEKLLSKEECEELKTFWLIDPLDGTSGFLKGSDEFCVMISLVHDNRPVLSLIQNPSKGDIFYAHAKTKVYKNDKPLQIDQQEYEKNKYKALLSVNHLSKEDEDFAKEHQLEAINIGSGLKFCAILEARAGVYKRFEKLNIWDIVAGDFLINQNGGFMGDFSKKYILYNPLNYKSSPFICVSSRNFLQDFL

SEQ ID NO: 84393 - DNA, 798 bp, Gluconobacter oxydans 621H
  CDS (1)..(798): transl_table=11
atgacttctgcctcacccatcaccgtccctgcggacgatgaccgcgcccttctggccctggcgttccggctcgcgtccgaagcctcggacatcatcaacgccatccgcgaacgcggcttccggacggacatcaaggacgatgcctcccccgtcacggaagcggaccacgcctccgaacatcacatcctgtcgggcctgcgcgcggcctgcccgtccattcccgccatcggcgaggaagaaatgtcggccgggatccgggtgaacgcggaagacgcctactggctggtcgatcccctcgacgggacacgtggctttgcctcgggcggaaaagacttcaccgtcaatatcggcctggtccgccatgaccgtccggttctgggcgtggttgccctgccgggttacggcctgatctacagcggcggacagggcctcggcgcccaccgctcggacggcacaaacagcacgccgatccataccgccacaccgcctgcagaaggcctgcgcgttctggcttcgagccatcacggcaatcccgaacttctggaacgctggctcgccggacgacaggtcgcctccgtcgagaagctgtcatcctcggtcaagttcatgcgtgtggccgaaggtgctgcggatttctatccccgtttcggacccacgatggaatgggacacggccgctccccaggccattctggaagccgcaggtggagccctgctcgacgagaccggcgcgcccctgcgctatggcaagccggaccggctgaacggctcattctactgcaccggaggcgcatcttga

SEQ ID NO: 84394 - protein, 265 aa, Gluconobacter oxydans 621H
MTSASPITVPADDDRALLALAFRLASEASDIINAIRERGFRTDIKDDASPVTEADHASEHHILSGLRAACPSIPAIGEEEMSAGIRVNAEDAYWLVDPLDGTRGFASGGKDFTVNIGLVRHDRPVLGVVALPGYGLIYSGGQGLGAHRSDGTNSTPIHTATPPAEGLRVLASSHHGNPELLERWLAGRQVASVEKLSSSVKFMRVAEGAADFYPRFGPTMEWDTAAPQAILEAAGGALLDETGAPLRYGKPDRLNGSFYCTGGAS

SEQ ID NO: 84395 - DNA, 1518 bp, Xanthomonas oryzae pv. oryzae KACC10331
  CDS (1)..(1518): transl_table=11
gtgtgcgggtgctcacgcatctgcgtgcagggatgccacaccaccgcaagatcgcgttgccgccaatgttcggcagtttgtgcggctgcagggtctgctaggatttcgggttcatggacatgtcgatgcatctgcctattctatcggcccgccttgcggctgcgtgcgacgcatgagcttgcgcctgccgaccatccacaaaatcaccgatctgggcgacgggccgttccgtcggcagcggctggatctggaattttccaacgggcagcgccgcatctacgaacgtcaactcagccaaggccacggggccgtggtggtggtgccgatgctcgatgcgcagaccgtgctgctggtgcgcgaatacgccgccggcgtgcatcgctacgagctgggtctggtcaagggccgcatcgatgcgggcgaaacgcccgagcaggccgccgaccgcgagctcaaggaagaagccggctacggcgcacgccaggtccaggtgctgcgcgcgatgacgctcgctcccacttatatgagtcaccaatcctggttggtactggcacgcgacctctaccccgagcgcctggtcggcgacgagccggaagagatggacgtggtgccgtggccgatcgcacgcctggacgaattgatgctgcgcgaagatttctccgaaggccgctcgctggccgccttgttcattgcgcgcgagtggctggagcgcaacccatgatccgcattccgatggagctgcgcgaaaccgtgattgccatcgcgtgcgatgccggcgccgccatcatggaggtctatgcgcaggacttcgcggtggagctcaaggacgacgccagcccgctgacccaggccgacctggccgctcaccgcgtcatcgtcgaaggtctgcgccgggtgactccagacgtgccggtgttgtcggaagaatccgcgcacgtggcctgggaagaacgccagtactggaccagttactggctggtcgatccgctcgatggcacccgcgagttcgtcaagcgcaacggcgagttcagcgtcaatatcgcactcatccatatgggcgcgccggtgctcggggtggtgcaggcgccggtcgacgggcgtgtctggtatgccgcacgcggcgagaacgcgttccgccgcgatggcgaccgcgacgagatgctgcacacgcgcaccccggcggccaagccgttacgggtggccgccagccgttcgcaccgcgacgcgcgtactaccgccgcgctggatcgcatgggcgagatcgacgtggttgcgcaagggtcgtcgttgaagttctgccgcatcgccgaaggcaacctggacgtgtatccgcgcttcggccccacgtccgagtgggataccgccgccggccagtgcgtgctgcatgcggccggtggcgtattgctggcctgcaccagcggcaaaccgtttcgctataaccgccgcgacaccttgctcaatggcgacttcattgcgttgggcgaccctaatctgccctggcgaaattggttggcctga

SEQ ID NO: 84396 - protein, 505 aa, Xanthomonas oryzae pv. oryzae KACC10331
MCGCSRICVQGCHTTARSRCRQCSAVCAAAGSARISGSWTCRCICLFYRPALRLRATHELAPADHPQNHRSGRRAVPSAAAGSGIFQRAAPHLRTSTQPRPRGRGGGADARCADRAAGARIRRRRASLRAGSGQGPHRCGRNARAGRRPRAQGRSRLRRTPGPGAARDDARSHLYESPILVGTGTRPLPRAPGRRRAGRDGRGAVADRTPGRIDAARRFLRRPLAGRLVHCARVAGAQPMIRIPMELRETVIAIACDAGAAIMEVYAQDFAVELKDDASPLTQADLAAHRVIVEGLRRVTPDVPVLSEESAHVAWEERQYWTSYWLVDPLDGTREFVKRNGEFSVNIALIHMGAPVLGVVQAPVDGRVWYAARGENAFRRDGDRDEMLHTRTPAAKPLRVAASRSHRDARTTAALDRMGEIDVVAQGSSLKFCRIAEGNLDVYPRFGPTSEWDTAAGQCVLHAAGGVLLACTSGKPFRYNRRDTLLNGDFIALGDPNLPWRNWLA

SEQ ID NO: 84397 - DNA, 867 bp, Xanthomonas oryzae pv. oryzae KACC10331
  CDS (1)..(867): transl_table=11
ttgtccgattctgccttcacgggagctttaaccatgcagaaacccgccgtcaccgtcatggtcaaagccgcccgcctcgccggcaatgtgctgttgcgcggtatcaacaagctcgatgcgctcaacgtggtgcagaaaggccgcatggactatgccagcgaagtcgatgccgacgccgagaaggtcatcatcaaggaactcaagcgcggctatcccgaatacgccgtatttggcgaagaaggcggcgtgcagggcggcaagagtggccgctacacctgggtgatcgatccgctggacggcaccagcaactatctgcgcggctttccgcactactgcgtttccatcgcactggtggaaaacggcgaacctatcgatgcggtgattttcgatccgctgcgcaatgagctgttcactgccagccgtggtgtcggcgcggtgctcaacgaccgccgcatccgcattgccgagcgcaaggacctggaaggcgcgatggtccacaccggcttcccgccgcgcgaacgtgcgcgcgccagtgcgcagctcaagtgcgtggatgcgctgctggtgcaggccgaagacgtgcgtcgcaccggctcggcggcgctggacctggcctatgtggcctgcgggcgcgccgacgcctatttcgaagcaggcgtcaaagcctgggacatcgctgccggcgttttgctggtgcgcgaggccggtggccgcgtttgcgactacaagggcgccactccgccgcgcatggacaacatgggcccgcagacgcagcagatcgtggccggcaacatcaagatcagcgacgcgctgcagaaggtcatcgtcaataccggctatgcgcgcgagttcgacgccacgttctga

SEQ ID NO: 84398 - protein, 288 aa, Xanthomonas oryzae pv. oryzae KACC10331
MSDSAFTGALTMQKPAVTVMVKAARLAGNVLLRGINKLDALNVVQKGRMDYASEVDADAEKVIIKELKRGYPEYAVFGEEGGVQGGKSGRYTWVIDPLDGTSNYLRGFPHYCVSIALVENGEPIDAVIFDPLRNELFTASRGVGAVLNDRRIRIAERKDLEGAMVHTGFPPRERARASAQLKCVDALLVQAEDVRRTGSAALDLAYVACGRADAYFEAGVKAWDIAAGVLLVREAGGRVCDYKGATPPRMDNMGPQTQQIVAGNIKISDALQKVIVNTGYAREFDATF

SEQ ID NO: 84399 - DNA, 804 bp, Vibrio fischeri ES114
  CDS (1)..(804): transl_table=11
atgcatccaatgctaaacattgctgtacgtgctgcacgtaaagctggtgactttgttgctaaatcttttgagcaaactgacaaaattgaaacaacaaagaaaggcaacaacgaatttattacgaacatcgaagccgatgctcaatacattcttgttgacatgatcaagaaatcttaccctgatcacagcatcatttctgaagagtctggcctaattgaaggtaaagacactgacattcaatggatcattgacccattagatggcacgactaacttcgttaaaggtatcccacacttctctgtttctattgctgttcgcatcaaaggccgtacagaagtagcttgtgtatacgatccaatccgtaatgaactatttactgctcaacgtggtgctggtgctcaacgcaacaaccaacgtatgcgcgttaaagagttaaaagatcttagcgaagctatcatctctacaggtttcccataccgtcacaaacaacacactgaaagcttcatgaaagttgttggtgcgttattcatcgaaggttctgacgttcgtcgttctggttgtgcatctctagacctatgttacctagcatctgcacgcatggacggttttgttgaactaggccttaagccttgggaaatgacagcggctgacttaattgctcgtgaagctggcgttatctgtactgacttcgttggcggtactgattacctaaaatctggtaacctagttgctggtagcccacgtgttgttaaagcgatgcttaaaaaagttcgtgaaaacggcaacgaagctatgatgaagtaa

SEQ ID NO: 84400 - protein, 267 aa, Vibrio fischeri ES114
MHPMLNIAVRAARKAGDFVAKSFEQTDKIETTKKGNNEFITNIEADAQYILVDMIKKSYPDHSIISEESGLIEGKDTDIQWIIDPLDGTTNFVKGIPHFSVSIAVRIKGRTEVACVYDPIRNELFTAQRGAGAQRNNQRMRVKELKDLSEAIISTGFPYRHKQHTESFMKVVGALFIEGSDVRRSGCASLDLCYLASARMDGFVELGLKPWEMTAADLIAREAGVICTDFVGGTDYLKSGNLVAGSPRVVKAMLKKVRENGNEAMMK

SEQ ID NO: 84401 - DNA, 786 bp, Neisseria gonorrhoeae FA 1090
  CDS (1)..(786): transl_table=11
atgaatccgtttttgaatacagcctttaaagccgcccgccgtgccggtcagatgatgattcgcgccgcaggtaacctcgatgccgtcaaaaccgacagcaaagccttcaacgattttgtttccgatgttgaccgcaattccgaaatcatcctggttgaggctttgaaagaagcttatccgcatcacaaaatcacttgcgaagaaagcggcttccacggcaaagctacagccgagtacgaatggattatcgatccgctcgacgggacgaccaatttccttcacggccatccccaatacgccatctctatggcactgctgcacaaaggcgtgttgcaggaagctttggtgtacgcccccgaacgtaacgacgtgtacatggcttcgcgcggtaaaggcgcgttgcttaacgaccgccgcatccgtgtctccaaccgcatcgaattgaaccgctgcctgatcggtaccggcttccctgttgtcgatcaaagcatgatggacaaatatctggcgattttgaaagactttttggcaaaaaccgccggaggccgccgcgaaggcgcggcttctttggatttgtgcgccgtagcaacaggacgttttgacggctttttcgagttcaacctcaaaccgtgggacattgccgccggtgcattgattgtccaagaagcaggcggcatcgttaccgatatgtcgggtgaggacgcttggttggaaagcggcgatattgtggctgccaatcccaaagtactggcgcaaatgttaaaaatcatttccgcacacgtttaa

SEQ ID NO: 84402 - protein, 261 aa, Neisseria gonorrhoeae FA 1090
MNPFLNTAFKAARRAGQMMIRAAGNLDAVKTDSKAFNDFVSDVDRNSEIILVEALKEAYPHHKITCEESGFHGKATAEYEWIIDPLDGTTNFLHGHPQYAISMALLHKGVLQEALVYAPERNDVYMASRGKGALLNDRRIRVSNRIELNRCLIGTGFPVVDQSMMDKYLAILKDFLAKTAGGRREGAASLDLCAVATGRFDGFFEFNLKPWDIAAGALIVQEAGGIVTDMSGEDAWLESGDIVAANPKVLAQMLKIISAHV

SEQ ID NO: 84403 - DNA, 795 bp, Neisseria gonorrhoeae FA 1090
  CDS (1)..(795): transl_table=11
gtgttacaccgtttgcagaaagtcgtgcgccatatcgcgcaaaccgaaattatgccgcgttttttgaatacgccgtcccgccgcaaggaagacggttcgatgttgagcgaggcggacattgccgcgcagacggcatttgccgccgcgttgccgcttctgatcgattgcccgatgttgggcgaggaaatgtcgcggcaggaacagtcggctttgtgggaacaatattcgggggaaaaggggctgtggattgtcgatccgatagacgggacgaacaattttgtcaacgggctgccgcattttgccgtgtcggtggcgtttgtccgcaacgggcgcgccgaattgggcgtaatctacaatccggtcagcggcgaatgtttttatgccgaacgcgggcagggtgcgtttcttaatgggacacgcctgcctttgcgtctcgtggataaaaaactcaatgaggcgattgcgggcgtggaaatcaaatatctgcgttcgggcaaactttccagccgcatgagtacgctcgcgcctttcgggacgatacgcagtatgggcagcagcacgctggactggtgttatctggcgtgcgggcgttatgatgtttatgtccacggcgggcagaagctgtgggattatgctgcgggtgcgttgattttcgaggaggcgggcggcaggctgacgactttggaaggcgacgggttttggagtggtgaacacgtgttcaaacgctcggtcgtcgccgcgctcgaaccgaagctgtttgaacgctgggtcgggtggatacgggaaaaccagtag

SEQ ID NO: 84404 - protein, 264 aa, Neisseria gonorrhoeae FA 1090
MLHRLQKVVRHIAQTEIMPRFLNTPSRRKEDGSMLSEADIAAQTAFAAALPLLIDCPMLGEEMSRQEQSALWEQYSGEKGLWIVDPIDGTNNFVNGLPHFAVSVAFVRNGRAELGVIYNPVSGECFYAERGQGAFLNGTRLPLRLVDKKLNEAIAGVEIKYLRSGKLSSRMSTLAPFGTIRSMGSSTLDWCYLACGRYDVYVHGGQKLWDYAAGALIFEEAGGRLTTLEGDGFWSGEHVFKRSVVAALEPKLFERWVGWIRENQ

SEQ ID NO: 84405 - DNA, 795 bp, Rhodobacter sphaeroides 2.4.1
  CDS (1)..(795)
atgagcgaattgggcgatgctttgcgtttcgcgaatgacacggcagacgaggcgcgccgcatcgcgctgaagcatttccgtcaggcgctcgatgtcgagagcaaggccgatgacagccccgtcacgctggccgaccgcgcggtcgaggcgctgatccgcgaccggatcatggcggcctttcccaaccatggcatcttcggcgaggaagaggcgccgctccggcccgacagcgaccatctctgggtcgtcgatccgatcgacggcaccaagagctatgtcacgggcaatccgctgttcggggggctgatggccctgctgaaggacggggcgccctgcctcgggcagatcgacatgcccgctctgggcgaacgctggagcgggatcgaggggcaggccaccaccttcaacggccgtccctgccgcaccagcgactgccgggacccggccgaggccttcgcctatacgaccgatcccatgctgttcacgggcgccgatgctcaggtgctcgagatgctgcgccggtcggtgcggatgctgcgcttcggtggcgattgctatgcctatgcgctgctggcctcggggcactgcgatctggtgctggagaccgggttgcagccctatgactacctgccgctggtgcaggtcatccgcggggcgggcggcgtcatcaccgactggcaggggcaggcgctcggcgtgggctccgcaggcgaggtgctggccgcggccacgcccgaactgcaccgcgcgatgctggacaggatcgagaggctgcgggccggtcaggcggcctga

SEQ ID NO: 84406 - protein, 264 aa, Rhodobacter sphaeroides 2.4.1
MSELGDALRFANDTADEARRIALKHFRQALDVESKADDSPVTLADRAVEALIRDRIMAAFPNHGIFGEEEAPLRPDSDHLWVVDPIDGTKSYVTGNPLFGGLMALLKDGAPCLGQIDMPALGERWSGIEGQATTFNGRPCRTSDCRDPAEAFAYTTDPMLFTGADAQVLEMLRRSVRMLRFGGDCYAYALLASGHCDLVLETGLQPYDYLPLVQVIRGAGGVITDWQGQALGVGSAGEVLAAATPELHRAMLDRIERLRAGQAA

SEQ ID NO: 84407 - DNA, 795 bp, Rhodobacter sphaeroides 2.4.1
  CDS (1)..(795)
atgaattacgacgatctgaccgccctcatccgccgtctcgcgctggaggcgggcgacaggatcatggaggtctacaacggccccgatttcgaggtgaaggcgaagtccgacgcgagccccgtgaccgaggccgacgaggccgccgaccggctgatctcggccggtctgcgcgcggcctatcccgacatcccgctcatcaccgaagaacaggccgactcgcacgggctcagcgccagcacctttctgatcgtcgatccgctcgacggcaccaaggagttcgtccagcggcgcggcgacttcaccgtgaacatcgcctatgtcgaagacggcgtgccggtccgcggcgtcgtctatgcccccgcgaagggccgcctcttctacacccaggcggacggcaccgccgtcgaggagacgggcgcgcttgacaagacgaagcccggcaacctgcgcaggctctcggtctcgaagcccgacaatggcgcgctgatggtggtggcctcgaaatcgcaccgcgatcaggcaaccgacgattacatcgcgaaatatgcggtgaaggacatgacgagcgcgggctcgagcctgaagttctgcctcgtggcaacgggtgaggccgacctctatccgcggctcggccgcacgatggagtgggatacggcggcgggcgatgcggtgctgcgcggcgcgggcgggatcgtggtgcggttcgacgatcatcagccgctcgcctacggcaagtccggctgggacaatcccttcttcatcgcccacgcgccgggcgtgacgctcaagtcctga

SEQ ID NO: 84408 - protein, 264 aa, Rhodobacter sphaeroides 2.4.1
MNYDDLTALIRRLALEAGDRIMEVYNGPDFEVKAKSDASPVTEADEAADRLISAGLRAAYPDIPLITEEQADSHGLSASTFLIVDPLDGTKEFVQRRGDFTVNIAYVEDGVPVRGVVYAPAKGRLFYTQADGTAVEETGALDKTKPGNLRRLSVSKPDNGALMVVASKSHRDQATDDYIAKYAVKDMTSAGSSLKFCLVATGEADLYPRLGRTMEWDTAAGDAVLRGAGGIVVRFDDHQPLAYGKSGWDNPFFIAHAPGVTLKS

SEQ ID NO: 84409 - DNA, 828 bp, Xylella fastidiosa Ann-1
  CDS (1)..(828)
atgcagaaacccgcggttaacatcatggtcaaagccgctcgttccgccggcaacgtcctattgcgacacatcaataaattagaaacgctgcatgtcatccaaaaaagccgtatggactatgccagcgacgtggatgagatggctgaaaaggtcattgtcaaggaactcaagcgggcctatccggactacggcattctcggcgaggaagggggactgcagggcaatcatcggatcatgtgggtgattgatccactggacggtaccagtaactatttgcgtggtttcccgcattactgcgtttcaatcgcgttggtcgaaaatggtgaacctacagatgccgtgattttcgatccgctgcgcaacgagctgttcactgccagccgtggtgttggtgcagtcctcaatgaacgcaagatccgcgtggcgaaccgtaaagatttgaacggtacgatactgaacaccggtttctcaccacgggaacgcagccgtgctcatgcgcagttgaaatgcgtggatgcgttgctgatgcaggccgaagatatccgccgtagcggttcggccgctctggacttggcctacgttgcttgtggccgtgcagatgcttacttcgaggctggaataaaggtgtgggatgtggctgcgggaatgttgttagtccgcgaagccgggggttacgtgtgcgacttcaagggtgctgatacgccccgcatggatgataaagggccggagagctgccagttggtcgcaggcaacattaaagtggcccgcgcgctgcaacaagtcattgtcagcagtggttacgggcgggagttcgattcgaagcgctga

SEQ ID NO: 84410 - protein, 275 aa, Xylella fastidiosa Ann-1
MQKPAVNIMVKAARSAGNVLLRHINKLETLHVIQKSRMDYASDVDEMAEKVIVKELKRAYPDYGILGEEGGLQGNHRIMWVIDPLDGTSNYLRGFPHYCVSIALVENGEPTDAVIFDPLRNELFTASRGVGAVLNERKIRVANRKDLNGTILNTGFSPRERSRAHAQLKCVDALLMQAEDIRRSGSAALDLAYVACGRADAYFEAGIKVWDVAAGMLLVREAGGYVCDFKGADTPRMDDKGPESCQLVAGNIKVARALQQVIVSSGYGREFDSKR

SEQ ID NO: 84411 - DNA, 885 bp, Magnetospirillum magnetotacticum MS-1
  CDS (1)..(885)
atgcgtgaccccatccggtacagctctcgggatcgcctgcgagtcgggcgcatcctgcgcggctatcacggcggcgactgcccgcatgtcatcaaacccgacggctcgcccgcgagtctggccgatacgcggtccgaggagctgatcgtcgccgccctggcccgggccttccccggcattccggtgatcgcggaggaatcctgctgcaccgtgccgccggcgccgctgttcttcctggtcgaccccctcgacggcacccgcgatttcctggcgggcaacgaacaatattgcgtgaacatctgcctcgtgcagggcgagcgcccgatcgcctcggcgctggcggcgccgggcctcgggcgggtctgggcggcggggacgagcgcccgcgaggcgccgatccgcgaggggaagcccggcgccttccatccggtgggcgtgcgcaagcctcccgcggcggggctcgtcgccctggtcagccgccgccacggcgacagcgacaccgatgcctgcctggagcgcctcgcgatcggcgagcggcgggtcgcctcctcggccctcaagttctgtctgatcgccgcgggcgaggcggatatctatgtgcgctgcgcgcccaccatggagtgggatacggcggccggcgaccacgttctgaccatggccggcggccgcgtcgtcggccccggcgggtccacgatcacctatggccatcacgcccgcttctaccgcaacggccccttcgccgccctcggctcggcggcctatcgcgacgaactcgccctgccgcagcacagcgccgtctcctatttcgaccggcgccgggcgggaatgtcggaggcgccgccagtgccggacgcgaaggcggcccctcgggcggagcgcggttaa

SEQ ID NO: 84412 - protein, 294 aa, Magnetospirillum magnetotacticum MS-1
MRDPIRYSSRDRLRVGRILRGYHGGDCPHVIKPDGSPASLADTRSEELIVAALARAFPGIPVIAEESCCTVPPAPLFFLVDPLDGTRDFLAGNEQYCVNICLVQGERPIASALAAPGLGRVWAAGTSAREAPIREGKPGAFHPVGVRKPPAAGLVALVSRRHGDSDTDACLERLAIGERRVASSALKFCLIAAGEADIYVRCAPTMEWDTAAGDHVLTMAGGRVVGPGGSTITYGHHARFYRNGPFAALGSAAYRDELALPQHSAVSYFDRRRAGMSEAPPVPDAKAAPRAERG

SEQ ID NO: 84413 - DNA, 777 bp, Magnetospirillum magnetotacticum MS-1
  CDS (1)..(777)
atgaccctgcctaccgatctttcgcccctgctcgcccccctggaagacctggcccgccaagcgggcgcggtaatcatggaggtctataattccgacttcgccgtgcgcgacaagaccgacgcctcgccggttaccgaggccgacgaaaaggcggaggccatcatcttgccgggactggcggcgcttacccccggcgtgcccgtggtggccgaggaatcggtggcggccgggcgcattcccgagatcggctccggcccgttctggctggtggaccccctggacggcaccaaggaattcatcaagaagaacggcgagttcacagtgaatatcggcctgatcagagacggcgttccggtgttgggcgtggtgctggcaccggcgcgcggcgaattatggtcgggcaccggcaccaccgccttcaaggccgattcccagggccgccgccccatcgcctgccgccccattcctgccacgggcgccgtggccatgacctcgcgctcgcaccgtaaccccgaagccatgggcaaatggctggcgcaatttcccggcgtcagcctggatttcgcgggctcgtccctgaaattctgcctggtggccgagggcgccgccgatctctatccccgctttggccccacctgtgaatgggacatcgcggcggccagcgccgtgctgatggcggcgggcggcagtgtcgaaaccttcgagggcaggcccatggcctatggcaagacgcccaaattcctcaacccggacttcatcgcgcggggcaaggcgtaa

SEQ ID NO: 84414 - protein, 258 aa, Magnetospirillum magnetotacticum MS-1
MTLPTDLSPLLAPLEDLARQAGAVIMEVYNSDFAVRDKTDASPVTEADEKAEAIILPGLAALTPGVPVVAEESVAAGRIPEIGSGPFWLVDPLDGTKEFIKKNGEFTVNIGLIRDGVPVLGVVLAPARGELWSGTGTTAFKADSQGRRPIACRPIPATGAVAMTSRSHRNPEAMGKWLAQFPGVSLDFAGSSLKFCLVAEGAADLYPRFGPTCEWDIAAASAVLMAAGGSVETFEGRPMAYGKTPKFLNPDFIARGKA

SEQ ID NO: 84415 - DNA, 825 bp, Azotobacter vinelandii
  CDS (1)..(825)
atgagcgccgttcccttcgccccgctgatcgacctggtgcgccaggccggcgccgccatcctgccgtactggcgcatggacggtatcgacgtacaggaaaaggacgacgcctcgccggtgaccgccgccgacctggccgcgcaccgcgtgctctgcgccggcctgcgggcgctcgaaccgacggttccggtgctctccgaggaggactgcgcgattcccctggccgaacgcgccggttggcgccgctggtggctggtcgacccgctggacggcaccaaggagttcatcgccggcagcgaggagttcaccgtcaacgtcgcgctgatcgaggagggccgggtgctgctcggcgtggtcggggtgccggcgaccggctgctgctatttcggcggcgccgggctcggcgcctggagcagcgagatgtcgggcgtcgaacggccgatcgccgtgcgtcgcgcgccgggcgaggatttcaccgtggtcgccagccggcggcacagcagtccggcccaggagcgcctactgcaggggctcgccgcgcgtttcggcaacctgcggctgaccagcgtcggcagttcgctgaagttctgcctgctcgccgaggggctggcggatttctatccgcgcctggcgccgacctcgcagtgggacaccgccgccgcccagggcgtgctcgagggcgccggcggcgaggtgctggatctgcagggcagggcgctggactacgcggcgcgcgccgatttcctcaacccgtcgttcctggctctgccgcgcacggccggctggcgcgacgggctgctcgaactggcgcggacgctggagtga

SEQ ID NO: 84416 - protein, 274 aa, Azotobacter vinelandii
MSAVPFAPLIDLVRQAGAAILPYWRMDGIDVQEKDDASPVTAADLAAHRVLCAGLRALEPTVPVLSEEDCAIPLAERAGWRRWWLVDPLDGTKEFIAGSEEFTVNVALIEEGRVLLGVVGVPATGCCYFGGAGLGAWSSEMSGVERPIAVRRAPGEDFTVVASRRHSSPAQERLLQGLAARFGNLRLTSVGSSLKFCLLAEGLADFYPRLAPTSQWDTAAAQGVLEGAGGEVLDLQGRALDYAARADFLNPSFLALPRTAGWRDGLLELARTLE

SEQ ID NO: 84417 - DNA, 861 bp, Nostoc punctiforme PCC 73102
  CDS (1)..(861)
atgaaagacttacaagaaatattagcgatcgctcgtgagatagcttggggtgcagcagatatactgcgatcgtattaccacggtaccgcaaaagaccctaacttagatgtgcaatataaacagaacgagcctgttaccgttgccgatgtagctgtgagtcaatatatcttacagaagctacaagcaactttgggtaacgaagattttgcttacatcagcgaagaaacctatcagtcaccaactacaggcacacacccttccgccccttgggtatggataattgaccctttggatggcacacgagactttattgaaaaaactggggactatgcagttcacattgctttagttaaggaaacacgcccgattttagcagtggtagcagtaccagaagcagaaaagttatattacgctaccaaaggtggggggacatttgtagaaaccagtgatggctctgttcctttacaagtgtcgtcaggtaaaccaattgaggatttaaccttagtggttagtcgctctcaccgcaaccagcgcttagattacttgctacaaaatttaccctgtcaaaatcagaaatctgtgggtagtgtaggctgcaaaatcgccactattgtcgagcaacaagcagatatctacatttccctttctggtaagtctgcgcccaaagattgggatatggcagcaccagaactgattttaacagaagctggtggtaagtttacccactttgacggcgctccgttgcagtataacactggtgatatcaatcaatggggaggtttgctggcgagtaatggtgaatatcacgaagcactgtgccagcaagcagaaaagattttagcgcagttcgaccatagctaa

SEQ ID NO: 84418 - protein, 286 aa, Nostoc punctiforme PCC 73102
MKDLQEILAIAREIAWGAADILRSYYHGTAKDPNLDVQYKQNEPVTVADVAVSQYILQKLQATLGNEDFAYISEETYQSPTTGTHPSAPWVWIIDPLDGTRDFIEKTGDYAVHIALVKETRPILAVVAVPEAEKLYYATKGGGTFVETSDGSVPLQVSSGKPIEDLTLVVSRSHRNQRLDYLLQNLPCQNQKSVGSVGCKIATIVEQQADIYISLSGKSAPKDWDMAAPELILTEAGGKFTHFDGAPLQYNTGDINQWGGLLASNGEYHEALCQQAEKILAQFDHS

SEQ ID NO: 84419 - DNA, 747 bp, Desulfovibrio desulfuricans G20
  CDS (1)..(747)
atgatccgcatagccagacaggcgggaaaagaaatcgccgcccgtcagcaggccattgtgcaggcaggtgaagccgccatatggcacaaggacgacgactcgcccgtcactcaggcggacagggcggccagtgccgttctgtgtgccggactggcacagatggctccttctgttcccgttatttcagaagaggaatccattccccctgccgaggtacgacggggctgggggctgtattttctggtggacccgctggacggcaccaaaggctatctgaaaggagaggcagactacagtgtctgtgtggcactcatgcgccgcgacatgcctctggccggagttgtccatgtgcctgcgcgcgggcttacctattacggtctgcccggcacgggcgcatggcgcgaagatgaaagcggcatgccggtgcgcctgcataccgcccccgccgtttcaggaaaacaaccggtggtgctgcaaagccgggtgtccgcaacccccaaactggatgcctacatggatggtctgccccatacgcgcctgatggcaggcagtgcctacaagttctgcctgctggccgagggaacggcccagatgtatccctgtctgcaccccacatgggaatgggacaccgccgccggagaagccgttctgcgcggagcgggcggcactgtgaccgatatggacggccgccccctcagatacggcaaaagctctctgctcaacgatcttttcatagcgcggggatga

SEQ ID NO: 84420 - protein, 248 aa, Desulfovibrio desulfuricans G20
MIRIARQAGKEIAARQQAIVQAGEAAIWHKDDDSPVTQADRAASAVLCAGLAQMAPSVPVISEEESIPPAEVRRGWGLYFLVDPLDGTKGYLKGEADYSVCVALMRRDMPLAGVVHVPARGLTYYGLPGTGAWREDESGMPVRLHTAPAVSGKQPVVLQSRVSATPKLDAYMDGLPHTRLMAGSAYKFCLLAEGTAQMYPCLHPTWEWDTAAGEAVLRGAGGTVTDMDGRPLRYGKSSLLNDLFIARG

SEQ ID NO: 84421 - DNA, 819 bp, Haemophilus somnus 2336
  CDS (1)..(819)
atgaatgaattaaaaagtcaggtactgctggaaaaggttttacaaatcgctcatcaagctggagactatcttaatcttttttacaatggagaatttgattttcagatcaacataaaatcggataatacgcctatcacaaacgcagatttatttgtaaaccagtttcttatcgaaaaactgaccgcacttacgccacatatccctgttttatcagaagaaagctgtcaaatttctttttcagatcgacggcggtggcgtacttattggttgattgatccgctggatggtacacaacaatttattaatcgaacagatcaattcgctgtgctaattgcactgattcatcaaaatcggatcatgttaggtattattcatgctcccgtgttaaaacaaacttattatgccctgaaagggcatggtgcttataaacaaacggaacattctctgcaaactttatcagccagaaaatttgacttaaaccatacagtaaaaattgcagtaggttcaaaaaatgcggagcaaaaagtgcggtcaattttgagatcaaattatcaatacgaatttattacttatggttctagcggtttaaaaaccgcactggttgcagaaggaagtgcagattgctatattcgactgggacaaaccggtgaatgggacacagctgcggcggaagccattttatccgaaataggcggaggaatccgtgatacccaattcaacgccctaacttataacaaacgaccgagtttaataaaccctgattttattatggtatcggacatatctgccgattggaaaaaaatctttcaatttaattaa

SEQ ID NO: 84422 - protein, 272 aa, Haemophilus somnus 2336
MNELKSQVLLEKVLQIAHQAGDYLNLFYNGEFDFQINIKSDNTPITNADLFVNQFLIEKLTALTPHIPVLSEESCQISFSDRRRWRTYWLIDPLDGTQQFINRTDQFAVLIALIHQNRIMLGIIHAPVLKQTYYALKGHGAYKQTEHSLQTLSARKFDLNHTVKIAVGSKNAEQKVRSILRSNYQYEFITYGSSGLKTALVAEGSADCYIRLGQTGEWDTAAAEAILSEIGGGIRDTQFNALTYNKRPSLINPDFIMVSDISADWKKIFQFN

SEQ ID NO: 84423 - DNA, 816 bp, Actinobacillus pleuropneumoniae serovar 1 str. 4074
  CDS (1)..(816)
atgcaaccattaaattcaacgctgttggaagcggttaaacggattgcgatagaagcgggagagcaccttaaacgtttttatcagtgttcggtacaggtcaaaatcaaagcggatcatacgccggttacggaggcggatctgtttatcagccaattcgtaacggaaaaacttcgtcaattaacgccggacgtgccgattttatccgaagaaaattgcaatatcgcattagcggatcgacaaacttggcaagaatattggatcattgatccgttagacgggacgcaacaatttattgatcgtaccgatcaattttctgtggtaatcggtttagtgcaagatcatcgcccggtgttaggtgtgatccattctccgattttagcgaagacttattttgctatggcgggaaacggcgcatttttgcaagaaaacggcgaaattcgacagcttgtcggacatcagggcttacttcaggataatcgcttgaagattacgatgggtgcatctgcacagcaggcggtattaaattcggtagataaatcttatcaagcggaaatcttccaatacggttcaagcagtttaaaagcgggtttacttgccgaaggtaaagcggattgttacgtacgtttcggcgataccggagaatgggatacggcggttgccgaagtattactttcggaagtaggcggcaaaatttttaatttgaagtttgagccgcttacttataatcggcgttcaacttttatcaacccctatttcgtgatggtggcggataagcatttggcttgggaacaaatttttagatttaatgcgcaatag

SEQ ID NO: 84424 - protein, 271 aa, Actinobacillus pleuropneumoniae serovar 1 str. 4074
MQPLNSTLLEAVKRIAIEAGEHLKRFYQCSVQVKIKADHTPVTEADLFISQFVTEKLRQLTPDVPILSEENCNIALADRQTWQEYWIIDPLDGTQQFIDRTDQFSVVIGLVQDHRPVLGVIHSPILAKTYFAMAGNGAFLQENGEIRQLVGHQGLLQDNRLKITMGASAQQAVLNSVDKSYQAEIFQYGSSSLKAGLLAEGKADCYVRFGDTGEWDTAVAEVLLSEVGGKIFNLKFEPLTYNRRSTFINPYFVMVADKHLAWEQIFRFNAQ

SEQ ID NO: 84425 - DNA, 822 bp, Pseudomonas aeruginosa UCBPP-PA14
  CDS (1)..(822)
atgaggccggtgccttggggcgaattggtggcgctggtgcggcgcgccggcgaggcgatcctgccgcactggcgcgccgacgtggcggtgcgctcgaaggccgacgaatcgccggtgactgccgccgacctggccgcgcaccatatattggaggcgggattgcgggcgctggcgccggacattccggtgctttccgaagaggattgcgagataccgctgagcgagcgcggccactggcggcgctggtggctggtggacccgctggacggcaccaaggagttcatctccggtagcgaggagttcaccgtcaacgtggccctggtcgaggatggccgggtgctgttcggcctggtcggcgtgccggtgagcggccgctgctactacggtggcgccggtctcggtgcctggcgcgaggaggccgatggccgcgcgcaaccgatcagtgtgcgcctggagcccgaggaggccttcaccgtggtggccagcaagcgccacggcagcccggcccaggagcgcctgctggatggcttgagcgagcgcttcggcgacctgcggcgagccagtatcggcagttcgctgaagttctgcctgctggccgagggcgctgccgactgctatccgcgcctgacgccaacctcgcaatgggacacggccgccgcccagggtgtgctggagggcgccggcggcgaggtgctcgacctgcatggcgcgccattcacctacgagccgcgcgaggactacctcaacggctccttcctggccctgccgcgcgctgccgagtggcgcagcgaactgatccaactggcgcgcgcgctgcactga

SEQ ID NO: 84426 - protein, 273 aa, Pseudomonas aeruginosa UCBPP-PA14
MRPVPWGELVALVRRAGEAILPHWRADVAVRSKADESPVTAADLAAHHILEAGLRALAPDIPVLSEEDCEIPLSERGHWRRWWLVDPLDGTKEFISGSEEFTVNVALVEDGRVLFGLVGVPVSGRCYYGGAGLGAWREEADGRAQPISVRLEPEEAFTVVASKRHGSPAQERLLDGLSERFGDLRRASIGSSLKFCLLAEGAADCYPRLTPTSQWDTAAAQGVLEGAGGEVLDLHGAPFTYEPREDYLNGSFLALPRAAEWRSELIQLARALH

SEQ ID NO: 84427 - DNA, 777 bp, Rickettsia rickettsii
  CDS (1)..(777)
atgaatgacaatttaattaatgctttaaaagatttaattattaataccggcaagattgcactagatataaaaaaggcaggaatgttgactgatattaaatcagatgggtcagtagtcactaatgccgataaggaaattagtaaaataatttatcaaactctacaaaccttaacctctcaaatagctatagtatgtgaagagcagccgctacctatattcagcagtgatactttttggttaatcgatcctattgatgggacatggagctatgtaaacggtaaaagtacatatacggtcaatatagggcttattgaaaacggttttccaaccatcggcttgatatatcaccctgaaacagcaaagctatattatactgatgtaaacggtcggttaaaaatcgaacagaattctaaagaaatatttgttaataatgaacctaaacatgaagagcttcatgcggtaataggtttttataattcaaataaagctactaaagaatttttaagtaagtattcattcggtcaaataaatgcaataggcagttcaatgaaactatgcttaattgctgaaggagcagctgatatatatccaaaattcggtcaaactatggaatgggacatagcggcaggtcatgctttaattaaagccggcggtggtaatattttagatacgcatggacaagaaattacttacggtaaagaaagtttcgctaatcctaatttttttgcctgtagtaaatattggttggaaagggaggcaaggttgcatagatactag

SEQ ID NO: 84428 - protein, 258 aa, Rickettsia rickettsii
MNDNLINALKDLIINTGKIALDIKKAGMLTDIKSDGSVVTNADKEISKIIYQTLQTLTSQIAIVCEEQPLPIFSSDTFWLIDPIDGTWSYVNGKSTYTVNIGLIENGFPTIGLIYHPETAKLYYTDVNGRLKIEQNSKEIFVNNEPKHEELHAVIGFYNSNKATKEFLSKYSFGQINAIGSSMKLCLIAEGAADIYPKFGQTMEWDIAAGHALIKAGGGNILDTHGQEITYGKESFANPNFFACSKYWLEREARLHRY

SEQ ID NO: 84429 - DNA, 804 bp, Haemophilus influenzae R2846
  CDS (1)..(804)
atgaatccaatgttaaatatcgctattcgtgcggcacgaaaagcgggcaatgcgattgctaaaaattatgaacgccgtgatgcaatcgaaagcacacaaaaaggtattaatgattatgtgacaaacgttgataaagcggcagaagcagaaatcattgaaattattcgtaaatcttatcctgatcacacaattattacggaagaaacaggcgcaattgaaggcaaagatagcgatgtacaatggattattgatccgctagatggtactcgtaattttatgacagggcttccccacttttctgtgtctatcgcagttcgtgtaaaaaatcgcactgaagtcggggttgtttacgatccaatccgcaatgaattatttaccgctgtgcgtggcgaaggtgcaaaattaaatgaagtacgtttacgtgtagatagtaaacgtgaaattcaaggttcaattttagccactggttttccattcaaacaaccaaaattaatgccaactcaatttgcaatgatgaatgccttaattgaagatgctgcggatttccgtcgcacgggttccgctgcattagatttatgctatgtggcgtcaaaccgtattgatggttattttgaaatgggcttaaaagcatgggattgcgcagcgggcgatttaatcgtgcgtgaagcaggtggtttagtctgtgattttgatgcagataacggctacttacgcagtggcaatatcatcgcagccccatcacgcgtaataaaagaaatgttaaataaaatccgcccttgtttaggtgctgaatttaatcattaa

SEQ ID NO: 84430 - protein, 267 aa, Haemophilus influenzae R2846
MNPMLNIAIRAARKAGNAIAKNYERRDAIESTQKGINDYVTNVDKAAEAEIIEIIRKSYPDHTIITEETGAIEGKDSDVQWIIDPLDGTRNFMTGLPHFSVSIAVRVKNRTEVGVVYDPIRNELFTAVRGEGAKLNEVRLRVDSKREIQGSILATGFPFKQPKLMPTQFAMMNALIEDAADFRRTGSAALDLCYVASNRIDGYFEMGLKAWDCAAGDLIVREAGGLVCDFDADNGYLRSGNIIAAPSRVIKEMLNKIRPCLGAEFNH

SEQ ID NO: 84431 - DNA, 804 bp, Haemophilus influenzae R2866
  CDS (1)..(804)
atgaatccaatgttaaatatcgcaattcgtgcggcacgaaaagcaggcaatgtgattgctaaaaattatgaacgccgtgatgctatcgaaagcacacaaaaaggtattaatgattatgtaacaaacgttgataaagcgtctgaagcagaaatcattgaagttattcgtaaatcttatcctgatcacacaattattacggaagaaacagacgcaattgaaggcaaagatagcgatgtacaatggattattgatccgctagatggtactcgtaattttatgacaggacttccccacttttctgtgtctatcgcagttcgtgtaaaaaatcgcactgaagtcggggttgtttacgatccaatccgtaatgaattatttaccgctgtgcgtggcgaaggtgcaaaattaaatgaagtacgtttacgtgtagatagtaaacgtgaaattcaaggttcaattttagccactggtttcccattcaaacaaccaaaattaatgccaactcaatttgcaatgatgaatgccttaattgaagatgctgcggatttccgtcgcacgggctctgccgcattggatttatgctatgtggcgtcaaaccgtattgatggttattttgaaatgggcttaaaagcatgggattgtgctgctggcgatttaatcgtgcgtgaagcaggtggtttagtttgcgattttgatgctggtaacggctacttacgcagtggcaatatcattgctgcaccatcacgcataattaaagaaatgttaaataaaattcgcccttgtttaggtgctgaatttaatcattaa

SEQ ID NO: 84432 - protein, 267 aa, Haemophilus influenzae R2866
MNPMLNIAIRAARKAGNVIAKNYERRDAIESTQKGINDYVTNVDKASEAEIIEVIRKSYPDHTIITEETDAIEGKDSDVQWIIDPLDGTRNFMTGLPHFSVSIAVRVKNRTEVGVVYDPIRNELFTAVRGEGAKLNEVRLRVDSKREIQGSILATGFPFKQPKLMPTQFAMMNALIEDAADFRRTGSAALDLCYVASNRIDGYFEMGLKAWDCAAGDLIVREAGGLVCDFDAGNGYLRSGNIIAAPSRIIKEMLNKIRPCLGAEFNH

SEQ ID NO: 84433 - DNA, 801 bp, Methylobacillus flagellatus KT
  CDS (1)..(801)
atgagtcatgcgctgctcccggcattgatccgattggcgcataaggccggggatgccatcatgcaggtataccggggagattttgcagtacagcgcaaacaagattactctcccctgacagaggcggacctggttgcccatggtgtcattgccgcgggcttgcagcgcttgacaccgggcgtgcccttgatttccgaggagtgcgagcttgctccgttcttggagcgtcggcagtggcggcaatactggctggtagaccctctggacggcacgcgggagttcgtcaagcgtaatgatgaattcagcgtcaatatcgccctgatcgatcaaggccggcctgtactcggggtcatccatgcgccagcactggggctcagctattatgccgacggtaaagctgcctataagcaatctggcagcgggtcagccattaggattcacgcgcggacgctggattttgggcatatcacggtagcggtcagccgttcccatctcaacaataaagtccaggcaatgctgcgcaacattgccaagcggcatggcgagccggatatgatcagcatggggagctctctcaaaatatgtctggtggcggaagggcgggctgatgtctatcctcgcctgggtctgacatcggagtgggatacggcagccgggcaatgcgtgctcgaatgcgcaggcgggcaagtggtggaccgccatggcctggccctgcaatacaatggcaaggatacgattctcaacccagaattctttgcgcgtggcgcgacagcgcacgactggaatcaatatatggagtaa

SEQ ID NO: 84434 - protein, 266 aa, Methylobacillus flagellatus KT
MSHALLPALIRLAHKAGDAIMQVYRGDFAVQRKQDYSPLTEADLVAHGVIAAGLQRLTPGVPLISEECELAPFLERRQWRQYWLVDPLDGTREFVKRNDEFSVNIALIDQGRPVLGVIHAPALGLSYYADGKAAYKQSGSGSAIRIHARTLDFGHITVAVSRSHLNNKVQAMLRNIAKRHGEPDMISMGSSLKICLVAEGRADVYPRLGLTSEWDTAAGQCVLECAGGQVVDRHGLALQYNGKDTILNPEFFARGATAHDWNQYME

SEQ ID NO: 84435 - DNA, 858 bp, Crocosphaera watsonii WH 8501
  CDS (1)..(858)
atgacagaaatccaaaaattagaagaaatcgaagccatcacccgttcagtgggttggggtgcagcaaaaattctcagcgaatattatcgcggagaaggggatttaaatgttaatgaagataaaaaagatggtcccgtcactgcggctgatcttgctgctaaccgttacattttagagaaattacaagctgttttccctgaagatacctttggttatttgagtgaagaaacccatgaaggaacagaacctattaataaagagtgggtttggatcattgatcctctggatgggactcgggattttattgataaaactggtgaatatgctttacatatcgccttagcttatcaaggtcgtcccatggtgtctgtagttgccattcccgaagctcaaaaaatctattatgccagtaaaggcaacggtacttttgtggaaacgcccgatgggacaattaccccgatcaaagtatcggaacgaaatcaacttgaagacttatatttagtcgttagtcgtacccatagagacgatcgctttcaagctttaattgaggctttacccttaaaagatcgcatttatatgggtagtgtcgggggaaaaatttcaactttattagaaaaaacctctgatatttatatctctttgtccggtaaatctgcggccaaagattgggacttcgctgcaccggaattaattttaaccgaagcagggggacaatttacccatgaaaacggtgatcccttaatttataaccgaggggatgtgcgtcaatggggttgtttaatcgctagtaatggtcattgtcatgaagctttatgtgcagaagccacgcaaattctagccaaaattgataataaataa

SEQ ID NO: 84436 - protein, 285 aa, Crocosphaera watsonii WH 8501
MTEIQKLEEIEAITRSVGWGAAKILSEYYRGEGDLNVNEDKKDGPVTAADLAANRYILEKLQAVFPEDTFGYLSEETHEGTEPINKEWVWIIDPLDGTRDFIDKTGEYALHIALAYQGRPMVSVVAIPEAQKIYYASKGNGTFVETPDGTITPIKVSERNQLEDLYLVVSRTHRDDRFQALIEALPLKDRIYMGSVGGKISTLLEKTSDIYISLSGKSAAKDWDFAAPELILTEAGGQFTHENGDPLIYNRGDVRQWGCLIASNGHCHEALCAEATQILAKIDNK

SEQ ID NO: 84437 - DNA, 972 bp, Crocosphaera watsonii WH 8501
  CDS (1)..(972)
atgaattatcaagcagaaaaagagttagccttgaagatagtcacagaagcggctaaactctgtcaacgagtgcaacaaaccgacgggggaaaagcggttaaaaaggccgataccagtcccgttactgtggcagatttcggggcgcaagccattttatgtcaagggttaattgagggatttccccatgatcctgtgattggggaagaagatgctaccctcttgcaacaaccagagttagcaggggtacgccagcaaattattgaacaggtacaagaatctattcccactgccaccccagataatgtcatagattggattaactggggtaatggagaagttgcccaacgttattggactttggaccccatcgatggcactagggggtttattcggggcaatcaatacgctgttgctttggctttagttgaagggggagaggtaaagttaggggtattagcttgtcctgcttttcctagagaagatggtgggaaaggactgattttcttggctattcggggtcaaggagccacagaaatgcccttagaaggggggaaccctctaccaattcgagtcgatccctcgttcaattttgagcagttgtatcgcatcgaaagcatcgaatctagccatagcgatcgcggagtccaaagcgccgttgatcgccatctggggttgacttatggggcgaaacagatggattctttggctaaatatggggcgatcgccaagggagaggctcatttttataccagagtccctttaccgcaatttaagggcaaaaaagaaaatatctgggaccatgcacccggagtcgtcattgtggaagaagcaggaggaaaggtgacggatttagagggtaaacccttagatttttctgttggtacaaaattgagcaataatcacggtgttttagccactaatggcgtaattcattcccaagttttagcagctttatcgaaaaattgggtttaa

SEQ ID NO: 84438 - protein, 323 aa, Crocosphaera watsonii WH 8501
MNYQAEKELALKIVTEAAKLCQRVQQTDGGKAVKKADTSPVTVADFGAQAILCQGLIEGFPHDPVIGEEDATLLQQPELAGVRQQIIEQVQESIPTATPDNVIDWINWGNGEVAQRYWTLDPIDGTRGFIRGNQYAVALALVEGGEVKLGVLACPAFPREDGGKGLIFLAIRGQGATEMPLEGGNPLPIRVDPSFNFEQLYRIESIESSHSDRGVQSAVDRHLGLTYGAKQMDSLAKYGAIAKGEAHFYTRVPLPQFKGKKENIWDHAPGVVIVEEAGGKVTDLEGKPLDFSVGTKLSNNHGVLATNGVIHSQVLAALSKNWV

SEQ ID NO: 84439 - DNA, 780 bp, Rubrobacter xylanophilus DSM 9941
  CDS (1)..(780)
ttgcgcggggagttcgaggtggcgctggaggcggccagggccgcgggcggggtgctgctcgcgggcttcggccggagaggggaggtccgctacaagggcgaggtcgacctggtgacggagacggacgtgagggcggagcgcctgctcaaggagaggcttctcggggccttccccggctacggcgtgctggccgaggagagcgggcagaccgcgggggagggtgatgtgcgctgggtcgtggaccccctcgacgggacggtcaacttcgcccacgggcttcccatcttcgcggtctccgtcgcccttcagagggggcgagaggtcgtcctgggggcggtctacgacccggtgagggacgagatgttcgccgcccggcggggagggggagccacacttaacggcgagcccataagcacctcggacaacggcgagctcatccgggcgctcgtggccaccggcttcccctacgatcgggccaagatgcccgaggccctggagctcttcgggcgcttcgccacgcgcacgcggggcatgcggcggctcggctccagcgccctggacctctgctacgtcgcctgcgggaggctcgacggctactacgagcgcggggtctgggcctgggatgttgccgcggccgctttgatcctggaggaggccggcgggagggtgtcggactaccgcggcgggccgctcgacgtggagggaagggagatagtcgcgagcaacggaccgctgcacgcggcgatgctcgacctcacgcgcccgttctccgggcggtga

SEQ ID NO: 84440 - protein, 259 aa, Rubrobacter xylanophilus DSM 9941
MRGEFEVALEAARAAGGVLLAGFGRRGEVRYKGEVDLVTETDVRAERLLKERLLGAFPGYGVLAEESGQTAGEGDVRWVVDPLDGTVNFAHGLPIFAVSVALQRGREVVLGAVYDPVRDEMFAARRGGGATLNGEPISTSDNGELIRALVATGFPYDRAKMPEALELFGRFATRTRGMRRLGSSALDLCYVACGRLDGYYERGVWAWDVAAAALILEEAGGRVSDYRGGPLDVEGREIVASNGPLHAAMLDLTRPFSGR

SEQ ID NO: 84441 - DNA, 801 bp, Mesorhizobium sp. BNC1
  CDS (1)..(801)
atggctggcgagacagcccttctggcgctcttcgaggagctggcgcttgcggccggccgtcaggtcatggcgcattatgaagccggcgtgcagatcgagcacaaatccgatgcctcccccgtgacggaagccgatcgtgccgccgagcgcgtcattctcgccgggctgcgtgccaccgtggcggggacgccgtgcgtctctgaagaggaggcctcgggcggcgtgctgccggcctgcggcgacgaaggattttttctggtcgacccgctcgacggcacccgcgaattcattgggcgcaggccggatttcacggtcaacatagcctatgtgaaggatggtgctccggtggtcggcgtggtctatgcgccggcgcgcgggcttctctattccggcaggcccggcgcggccttcgaagccgaatgccacaacggcgcaatcacaagccgccgcgggatcaatacccgcccgcggcgcaatcctccagcgatcgtggccagccgctcccattccacgccggaaacggaagccttcatcgcccgctatcccggcgcggaaaccgtctccgtcggctcgtcgctgaaattctgcatgattgcctgcggccaggcggatctttatccgcgttacggccgcaccatgcagtgggatacggcagccggtgacgcggtgctgcgcgccgcgggtggcagcacgcttacgcttcaaggcaaaccgcttacctatgggccgaaggaaggtgagggactggaggctttcgccaacccgttcttcatagccgaggggcgggcggctcaagattag

SEQ ID NO: 84442 - protein, 266 aa, Mesorhizobium sp. BNC1
MAGETALLALFEELALAAGRQVMAHYEAGVQIEHKSDASPVTEADRAAERVILAGLRATVAGTPCVSEEEASGGVLPACGDEGFFLVDPLDGTREFIGRRPDFTVNIAYVKDGAPVVGVVYAPARGLLYSGRPGAAFEAECHNGAITSRRGINTRPRRNPPAIVASRSHSTPETEAFIARYPGAETVSVGSSLKFCMIACGQADLYPRYGRTMQWDTAAGDAVLRAAGGSTLTLQGKPLTYGPKEGEGLEAFANPFFIAEGRAAQD

SEQ ID NO: 84443 - DNA, 783 bp, Rhodospirillum rubrum
  CDS (1)..(783)
atgatcgacatcgatgctccgctagaccttgtccaggctctgatccccatcgccgaaaaggcgggcgaggagatcctggcggtctacaccacgcccttcgccgttgaaagcaaggccgaccattccccggttaccgaggccgaccgccgggcggaagcggtgatcatcgaggccttgacccggctgaccccggccattccgatcgtcgccgaggaagccgtcgccgccggccatatcccggtggtcggcgatcagccgttctggctggtcgacccgctggacggcaccaaggaattcgtcaagcgcaacggcgagttcacggtcaatatcggccttgtcgtcggcggcgtgccggtgctgggcgtcgtgcattgcccggccctggagatcacctattggggggccggcctcggccatgcggtcatgcgcagccgccacagcacgcggacgatcacctgccgcccggagcccgaggacggattgaccgttctggccagccgcagccatggctcggacgacgagatgacgacctttctcgccgcctttccggtcaaggcccgcatcgccgccggcagcagcctgaagttctgccgcatcgccgagggaaccgccgatctgtatccccggcttggcccgacctatgaatgggacacctgcgccgcccatgcggtgctgcgcgccgccggcggtggcgtcttcaccctggacggccagcctttggcctatgccaagcgcggcgatttcctcaatccgcccttcgtcgcccggggattgccggcgtga

SEQ ID NO: 84444 - protein, 260 aa, Rhodospirillum rubrum
MIDIDAPLDLVQALIPIAEKAGEEILAVYTTPFAVESKADHSPVTEADRRAEAVIIEALTRLTPAIPIVAEEAVAAGHIPVVGDQPFWLVDPLDGTKEFVKRNGEFTVNIGLVVGGVPVLGVVHCPALEITYWGAGLGHAVMRSRHSTRTITCRPEPEDGLTVLASRSHGSDDEMTTFLAAFPVKARIAAGSSLKFCRIAEGTADLYPRLGPTYEWDTCAAHAVLRAAGGGVFTLDGQPLAYAKRGDFLNPPFVARGLPA

SEQ ID NO: 84445 - DNA, 825 bp, Magnetococcus sp. MC-1
  CDS (1)..(825)
atgcctagcgcttatgaaattgagtgccaactgatgacccaagcggcccaacagtgccacgacaccattatgcaacattttcggttgggccaaaccgttggcgaaggggccaatgtacaggataaaggcatcaacaaccccctaaccgcagccgacctcgccgtcgacggttatttgcacgacaccctgttaaccgcccggcccgactatggttggctctctgaagagacggtggataacccaagccgcctgaaaaaccagcgtgtatgggtcgtggaccccatcgacgggaccaaagagtttatagctggcattcctcagtttgccatctccattggcctggtagataacggccaacctgtcgctgcggtggtctacaatcccgccttacaggagatgtttagtgcccaccttggcggtggggcacagttaaatggcacgcccattcatacctccacccgcaccagcctacaaggcgctcgctgcctggccagccgctccgaaaccaaacgcggcgagtgggatagctttacctcggagctgcaactgaccactatgggctccatcgcctataaactggccctggtagccatgggtcgctatgatatgacctttacccttacacccaaaaatgaatgggacttctgcgcaggtcatctgttggtaaccgaggctggcggtgccattagtcacaaagaggggtcaccctttatctacaatcaagcgcagcccaaaacccgctccgttgtcgcgaccaacggcccccttcacgaacccctgctcaaccgcttgcgtgatgtccccttgggacgcgatcgacgttaa

SEQ ID NO: 84446 - protein, 274 aa, Magnetococcus sp. MC-1
MPSAYEIECQLMTQAAQQCHDTIMQHFRLGQTVGEGANVQDKGINNPLTAADLAVDGYLHDTLLTARPDYGWLSEETVDNPSRLKNQRVWVVDPIDGTKEFIAGIPQFAISIGLVDNGQPVAAVVYNPALQEMFSAHLGGGAQLNGTPIHTSTRTSLQGARCLASRSETKRGEWDSFTSELQLTTMGSIAYKLALVAMGRYDMTFTLTPKNEWDFCAGHLLVTEAGGAISHKEGSPFIYNQAQPKTRSVVATNGPLHEPLLNRLRDVPLGRDRR

SEQ ID NO: 84447 - DNA, 798 bp, Thermobifida fusca
  CDS (1)..(798)
atgctgaacctggtgagcaccatcagaaacgatcacgaagtggcgcgtgaccttgcgtttgaggccggtcaacggttgctgcggctgcgggagcgccacgggttcgacgaaccggaagtgctgcgcaccctgggtgaccgggtgtcgcacgagtttctgttctccgcactgggacggctgcggcccagcgatccggtgctgtcggaggaaggggtagaggatccccggcggttcagagcacaccgcgtgtggattatcgacccgttggacggcacccgggagttcggtgaggcgggccgcacggactgggcggtgcacgtcgcactgtgggagaacggggagctcgtcgccggtgcggtgtcgctgcccgcacaggggagcacgctgtctacggtggacccgccgtggcttccggaggagcgccccgcggggcagcggttgcggatcacgacgagccggacccgtccgccggagttcgtgcggcggctggcgaaccagttgggtgccgagctggtgccgatgggttcggcgggcgccaagatcagcgcggtgatgctggggatcgccgatatctacatccacgcgggcggccagtacgaatgggacagtgcggctccggtcgcggtggcccgggcagctggcctgcacacgtcgcgcattgacgggagctcgttgacctacaaccggccagacccctacctgcccgatatcctagtatgtcgatcggagttgtcgggtatgttgttggccagtatccgtaacgtagcggatatggacaacgcgggtccacacacctga

SEQ ID NO: 84448 - protein, 265 aa, Thermobifida fusca
MLNLVSTIRNDHEVARDLAFEAGQRLLRLRERHGFDEPEVLRTLGDRVSHEFLFSALGRLRPSDPVLSEEGVEDPRRFRAHRVWIIDPLDGTREFGEAGRTDWAVHVALWENGELVAGAVSLPAQGSTLSTVDPPWLPEERPAGQRLRITTSRTRPPEFVRRLANQLGAELVPMGSAGAKISAVMLGIADIYIHAGGQYEWDSAAPVAVARAAGLHTSRIDGSSLTYNRPDPYLPDILVCRSELSGMLLASIRNVADMDNAGPHT

SEQ ID NO: 84449 - DNA, 747 bp, Novosphingobium aromaticivorans DSM 12444
  CDS (1)..(747)
atgaacgacgcagaactcgccgcccatctcgccgaatatgcaggcaagctgctgctgaccgtgcgcgaaagcgggatgctcagcctcaagcagctcggcaaggcgggcgatgcgacagcgaaccagttcctggtccatgccctgcgcgaacagcggccggatgacggactgctttccgaggaggagaaggacaacctcgaccgcctgcaattctcgcgcacgtggatcgtcgacccggtggacgggacccgcgaatatggcgaggcgcggaccgactgggcggtgcacgtggggcttgccatcgatggcgtggcgacggtcggcgccgttgcgttgccgggcgcgggtgtggtgctgcgcacggacaggccacaggtcgttcctcccgcacccgagacgctgcgcatggtcgtaagccgtacccggcccgcgcacgaggccgtgaccatcgccgaaaagatcggcgctgaactggtgcccatgggtagcgcgggtgcgaaggccatggcggtgatccttggcgaggcggatatctacctgcactcgggcggtcagttcgaatgggattcctgtgcgccggtcgccgtcgcactggctcacgggctgcactgttcgcggatcgatggcagtccgctggtttacaaccaggccgaaacatacatgcccgacctgctgatctgccgcccggaacacgctcgcatggtgctggacgaagtcgccgcggttcatgccgggacgcctgcctga

SEQ ID NO: 84450 - protein, 248 aa, Novosphingobium aromaticivorans DSM 12444
MNDAELAAHLAEYAGKLLLTVRESGMLSLKQLGKAGDATANQFLVHALREQRPDDGLLSEEEKDNLDRLQFSRTWIVDPVDGTREYGEARTDWAVHVGLAIDGVATVGAVALPGAGVVLRTDRPQVVPPAPETLRMVVSRTRPAHEAVTIAEKIGAELVPMGSAGAKAMAVILGEADIYLHSGGQFEWDSCAPVAVALAHGLHCSRIDGSPLVYNQAETYMPDLLICRPEHARMVLDEVAAVHAGTPA

SEQ ID NO: 84451 - DNA, 777 bp, Novosphingobium aromaticivorans DSM 12444
  CDS (1)..(777)
atgatcgactacgaccgcctccacgccatcgtccgcgccgcaggggatatggccctggccctctggcccggccacgggcacgcgcccgaggtgtgggaaaagacccccggcagcccggtctgcgaggcggatatcgccgtggacaccttcctgaaacgcgaactgggcgtgctgctcccatcggcgggctggctttcggaagagaccgtggaccatcccgagcggctcgaacgcgggctgtgctggctggtcgacccgatcgacggcacgcgcgatttcgtgcggggacgaccgggctgggccgtttcggtcgcgctggtcagcgaggggcgcccgcttatcggcgttctgagcgcgcccgcccgcgaggaatactggtcggcggtggccgggcgcggagcaacccgcaacggcctgccgcttgccgccagcacgcgccaggtgcttgccggggcgcgagtgcccgccgacagcctgccgcgcgccgacgcggacctggtgaccgtggacaagcccaattccatcgccctgcgcatcgccatggtcggcgcgaacgaggctgatcttctggcaacgctacgctggggcttcgaatgggacatcgccgccgcgaccctgatcgcgcgcgaggccggggccgccgtttccgacgcattcggtcagccgctggcctacaacaagcgcgacccgcgcgccttcgggctgctggttacggcccccgccatccacgcggcggcggtcgaacgccttgccgaccgcgccgcgaagctggcgtaa

SEQ ID NO: 84452 - protein, 258 aa, Novosphingobium aromaticivorans DSM 12444
MIDYDRLHAIVRAAGDMALALWPGHGHAPEVWEKTPGSPVCEADIAVDTFLKRELGVLLPSAGWLSEETVDHPERLERGLCWLVDPIDGTRDFVRGRPGWAVSVALVSEGRPLIGVLSAPAREEYWSAVAGRGATRNGLPLAASTRQVLAGARVPADSLPRADADLVTVDKPNSIALRIAMVGANEADLLATLRWGFEWDIAAATLIAREAGAAVSDAFGQPLAYNKRDPRAFGLLVTAPAIHAAAVERLADRAAKLA

SEQ ID NO: 84453 - DNA, 765 bp, Cytophaga hutchinsonii
  CDS (1)..(765)
atgaataatttacttgaaaatgcaattgtagcgagtatggtggcgggaaaagcaatcatggaggtctatgcaatacccgattttacggatctgatcgaaatcaaaaacgataaatccccccttacggtcgcagataaaaatgcacatcaagtgatttatacccttttgagaggtgaattccctgagattccgatgatctcggaagaaggaaaaggtactccgtacgaagaacgtaaagactggaaacggtactggctggttgatccgctggatggaacaaaggaattcatcaaacgcaacggagagtttaccgtaaacattgccttgatcgaaaataaccgtccggtgatgggcgtggtatacattcccgtaacagacaccttgtatgccgggatcgtggggcaaggtgccttcaaaattgtgaacggcgaagaaacgccgattaccgtacgcaaggcaccggatacaggccggacagccgtgggatcgcgttcacacagtacggaagaagaagcaaaattattggccgattataacgtaaccgattttatcacaacgggaagctcgatcaaattctgtttggtagcggaaggtacagcggacctgtattaccgcgccggacctacaatggagtgggacactgccgccgggcaagctgtattagaagccgcaggcggaacattgacaaatcccgatggatcgatgtttttatacaacaaagaaaatttattgaacggcggatttttgtgcaagggagatatttaa

SEQ ID NO: 84454 - protein, 254 aa, Cytophaga hutchinsonii
MNNLLENAIVASMVAGKAIMEVYAIPDFTDLIEIKNDKSPLTVADKNAHQVIYTLLRGEFPEIPMISEEGKGTPYEERKDWKRYWLVDPLDGTKEFIKRNGEFTVNIALIENNRPVMGVVYIPVTDTLYAGIVGQGAFKIVNGEETPITVRKAPDTGRTAVGSRSHSTEEEAKLLADYNVTDFITTGSSIKFCLVAEGTADLYYRAGPTMEWDTAAGQAVLEAAGGTLTNPDGSMFLYNKENLLNGGFLCKGDI

SEQ ID NO: 84455 - DNA, 816 bp, Microbulbifer degradans 2-40
  CDS (1)..(816)
atgaatttagcaaccttactacctagtatcgaacagcttgccaaacaagcgggtgaagccacgcttgcggtttataaaaagccagaattgtgggatgtagagcataaagacgattgcagcccactcactcaagcagatattcaaagccacaatattattgccgaaggcctagccgcgcttacgcctaacattcctgtgttatcggaagaagacgacgtaccgtcctttgaggtgcgcagccaatggcaacagtattggttaatagacccgttagatggcaccaaagaatttattaatcgcaaaggcgagttcactgtaaacatcgcacttattcaaaataataaagctgtgcttggcgttgtatacgcgccggtgttagatgtgtgttacacaggggcagaaggcattggcgcgtttaaaatagatgctaaaggcaaaacgccactgcgtgtaaaaaaacttacacagggcaagcaaacattgaatattgtagccagccgccggcatggcgcagaagaagtagatcgcttactagaaactataaccagcaagtatggcgaaccccaattaacaagtatgggcagctcgttaaagttgtgtttagtggctgagggtaaagccgacatttacccgcgcttagcacctacctgcgaatgggataccgccgcctcgcaagctgttgtggagcaagccggtggtgtagtgctagatgatcaatttaaacccatgcaatacaacgccaaacccgagctgctaaacggctatttttatgtaataggcgaccaacaatttgattggttggcactgcttaaataa

SEQ ID NO: 84456 - protein, 271 aa, Microbulbifer degradans 2-40
MNLATLLPSIEQLAKQAGEATLAVYKKPELWDVEHKDDCSPLTQADIQSHNIIAEGLAALTPNIPVLSEEDDVPSFEVRSQWQQYWLIDPLDGTKEFINRKGEFTVNIALIQNNKAVLGVVYAPVLDVCYTGAEGIGAFKIDAKGKTPLRVKKLTQGKQTLNIVASRRHGAEEVDRLLETITSKYGEPQLTSMGSSLKLCLVAEGKADIYPRLAPTCEWDTAASQAVVEQAGGVVLDDQFKPMQYNAKPELLNGYFYVIGDQQFDWLALLK

SEQ ID NO: 84457 - DNA, 972 bp, Trichodesmium erythraeum IMS101
  CDS (1)..(972)
atggcttacgaacgcgaaaaacaaatagcaatagaatctgccctagcagcagccaaactctgcgaacaggtgcgtatcaatattcccccagcaatggaaaagggcgacaaaagtcctgtaactgttgctgactatggtgctcaggcattaatttgtaaagctttagctgaagcttttcccaatgatccagtggtaggagaagaagatgctactgagttacaaactccggaaatggcagaaaatttgacaaaagtgacaaattatgtgcaagaacaaataacaaatgctactccagaacaggtagtacagtggattaaccaaggtaatggtaaagttggaccccgttattggacgttagaccctattgatggcacgaaagggtttttacgtcaagaccaatatgcagtagctttagcattagtcgaagaaggagaagttaaagtcggggtgttagcttgtcctgcaatgccagtagaaaataatcaaccaggaatgttatatgtagcagtaagaggtgaaggtgcagcaatgatgccaatagcagggggcgaactgactcccattcaagttgtgcaggctgatgatactgctcatcttcggtttgttgagagcgtggaaagttctcacggcgaccaagaccgtcagaatgctgtagcaaaagcagtaggtattacagcagcatcagttagagtagactcccaagcgaaatacggtatcgttgcatctggacaagctgctttgtatttgcgcttgccctcaccaaagtctccaaattaccgagaaaatatttgggatcatgctgctggtgcgatcgtagttgaggaagcaggagggcgtgtttctgatattcatggcaaaccattaaattttgctgatggcgcaaagatgcttgagaacaggggtatagttgttagtaataaaataattcatgaccaggttttatctattttaaaacagctttcagttaagtag

SEQ ID NO: 84458 - protein, 323 aa, Trichodesmium erythraeum IMS101
MAYEREKQIAIESALAAAKLCEQVRINIPPAMEKGDKSPVTVADYGAQALICKALAEAFPNDPVVGEEDATELQTPEMAENLTKVTNYVQEQITNATPEQVVQWINQGNGKVGPRYWTLDPIDGTKGFLRQDQYAVALALVEEGEVKVGVLACPAMPVENNQPGMLYVAVRGEGAAMMPIAGGELTPIQVVQADDTAHLRFVESVESSHGDQDRQNAVAKAVGITAASVRVDSQAKYGIVASGQAALYLRLPSPKSPNYRENIWDHAAGAIVVEEAGGRVSDIHGKPLNFADGAKMLENRGIVVSNKIIHDQVLSILKQLSVK

SEQ ID NO: 84459 - DNA, 780 bp, Rickettsia akari str. Hartford
  CDS (1)..(780)
atgaataataacttaatagccgctttaaaagatttaattattaataccggcaaggttgcactagatataaaaaaggcaggaatattgactgatattaaatcagatgggtcagtagttactaatgccgataaggaaattagtaaaataatttatcaaactttacgaagcttaacctctcaaatagcgatagtatgtgaagagcagccgctacctatattaagcagtgatactttttggttaatcgatcctattgatgggacacggagctatgtagacggtaaaagtacatatacggtaaatatagggcttattgaaaacggttttccaaccataggcttgatatatcaccctgaaacggcaaagctatattataccgatgtgaacggtcggttaaaaatcgaacagaattctaaagaaatatttgttaatcatgaaccaaaacatgaagagcttaatgcggtaataggtttttataattcaaataaagctactaaagaatttttaagtaagtattcattcggtcaaataaatgaaataggcagttcaattaaattatgcttaattgctgaaggggcagctgatatatatccacaattcagtcaaactatggaatgggacatagctgcaggtcatgctttaattaaagccggcggcggtaatattttagatacacatggacaagaaattacttacggtaaagaaaatttcgctaatcctaattttttcgcttgcggtaaatattggttggaaaagtatccagcctgtaataccttggcttga

SEQ ID NO: 84460 - protein, 259 aa, Rickettsia akari str. Hartford
MNNNLIAALKDLIINTGKVALDIKKAGILTDIKSDGSVVTNADKEISKIIYQTLRSLTSQIAIVCEEQPLPILSSDTFWLIDPIDGTRSYVDGKSTYTVNIGLIENGFPTIGLIYHPETAKLYYTDVNGRLKIEQNSKEIFVNHEPKHEELNAVIGFYNSNKATKEFLSKYSFGQINEIGSSIKLCLIAEGAADIYPQFSQTMEWDIAAGHALIKAGGGNILDTHGQEITYGKENFANPNFFACGKYWLEKYPACNTLA

SEQ ID NO: 84461 - DNA, 801 bp, Xylella fastidiosa Ann-1
  CDS (1)..(801)
atgatcactattcccagcgatcttcacgagtcggtcatcgccattgctacagattccggcagagcgatcatggagatctatcaggatcatttcaaggtccagataaaagcagacatgagtccactgacgcaggccgatttaatctcacatcagatcatcgtgcatggactcaagcaactgacccccagtctgcccgtgttgtcggaagagtcgacaggaatcacttgggaggaacgccgtcactggaagagctactggttggtcgatccactcgacggcacccgcgaatttgtgaaacgcaatggcgagttttgcataaacatcgcactgatccatgaaggtatccccgtatatggaatgatcctggcgccggtggaagggaccatctggcatgcaatgcatggcgggcaggcattccgccgtgatggtcaccgtgataccacattgcacgtgcgggcacctgctggcaccgcgttacaggtcgcagcaagccggtcgcacattgatgtacacacctcggcgttactggcacagatgaaagaaataaccctagtttcgcagggatcggcgctgaagttctgtcgacttgctgaaggcacactcgacgtgtacccgcgtctaggcgctacctatgagtgggatactgccgcaggccagtgcttactgcttgctgcgggcggtacgctactgaacatcgagactggaaaaccgttccgctacaacaaacgcgagacactgcttaacggcggttttatcgcactgggcgacgccacgctgccttggcgcgattggttgccctga

SEQ ID NO: 84462 - protein, 266 aa, Xylella fastidiosa Ann-1
MITIPSDLHESVIAIATDSGRAIMEIYQDHFKVQIKADMSPLTQADLISHQIIVHGLKQLTPSLPVLSEESTGITWEERRHWKSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKPFRYNKRETLLNGGFIALGDATLPWRDWLP

SEQ ID NO: 84463 - DNA, 840 bp, Desulfitobacterium hafniense DCB-2
  CDS (1)..(840)
atgagcgtagccgcagcccccgccttcgtcgccgacagcgccctggtcgaaggcgccatcgccatcgcccgcgccgccgccgcggcgatcctggaaatctacgacggcgagttcgaagtcgagcgcaaggccgacgcctcgccgctcaccgccgccgacatggccgcgcatcacgtcatcgtcgacgggctggcgcggctgacgccggacatcccggtgctgtcggaagaatccgcgcacgaagtcgacgccgcccagcgccgcggctgggaccggctgtggctggtcgatccgctcgacggcacccgcgagttcgtcaagcgcaacggcgaattctcggtcaacctggccctgatcgaacgcggcgagccggtgttcggcgtggttctggcgccggtcggcggcgcgctgtggcacggcgcgcgcggcggccacgcctatcgccgcgatggcgacgccgagcgccgcgtgcaggcgcaggtgccgccggcgcagccgctgcgggtggccgcgagccgctcgcaccacagccagcgcagcgacgagttcctcgcccgcgcgcatcgccaagccgcgcggcggcatcgccatggtcagcctgggctcgtccttgaaattctgccgcatcgccgaaggctcgctggatctgtatccgcgcttcggcccgaccagcgagtgggacaccgccgccgggcaatgcgtgctcgaagcggccggcggcgcgtgctcgacccgcgcggacgcccgttccgttacaaccagcgcgacggcctgctcaacggcgacttcatcgccctgggcgacctgtcgctgccgtggagggcctggcaagatggctga

SEQ ID NO: 84464 - protein, 279 aa, Desulfitobacterium hafniense DCB-2
MSVAAAPAFVADSALVEGAIAIARAAAAAILEIYDGEFEVERKADASPLTAADMAAHHVIVDGLARLTPDIPVLSEESAHEVDAAQRRGWDRLWLVDPLDGTREFVKRNGEFSVNLALIERGEPVFGVVLAPVGGALWHGARGGHAYRRDGDAERRVQAQVPPAQPLRVAASRSHHSQRSDEFLARAHRQAARRHRHGQPGLVLEILPHRRRLAGSVSALRPDQRVGHRRRAMRARSGRRRVLDPRGRPFRYNQRDGLLNGDFIALGDLSLPWRAWQDG

SEQ ID NO: 84465 - DNA, 813 bp, Actinobacillus pleuropneumoniae serovar 1 str. 4074
  CDS (1)..(813)
atgaacccaatgttaaacattgctattcgtgctgcacgaaaagcaggcaatattattgcgaaaggctatgagcaagccgcgagtgaaatcgaagtggctcaaaaaggtacaaacgattacgtaacggcaattgataaagcggcggaagcggcgattatcgaagtaatccgtaaatcttatcctgatcatgcgattgtcggcgaagagtcaggtattttggcaggcgaaaacgaaaatgtgcaatgggtgattgatccattagacggtacaactaacttcgtaaaacgtttgcctcattttgcagtatctatcgcagtgcgtgaaaacggtcgtaccacggtgggagtggtttacgatccaattcgtaacgaacttttcaccgccgtacgcggtgaaggtgcaaaactcaatgaattccgtttacgtgtagaaacggaacgtcgcgatttaaacggtaccgtacttgcaaccggttttcctttcaaagcggctaaacatcgtccggcgcatttaaatatgctcgaaggcttaatgaataacggcgtggcggatttccgtcgtaccggttccgcggcacttgatttggcttatgttgcggcaaatcgtgtggacggttactttgaaatcggtttaaaaccgtgggattgtgcggcgggtgatttaattgtgcgtgaagcgggtgcaatcgtgacgaattttgtcggcggtacggactacttaaaatcaggtaatgtcgtagcaggtcaggctcgtgtggtaaaagaaatcctaaatgcgattcaaccgacattaaccgaagatcttaaaaactaa

SEQ ID NO: 84466 - protein, 270 aa, Actinobacillus pleuropneumoniae serovar 1 str. 4074
MNPMLNIAIRAARKAGNIIAKGYEQAASEIEVAQKGTNDYVTAIDKAAEAAIIEVIRKSYPDHAIVGEESGILAGENENVQWVIDPLDGTTNFVKRLPHFAVSIAVRENGRTTVGVVYDPIRNELFTAVRGEGAKLNEFRLRVETERRDLNGTVLATGFPFKAAKHRPAHLNMLEGLMNNGVADFRRTGSAALDLAYVAANRVDGYFEIGLKPWDCAAGDLIVREAGAIVTNFVGGTDYLKSGNVVAGQARVVKEILNAIQPTLTEDLKN

SEQ ID NO: 84467 - DNA, 774 bp, Chloroflexus aurantiacus
  CDS (1)..(774)
atggagatcgatattgcgctcgtgcgcgcatgggcgcaacaagccggtgatatgcttttgcgctcgtacttcaatcaggtgtcgccagaacgaaaactcgacaagagtctggtgacggcggcagatcgtgcgattgaggattggttacgcgctgcaattcacgctcgctttcccgatcatggtgtgttgggtgaggagcgcgatccggttggcctcgaccgtgagtatatctgggttatcgatccgattgacggcaccagctcgtttgtgtcaggattaccgatgtgggccgtctctatcggtattctgcgccgcggcgagccgcaggctggtgtgatttatctgccggtcttgggcgattgttattgggcagttgccggtggtcaggcgttctggaatgatgtgccgatacaggttgcaccccctcaaccgcctggccccaacgattggattgccattccttcgaccttccaccgggcgtataccatccactaccccggtaaagtacgggtgctgggatcggttgctgccgattgttgttatgtagcccgtggtcaggccaaagccgctattatcggtaaagcaaaggtgtgggatgttgctgccggctgggtgattgtacaggcagccggcggggtggtttgtccgctggaaggaaccctgcccgactggatgacactgctgcaaacgattcgcttgccggcgccggtcgtgatcggacacccacaacaggtaactcaggtgtgtgcggttgtgcggcgcattaagccttga

SEQ ID NO: 84468 - protein, 257 aa, Chloroflexus aurantiacus
MEIDIALVRAWAQQAGDMLLRSYFNQVSPERKLDKSLVTAADRAIEDWLRAAIHARFPDHGVLGEERDPVGLDREYIWVIDPIDGTSSFVSGLPMWAVSIGILRRGEPQAGVIYLPVLGDCYWAVAGGQAFWNDVPIQVAPPQPPGPNDWIAIPSTFHRAYTIHYPGKVRVLGSVAADCCYVARGQAKAAIIGKAKVWDVAAGWVIVQAAGGVVCPLEGTLPDWMTLLQTIRLPAPVVIGHPQQVTQVCAVVRRIKP

SEQ ID NO: 84469 - DNA, 795 bp, Chloroflexus aurantiacus
  CDS (1)..(795)
atgcttgattttgctatcgatctcgcctaccgggccggcacgctgatccgggccggcgccgagcgtgatgtgagttacgaaccgaaacagtacgccgatgtggtgaccgaagtagatcgagccagtgaagcattgattgtcggcgcgatccgtgctcgctatcccgatcacgcgattatcgccgaggaggggagtggggtgagtatgtcatcgccctacacctggctgatcgatccactcgatggaacgctcaattttctccacgggctgccgatcttctgtgtctcgattgccctgctcgcctataacgaaccgttgctgggagttgtctacgatcccatgcgcaacgagctgttctacgccgagcgtggtcggggtgcatttctcaacgggcgacggctgcgggtttcgcaaacacccacgctggcacgtagtttgttgagcagtgggttgccctacgaccggtttgagcagcctgacaacaatctggccgagttgacccatctggcgatgcttgtacaggatattcggcggcccggctcagcagccctcgatctctgtgcagtcgctgccggtcgcactgatggacactgggagctggggctgaagccatgggatgttggagccggcgggttgatcgccctcgaagcgggtgccaccgtcaccgactggcagggtgagccgtggcgaccgctcggcggtgatcgactggtcgcaaccaatggtctgatccatgccgagctactggcagccctggctgaggttcggcgtcaacgttcgctgaaattgtcgtag

SEQ ID NO: 84470 - protein, 264 aa, Chloroflexus aurantiacus
MLDFAIDLAYRAGTLIRAGAERDVSYEPKQYADVVTEVDRASEALIVGAIRARYPDHAIIAEEGSGVSMSSPYTWLIDPLDGTLNFLHGLPIFCVSIALLAYNEPLLGVVYDPMRNELFYAERGRGAFLNGRRLRVSQTPTLARSLLSSGLPYDRFEQPDNNLAELTHLAMLVQDIRRPGSAALDLCAVAAGRTDGHWELGLKPWDVGAGGLIALEAGATVTDWQGEPWRPLGGDRLVATNGLIHAELLAALAEVRRQRSLKLS

SEQ ID NO: 84471 - DNA, 786 bp, Chloroflexus aurantiacus
  CDS (1)..(786)
atgagcatatcacttgcccacacgcttgactttgcccgccagatcgcttacgaggccggccagatcacgctgcgctattttcagcgtggtatcactgttgaacacaaagccgatgagtcgccggtgacgattgctgatcgggaggccgagcgtcatctgcgcgccgctattcaggcggcctaccctgatcacgccgtccttggtgaagaagatggtctgaccgggagtgaacacgctacctaccgctgggtgcttgatccgattgacggtacgaaaagttttgtgcggggcgtgccactctacggagtgctgattggattgttgcgggaaggtgaacctgtgcttggtgtcatccatatcccggcgctggccgaaactgtggcagccgcgcagggtttgggttgttactggaacaatcaaccctgtcgggtgtcgtctgtctccagcctacgcgagagtctggtcgtcgggacggtggctcacggctacgaacgctacaaccgatcagaagcttttcagcgtattctgaagcgtgccggcctgttccgcacctggggcgattgctacggctacgttctggtagccaccggtcgcgccgaagttgcgctcgatccggcaatgaacgtctgggatgccgcagccctgctgccgattttgagcgaagctggtggtgcctacaccgactggcagggtgtgccgaccatttaccacaacgaaggcattggcagcaatcgccatgtcttacccgaactgttaagcctcattgctggcgaggagtcgtcatga

SEQ ID NO: 84472 - protein, 261 aa, Chloroflexus aurantiacus
MSISLAHTLDFARQIAYEAGQITLRYFQRGITVEHKADESPVTIADREAERHLRAAIQAAYPDHAVLGEEDGLTGSEHATYRWVLDPIDGTKSFVRGVPLYGVLIGLLREGEPVLGVIHIPALAETVAAAQGLGCYWNNQPCRVSSVSSLRESLVVGTVAHGYERYNRSEAFQRILKRAGLFRTWGDCYGYVLVATGRAEVALDPAMNVWDAAALLPILSEAGGAYTDWQGVPTIYHNEGIGSNRHVLPELLSLIAGEESS

SEQ ID NO: 84473 - DNA, 744 bp, Campylobacter coli RM2228
  CDS (1)..(744): transl_table=11
atgcttagacaaattaacttaaaagacataacttttatagctataaaagcaggtaaaagtgtcttagaaatttataatcaagactttaaaatttcttataaagatgataactcacctttaagtgaagcagatatcatctcaaatgagatcatttgtaatgagcttgctaaatttagcctccctatactctcagaagaaaataaaaccctaccttatgagcaaagaaaaaattgggaatatttttggtgtatagatccaatcgatggcactaaagagtttatcaacaaaaatggagaatttactataaatatagctttgatttataaagatactccggttttgggtgtagtatatgctccagcattggatctgctatatagtgctaaaaaaggtgaaggtgcttttaaaaatagtgtaaaattacccttgcaaagaaatgacgacttttttaaaatagtcgctagcaaatcccatctcaatgagcaaacaaaagattttatcgatagtatccaaacgaccaagcaaaaagaatttgtttccatgggcagctctttaaagctttgtctagtagctagcaatgaagcagatatttacccaagactagcccctactatggagtgggatgtagctgctgctgatgctatagtcagagaggttgggaaaatgacttatgatttttacactaaaaaacctttagtgtataataaagaaaatttattaaatccatattttatagtagagtaa

SEQ ID NO: 84474 - protein, 247 aa, Campylobacter coli RM2228
MLRQINLKDITFIAIKAGKSVLEIYNQDFKISYKDDNSPLSEADIISNEIICNELAKFSLPILSEENKTLPYEQRKNWEYFWCIDPIDGTKEFINKNGEFTINIALIYKDTPVLGVVYAPALDLLYSAKKGEGAFKNSVKLPLQRNDDFFKIVASKSHLNEQTKDFIDSIQTTKQKEFVSMGSSLKLCLVASNEADIYPRLAPTMEWDVAAADAIVREVGKMTYDFYTKKPLVYNKENLLNPYFIVE

SEQ ID NO: 84475 - DNA, 765 bp, Campylobacter upsaliensis RM3195
  CDS (1)..(765): transl_table=11
atgaatttagactcttatttaaatttggctctagacgctgcagaaaaagcatctagagctatattaaaagaaaaagaaaattttaaaattctacccaaagaagacggcacagcactcacttcagccgaccttgcctccaatgaaattttaagcgaagctcttgcaaaaacggatttaaaaattctttctgaagaaaaaatcttaagttatgaagaaagacgagagctagagtatttttggctcatcgaccctcttgatggcacaaaaggctttataaaagggcaagatgaatactgcattatgataagcttaattcatcaaaaacgccctattttagctcttatcaaaagccctgaaaaaaatgaagttttttatgcacacaaaaaaagtaaggtctataaaaatgcaaaccctcttcaaaatgacgaagctttttttaaaaagaatcaatataccgcacttttaagcattaatcatctttgtaaagaagatgaagaatttgctaaaaaatatcaattaaaagccttaaatataagctctgggcttaaatttaccgctcttttagaaggaaaggctggaatttatagacgcaaagaaaaattaaacatctgggacatagctgctggagattttttacttaatcaaaatggtggctttatgggaaaatttgataaaactttactttcttacaatgaaaaagatttaagggcggattatttcatcgcggtatcaaataaggcttttttgcaagattttggcgattaa

SEQ ID NO: 84476 - protein, 254 aa, Campylobacter upsaliensis RM3195
MNLDSYLNLALDAAEKASRAILKEKENFKILPKEDGTALTSADLASNEILSEALAKTDLKILSEEKILSYEERRELEYFWLIDPLDGTKGFIKGQDEYCIMISLIHQKRPILALIKSPEKNEVFYAHKKSKVYKNANPLQNDEAFFKKNQYTALLSINHLCKEDEEFAKKYQLKALNISSGLKFTALLEGKAGIYRRKEKLNIWDIAAGDFLLNQNGGFMGKFDKTLLSYNEKDLRADYFIAVSNKAFLQDFGD

SEQ ID NO: 84477 - DNA, 819 bp, Agrobacterium tumefaciens
  CDS (1)..(819): transl_table=11
atggctgatcgggacacatcgacctctcacgcaggagaaacagcttcgattgtggaagagatcgcgcgcaaggcaggcgaccttgccctcgctcatttccgctccctatcgagcctgtcggtcgagaccaagggacatctcgatcttgtgacgaaggcggacaaggaggtcgaaacatttcttatcgcgcagttgcgggaggcgtttcccgcagacggcatatttggagaagaagggggcgaaatcaaagcgcgttcaggtcgtatctgggtgatcgatccgattgatggaacattcaatttcgtccgcggcggtcagaactgggcaatttccatcggtctctatgaaaacaagcgtcctacattcggggttatcttcgctccagtccgaaacctgatgtttgttggagggaaaacggtggagacgaagctcaacggcatggcggtcaagccacttccgccgctcgatatgtcgcgtgcatcgaccgggttcagctaccatccttcggcttcgacagcggacaggctcgaagtcatccgttatatctcggatgatctcaatatcagcttccgtttctgctgcgctgcgacactctcgatggtcgaggtggccatgggcgagacagatggctacgtttcattgggagactcgacgtgggacgttatggcagcgttgcctattttgagcaatctgggtgttgcggatacgatcgactgggacaggaccgacttgtcggccaaactccggtttgcttgtggcagccacgacttcctggagaaggtgaagccgttgctcgataaagtggcgctggccgcataa

SEQ ID NO: 84478 - protein, 272 aa, Agrobacterium tumefaciens
MADRDTSTSHAGETASIVEEIARKAGDLALAHFRSLSSLSVETKGHLDLVTKADKEVETFLIAQLREAFPADGIFGEEGGEIKARSGRIWVIDPIDGTFNFVRGGQNWAISIGLYENKRPTFGVIFAPVRNLMFVGGKTVETKLNGMAVKPLPPLDMSRASTGFSYHPSASTADRLEVIRYISDDLNISFRFCCAATLSMVEVAMGETDGYVSLGDSTWDVMAALPILSNLGVADTIDWDRTDLSAKLRFACGSHDFLEKVKPLLDKVALAA

SEQ ID NO: 84479 - DNA, 888 bp, Agrobacterium tumefaciens
  CDS (1)..(888): transl_table=11
gtgaaggtcagttggatcagttgctcggagacgacgtcgcacaggtcgccaggctcaaggaccgtgcaaatggctgatcgggacacatcgacctctcacgcaggagaaacagcttcgattgtggaagagatcgcgcgcaaggcaggcgaccttgccctcgctcatttccgctccctatcgagcctgtcggtcgagaccaagggacatctcgatcttgtgacgaaggcggacaaggaggtcgaaacatttcttatcgcgcagttgcgggaggcgtttcccgcagacggcatatttggagaagaagggggcgaaatcaaagggcgttcaggtcgtatctgggtgatcgatccgattgatggaacattcaatttcgtccgcggcggtcagaactgggcaatttccatcggtctctatgaaaacaagcgtcctacattcggggttatcttcgctccagtccgaaacctgatgtttgttggagggaaaacggtggagacgaagctcaacggcatggcggtcaagccacttccgccgctcgatatgtcgcgtgcatcgaccgggttcagctaccatccttcggcttcgacagcggacaggctcgaagtcatccgttatatctcggatgatctcaatatcagcttccgtttctgcggcgctgcgacactctcgatggtcgaggtggccatgggcgagacagatggctacgtttcattgggagactcgacgtgggacgttatggcagcgttgcctattttgagcaatctgggtgttgcggatacgatcgactgggacaggaccgacttgtcggccaaactccggtttgcttgtggcagccacgacttcctggagaaggtgaagccgttgctcgataaagtggcgctggccgcataa

SEQ ID NO: 84480 - protein, 295 aa, Agrobacterium tumefaciens
MKVSWISCSETTSHRSPGSRTVQMADRDTSTSHAGETASIVEEIARKAGDLALAHFRSLSSLSVETKGHLDLVTKADKEVETFLIAQLREAFPADGIFGEEGGEIKGRSGRIWVIDPIDGTFNFVRGGQNWAISIGLYENKRPTFGVIFAPVRNLMFVGGKTVETKLNGMAVKPLPPLDMSRASTGFSYHPSASTADRLEVIRYISDDLNISFRFCGAATLSMVEVAMGETDGYVSLGDSTWDVMAALPILSNLGVADTIDWDRTDLSAKLRFACGSHDFLEKVKPLLDKVALAA

SEQ ID NO: 84481 - DNA, 804 bp, Rhodococcus sp
  CDS (1)..(804): transl_table=11
atgacacgcactaacgatgaacgcgcggcgatcgacatcgccgctgcggctggagaacttctgctcgaccatcggaaatccctcggcgaaaacgacggtgatgtcgcgactttcaagagacgcggccgatcggctcagtcagaattcatcgtcgccgaacttgcccgacgctttcctgcggatgcagtgctgtcggaggaaggggctgacgacctcgcgaggctggctgcggatcgggtgtggatcgtcgaccctctcgacggcacccgtgagtacggcgaggccggacgatcggactgggccgttcatgttgcactgactgaaaacggtgtcctcacaacaggtgcggtcgcaatgcctgcccttgccgtcacctattcgagcagcgatgatcgaaccgaacgggatgccgcgacgccggttcgagtcgtcgtatcgcggacgcgtcgtccggaaccggtcatgcgcatggccgactcgatgggcgcggagttgatcgaaatgggatccgccggagccaaagcaatggcggtcgtctcgggtgaggcagacatctatgcacatgcgggcggacagtacgagtgggattcggcggcgcccgttgctgtcgcacgtgctgcgggactgcatgtttcgcgtatcgatggcagcgaactgcgctacaaccaggaaaacccgtggttgccggatctgctgatctgccgaccagaactcgccccgaaagcactggaggactgggccgatgaccgcgacactgacgcacctcgaacgactcgaagccgagagcattcacatcatgcgtga

SEQ ID NO: 84482 - protein, 267 aa, Rhodococcus sp
MTRTNDERAAIDIAAAAGELLLDHRKSLGENDGDVATFKRRGRSAQSEFIVAELARRFPADAVLSEEGADDLARLAADRVWIVDPLDGTREYGEAGRSDWAVHVALTENGVLTTGAVAMPALAVTYSSSDDRTERDAATPVRVVVSRTRRPEPVMRMADSMGAELIEMGSAGAKAMAVVSGEADIYAHAGGQYEWDSAAPVAVARAAGLHVSRIDGSELRYNQENPWLPDLLICRPELAPKALEDWADDRDTDAPRTTRSREHSHHA

SEQ ID NO: 84483 - DNA, 816 bp, Arabidopsis thaliana
  CDS (1)..(816)
atggcggacaatcattctctagatcagtttttggctgccgccattgatgccgctaaaaaagctggacagatcattcgtaaagggttttacgagactaaacatgttgaacacaaaagccaggtggatttggtgacagagactgataaaggatgtgaagaacttgtgtttaatcatctcaagcagctctttcccaatcacaagttcataggagaagaaactacagctgcatttggtgtgacagaactaactgacgaaccaacttggattgttgatcctcttgatggaacaaccaatttcgttcacgggttccctttcgtgtgtgtttccattggacttacgattgggaaagtccctgttgttggagttgtttataatcctattatggaagagctattcaccggtgtccaagggaaaggagcattcttgaatggaaagcgaatcaaagtgtcagctcaaagcgaacttttaaccgctttgctcgtgacagaggcgggtactaaacgagataaagctacattagacgatacaaccaacagaatcaacagtttgctaaccaaggtcaggtcccttaggatgagtggttcgtgtgcactggacctctgtggcgttgcgtgtggaagggttgatatcttctacgagctcggtttcggtggtccatgggacattgcagcaggaattgttatcgtgaaagaagctggtggactcatctttgatccatccggtaaagatttggacataacatcgcagaggatcgcggcttcaaacgcttctctcaaggagttattcgctgaggcgttgcggcttacaggggcatga

SEQ ID NO: 84484 - protein, 271 aa, Arabidopsis thaliana
MADNHSLDQFLAAAIDAAKKAGQIIRKGFYETKHVEHKSQVDLVTETDKGCEELVFNHLKQLFPNHKFIGEETTAAFGVTELTDEPTWIVDPLDGTTNFVHGFPFVCVSIGLTIGKVPVVGVVYNPIMEELFTGVQGKGAFLNGKRIKVSAQSELLTALLVTEAGTKRDKATLDDTTNRINSLLTKVRSLRMSGSCALDLCGVACGRVDIFYELGFGGPWDIAAGIVIVKEAGGLIFDPSGKDLDITSQRIAASNASLKELFAEALRLTGA

SEQ ID NO: 84485 - DNA, 834 bp, Coxiella burnetii
  CDS (1)..(834): transl_table=11
atgattaagatggaagccttcatttatagtgaaaagatgttgacatctgtgatcgaaataatcaagtttgctgcaaaaaagattcttagtatctatagtgaacccacttctttagtagtgacaaagaaaggcgatggttccccgttaacaaaagctgatcaattggcacatgattttatttcagcgcaactcactaatttaaccccgaagattcccatcatttccgaagagttagattttgagatttattctaacacccttctaaattcttatttttggttggttgatcctttagacgggaccaaagactttattaaacgcaatggcgaatttactgttaatatagccttaatcaaagatgcgaaagtagtactcggggtagtgtttgttcctgtaaccaacacttgttattatgcaaataaagtagttggcgccttcaagcaagttggagaacaaccaccccaacaattacaattgaccccgcagaacaaagcaagggatttgaatcaacctatcaaagtcgcaataagtcgccaccatggacttgatggcatacaaaaatttattgataaaattggtccttgcgagtgtgtcagcatgggcagtagcttgaagatatgctcgttagcagaaggggaagtagacatctacccgagattaggtcctacgaaagagtgggatacggctgcagcgcaatgcgttttagaacaagcgggcggaaaaattctgattgaaaccggaaaatcattattttacaataaattggattttttaaatccaaaattcttggctcttggtagtaggggaaatccagcttgggttacctatttataa

SEQ ID NO: 84486 - protein, 277 aa, Coxiella burnetii
MIKMEAFIYSEKMLTSVIEIIKFAAKKILSIYSEPTSLVVTKKGDGSPLTKADQLAHDFISAQLTNLTPKIPIISEELDFEIYSNTLLNSYFWLVDPLDGTKDFIKRNGEFTVNIALIKDAKVVLGVVFVPVTNTCYYANKVVGAFKQVGEQPPQQLQLTPQNKARDLNQPIKVAISRHHGLDGIQKFIDKIGPCECVSMGSSLKICSLAEGEVDIYPRLGPTKEWDTAAAQCVLEQAGGKILIETGKSLFYNKLDFLNPKFLALGSRGNPAWVTYL

SEQ ID NO: 84487 - DNA, 795 bp, Streptomyces spectabilis
  CDS (1)..(795): transl_table=11
atgtctttggcacatgccgagggcggtgccgcgttactccgactcgccgtcagggccgcacaccgggccggtgagctgctgctcgaaggggccgcggcggggccgcccgaggtacggaccaagtcgtcggccaaggacctggtgactgccttcgaccgcgggagcgaggcgtgcgtcgtcgagatcctcaccgcggcccggcccgacgacggcatcctgggggaggagggcggcgagcgcccgggcggctccggcgtgcgctgggtgatcgaccccctggacggcacggcgaacttcgtcagcgggtatccggcgttcgtcgtgtccatcgccgccgagcgcgcggggcgcaccgaggtgggggtcgtgtacgacccctcccgccgggagacgttcaccgcgatccgcggccggggagccgcccgtgacggcctgccgctgaccgtgtccggcgccgagcggctcgaacaggccctggtctccacgggattcagcagcgacccggcgacccgcgaccgccaggcggccctcgccgcccgcgtggtggcccgcgtgcgggacatccgcagcagcggctccgccgccctcgacctgtgctgggtcgcggccggccgcctcgacgcctactacgaatccggtacgcgcctgtgggaccgcgcggccggagcgctgatcgccgaggaggccggggcctgggtcggcggcgcggacgggcggccgccctgcgacgcgatgacgatcgcgtgcgccccgaagacggcggacgcgctgcgcgccctggtgggccatgcctga

SEQ ID NO: 84488 - protein, 264 aa, Streptomyces spectabilis
MSLAHAEGGAALLRLAVRAAHRAGELLLEGAAAGPPEVRTKSSAKDLVTAFDRGSEACVVEILTAARPDDGILGEEGGERPGGSGVRWVIDPLDGTANFVSGYPAFVVSIAAERAGRTEVGVVYDPSRRETFTAIRGRGAARDGLPLTVSGAERLEQALVSTGFSSDPATRDRQAALAARVVARVRDIRSSGSAALDLCWVAAGRLDAYYESGTRLWDRAAGALIAEEAGAWVGGADGRPPCDAMTIACAPKTADALRALVGHA

SEQ ID NO: 84489 - DNA, 861 bp, Arabidopsis thaliana
  CDS (1)..(861)
atggcttcaaactcaaaacggcctaacataagcaacgagtctccttcggaacttagcgacactgagctggatcgattcgccgctgtgggaaatgcattagctgacgcttccggcgaggttatcagaaagtatttccggaagaaattcgacattgttgataaagatgatatgagccctgttacaatcgctgatcaaatggctgaagaggcaatggtttccattatattccagaatctcccttctcatgctatatatggtgaggagaagggttggagatgcaaagaggaatctgcagactatgtttgggttttggacccaatcgacggaacaaagagctttattacagggaaacccgtgtttggtacgctgattgctctgctctacaaaggtaaaccgattctaggactgattgatcagcctattctaaaagagagatggataggaatgaatggaagaagaactaaactaaacggggaggatatctcaacgcgatcttgccccaaattatcacaagcatatttatacaccactagcccacatcttttcagtgaagaggcagaaaaggcatattctcgagttagagacaaggtgaaagtgcccttatacggctgtgattgttatgcttacgctctcctggcttctggatttgtcgatcttgttattgaatccggtctaaagccatatgatttccttgctctggtgcctgtaatagaaggcgctggaggtaccataaccgattggactggtaaacgatttctgtgggaagcttcatccagtgcagttgcgacaagctttaatgtagttgcagcaggagattcagacattcatcagcaggctttggagtcacttgagtggcattga

SEQ ID NO: 84490 - protein, 286 aa, Arabidopsis thaliana
MASNSKRPNISNESPSELSDTELDRFAAVGNALADASGEVIRKYFRKKFDIVDKDDMSPVTIADQMAEEAMVSIIFQNLPSHAIYGEEKGWRCKEESADYVWVLDPIDGTKSFITGKPVFGTLIALLYKGKPILGLIDQPILKERWIGMNGRRTKLNGEDISTRSCPKLSQAYLYTTSPHLFSEEAEKAYSRVRDKVKVPLYGCDCYAYALLASGFVDLVIESGLKPYDFLALVPVIEGAGGTITDWTGKRFLWEASSSAVATSFNVVAAGDSDIHQQALESLEWH

SEQ ID NO: 84491 - DNA, 810 bp, Actinobacillus actinomycetemcomitans
  CDS (1)..(810): transl_table=11
atgccaatcctcacgacccatttattgcaggatgtaatagagatcgcccaacaggcgggtgagcatttacgttgcttttatcaacgttcggtgacagttcgaatgaaagaagacaacacaccggtgaccgaagcggatttattcgtcagccaatttttaacggaaaaactgaccgcacttacgccgcagattccgattctttctgaagaaaattgccatattccgctgaccgagcggcaaacctggcgttcttactggttaatcgatcccctggacggcacgcaacaatttatcaatcgcaccggtcaattctccgtgctcgtcagtttggtgaaagatcatcaaccggtgttgggcgtgattcatgcgccgatgttgggttccacctattacgccatgcagggtttcggtgcgtataaacaccatgacgggcagcaccttaaattagccttccatgatattcaagcggacaatgccttgcgtattgctgtgggttccgccgccgcagccgaaaaagtgcggtcgattttaaataagaatttggcttacgaatttcatatttgcggatccagcgggttaaaaagcacactggtggcagacggcgtatgcgattgctacattcgcttgggttgcaccggtgaatgggatactgccgcttccgagattttactggcggaaatgggtggcattatttttgacttgaattatcaaccgctgacttataataaacgggaatctttcgtcaatccgaattttgtcatgggaatcacgcaggattttccgtgggataaaatttttcactccaattaa

SEQ ID NO: 84492 - protein, 269 aa, Actinobacillus actinomycetemcomitans
MPILTTHLLQDVIEIAQQAGEHLRCFYQRSVTVRMKEDNTPVTEADLFVSQFLTEKLTALTPQIPILSEENCHIPLTERQTWRSYWLIDPLDGTQQFINRTGQFSVLVSLVKDHQPVLGVIHAPMLGSTYYAMQGFGAYKHHDGQHLKLAFHDIQADNALRIAVGSAAAAEKVRSILNKNLAYEFHICGSSGLKSTLVADGVCDCYIRLGCTGEWDTAASEILLAEMGGIIFDLNYQPLTYNKRESFVNPNFVMGITQDFPWDKIFHSN

SEQ ID NO: 84493 - DNA, 798 bp, Buchnera aphidicola
  CDS (1)..(798)
atgcaaaaaattaatttttttgatactattaataatatatggcgtaaaatgttagataaaatttgtcaattagcacgttctgcaggtcattgtattatgaaactttataattctcaaaaatttataaatgtttcatataaaccagataacactcccatcaccgatgttgattatgcagccaataatatcatcaaaaaaggactttcattaatttctcctcaaattccaattatttctgaagaagaatcatataattttgaaatatgtcgtaattggaatagttattggttagttgatccgttagatggaactaaagaatttttaaaaaaaaatggtgaatttacagttaatattagtttgatcgaatacggtgtccctatactcggtgtaatatacgctcccttttttgatgttctatattctgctttttatgacaacgcgtggaaagaagaaaaatttggatcaaagaaaaagattaatgttgctcaagcagaagcaccattattagtgattagccgttcacatcctaatgaaaccttgaaaaattatttagaaaaaataaaatgttgtaaaataaaaaaaatgggttcatcactaaaattttgcttaatagcagaaggaactgctcaaatttatcccagatttggtgatactcatatatgggatactgccgctggtcatgctattgttatagcggctggtggaaaagtacaaacatggacaggcggcaatttaaattattcattgtcttcacgtgtttcttttattaattctggtttttatgcgtccgcattataa

SEQ ID NO: 84494 - protein, 265 aa, Buchnera aphidicola
MQKINFFDTINNIWRKMLDKICQLARSAGHCIMKLYNSQKFINVSYKPDNTPITDVDYAANNIIKKGLSLISPQIPIISEEESYNFEICRNWNSYWLVDPLDGTKEFLKKNGEFTVNISLIEYGVPILGVIYAPFFDVLYSAFYDNAWKEEKFGSKKKINVAQAEAPLLVISRSHPNETLKNYLEKIKCCKIKKMGSSLKFCLIAEGTAQIYPRFGDTHIWDTAAGHAIVIAAGGKVQTWTGGNLNYSLSSRVSFINSGFYASAL

SEQ ID NO: 84495 - DNA, 741 bp, Salmonella typhi
  CDS (1)..(741): transl_table=11
atgttagaacaagtatgccagcttgcacggaacgcgggcgatgccattatgcaggtttatgatggagccaaaccgatggagtacgcccgcaagcaggacgattctccagtcactgcggcggatatcgccgcacataccgtgattctcgaagggttacgcacgctcacgccggatattccggtgctttcagaagaagatccgcccgcctgggaagtgcgccagcactggcagcgttactggctggtcgatccgctcgacggcaccaaagaattcatcaagcgcaatagagaattcacggtcaatatcgcgctgattgagcagggcaagccggtgttgggcgttgtctatgcgccggtgctgaaagtgatgtactacgcggcggaaggtaaggcctggaaagaggagtgcggggtgcgtaagcagattcaggtgcgggatgcccgcccgccgctggtggtgattagccgttcgcatacggatgatgaactcaccgaatatctccaacagcttggcgaacatcagactacctctattggttcctcgctgaaattctgtcttgtggcggaaggacaggcgcagctttaccccagatttgggccgaccagcgtctgggatactgccgcaggtcatgccattgccgttgcagccggggcgcacgttcacgactggcagggaaaaacgctggactatacccctcgtgaatcgttccttaaccccggcttccgggtgactatttactga

SEQ ID NO: 84496 - protein, 246 aa, Salmonella typhi
MLEQVCQLARNAGDAIMQVYDGAKPMEYARKQDDSPVTAADIAAHTVILEGLRTLTPDIPVLSEEDPPAWEVRQHWQRYWLVDPLDGTKEFIKRNREFTVNIALIEQGKPVLGVVYAPVLKVMYYAAEGKAWKEECGVRKQIQVRDARPPLVVISRSHTDDELTEYLQQLGEHQTTSIGSSLKFCLVAEGQAQLYPRFGPTSVWDTAAGHAIAVAAGAHVHDWQGKTLDYTPRESFLNPGFRVTIY

SEQ ID NO: 84497 - DNA, 804 bp, Escherichia coli
  CDS (1)..(804): transl_table=11
atgcatccgatgctgaacatcgccgtgcgcgcagcgcgcaaggcgggtaatttaattgccaaaaactatgaaaccccggacgctgtagaagcgagccagaaaggcagtaacgatttcgtgaccaacgtagataaagctgccgaagcggtgattatcgacacgattcgtaaatcttacccacagcacaccatcatcaccgaagaaagcggtgaacttgaaggtaccgatcaggatgttcaatgggttatcgatccactggatggcactaccaactttatcaaacgtctgccgcacttcgcggtatctatcgccgttcgtatcaaaggccgcaccgaagttgctgtggtatacgatcctatgcgtaacgaactgttcaccgccactcgcggtcagggcgcacagctgaacggctaccgtctgcgcggcagcaccgctcgcgatctcgacggtactattctggcgaccggcttcccgttcaaagcaaaacagtacgccactacctacatcaacatcgtcggcaaactgttcaacgaatgtgcagacttccgtcgtaccggttctgcggcgctggatctggcttacgtcgctgcgggtcgcgttgacggtttctttgaaatcggtctgcgcccgtgggatttcgcggcaggcgagctgctggttcgtgaagcgggcggcatcgtcagcgacttcaccggtggtcataactatatgctgaccggtaacatcgttgctggtaacccgcgcgttgttaaagccatgctggcgaacatgcgtgacgagttaagcgacgctctgaagcgttaa

SEQ ID NO: 84498 - protein, 267 aa, Escherichia coli
MHPMLNIAVRAARKAGNLIAKNYETPDAVEASQKGSNDFVTNVDKAAEAVIIDTIRKSYPQHTIITEESGELEGTDQDVQWVIDPLDGTTNFIKRLPHFAVSIAVRIKGRTEVAVVYDPMRNELFTATRGQGAQLNGYRLRGSTARDLDGTILATGFPFKAKQYATTYINIVGKLFNECADFRRTGSAALDLAYVAAGRVDGFFEIGLRPWDFAAGELLVREAGGIVSDFTGGHNYMLTGNIVAGNPRVVKAMLANMRDELSDALKR

SEQ ID NO: 84499 - DNA, 804 bp, Haemophilus influenzae
  CDS (1)..(804): transl_table=11
atgaatccaatgttaaatatcgcaattcgtgcggcacgaaaagcgggcaatgtgattgctaaaaattatgaacgccgtgatgctatcgaaagcacacaaaaaggtattaatgattatgtaacaaacgttgataaagcgtctgaagcagaaatcattgaagttattcgtaaatcttatcctgatcacacaattattacggaagaaacaggcgcaattgaaggcaaagatagcgatgtacaatggattattgatccgctagatggtactcgtaattttatgacagggcttccccacttttctgtgtctatcgcagttcgtgtaaaaaatcgcactgaagtcggggttgtttacgatccaatccgtaatgaattatttaccgctgtgcgtggcgaaggtgcaaaattaaatgaagtacgtttacgtgtagatagtaaacgtgaaattcaaggttcaattttagccactggtttcccattcaaacaaccaaaattaatgccagctcaatttgcaatgatgaatgccttaattgaagatgctgcggatttccgtcgtactggttctgccgcattggatttatgctatgtggcgtcaaaccgtattgatggttattttgaaatgggcttaaaagcatgggattgtgctgctggcgatttaatcgtgcgtgaagcgggtggtttagtttgcgattttgatgctggtaacagctacttacgcagtggcaatatcattgctgcaccatcacgcgtaattaaagaaatgttaaataaaattcgcccttgtttaggtgctgaatttaatcattaa

SEQ ID NO: 84500 - protein, 267 aa, Haemophilus influenzae
MNPMLNIAIRAARKAGNVIAKNYERRDAIESTQKGINDYVTNVDKASEAEIIEVIRKSYPDHTIITEETGAIEGKDSDVQWIIDPLDGTRNFMTGLPHFSVSIAVRVKNRTEVGVVYDPIRNELFTAVRGEGAKLNEVRLRVDSKREIQGSILATGFPFKQPKLMPAQFAMMNALIEDAADFRRTGSAALDLCYVASNRIDGYFEMGLKAWDCAAGDLIVREAGGLVCDFDAGNSYLRSGNIIAAPSRVIKEMLNKIRPCLGAEFNH

SEQ ID NO: 84501 - DNA, 804 bp, Pasteurella multocida
  CDS (1)..(804): transl_table=11
atgaatccaatgttaaatatcgcgattcgtgcggcacgaaaagcgggcaatgtaattgctaaaggttatgagcgccgtgatgatcttcaaacaacgctaaaaagcacaaacgattatgtgacaaatattgataaagcttctgaagaagccattattgaagtgattagaaaatcgtacccggatcacacaattattacggaagaaagtggtgcgttagaaggtaaagatagcgatattcaatgggtgattgatccactagatggcaccacaaactttgttaaaggtttaccgcatttttctgtttctattgctattcgtgtcaaaggtcgcaccgaagtgggtgtggtttacgatcctatccgtaacgaattattcaccgcagtacgtggtgaaggcgctaaaattaatgacatgcgtttacgcgttgaaaataaacgcgacttagctggtaccgtgttaacaacaggttttccttttaaacaaacgcgcttaatgccaatgcaatttgcgatgatgaataacttaattcaagattgtgctgatttccgtcgcatgggctctgcggcattagacttatgctatgttgctgcgggacgcgttgatggttattttgaagtcggtgttaaagcttgggatattgctgcaggcgacttgatcgtacgtgaagctggcgggttagtttgtgattttaatggtgggcatagctatttaacatcaggtcatcttgttgctgcagcacctcgtattgtgaaagaaatcttaaataaaattcaaccttgtctgtctgacgaatttaaaaaataa

SEQ ID NO: 84502 - protein, 267 aa, Pasteurella multocida
MNPMLNIAIRAARKAGNVIAKGYERRDDLQTTLKSTNDYVTNIDKASEEAIIEVIRKSYPDHTIITEESGALEGKDSDIQWVIDPLDGTTNFVKGLPHFSVSIAIRVKGRTEVGVVYDPIRNELFTAVRGEGAKINDMRLRVENKRDLAGTVLTTGFPFKQTRLMPMQFAMMNNLIQDCADFRRMGSAALDLCYVAAGRVDGYFEVGVKAWDIAAGDLIVREAGGLVCDFNGGHSYLTSGHLVAAAPRIVKEILNKIQPCLSDEFKK

SEQ ID NO: 84503 - DNA, 771 bp, Thermotoga maritima
  CDS (1)..(771): transl_table=11
ttggacagactggacttttctataaagcttttgagaaaggtgggacacctcctcatgatacactggggaagggtggacaacgtcgagaaaaaaaccggtttcaaggacatagtcacagagatagacagagaagcccagagaatgatagtcgatgagataagaaaattcttccctgacgaaaacatcatggccgaagaaggaatattcgaaaaaggagacaggctctggataatagacccgatagatggaacgataaacttcgttcacggccttccgaacttttccatctctttggcctacgttgaaaacggagaagtcaagctaggggtcgtccacgcccctgctctcaacgaaacactctacgctgaggaaggaagcggtgccttcttcaacggtgagagaatcagagtgtctgagaacgccagcctcgaagagtgtgttggttccactggtagctacgtggatttcaccgggaaattcatcgagaggatggaaaagaggaccagaaggattcggattcttggaagtgccgcgctgaacgccgcttacgttggtgcaggaagggttgactttttcgtcacctggaggataaatccctgggatatagcagccggtctgataatcgtgaaggaagcgggaggaatggtcacggatttctccggaaaggaagcaaacgctttctcgaagaatttcatcttctcgaacgggttgatccacgatgaagtggtgaaagttgttaacgaggtggtagaagaaataggaggaaagtga

SEQ ID NO: 84504 - protein, 256 aa, Thermotoga maritima
MDRLDFSIKLLRKVGHLLMIHWGRVDNVEKKTGFKDIVTEIDREAQRMIVDEIRKFFPDENIMAEEGIFEKGDRLWIIDPIDGTINFVHGLPNFSISLAYVENGEVKLGVVHAPALNETLYAEEGSGAFFNGERIRVSENASLEECVGSTGSYVDFTGKFIERMEKRTRRIRILGSAALNAAYVGAGRVDFFVTWRINPWDIAAGLIIVKEAGGMVTDFSGKEANAFSKNFIFSNGLIHDEVVKVVNEVVEEIGGK

SEQ ID NO: 84505 - DNA, 828 bp, Xylella fastidiosa
  CDS (1)..(828): transl_table=11
atgcagaaacccgcggttaacatcatggtcaaagccgctcgttccgccggcaacgtcctattgcgacacatcaataaattagaaacgctgcatgtcatccaaaaaagccgtatggactatgccagcgacgtggatgagatggctgaaaaggtcattgtcaaggaactcaagcgggcctatccggagtacggcattctcggcgaggaagggggactgcagggcaatcatcggatcatgtgggtgattgatccactggacggtaccagtaactacttgcgtggtttccctcattactgcatctccatcgctttggtcgaaaacggtgaaccaacagatgctgtcatttttgacccgctgcgcaacgagctgttcactgccagccgtggcgctggtgcaatcctcaatgaacgcaagatccgcgtggcgaaccgtaaagatttgaacggtacgatgctgaacaccggtttctcaccacgggaacgcagccgtgctcatgcgcagttgaaatgtgtggatgcgttgctgatgcaggccgaagatatccgccgtagcggttcggccgctctggacttggcctacgttgcttgtggccgtgcagatgcttacttcgaggctggaataaaggtgtgggatgtcgctgcgggaatgttgttagtccgcgaagccgggggttacgtatgcgacttcaagggtgctgatgcgccccgcatggatgataaaggaccggagagctgccagttggtcgcaggcaatatcaaagtggcccacgcgctgcaacaagtcattgtcagcagtggttacgggcgggagttcgatccgaagcgctga

SEQ ID NO: 84506 - protein, 275 aa, Xylella fastidiosa
MQKPAVNIMVKAARSAGNVLLRHINKLETLHVIQKSRMDYASDVDEMAEKVIVKELKRAYPEYGILGEEGGLQGNHRIMWVIDPLDGTSNYLRGFPHYCISIALVENGEPTDAVIFDPLRNELFTASRGAGAILNERKIRVANRKDLNGTMLNTGFSPRERSRAHAQLKCVDALLMQAEDIRRSGSAALDLAYVACGRADAYFEAGIKVWDVAAGMLLVREAGGYVCDFKGADAPRMDDKGPESCQLVAGNIKVAHALQQVIVSSGYGREFDPKR

SEQ ID NO: 84507 - DNA, 828 bp, Xylella fastidiosa
  CDS (1)..(828): transl_table=11
atgcagaaacccgcggttaacatcatggtcaaagccgctcgttccgccggcaacgtcctattgcgacacatcaataaattagaaacgctgcatgtcatccaaaaaagccgtatggactatgccagcgacgtggatgagatggctgaaaaggtcattgtcaaggaactcaagcgggcctatccggactacggcatcctcggcgaggaagggggactgcagggcaatcatcgaatcatgtgggtgattgatccactggacggcaccagtaactatttgcgtggtttcccgcattactgcgtttcaatcgcgttggtcgaaaatggtgaacctacagatgccgtgattttcgatccgctgcgcaacgagctgttcactgccagccgtggtgctggtgcagtcctcaatgaacgcaagatccgcgtggcgaaccgtaaagatttgaacggtacgatgctaaacacgggtttctcaccacgggaacgcagccgtgctcatgcgcagttgaaatgcgtggatgcgttgctgatgcaggccgaagatatccgccgtagcggttcggccgctctggacttggcctacgttgcttgtggccgtgcagatgcttacttcgaggctggaataaaggtgtgggatgtggctgcgggaatgttgttagtccgcgaagccgggggttacgtgtgcgacttcaagggtgctgatgcgccccgcatggatgataaagggccggagagctgccagttgatcgcaggcaatatcaaagtggcccacgcgctgcaacaagtcattgtcagcagtggttacgggcgggagttcgatccgaagcgctga

SEQ ID NO: 84508 - protein, 275 aa, Xylella fastidiosa
MQKPAVNIMVKAARSAGNVLLRHINKLETLHVIQKSRMDYASDVDEMAEKVIVKELKRAYPDYGILGEEGGLQGNHRIMWVIDPLDGTSNYLRGFPHYCVSIALVENGEPTDAVIFDPLRNELFTASRGAGAVLNERKIRVANRKDLNGTMLNTGFSPRERSRAHAQLKCVDALLMQAEDIRRSGSAALDLAYVACGRADAYFEAGIKVWDVAAGMLLVREAGGYVCDFKGADAPRMDDKGPESCQLIAGNIKVAHALQQVIVSSGYGREFDPKR

SEQ ID NO: 84509 - DNA, 25 bp, Primer
atgttagatcaagtatgccagcttg

SEQ ID NO: 84510 - DNA, 25 bp, Primer
ttagtaaatagacactctgaacccc

SEQ ID NO: 84511 - protein, 293 aa, consensus
  MISC_FEATURE (1)..(293): consensus for the disclosure of xaa see table XV
AXXXXXXXXXXXXXXXXXXXXXXXXKXXXXXXTXXDXXXXXXXXXXXXXXXPXXXXXXXXEEXXXXXXXXXXXXXXXXXXXXXXXXXXXXXXXXXXXXXXXXXXXXXXXXWXXDPXDGTXXFXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXGXXDXXXXXXXXXXXXXXXXXWDXXAXXXXXXXAG

SEQ ID NO: 84512 - protein, 92 aa, consensus
  MISC_FEATURE (1)..(92): consensus for the disclosure of xaa see table XV
XXEEXXXXXXXXXXXXXXXXXXXXXXXXXXXXXXXXXXXXXXXXXXXXXXXXXXXDPXDXTXXXXXXXXXXXXXXXXXXXXXXXXXXXXXXP

SEQ ID NO: 84513 - protein, 14 aa, consensus
  MISC_FEATURE (1)..(14): consensus for the disclosure of xaa see table XV
XXXXXXXXXXXXXG

SEQ ID NO: 84514 - DNA, 1062 bp, Escherichia coli
  CDS (1)..(1062)
atgctctacacttcccaaacaacaccagagaaggaccaaaaaatgtcgatgataaaaagctatgccgcaaaagaagcgggcggcgaactggaagtttatgagtacgatcccggtgagctgaggccacaagatgttgaagtgcaggtggattactgcgggatctgccattccgatctgtcgatgatcgataacgaatggggattttcacaatatccgctggttgccgggcatgaggtgattgggcgcgtggtggcactcgggagcgccgcgcaggataaaggtttgcaggtcggtcagcgtgtcgggattggctggacggcgcgtagctgtggtcactgcgacgcctgtattagcggtaatcagatcaactgcgagcaaggtgcggtgccgacgattatgaatcgcggtggctttgccgagaagttgcgtgcggactggcaatgggtgattccactgccagaaaatattgatatcgagtccgccgggccgctgttgtgcggcggtatcacggtctttaaaccactgttgatgcaccatatcactgctaccagccgcgttggggtaattggtattggcgggctggggcatatcgctataaaacttctgcacgcaatgggatgcgaggtgacagcctttagttctaatccggcgaaagagcaggaagtgctggcgatgggtgccgataaagtggtgaatagccgcgatccgcaggcactgaaagcactggcggggcagtttgatctcattatcaacaccgtcaacgtcagcctcgactggcagccctattttgaggcgctgacctatggcggtaatttccatacggtcggtgcggttctcacgccgctgtctgttccggcctttacgttaattgcgggcgatcgcagcgtctctggttctgctaccggcacgccttatgagctgcgtaagctgatgcgttttgccgcccgcagcaaggttgcgccgaccaccgaactgttcccgatgtcgaaaattaacgacgccatccagcatgtgcgcgacggtaaggcgcgttaccgcgtggtgttgaaagccgatttttga

SEQ ID NO: 84515 - protein, 353 aa, Escherichia coli
MLYTSQTTPEKDQKMSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 84516 - DNA, 1047 bp, Saccharomyces cerevisiae
  CDS (1)..(1047)
atgtctattccagaaactcaaaaagccattatcttctacgaatccaacggcaagttggagcataaggatatcccagttccaaagccaaagcccaacgaattgttaatcaacgtcaagtactctggtgtctgccacaccgatttgcacgcttggcatggtgactggccattgccaactaagttaccattagttggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaagaatacgctaccgctgacgctgttcaagccgctcacattcctcaaggtactgacttggctgaagtcgcgccaatcttgtgtgctggtatcaccgtatacaaggctttgaagtctgccaacttgagagcaggccactgggcggccatttctggtgctgctggtggtctaggttctttggctgttcaatatgctaaggcgatgggttacagagtcttaggtattgatggtggtccaggaaaggaagaattgtttacctcgctcggtggtgaagtattcatcgacttcaccaaagagaaggacattgttagcgcagtcgttaaggctaccaacggcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataa

SEQ ID NO: 84517 - protein, 348 aa, Saccharomyces cerevisiae
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 84518 - DNA, 1068 bp, Arabidopsis thaliana
  CDS (1)..(1068)
atgagttcttcagagagtgtggaaaacgagtgcatgtgttgggctgcaagagatccatctggtcttctttctcctcatactatcactcgcaggtctgttacaactgacgatgtttcactcacaatcactcattgtggagtgtgttacgctgatgttatctggagtagaaaccaacatggagactccaagtaccctttggttcctgggcatgagattgctggaatagtgactaaggttgggcctaatgttcaacgattcaaagttggagaccatgttggtgttggaacgtatgttaactcctgcagggagtgtgaatattgtaatgaaggacaagaagttaattgtgcgaaaggagtttttactttcaatggcattgatcatgatggctctgttactaaaggaggctactctagtcacattgttgttcatgaaaggtactgctacaagatacctgtggactatcccttggaatcagctgcaccattactctgtgctggaatcacggtttatgctcctatgatgcgtcacaatatgaatcaacctggtaaatctcttggggtgatcgggctaggtggtcttggacacatggcggttaagtttggcaaggcttttggacttagtgttacggtttttagcaccagcatttccaagaaagaagaagctttgaatctgctaggagctgagaatttcgttatctcatctgaccatgaccagatgaaggcactagagaaatctctagactttctagttgacacagcatctggtgatcacgcgtttgatccttacatgtctctcttgaagattgctggaacttatgtattggttggtttcccaagtgaaattaaaatcagtcctgccaatctcaatcttggtatgagaatgctcgctggaagtgtaaccggggggaccaaaataacacagcaaatgttagatttctgtgcagctcataagatttatccaaacatagaggtgattcccattcaaaagataaacgaagctctcgaaagagtggtgaagaaggacatcaagtaccgtttcgtgattgacatcaagaactccctcaaatag

SEQ ID NO: 84519 - protein, 355 aa, Arabidopsis thaliana
MSSSESVENECMCWAARDPSGLLSPHTITRRSVTTDDVSLTITHCGVCYADVIWSRNQHGDSKYPLVPGHEIAGIVTKVGPNVQRFKVGDHVGVGTYVNSCRECEYCNEGQEVNCAKGVFTFNGIDHDGSVTKGGYSSHIVVHERYCYKIPVDYPLESAAPLLCAGITVYAPMMRHNMNQPGKSLGVIGLGGLGHMAVKFGKAFGLSVTVFSTSISKKEEALNLLGAENFVISSDHDQMKALEKSLDFLVDTASGDHAFDPYMSLLKIAGTYVLVGFPSEIKISPANLNLGMRMLAGSVTGGTKITQQMLDFCAAHKIYPNIEVIPIQKINEALERVVKKDIKYRFVIDIKNSLK

SEQ ID NO: 84520 - DNA, 1131 bp, Arabidopsis thaliana
  CDS (1)..(1131)
atggtagatcaaaataaagcatttggttgggcggccaacgacgaatcgggcgtcctctctccatttcatttctctagaagagaaaatggtgagaacgatgtaacagtgaagatcttgttctgtggtgtttgtcactctgatcttcataccatcaagaaccattggggattctctcgttaccccattattcccgggcatgaaatcgttggaatagcaacaaaagttgggaagaatgtgacaaagtttaaagaaggagaccgagtaggagtaggcgtaataatcggttcatgccaatcatgtgaatcatgtaaccaagacttagaaaactattgtcctaaagtcgttttcacatacaactctcgttcctctgacggaaccagcagaaaccaaggtggttattccgacgtaattgttgtcgatcaccgctttgtcctaagcattcccgatggtttaccaagcgattcaggcgcgccgctgctctgtgctggaatcactgtgtacagtcccatgaagtattatggcatgactaaagaatcagggaaacgtttaggtgtgaatggacttggtggacttggtcatatcgctgttaagattggtaaagcctttggtttaagagttactgtgattagtaggtcatcagaaaaagagagagaagcaattgatcggcttggtgctgattcgtttcttgttacaacggattctcaaaagatgaaggaagcggttggaactatggatttcattatcgatacggtatcagcagaacatgctctattaccgttgtttagtttgcttaaagtgaatggaaagcttgtggctttaggcttaccggagaagccactcgacctgccaattttctctctagttctcggaaggaaaatggtgggaggaagtcagattggagggatgaaggagacacaagagatgcttgagttctgtgccaagcataaaatcgtttcggatattgagctcataaagatgagtgatatcaactctgcgatggaccgtttggctaaatctgatgtcaggtaccggttcgtgatcgatgtggccaactctttactccctgagtcgtcagctgagattttaacggagcaggtggaccatggagtctcgatcacgtctagattctga

SEQ ID NO: 84521 - protein, 376 aa, Arabidopsis thaliana
MVDQNKAFGWAANDESGVLSPFHFSRRENGENDVTVKILFCGVCHSDLHTIKNHWGFSRYPIIPGHEIVGIATKVGKNVTKFKEGDRVGVGVIIGSCQSCESCNQDLENYCPKVVFTYNSRSSDGTSRNQGGYSDVIVVDHRFVLSIPDGLPSDSGAPLLCAGITVYSPMKYYGMTKESGKRLGVNGLGGLGHIAVKIGKAFGLRVTVISRSSEKEREAIDRLGADSFLVTTDSQKMKEAVGTMDFIIDTVSAEHALLPLFSLLKVNGKLVALGLPEKPLDLPIFSLVLGRKMVGGSQIGGMKETQEMLEFCAKHKIVSDIELIKMSDINSAMDRLAKSDVRYRFVIDVANSLLPESSAEILTEQVDHGVSITSRF

SEQ ID NO: 84522 - DNA, 1128 bp, Arabidopsis thaliana
  CDS (1)..(1128)
atggtagatcaaaatagagcatttggttgggcggccaacgacgaatcgggcgtcctctctccatttcatttctctagaagagaaaatggtgagaacgatgtaacagtgaagatcttgttctgtggtgtttgtcactctgatcttcataccatcaagaaccattggggattctctcgttaccccattattcccgggcatgaaatcgttggaatagcaacaaaagttgggaagaatgtgacaaagtttaaagaaggagaccgagtaggagtaggcgtaataatcggttcatgccaatcatgtgaatcatgtaaccaagacttagaaaactattgtcctaaagtcgttttcacatacaactctcgttcctctgacggaaccagaaaccaaggtggttattccgacgtaattgttgtcgatcaccgctttgtcctaagcattcccgacggtttaccaagcgattcaggcgcgccgctgctctgtgctggaatcactgtgtacagtcccatgaagtattatggcatgactaaagaatcagggaaacgtttaggtgtgaatggacttggtggacttggtcatatcgctgttaagattggtaaagcctttggtttaagagttactgtgattagtaggtcatcagagaaagagagagaagcaattgatcgactcggtgctgattcgtttcttgttacaacggattctcaaaagatgaaggaagcagttggaactatggatttcattatcgatacggtatcagcagaacatgctctattacctttgtttagtttgcttaaagtgagtggaaagcttgtggctttaggcttgctggagaagccactcgacctgccaattttccctctagttctcggaaggaaaatggtgggaggaagtcagattggagggatgaaggagacacaagagatgcttgagttctgtgccaagcataaaatcgtttcggatattgagctcataaagatgagtgatatcaactctgcgatggaccgtttggttaaatctgatgtcaggtaccggttcgtgatcgatgtggccaactctttactccctgagtcgtcagctgagattttaacggagcatgtcgaccatggagtctcgatcacgtctagattctga

SEQ ID NO: 84523 - protein, 375 aa, Arabidopsis thaliana
MVDQNRAFGWAANDESGVLSPFHFSRRENGENDVTVKILFCGVCHSDLHTIKNHWGFSRYPIIPGHEIVGIATKVGKNVTKFKEGDRVGVGVIIGSCQSCESCNQDLENYCPKVVFTYNSRSSDGTRNQGGYSDVIVVDHRFVLSIPDGLPSDSGAPLLCAGITVYSPMKYYGMTKESGKRLGVNGLGGLGHIAVKIGKAFGLRVTVISRSSEKEREAIDRLGADSFLVTTDSQKMKEAVGTMDFIIDTVSAEHALLPLFSLLKVSGKLVALGLLEKPLDLPIFPLVLGRKMVGGSQIGGMKETQEMLEFCAKHKIVSDIELIKMSDINSAMDRLVKSDVRYRFVIDVANSLLPESSAEILTEHVDHGVSITSRF

SEQ ID NO: 84524 - DNA, 1092 bp, Arabidopsis thaliana
  CDS (1)..(1092)
atggagagattatcaggagagaaagagcagagcgtagaggcgtttggatgggccgcgagagactcctcaggccatctctctccctttgtcttttctagaaggaaaacaggagaagaggaagtgagagtgaaggtgttatattgtggaatatgtcatagtgatctccattgtctcaagaacgaatggcattcctctatttaccctttggttcctggtcacgagattattggagaagtgagtgaaatagggaacaaagtaagtaaattcaatcttggagacaaagtcggtgtgggatgcatcgtagattcctgcagaacttgcgagagttgccgagaagatcaagaaaactactgcacaaaagcaatcgcaacctataacggagttcaccacgatggaacgattaactacggtggatactccgaccatatcgtcgtcgatgaacgttacgctgtcaaaattccacacacattgcctctagtttcggccgcacctttgctttgtgcaggcatctcgatgtacagtcctatgaagtacttcggattgaccggaccggataaacatgtcggaatcgtggggctaggtggtcttggacacattggtgtgagatttgctaaagcatttgggacaaaagtcacggtggttagttcgaccactgggaaatctaaggatgctcttgacactcttggagctgatggattcttggttagtactgatgaagaccaaatgaaggctgcaatgggaactatggatggcataattgatacagtttctgcatcgcattcgatttcacctttgattggactactcaaatccaacggtaaacttgttctactcggtgcaacggagaagccatttgatatatctgcattttccttaatattgggacgaaaatcgatagcgggaagtggtattggaggaatgcaagagacacaagagatgattgactttgcggcagagcatggcataaaagcagaaattgagatcatatccatggattatgtgaacaccgccatggatagacttgccaaaggggatgttagatatcgatttgtcattgacatttctaatacattggctgctactcgatcttaa

SEQ ID NO: 84525 - protein, 363 aa, Arabidopsis thaliana
MERLSGEKEQSVEAFGWAARDSSGHLSPFVFSRRKTGEEEVRVKVLYCGICHSDLHCLKNEWHSSIYPLVPGHEIIGEVSEIGNKVSKFNLGDKVGVGCIVDSCRTCESCREDQENYCTKAIATYNGVHHDGTINYGGYSDHIVVDERYAVKIPHTLPLVSAAPLLCAGISMYSPMKYFGLTGPDKHVGIVGLGGLGHIGVRFAKAFGTKVTVVSSTTGKSKDALDTLGADGFLVSTDEDQMKAAMGTMDGIIDTVSASHSISPLIGLLKSNGKLVLLGATEKPFDISAFSLILGRKSIAGSGIGGMQETQEMIDFAAEHGIKAEIEIISMDYVNTAMDRLAKGDVRYRFVIDISNTLAATRS

SEQ ID NO: 84526 - DNA, 1047 bp, Helicobacter pylori 26695
  CDS (1)..(1047): transl_table=11
atgagagttcaatctaaaggttttgctattttttctaaagacgggcatttcaaaccccatgattttagccgccatgctgtaggccctaaagatgtgttgattgacattctttatgcagggatttgtcatagcgatattcatagcgcttatagcgaatggaaagaaggcatttaccctatggttcctgggcatgaaattgctggggccatcaaagaagtgggtaaggaagttaagaaatttaaggttggcgatgtggtgggcgtgggctgttttgtcaattcatgcaaagcgtgtaagccctgtaaagaacaccaagagcaattttgcgccaaagtggtattcacttacgattgtttggattatttccatgacaacgaaccccacatgggcggatactctaataatattgtagtggatgaaaactatgtgattagcgtggataaaaacgctcctttagaaaaagtagcccccttgctttgtgcgggcatcaccacttattcgcccttaaaattttctaaggttactaaaggcacaaaagttggcgtcgctgggtttggcgggctaggaagcatggcggttaaatacgctgtggctatgggggctgaagtgagcgtttttgcaagaaacgaacacaaaaagcaagacgctttgagcatgggggttaaacatttctacactgaccccaaacaatgcaaagaggaattggactttatcatttcaaccattcctacccattatgatttaaaagactacctcaagctcttaacttataatggcgatctagcccttgtgggactcccccctgtagaaatcgctccagcgcttagcgtttttgattttatccatttaggcaatcgcaaggtttatggctcattgattgggggcattaaagaaacccaagaaatgatggatttttctatcaaacacaatatttaccctgaaatagatttgatcttaggcaaggatattgacaccgcttatcataatctaacccatgggaaagcgaaattccgctatgtgattgatatgaaaaaatcgtttgattaa

SEQ ID NO: 84527 - protein, 348 aa, Helicobacter pylori 26695
MRVQSKGFAIFSKDGHFKPHDFSRHAVGPKDVLIDILYAGICHSDIHSAYSEWKEGIYPMVPGHEIAGAIKEVGKEVKKFKVGDVVGVGCFVNSCKACKPCKEHQEQFCAKVVFTYDCLDYFHDNEPHMGGYSNNIVVDENYVISVDKNAPLEKVAPLLCAGITTYSPLKFSKVTKGTKVGVAGFGGLGSMAVKYAVAMGAEVSVFARNEHKKQDALSMGVKHFYTDPKQCKEELDFIISTIPTHYDLKDYLKLLTYNGDLALVGLPPVEIAPALSVFDFIHLGNRKVYGSLIGGIKETQEMMDFSIKHNIYPEIDLILGKDIDTAYHNLTHGKAKFRYVIDMKKSFD

SEQ ID NO: 84528 - DNA, 1053 bp, Helicobacter pylori J99
  CDS (1)..(1053): transl_table=11
atgagagttccatctaaaggttttgctattttttctaaagacgggcatttcaagccccatgactttagtcgccatgctgtaggccctaaagatgtgctgattgacattctttatgcagggatttgccatagcgatattcatagcgcttatagcgaatggaaagaaggcatttatcctatggttcctgggcatgaaattgctggggtgatcaaagaagtgggtaaggaagttaagaaatttaaggttggcgatgtggtgggcgtgggctgttttgtcaattcatgcaaaacatgtaagccctgtaaagaacaccaagagcaattttgcgccaaccacaaaacggtattcacttatgattgtttggattatttccatgacaatgaaccccacatgggcggatactctaataatattgtcgtggatgaaaactatgtgattagcgtggataaaaacgctcctttagaaaaagtagccccactattgtgcgcaggcatcaccacttattcgcccttaaaattttctaaggttactaaaggcacaaaagtgggtgtcgctgggtttggcgggctaggaagcatggcggtcaaatacgctgtggctatgggggctgaagtgagcgtttttgcaagaaacgatcataaaaagcaggacgctttaaatatgggggttaaacatttctatacagaccctaaacaatgcaaagaagaattggattttatcatttcaaccattcctacccattatgatctaaaagactacctcaagctcttaacttatagcggcgaattagctcttgtgggactccctcctgtagaagtcgctccagcgctcaatgtttttgaatttatccatttgggcaatcgtaaggtttatggctcattgattgggggcattaaagaaacccaagagatgatggatttttctatcaaacacaatatttaccctgaagtggatttgattttaggcaaggatattgacaccgcttatcacaatctaacccatgggaaagcgaaattccgctatgtgattgacatgaaaaaatcgtttgattaa

SEQ ID NO: 84529 - protein, 350 aa, Helicobacter pylori J99
MRVPSKGFAIFSKDGHFKPHDFSRHAVGPKDVLIDILYAGICHSDIHSAYSEWKEGIYPMVPGHEIAGVIKEVGKEVKKFKVGDVVGVGCFVNSCKTCKPCKEHQEQFCANHKTVFTYDCLDYFHDNEPHMGGYSNNIVVDENYVISVDKNAPLEKVAPLLCAGITTYSPLKFSKVTKGTKVGVAGFGGLGSMAVKYAVAMGAEVSVFARNDHKKQDALNMGVKHFYTDPKQCKEELDFIISTIPTHYDLKDYLKLLTYSGELALVGLPPVEVAPALNVFEFIHLGNRKVYGSLIGGIKETQEMMDFSIKHNIYPEVDLILGKDIDTAYHNLTHGKAKFRYVIDMKKSFD

SEQ ID NO: 84530 - DNA, 1098 bp, Helicobacter pylori J99
  CDS (1)..(1098): transl_table=11
atgcataacgcttgcaattgtaacagccaacgagtgccttttaaaggttttgcgatagacggcaaagacgggaaattccacgaatgggagcatagccgccatgccatgggcgaatacgatgttgtcattgacacccatttttcaggaatttgtcatacggatattcacttcgctcacagcgattggttgcctggaatttatcctatggtacctgggcatgagattgctggggtagtgagcgcggttggctctaaagtaacgaagtttaaagtaggcgatcacgctggagtgggttgcatggtaaattcttgcggtgagtgtcatacctgtaagcatgaacaccaagaacaatggtgcgaaaacaacaaaaccatttacacttacagctgggaagattctttccacaataatgagcctacttatggcgggtattctaacaatatcgtggtgagcgaaaactttgtgatttctatccctaaagaagccccattagacaaagcggcccccttgctttgcgcgggcatcaccgtgtattcgcctttaaaattttctaaagttactaaaggctctaaagtgggtatcgctggctttggcgggttggggcatatggctttaaaatacgccgtggctatgggagcgcaagtgagcgtgttcgcaaggaacgacaagaaaaagcaaatggctcaaaaactaggcgcgactaacttttatacaagcgtgggagaatgcaaagaaaaatttgatttaatcgtttctagcattcccacgcaatatgacttgctcgcttacacgaaattattaaaatatggcggtgaagtggcgatcgtgggtatccccccaaaagatccgcaaaggaatttggattttggcgatttggtgctgttttcaggcaatcataaggtttatggctcttggattgggggcgtgaaagaaacccaagaaatgatggatttttccgtcaaacatggcatttaccctgagattgagctagttaccggtcaagaaattgatgcgacttgggacaaactcttaaacgggcaagggaatttccgctatgtgattgacatgaaaaaatccatggaaaattttaagaaataa

SEQ ID NO: 84531 - protein, 365 aa, Helicobacter pylori J99
MHNACNCNSQRVPFKGFAIDGKDGKFHEWEHSRHAMGEYDVVIDTHFSGICHTDIHFAHSDWLPGIYPMVPGHEIAGVVSAVGSKVTKFKVGDHAGVGCMVNSCGECHTCKHEHQEQWCENNKTIYTYSWEDSFHNNEPTYGGYSNNIVVSENFVISIPKEAPLDKAAPLLCAGITVYSPLKFSKVTKGSKVGIAGFGGLGHMALKYAVAMGAQVSVFARNDKKKQMAQKLGATNFYTSVGECKEKFDLIVSSIPTQYDLLAYTKLLKYGGEVAIVGIPPKDPQRNLDFGDLVLFSGNHKVYGSWIGGVKETQEMMDFSVKHGIYPEIELVTGQEIDATWDKLLNGQGNFRYVIDMKKSMENFKK

SEQ ID NO: 84532 - DNA, 1029 bp, Pseudomonas aeruginosa PAO1
  CDS (1)..(1029): transl_table=11
atgaccctgccacagaccatgaaagccgcggtcgtgcacgcctacggcgcgccgctgcggatcgaggaagtcaaggttccgctgcccggccccgggcaggtactggtgaagatcgaagcctccggcgtctgccacaccgacctgcatgccgccgagggcgactggccggtgaagccgccgttgccgttcattcccggtcacgaaggcgtcggctacgtcgccgcggtgggcagcggagtgacccgagtgaaggaaggcgaccgggtcggcatcccctggctgtacaccgcctgcggctgctgcgagcactgcctgaccggctgggagaccctctgcgagagccagcagaacaccggctactcggtgaacggcggctatgccgaatacgtattggccgacccgaactacgtcggaattctgccgaaaaacgtcgaattcgctgaaatcgcgccgatcctctgcgccggcgtcaccgtctacaaggggctcaagcagactaacgcgcgccccggccagtgggtggcgatctccggcatcggcggcctcggccacgtcgccgtgcagtacgccagggccatgggcctgcacgtcgccgccatcgacatcgacgacgccaagctggaactggcgcgcaagctcggtgccagcctgacggtcaacgcccggcaggaagacccggtggaggtgctccagcgcgacatcggcggcgcccacggggtgctggtcaccgcggtatccaatagcgccttcggccaggccatcggcatggcgcgccgcggcggcaccatcgccctggtcggcctgccgccgggtgacttcccgacgccgatcttcgacgtggtgctcaagggcctgcacatcgccggctcaatcgtcggcacccgcgcggaccttcaggaagccctcgactttgccggcgaaggcctggtcaaggcgaccatccatccgggcaagctggacgacatcaaccagatcctcgaccagatgcgcgccgggcagatcgaggggcgcatcgtccttgagatgtga

SEQ ID NO: 84533 - protein, 342 aa, Pseudomonas aeruginosa PAO1
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEVLQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 84534 - DNA, 1023 bp, Lactococcus lactis subsp. lactis Il1403
  CDS (1)..(1023): transl_table=11
atgaaagcagcagtagtaagacacaatccagatggttatgcggaccttgttgaaaaggaacttcgagcaatcaaacctaatgaagctttgcttgacatggagtattgtggagtctgtcataccgatttgcacgttgcagcaggtgattatggcaacaaagcagggactgttcttggtcatgaaggaattggaattgtcaaagaaattggaactgatgtaagctcgcttcaagttggtgatcgggtttcagtggcttggttctttgaaggatgtggtcactgtgaatactgtgtatctggtaatgaaactttttgtcgagaagttaaaaatgcaggatattcagttgatggcggaatggctgaagaagcaattgttgttgccgattatgctgtcaaagttcctgacggacttgacccaattgaagctagctcaattacttgtgctggagtaacaacttacaaagcaatcaaagtatcaggagtaaaacctggtgattggcaagtaatttttggtgctggaggacttggaaatttagcaattcaatatgctaaaaatgtttttggagcaaaagtaattgctgttgatattaatcaagataaattaaatttagctaaaaaaattggagctgatgtgattatcaattctggtgatgtaaatccagttgatgaaattaaaaaaataactggcggcttaggagcacaaagtgcaatagtttgtgctgttgcaaggattgcttttgaacaagcggttgcttctttgaaacctatgggcaaaatggttgctgtggcacttcccaatactgagatgactttatcagttccaacagttgtttttgacggagtggaggttgcaggttcacttgtcggaacaagacttgacttggcagaagcttttcaatttggagcagagggtaaggtaaaaccaattgttgcgacacgcaaactggaagaaatcaatgatattattgatgaaatgaaggcaggaaaaattgaaggccgaatggtcattgattttactaaataa

SEQ ID NO: 84535 - protein, 340 aa, Lactococcus lactis subsp. lactis Il1403
MKAAVVRHNPDGYADLVEKELRAIKPNEALLDMEYCGVCHTDLHVAAGDYGNKAGTVLGHEGIGIVKEIGTDVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVIINSGDVNPVDEIKKITGGLGAQSAIVCAVARIAFEQAVASLKPMGKMVAVALPNTEMTLSVPTVVFDGVEVAGSLVGTRLDLAEAFQFGAEGKVKPIVATRKLEEINDIIDEMKAGKIEGRMVIDFTK

SEQ ID NO: 84536 - DNA, 1041 bp, Neisseria meningitidis Z2491
  CDS (1)..(1041): transl_table=11
atgcaggcagttgttgtgaataaaaatgtagcgggcgatgtggaagtcgtagaacgcgaggttcgcccgttggaatacggcgaggcattggtcgaagtcgaatattgcggcgtgtgccacaccgacctgcacgttgcggcaggcgactacggcgaaaaaccgggccgcgtgctgggacacgagggcatcggtttggttaaagaagttgccgacggtgtgaaacatctgaaagtcggcgaccgcgtcagcatcgcctggctgttccaaagctgcggctcttgcgaatactgcaataccggccgcgaaaccctgtgccgctctgtattgaacgcgggctacaccgccgacggcggtatggcgacccactgcatcgtgagtgccgattacgcggtcaaagtcccagaaggtttggatcctgcgcaagcttccagcattacttgtgccggcgtgaccacctataaagccattaaagtttccagtgttcgtccgggacagtggattgccatctacggcgcgggcggtttgggcaacttgggggtccaatacgcgaaaaaagtattcggcgcgcacgttgtcgccatcgacatcaacgacgacaaactggcgtttgccaaagaaaccggcgcggatttggttgtcaacgccgccaaagaggacgctgccaaagtgattcaggaaaaaaccggcggcgcacacgctgcggtcgtaaccgccgtatctgctgccgcattcaactctgccgtgaattgcgtccgcgcgggcggacgtgtggttgccatcggactgccgccggaatcgatggatttgtccatcccgcgtttggttttggacggcatcgaagtggtcggctctttggtcggcacgcgcaaagatttggaagaagctttccaattcggcgcggaaggtttggttgtgccgaaagtccaactgcgtgctttggatgaagcacccgccattttccaagaaatgcgcgaaggcaaaatcaccggccgtatggtgatcgatatgaaaaaagaatgcggctgcggccatcaccgctga

SEQ ID NO: 84537 - protein, 346 aa, Neisseria meningitidis Z2491
MQAVVVNKNVAGDVEVVEREVRPLEYGEALVEVEYCGVCHTDLHVAAGDYGEKPGRVLGHEGIGLVKEVADGVKHLKVGDRVSIAWLFQSCGSCEYCNTGRETLCRSVLNAGYTADGGMATHCIVSADYAVKVPEGLDPAQASSITCAGVTTYKAIKVSSVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHR

SEQ ID NO: 84538 - DNA, 1047 bp, Xylella fastidiosa 9a5c
  CDS (1)..(1047): transl_table=11
atgaacgcctccggctacgccgcctattcgcccaccgagccgctgcggcccttcagcttcgagcggcgcgccccgcgccccgatgacgtcgcgatcgagatcctgtactgcggcgtctgccacaccgatctgcacttcgcgcggggccacaagggcggaaccttcccgctggtgcccggccacgagatcgtcggccgcgtgaccggcgtcggcagcgaggtcacccgcgtccaggtcgggcaggtcgtcggcgtcggctgcatggtggattcctgcggccactgcgcggcgtgcgatggcggccacgagcagcattgcctgcaggggatgacgcccacctacaacggcaccgaccggcatgacggcagcaccacctacggcggctattcggaccgcatcgtggtgcccgagcatttcgtgctgaacgtccccgaccagctcgacctggccggcgtggcgccgctgctgtgtgctggcatcaccacctggtcgccgctgcgccgctggaaggtaggcccgggtagccgcgtggccgtcgtcggtctgggcggattgggccacatggcgctgaagctggcgaaggccatgggcgccgaggtgacgctgttctcgcgctcgccgggcaaggaagccgatgcgcgccgcctgggcgcggaccacgtggtgatctccaccgacgccgagcagatggccgcgatcaagggcaagtacgacctgatcgtggacacggtgccctacgaccacgacctgaatccctacgtgcccacgctgtccttccacggcacgctggtgctggtcggctacatgggaccgctggacgacaagctcaacacgctgccggtcgtgttcggcggccgagcggtcgccggttccttcatcggcggcatccccgagacgcaggcgatgctggatttctgcggcgagcacggcatcgtgtccgatgtcgagctgatccgcatgcaggagatcgaggacgcctacgagcgcatgctcaggagcgacgtgaagtaccgcttcgtcatcgacatggcttcgctgaaggcttga

SEQ ID NO: 84539 - protein, 348 aa, Xylella fastidiosa 9a5c
MNASGYAAYSPTEPLRPFSFERRAPRPDDVAIEILYCGVCHTDLHFARGHKGGTFPLVPGHEIVGRVTGVGSEVTRVQVGQVVGVGCMVDSCGHCAACDGGHEQHCLQGMTPTYNGTDRHDGSTTYGGYSDRIVVPEHFVLNVPDQLDLAGVAPLLCAGITTWSPLRRWKVGPGSRVAVVGLGGLGHMALKLAKAMGAEVTLFSRSPGKEADARRLGADHVVISTDAEQMAAIKGKYDLIVDTVPYDHDLNPYVPTLSFHGTLVLVGYMGPLDDKLNTLPVVFGGRAVAGSFIGGIPETQAMLDFCGEHGIVSDVELIRMQEIEDAYERMLRSDVKYRFVIDMASLKA

SEQ ID NO: 84540 - DNA, 1050 bp, Xylella fastidiosa 9a5c
  CDS (1)..(1050): transl_table=11
atgaccgtcaaagcctacggcgcctatgccgccgacaagcctctcgaatcgctggacattacccgccgcgcgccgggcgcgcacgacgtgcagatcgacattgcctactgcggcgtgtgccactccgacctgcaccaggtgcgtgccgaatgggcgggcacgcaattcccctgcgtgccgggccacgaaatcgtcggccgcgtctcggcggtgggtgcgcacgtctcgggcttccaaccgggcgatctggtcggcatcggctgcatcgtcgatagctgcaagcactgcgacgactgcgccgaggggctggagaactactgcgacgagatggtcggcacctacaacggcccgacgccggacgcacccggccacacgctgggcggctactcccagcagatcgtggtgcatgagcgctacgtgctgcgcatccgccacgacgaatcacaactggccgctgtcgcgccgctgctgtgcgcgggcatcaccacctactcgccgctgcgccactggaacgccgggccgggcaagaaggtcggcgtggtcggcatcggcggcctgggccacatgggcatcaagctggcgcacgccatgggcgcgcacgtggtcgcgttcaccacctcggaatccaagcgcgacgccgccatggccctgggtgccgacgaggtggtggtctcgcgcaatcctggcgagatggccgcccacggccagagcttcgacttcatcctgaacacggtggccgcgccgcacgacctcaacgccttcatgacgctgctcaagcgcgacggcacgatgacgccggtcggcgccccggcgtcgccgcacccctcgccggaagtcttcaacttcatcctcaagcgccgcagcctggccggttcggcaatcggcggcatccccgagacgcaggagatgctggacttctgcgcggagcacaacatcgtcgcggacatcgagctgatccgcgcagaggaaatcaacgacgcctatgagcgcatgctcaagggcgacgtgaagtaccgcttcgtcatcgacaacgcctccttggcggcgtga

SEQ ID NO: 84541 - protein, 349 aa, Xylella fastidiosa 9a5c
MTVKAYGAYAADKPLESLDITRRAPGAHDVQIDIAYCGVCHSDLHQVRAEWAGTQFPCVPGHEIVGRVSAVGAHVSGFQPGDLVGIGCIVDSCKHCDDCAEGLENYCDEMVGTYNGPTPDAPGHTLGGYSQQIVVHERYVLRIRHDESQLAAVAPLLCAGITTYSPLRHWNAGPGKKVGVVGIGGLGHMGIKLAHAMGAHVVAFTTSESKRDAAMALGADEVVVSRNPGEMAAHGQSFDFILNTVAAPHDLNAFMTLLKRDGTMTPVGAPASPHPSPEVFNFILKRRSLAGSAIGGIPETQEMLDFCAEHNIVADIELIRAEEINDAYERMLKGDVKYRFVIDNASLAA

SEQ ID NO: 84542 - DNA, 1089 bp, Mycobacterium leprae TN
  CDS (1)..(1089): transl_table=11
atgaagtcacacgtgtcaaaacacagaagaaagagaagattaggtgccatgactaccgtctccgcttacgccgccacgtcggcgaccgaaccgctaaccaaggtcaccatcaaccgccgcgccccgggtccgcacgacgtagcaatccagatcaagttcgccggtatctgccactccgatatccacaccgtaaaagctgagtggggccaaccgaattaccctgtggtaccaggccatgagatcgctggcgtggtgaccgcggtgggcactgaggtcaccaagcacaaggtgggcgaccgcgtcggcgtgggctgcatggtgggctcttgcggtgaatgcagcagctgcctagctggcatcgagcagtactgtaaacggggcgcgacctttacctacaactcgatcggcacagacggccagtcaacacaaggcggctacagccaggcaatcgtcgtcgacgagaactttgtcgtacacatacccgatgcgctaccgctggacgccgccgcaccgctgctgtgcgcgggcatcacgctctactcaccgcttaggcattggaatgctaagccgggcacgcggctcgcaatcatcggtttgggcggtctcgggcacatgggtgtcaagctgggcagaaagatgggctgtgaagtgacggtgctgtcccagtcgctgaagaagatggaggacggactgcagctgggcgccagcaactattacgcaactgccgatcccgacaccttccgcaaactacgtggcagtttcgacctgattttgaacaccgtctcggcgaatctggatctcggcaaatacctgaacctgcttgatgtcaacgggacgctcgtcgagctgggcattcccgagcacccgatgttggtgccggcattcgcgctggcactcatgcggcgcagcctagctgggtcgaacatcggcgggatcaccgaaacccaggagatgatgaatttcagtgctgaacatagtgttacaccggaaatagagctcatcgaaccggactacatcaacgaagcctatgaacgagtgctggcaagcgacgtgcggtaccgcttcgtcataaacatatcaagtttgtaa

SEQ ID NO: 84543 - protein, 362 aa, Mycobacterium leprae TN
MKSHVSKHRRKRRLGAMTTVSAYAATSATEPLTKVTINRRAPGPHDVAIQIKFAGICHSDIHTVKAEWGQPNYPVVPGHEIAGVVTAVGTEVTKHKVGDRVGVGCMVGSCGECSSCLAGIEQYCKRGATFTYNSIGTDGQSTQGGYSQAIVVDENFVVHIPDALPLDAAAPLLCAGITLYSPLRHWNAKPGTRLAIIGLGGLGHMGVKLGRKMGCEVTVLSQSLKKMEDGLQLGASNYYATADPDTFRKLRGSFDLILNTVSANLDLGKYLNLLDVNGTLVELGIPEHPMLVPAFALALMRRSLAGSNIGGITETQEMMNFSAEHSVTPEIELIEPDYINEAYERVLASDVRYRFVINISSL

SEQ ID NO: 84544 - DNA, 1107 bp, Agrobacterium tumefaciens str. C58
  CDS (1)..(1107): transl_table=11
gtgtttgatgcatcgatcaccataagaggaggaacgaccatgttcacaacgtccgcctatgcctgcgatgacggctcttcgccgatgaagctcgcgaccatcaggcgccgcgatcccggtccgcgcgatgtcgaaatcgagatagaattctgtggcgtctgccactcggacatccatacggcccgcagcgaatggccgggctccctctacccttgcgtccccggccacgaaatcgtcggccgtgtcggtcgggtgggcgcgcaagtcacccggttcaagacgggtgaccgcgtcggtgtcggctgtatcgtcgatagctgccgcgaatgcgcaagctgcgccgaagggctggagcaatattgcgaaaacggcatgaccggcacctataactcccctgacaaggcgatgggcggcggcgcgcatacgcttggcggctattccgcccatgtggtggtggatgaccgctatgtgctcaatattcccgaagggctcgatccggcggcagcagcaccgctactctgcgctggtatcaccacctactcgccgctgcgccactggaatgccggccccggcaaacgcgtcggcgtcgtcggtctgggcggcctcggccatatggccgtcaagctcgccaatgccatgggtgcgactgtcgtgatgatcaccacctcgcccggcaaggcggaggatgccaaaaaactcggcgcacacgaggtgatcatctcccgcgatgcggagcagatgaagaaggctacctcgagcctcgatctcatcatcgatgctgtcgccgccgaccacgacatcgacgcctatctggcgctgctgaaacgcgatggcgcgctggtgcaggtgggcgcgccggaaaagccactttcggtgatggccttcagcctcatccccggccgcaagacctttgccggctcgatgatcggcggtattcccgagactcaggaaatgctggatttctgcgccgaaaaaggcatcgccggcgaaatcgagatgatcgatatcgatcagatcaatgacgcttatgaacgcatgataaaaagcgatgtgcgttatcgtttcgtcattgatatgaagagcctgccgcgccagaaggccgcctga

SEQ ID NO: 84545 - protein, 368 aa, Agrobacterium tumefaciens str. C58
MFDASITIRGGTTMFTTSAYACDDGSSPMKLATIRRRDPGPRDVEIEIEFCGVCHSDIHTARSEWPGSLYPCVPGHEIVGRVGRVGAQVTRFKTGDRVGVGCIVDSCRECASCAEGLEQYCENGMTGTYNSPDKAMGGGAHTLGGYSAHVVVDDRYVLNIPEGLDPAAAAPLLCAGITTYSPLRHWNAGPGKRVGVVGLGGLGHMAVKLANAMGATVVMITTSPGKAEDAKKLGAHEVIISRDAEQMKKATSSLDLIIDAVAADHDIDAYLALLKRDGALVQVGAPEKPLSVMAFSLIPGRKTFAGSMIGGIPETQEMLDFCAEKGIAGEIEMIDIDQINDAYERMIKSDVRYRFVIDMKSLPRQKAA

SEQ ID NO: 84546 - DNA, 1044 bp, Sinorhizobium meliloti 1021
  CDS (1)..(1044): transl_table=11
atggccattgcaagaggatatgcggcgacggacgcgtcgaagccgctcgcacccttcaccttcgagcgtcgcgaaccgcgcgacgacgacgtggtgatcgacatcaaatattgcggcgtctgccattccgacatccaccaggcgcgcgacgaatggggcaattcgaccttccccatggtaccgggccacgagatcgtcggcatcgtcagggcagtcggctcccaggtcaccaggttcaagatcggcgaccgggtgggtgtcggctgcttcgtcgactcctgcacgacctgcgccaagcgtgatctcgacctggagcagtatctgccgggcctcgtggtgacctacaacggcgtcgaggccgacggaaccccgacccaaggcggctattccgaccatatcgtcgtcaaggaaggctatgtgctctccattccggagaaccttccgctcgatgctgccgcaccgctgctttgcgccggcatcacgctctactcgccgctgcgtcactggaaggccggccccggcaagaaggtggcgatcgtcggcttgggcggtctcggccatatgggcgtgaagctcgcccatgcgatgggcgcggaggtcacggtgctcagccagacactttcgaagaaggaggacgggcttaagctcggggcggatcactactacgcgacgaaggatccggagacattcacgaagctcgccggcagcttcgacctgatcatctgcacggtcgccgccgagatcgactggaacgcctatctcaacctcctgaaggtcgatggcgagctggtgctcgtcggcattccggagaatccggtgccggtccatgccttctcgctggtgccggcacggcgcagcatttccggctccatgatcggttcgatcaaggagacgcaggaaatgctcgatttctgcggcgagcacggaatcgtttcggagatcgagacgatccgcatggagcagatcaacgaggcctatgagcgggtggtgagaagcgacgtgcgctatcgcttcgtgatcgacatggaatcgatcaaggcttga

SEQ ID NO: 84547 - protein, 347 aa, Sinorhizobium meliloti 1021
MAIARGYAATDASKPLAPFTFERREPRDDDVVIDIKYCGVCHSDIHQARDEWGNSTFPMVPGHEIVGIVRAVGSQVTRFKIGDRVGVGCFVDSCTTCAKRDLDLEQYLPGLVVTYNGVEADGTPTQGGYSDHIVVKEGYVLSIPENLPLDAAAPLLCAGITLYSPLRHWKAGPGKKVAIVGLGGLGHMGVKLAHAMGAEVTVLSQTLSKKEDGLKLGADHYYATKDPETFTKLAGSFDLIICTVAAEIDWNAYLNLLKVDGELVLVGIPENPVPVHAFSLVPARRSISGSMIGSIKETQEMLDFCGEHGIVSEIETIRMEQINEAYERVVRSDVRYRFVIDMESIKA

SEQ ID NO: 84548 - DNA, 1050 bp, Bacillus subtilis subsp. subtilis str. 168
  CDS (1)..(1050): transl_table=11
atgtgtaatcaacatcaaacccgtgtattaagcgtgtcacatgcaaaagccaaatttgaacaaacgacgattgagcgaagaggattacggccgcacgatgtcttaatcgatattaaattcagcggcatttgccattcagacattcatagcgcttttgatgaatggggcggtggcatcttcccaatggtgcctggacatgaaatagccggtgttgtaacagccgttggaacaaaagtcaccaagttggctgtcggggaccgcgttggtgtcggctgttttgttgactcttgcggagaatgcgaatactgtctcaacgcagaggaacaattctgcacgaagggtgttgttcaaacgtataactcagtagactacgacggaaaccccacttatggcgggtacagccaaaaaatcgttgtcactgacagatttgttgttcgcataccagatcgtttggaaatggatgttgccagtccgctgttgtgtgcaggtatcacaacgtattccccgctgaaacactggaatgttggccctggtaaaaaggttgcgattgtaggcgtaggtggccttggacatttggcaattcaatttgcacatgcgatgggtgcagaagtaaccgtcctgagccgttccatgaataagaaagaggaagctctggaactcggtgcaaatcattactatgcaacaagtgacccagccacattcactgcattggccgggcgttttgacgtgatcttaaatacggtatcggcaaatctcgatgtagatgcctatttatcaatgcttcgtatagacgggacacttgtaagcgttggagctcctgccaagccggacacatacagtgtgttttccctaatcatggggcgccgcagcattgcaggttctctagtcggcggaattcaagaaactcaagagatgctggatttcgcagctgagcatggcatcgaacctaaaatcgaagtcatcggagctgaccaagtggacgaggcatacgaacgtatcctccgaagcgatgtccgttatcgatttgtgattgatatttccacattgtaa

SEQ ID NO: 84549 - protein, 349 aa, Bacillus subtilis subsp. subtilis str. 168
MCNQHQTRVLSVSHAKAKFEQTTIERRGLRPHDVLIDIKFSGICHSDIHSAFDEWGGGIFPMVPGHEIAGVVTAVGTKVTKLAVGDRVGVGCFVDSCGECEYCLNAEEQFCTKGVVQTYNSVDYDGNPTYGGYSQKIVVTDRFVVRIPDRLEMDVASPLLCAGITTYSPLKHWNVGPGKKVAIVGVGGLGHLAIQFAHAMGAEVTVLSRSMNKKEEALELGANHYYATSDPATFTALAGRFDVILNTVSANLDVDAYLSMLRIDGTLVSVGAPAKPDTYSVFSLIMGRRSIAGSLVGGIQETQEMLDFAAEHGIEPKIEVIGADQVDEAYERILRSDVRYRFVIDISTL

SEQ ID NO: 84550 - DNA, 1032 bp, Agrobacterium tumefaciens str. C58; identical to SEQ ID NO: 51375
  CDS (1)..(1032): transl_table=11

SEQ ID NO: 84551 - protein, 343 aa, Agrobacterium tumefaciens str. C58; identical to SEQ ID NO: 51376

SEQ ID NO: 84552 - DNA, 1041 bp, Escherichia coli K12
  CDS (1)..(1041): transl_table=11
atgcagaacatcatccgaaaaggaggaactatgaaggctgcagttgttacgaaggatcatcatgttgacgttacgtataaaacactgcgctcactgaaacatggcgaagccctgctgaaaatggagtgttgtggtgtatgtcataccgatcttcatgttaagaatggcgattttggtgacaaaaccggcgtaattctgggccatgaaggcatcggtgtggtggcagaagtgggtccaggtgtcacctcattaaaaccaggcgatcgtgccagcgtggcgtggttctacgaaggatgcggtcattgcgaatactgtaacagtggtaacgaaacgctctgccgttcagttaaaaatgccggatacagcgttgatggcgggatggcggaagagtgcatcgtggtcgccgattacgcggtaaaagtgccagatggtctggactcggcggcggccagcagcattacctgtgcgggagtcaccacctacaaagccgttaagctgtcaaaaattcgtccagggcagtggattgctatctacggtcttggcggtctgggtaacctcgccctgcaatacgcgaagaatgtctttaacgccaaagtgatcgccattgatgtcaatgatgagcagttaaaactggcaaccgaaatgggcgcagatttagcgattaactcacacaccgaagacgccgccaaaattgtgcaggagaaaactggtggcgctcacgctgcggtggtaacagcggtagctaaagctgcgtttaactcggcagttgatgctgtccgtgcaggcggtcgtgttgtggctgtcggtctaccgccggagtctatgagcctggatatcccacgtcttgtgctggatggtattgaagtggtcggttcgctggtcggcacgcgccaggatttaactgaagccttccagtttgccgccgaaggtaaagtggtgccgaaagtcgccctgcgtccgttagcggacatcaacaccatctttactgagatggaagaaggcaaaatccgtggccgcatggtgattgatttccgtcactaa

SEQ ID NO: 84553 - protein, 346 aa, Escherichia coli K12
MQNIIRKGGTMKAAVVTKDHHVDVTYKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 84554 - DNA, 1011 bp, Synechocystis sp. PCC 6803
  CDS (1)..(1011): transl_table=11
atgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattag

SEQ ID NO: 84555 - protein, 336 aa, Synechocystis sp. PCC 6803
MIKAYAALEANGKLQPFEYDPGALGANEVEIEVQYCGVCHSDLSMINNEWGISNYPLVPGHEVVGTVAAMGEGVNHVEVGDLVGLGWHSGYCMTCHSCLSGYHNLCATAESTIVGHYGGFGDRVRAKGVSVVKLPKGIDLASAGPLFCGGITVFSPMVELSLKPTAKVAVIGIGGLGHLAVQFLRAWGCEVTAFTSSARKQTEVLELGAHHILDSTNPEAIASAEGKFDYIISTVNLKLDWNLYISTLAPQGHFHFVGVVLEPLDLNLFPLLMGQRSVSASPVGSPATIATMLDFAVRHDIKPVVEQFSFDQINEAIAHLESGKAHYRVVLSHSKN

SEQ ID NO: 84556 - DNA, 1011 bp, Salmonella typhimurium LT2
  CDS (1)..(1011): transl_table=11
atgaaagctgctgttgtcacacaagatcatcaggttgatgttactgagaaaacgctgcgtccccttcgccacggtgaagctttgctaaaaatggagtgctgcggcgtatgccataccgatctacacgtgaaaaacggcgatttcggtgacaaaaccggcgttattctgggacacgaaggcattggcgtcgtggcggaagtcggtcctggtgtcacctcgctgaaacccggcgatcgcgcgagtgtcgcgtggttttatgaaggatgcggacactgtgagtattgcaatacgggcaatgaaaccttatgccgcaacgtgaaaaatgccggttacacggtagatggcggtatggccgaagagtgtattgtcgtcgcggattatgcggtgaaagtaccggaaggtctggactctgcagcggcaagtagtattacctgcgcgggcgttaccacctataaagcggtgaagatttctcatattaaacctggccagtggattgccatctacggtctgggcggtctgggtaatctggccttgcagtacgcgaaaaacgttttcaatgcgaaagtgatcgccattgatgtcaatgatggacaactgaaactggccgaggaaatgggcgcagatctgaccattaattcacgtacggaagatgcggctaaaattgtgcaggaaaaaaccggtggcgcgcacgcagcggtggttaccgcggtcgctaaggcggcgtttaattccgcagtagatgccgttcgcgccggaggccgcgtggtggcagtcgggttgccgccagaagccatgaaccttgatatccctcgcctggtgctggatggcattcaggttgtcggttcgttggtggggacacgccaggatctgaccgaagccttccagtttgcggcggaaggaaaagtcgtgccaaaagtcgctttacgtccgcttgaagatatcaacgttatttttaaagagatggaacagggacaaattcgtggccgtatggtcatcgatttccgtcgttaa

SEQ ID NO: 84557 - protein, 336 aa, Salmonella typhimurium LT2
MKAAVVTQDHQVDVTEKTLRPLRHGEALLKMECCGVCHTDLHVKNGDFGDKTGVILGHEGIGVVAEVGPGVTSLKPGDRASVAWFYEGCGHCEYCNTGNETLCRNVKNAGYTVDGGMAEECIVVADYAVKVPEGLDSAAASSITCAGVTTYKAVKISHIKPGQWIAIYGLGGLGNLALQYAKNVFNAKVIAIDVNDGQLKLAEEMGADLTINSRTEDAAKIVQEKTGGAHAAVVTAVAKAAFNSAVDAVRAGGRVVAVGLPPEAMNLDIPRLVLDGIQVVGSLVGTRQDLTEAFQFAAEGKVVPKVALRPLEDINVIFKEMEQGQIRGRMVIDFRR

SEQ ID NO: 84558 - DNA, 1020 bp, Salmonella typhimurium LT2
  CDS (1)..(1020): transl_table=11
atgacgataataaaaagctatgccgccaaagaggcgggcggcgagctcgaactctatgaatatgacgcgggagaactccaaccggaagatgtcgaggtacgggtcgactactgcgggatctgccattccgatctgtcaatgatcgacaatgaatgggggttctctcaataccctctggttgccggacatgaggtcatcggtcgggtggccgcactcggcagcgcggcacaggataaggggctaaaagtcggccagcgcgttggaatcggctggacggcgcgcagctgcggacactgcgatgcctgtatcagcggcaatcaaattaactgccaggaaggcgcagtgcccactatcctcaatcgtggcggttttgccgagaagcttcgcgcaggctggcagtgggtaattcctcttccggagaatatagatatggcgtccgcaggcccgctgttatgtggcggcattacggtctttaaaccgctattgatgcaccatattactgctaccagccgcgttggcgtcatcggtattggcgggctggggcatatcgccataaagctgttacacgcgatgggctgcgaagtcaccgcgttcagctcaaatccatcgaaggagcaggaagtgctggcgatgggggccaataacgtggtgaacagccgcgatccggaagcgttaaaagcactggcgggtcagttcgatctcattattaacacggttaacgtcgatctcgactggcaaccctacttcgaagcgctgacctatggcggcaacttccataccgttggggcggtattgaagccgctgcccgtaccggcgtttacattaattgccggcgatcgcagtatctcaggctcggcaaccggaacgccatatgaacttcgcaaactgatgaaattcgccggacgcagtaaagtcgcgcccaccacggaactgttcgcaatgtcacaaatcaacgaggctatccagcacgttcgcgacggcaaagcccgctatcgtgtagtgctaaaagctgacttctga

SEQ ID NO: 84559 - protein, 339 aa, Salmonella typhimurium LT2
MTIIKSYAAKEAGGELELYEYDAGELQPEDVEVRVDYCGICHSDLSMIDNEWGFSQYPLVAGHEVIGRVAALGSAAQDKGLKVGQRVGIGWTARSCGHCDACISGNQINCQEGAVPTILNRGGFAEKLRAGWQWVIPLPENIDMASAGPLLCGGITVFKPLLMHHITATSRVGVIGIGGLGHIAIKLLHAMGCEVTAFSSNPSKEQEVLAMGANNVVNSRDPEALKALAGQFDLIINTVNVDLDWQPYFEALTYGGNFHTVGAVLKPLPVPAFTLIAGDRSISGSATGTPYELRKLMKFAGRSKVAPTTELFAMSQINEAIQHVRDGKARYRVVLKADF

SEQ ID NO: 84560 - DNA, 1059 bp, Ralstonia solanacearum GMI1000
  CDS (1)..(1059): transl_table=11
atgcaggccctgggatacgctgctgcgtcttcaaccgatgcgctcgtaccattgcgcttcgagcggcgggagccacgtccggacgatgtcgttctggacgtgctctactgcggcgtctgccacacagacctccacatcgcaaagaaccatggcgggtatacgaactaccctgtcgtgccgggtcacgaaatcatcggacgcgtcacgcgggtcggtagcgaagtcacccgctttaaggtgggggacacggttggcgtcggatgcatggtcgattcgtgccagcactgcaacccttgcctcgcgggctatgaacagcactgccaggcgggaccggtcttcacctacaacggaacggaccggcatgaccacacgagaaccttcggcggttactcgaacacgctggtcgtatcggacaagtttgtcttgagcattcccaatgggcttgacccggccggtgccgcacctctgctctgcgccggaatcacgacgtgggagccgctgcatcagtggaaagtcggcccgggcagccaggtcgccgttgtgggcttgggcggcctgggtcacatggccctgaagctggccaaagcgctcggggcagaggtcaccctgttgacccgttcgcccaataaggagctcgatgcacggcgtctcggcgccaatcacgtcgtgctgtcgaccgatgctagccagatggcgtccgtggccgggcgcttcgacttgatcgtggacaccgttccctacgaacacgacgtcaatccgtacctgcctaccctagcgcttaacggtaccttggtcttggtcggctacatgggaccgctgaacgagccggtttcagcaagagcactcgtgttcggccgcaaggccatcgcgggatcgttcatcggcggcattgccgcaacgcaggcgatgctcgacttttgcggggcgcacaacgtcgtgtcggatgtcgagatcatcccgatccagcagatcaacgcagcgtatgaacggctgctcaagagcgacgtgaaatatcgcttcgtcattgatatgtcatcactggcggcggacaagccctga

SEQ ID NO: 84561 - protein, 352 aa, Ralstonia solanacearum GMI1000
MQALGYAAASSTDALVPLRFERREPRPDDVVLDVLYCGVCHTDLHIAKNHGGYTNYPVVPGHEIIGRVTRVGSEVTRFKVGDTVGVGCMVDSCQHCNPCLAGYEQHCQAGPVFTYNGTDRHDHTRTFGGYSNTLVVSDKFVLSIPNGLDPAGAAPLLCAGITTWEPLHQWKVGPGSQVAVVGLGGLGHMALKLAKALGAEVTLLTRSPNKELDARRLGANHVVLSTDASQMASVAGRFDLIVDTVPYEHDVNPYLPTLALNGTLVLVGYMGPLNEPVSARALVFGRKAIAGSFIGGIAATQAMLDFCGAHNVVSDVEIIPIQQINAAYERLLKSDVKYRFVIDMSSLAADKP

SEQ ID NO: 84562 - DNA, 1032 bp, Ralstonia solanacearum GMI1000
  CDS (1)..(1032): transl_table=11
atgccggagaaaaagacatacaaagcgatgcaggtgaccgggccaggcgtgctggaaatggttgaacgggatacgccgacaccagcgatcggtgaggtcctgatccaggtggaggcatgcggcatctgcggtgccgatgcaggtgtcattgaaggacgggaggccgggctgcagtacccacgcgttccgggccacgaagtcgtcgggcgcatcgtggcgaccggacccggtaccgcttcgatctggagggtgggccagcgtgtaggtgtgggccggctgggcggacactgcaacgaatgcgagcagtgccgacgcgggcaattccagctctgcaggaaccagcccattgtggggagcacacaagacggcggctatgcggaaatgatgctggcccgcagcacagggctggtctcgatccccgacacacttagctcggaagcggcagcccccattctgtgcgccggcattgccaccttcaacgcgctcaggaaatcgggcgcgcaggcaggcgatctcgttgccatccagggcattgggggcctggggcacatggccatccagtacgcgcgcaggatgggctttcgggttgtggccgtaggccgaggcaccgatatcgtcaacgacgttcgcgcgttgggtgcgcacatctatatcgacacccatatcgaggatccggcggtccggctgcgggaattgggcggggcgcaggtgatcttgaccaccatcacggacagcgccgcggcctccccgctcatgtcggccctcgcgcctcaaggacggttgcttgtcgttggcgtcggacaagcgccgctggccgtcatgcccagcgccctggtaggtggtgaacgcatggtccagggaaccctcactggctcgccttttgaatccgagaaggctctggacttcagcgtcctgacagacgttcgtccgctgatcgaaaccatgccgcttgagaaggcgcacgaagcgtaccagcgcatgatgtcggggcaagtcaagttccgcatggtgctgacgatgaacgccggttga

SEQ ID NO: 84563 - protein, 343 aa, Ralstonia solanacearum GMI1000
MPEKKTYKAMQVTGPGVLEMVERDTPTPAIGEVLIQVEACGICGADAGVIEGREAGLQYPRVPGHEVVGRIVATGPGTASIWRVGQRVGVGRLGGHCNECEQCRRGQFQLCRNQPIVGSTQDGGYAEMMLARSTGLVSIPDTLSSEAAAPILCAGIATFNALRKSGAQAGDLVAIQGIGGLGHMAIQYARRMGFRVVAVGRGTDIVNDVRALGAHIYIDTHIEDPAVRLRELGGAQVILTTITDSAAASPLMSALAPQGRLLVVGVGQAPLAVMPSALVGGERMVQGTLTGSPFESEKALDFSVLTDVRPLIETMPLEKAHEAYQRMMSGQVKFRMVLTMNAG

SEQ ID NO: 84564 - DNA, 1068 bp, Ralstonia solanacearum GMI1000; identical to SEQ ID NO: 51397
  CDS (1)..(1068): transl_table=11

SEQ ID NO: 84565 - protein, 355 aa, Ralstonia solanacearum GMI1000; identical to SEQ ID NO: 51398

SEQ ID NO: 84566 - DNA, 1029 bp, Agrobacterium tumefaciens str. C58
  CDS (1)..(1029): transl_table=11
atgactaaaacaatgaaggcggcggttgtccgcgcatttggaaaaccgctgaccatcgaggaagtggcaataccggatcccggccccggtgaaattctcatcaactacaaggcgacgggcgtttgccacaccgacctgcacgccgcaacgggggattggccggtcaagcccaacccgcccttcattcccggacatgaaggtgcaggttacgtcgccaagatcggcgctggcgtcaccggcatcaaggagggcgaccgcgccggcacgccctggctctacaccgcctgcggatgctgcattccctgccgtaccggctgggaaaccctgtgcccgagccagaagaactcaggttattccgtcaacggcagctttgccgaatatggccttgccgatccgaaattcgtcggccgcctgcctgacaatctcgatttcggcccagccgcacccgtgctctgcgccggcgttacagtctataagggcctgaaggaaaccgaagtcaggcccggtgaatgggtggtcatttcaggcattggcgggcttggccacatggccgtgcaatatgcgaaagccatgggcatgcatgtggttgccgccgatattttcgacgacaagctggcgcttgccaaaaagctcggagccgacgtcgtcgtcaacggccgcgcgcctgacgcggtggagcaagtgcaaaaggcaaccggcggcgtccatggcgcgctggtgacggcggtttcaccgaaggccatggagcaggcttatggcttcctgcgctccaagggcacgatggcgcttgtcggtctgccgccgggcttcatctccattccggtgttcgacacggtgctgaagcgcatcacggtgcgtggctccatcgtcggcacgcggcaggatctggaggaggcgttgaccttcgccggtgaaggcaaggtggccgcccacttctcgtgggacaagctcgaaaacatcaatgatatcttccatcgcatggaagagggcaagatcgacggccgtatcgtcgtggatctcgccgcctga

SEQ ID NO: 84567 - protein, 342 aa, Agrobacterium tumefaciens str. C58
MTKTMKAAVVRAFGKPLTIEEVAIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDLAA

SEQ ID NO: 84568 - DNA, 1047 bp, Agrobacterium tumefaciens str. C58
  CDS (1)..(1047): transl_table=11
atggctattgcaagaggttatgctgcgaccgacgcgtcgaagccgcttaccccgttcaccttcgaacgccgcgagccgaatgatgacgacgtcgtcatcgatatcaaatatgccggcatctgccactcggacatccacaccgtccgcaacgaatggcacaatgccgtttacccgatcgttccgggccacgaaatcgccggtgtcgtgcgggccgttggttccaaggtcacgcggttcaaggtcggcgaccatgtcggcgtcggctgctttgtcgattcctgcgttggctgcgccacccgcgatgtcgacaatgagcagtatatgccgggtctcgtgcagacctacaattccgttgaacgggacggcaagagcgcgacccagggcggttattccgaccatatcgtggtcagggaagactacgtcctgtccatcccggacaacctgccgctcgatgcctccgcgccgcttctctgcgccggcatcacgctctattcgccgctgcagcactggaatgcaggccccggcaagaaagtggctatcgtcggcatgggtggccttggccacatgggcgtgaagatcggctcggccatgggcgctgatatcaccgttctctcgcagacgctgtcgaagaaggaagacggcctcaagctcggcgcgaaggaatattacgccaccagcgacgcctcgacctttgagaaactcgccggcaccttcgacctgatcctgtgcacagtctcggccgaaatcgactggaacgcctacctcaacctgctcaaggtcaacggcacgatggttctgctcggcgtgccggaacatgcgatcccggtgcacgcattctcggtcattcccgcccgccgttcgctcgccggttcgatgatcggctcgatcaaggaaacccaggaaatgctggatttctgcggcaagcacgacatcgtttcggaaatcgaaacgatcggcatcaaggacgtcaacgaagcctatgagcgcgtgctgaagagcgacgtgcgttaccgcttcgtcatcgacatggcctcgctcgacgcttga

SEQ ID NO: 84569 - protein, 348 aa, Agrobacterium tumefaciens str. C58
MAIARGYAATDASKPLTPFTFERREPNDDDVVIDIKYAGICHSDIHTVRNEWHNAVYPIVPGHEIAGVVRAVGSKVTRFKVGDHVGVGCFVDSCVGCATRDVDNEQYMPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASLDA

SEQ ID NO: 84570 - DNA, 1122 bp, Brucella melitensis 16M
  CDS (1)..(1122): transl_table=11
gtgtggcagccagcagtttcaagccctgcgtctctcatgcttgtttcttcgcattcccctggaacgatgcaagttcgacaacgaaggagtaactctatggcaaagacgatgaaagctgcggtcgtgcgtgccttcggcaaaccgctgacgattgatgaagtgccgatacctcaacccggtcccggccagattcaggttgccattcaggcttccggcgtatgccataccgaccttcatgccgccgagggcgattggccggtaaaacccaatccgcccttcattccgggtcatgagggtgtcggtttcgtttccgccgtgggcagcggcgtcaagcatgtcaaggaaggcgaccgtgtcggcattccatggctttacactgcctgcggccattgccttggtggctgggaaacgctttgcgaggaacagctcaataccggctattccgtcaatggcggctttgccgaatatgtggtggccgatccgaatttcgtcggccacttgccgaagaatatcgatttcaacgagattgcgccggtgctctgcgcgggcgtgacggtctataagggcctcaaggtcacggatacgaagcccggtgactgggtggtcatttcaggcataggcgggctcggccacatggctgtgcaatatgccagggccatggggctgaatgttgccgccgtcgatattgacgaccgcaagctcgatctcgcccgcagacttggcgcaaccgttacggtcaacgctaagacggttgccgacccggcagcctatattcgcaaggaaaccgatggcggtgcgcaaggcgtgctggtgacggcggtttcgcccaaggcttttgaacaggcgctgggcatggttgcgcgcggcggtactgtttcgctgaatggcctgccgcctggcgatttcccgctttccatcttcaacatggtgctcaatggcgtaacggtgcgcggctccatcgtggggacgcggcttgatttgcaggaatcgctcgattttgcagccgacggcaaggtcaaggccaccatccaaaccggcaagctggaagacatcaacgccatcttcgacgatatgcggcaaggcaatatcgaaggccgcatcgtgatggacctgactcaatag

SEQ ID NO: 84571 - protein, 373 aa, Brucella melitensis 16M
MWQPAVSSPASLMLVSSHSPGTMQVRQRRSNSMAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 84572 - DNA, 1020 bp, Corynebacterium glutamicum ATCC 13032
  CDS (1)..(1020): transl_table=11
atgcccaaatacattgccatgcaggtatccgaatccggtgcaccgttagccgcgaatctcgtgcaacctgctccgttgaaatcgagggaagtccgcgtggaaatcgctgctagtggtgtgtgccatgcagatattggcacggcagcagcatcggggaagcacactgtttttcctgttacccctggtcatgagattgcaggaaccatcgcggaaattggtgaaaacgtatctcggtggacggttggtgatcgcgttgcaatcggttggtttggtggcaattgcggtgactgcgctttttgtcgtgcaggtgatcctgtgcattgcagagagcggaagattcctggcgtttcttatgcgggtggttgggcacagaatattgttgttccagcggaggctcttgctgcgattccagatggcatggacttttacgaggccgccccgatgggctgcgcaggtgtgacaacattcaatgcgttgcgaaacctgaagctggatcccggtgcggctgtcgcggtctttggaatcggcggtttagtgcgcctagctattcagtttgctgcgaaaatgggttatcgaaccatcaccatcgcccgcggtttagagcgtgaggagctagctaggcaacttggcgccaaccactacatcgatagcaatgatctgcaccctggccaggcgttatttgaacttggcggggctgacttgatcttgtctactgcgtccaccacggagcctctttcggagttgtctaccggtctttctattggcgggcagctaaccattatcggagttgatgggggagatatcaccgtttcggcagcccaattgatgatgaaccgtcagatcatcacaggtcacctcactggaagtgcgaatgacacggaacagactatgaaatttgctcatctccatggcgtgaaaccgcttattgaacggatgcctctcgatcaagccaacgaggctattgcacgtatttcagctggtaaaccacgtttccgtattgtcttggagccgaattcataa

SEQ ID NO: 84573 - protein, 339 aa, Corynebacterium glutamicum ATCC 13032
MPKYIAMQVSESGAPLAANLVQPAPLKSREVRVEIAASGVCHADIGTAAASGKHTVFPVTPGHEIAGTIAEIGENVSRWTVGDRVAIGWFGGNCGDCAFCRAGDPVHCRERKIPGVSYAGGWAQNIVVPAEALAAIPDGMDFYEAAPMGCAGVTTFNALRNLKLDPGAAVAVFGIGGLVRLAIQFAAKMGYRTITIARGLEREELARQLGANHYIDSNDLHPGQALFELGGADLILSTASTTEPLSELSTGLSIGGQLTIIGVDGGDITVSAAQLMMNRQIITGHLTGSANDTEQTMKFAHLHGVKPLIERMPLDQANEAIARISAGKPRFRIVLEPNS

SEQ ID NO: 84574 - DNA, 1062 bp, Corynebacterium glutamicum ATCC 13032
  CDS (1)..(1062): transl_table=11
gtgagtatctcagtaaaagcactacaaaagtccggcccagaagcacctttcgaggtcaagatcattgaacgccgtgacccacgcgcagatgatgtggttattgatatcaaagctgcgggcatctgccacagcgatatccacaccatccgcaacgaatggggcgaggcgcacttcccgctcaccgtcggccacgaaatcgcaggcgttgtctctgcggttggatccgatgtaaccaaatggaaagtcggcgaccgcgtgggcgtcggctgcctcgttaactcctgcggcgaatgcgaacagtgcgtcgcaggatttgaaaacaactgccttcgcggaaacgtcggaacctacaactctaacgacgtcgacggcaccatcacccaaggcggctacgctgaaaaggtagtggtcaacgaacgtttcctgtgcagcatcccagaggaacttaacttcgatgtcgcagcaccactgctgtgcgcaggcatcaccacctactccccaatcgctcgctggaacgttaaagaaggcgacaaagtagcagtcatgggcctcggcggactcggacacatgggtgtccagatcgctgcagccaagggtgctgaggttaccgttctgtcccgttccctgcgcaaggcagaacttgccaaggaactcggcgcagctcgcacgcttgcgacttctgatgaggatttcttcaccgaacacgccggtgaattcgacttcatcctcaacaccattagcgcatccatcccagtcgacaagtacctgagccttctcaagccacacggtgtcatggctgttgtcggtctgccaccagagaagcagccactgagcttcggtgcgctcatcggcggcggaaaagtcctcaccggatccaacattggcggcatccctgaaacccaggaaatgctcgacttctgtgcaaaacacggcctcggtgcgatgatcgaaactgtcggcgtcaacgatgttgatgcagcctacgaccgtgttgttgccggcgacgttcagttccgcgttgtcattgatactgcttcgtttgctgaggttgaggcggtttag

SEQ ID NO: 84575 - protein, 353 aa, Corynebacterium glutamicum ATCC 13032
MSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGLGHMGVQIAAAKGAEVTVLSRSLRKAELAKELGAARTLATSDEDFFTEHAGEFDFILNTISASIPVDKYLSLLKPHGVMAVVGLPPEKQPLSFGALIGGGKVLTGSNIGGIPETQEMLDFCAKHGLGAMIETVGVNDVDAAYDRVVAGDVQFRVVIDTASFAEVEAV

SEQ ID NO: 84576 - DNA, 1038 bp, Corynebacterium glutamicum ATCC 13032; identical to SEQ ID NO: 51401
  CDS (1)..(1038): transl_table=11

SEQ ID NO: 84577 - protein, 345 aa, Corynebacterium glutamicum ATCC 13032; identical to SEQ ID NO: 51402

SEQ ID NO: 84578 - DNA, 1017 bp, Streptococcus pyogenes MGAS8232; identical to SEQ ID NO: 51403
  CDS (1)..(1017): transl_table=11

SEQ ID NO: 84579 - protein, 338 aa, Streptococcus pyogenes MGAS8232; identical to SEQ ID NO: 51404

SEQ ID NO: 84580 - DNA, 1128 bp, Methanosarcina acetivorans C2A
  CDS (1)..(1128): transl_table=11
ttgaggaaattaagaattcgaattgaagttaaaagttacaaagtaaataagaggtgcataaatatggcggaaaatattcaatcaaaaggttatgctggaaaagatgagtcaggaaagctagttccctggtcttttgaaagaagacctgtaggtaataatgacattctaattgacattaaatactgtggagtttgtcattccgacattcatcagatcaaaggacactggggaccacaacaatatccacaagtgcctggtcatgaaattgtgggtgtggttgctgctgttggaaagaacgtaacaaacttcaaagtcggtgatcgtgcaggagtcgggtgcatggttagcagttgtatggagtgtgaaagctgcaagaatggtgaagaacatcattgcgacaacaatgcaactataatgacatatggttatctggaagaatcatcacctacaggtataagccagggaggatattcccaaaatatcgttgtcgccgagcattttgcgataaagatacccgactccatagatcttcaggaagctgctccattactatgtgccggtattactatttattcacctttaatgaaagctaatatcaaaaaaggggacaaggtaggagttgcaggaattggtggactgggacacatggctattaaattagccgtatcaaaaggtgccgaagtttatgcctttacaaccactgaaagcaaaaaagaagattgccttgcattcggagcaacggaagttattgttgttaactcaccaagcgacctacaaccatggaaaggaaaaatggattacatgatatccacaattccatacgcatacgaaatgtcatcatacattgattgcgtaaaaccatacggatacttcactcaagtaggacaaccaattggaggagaactcacaattaacaacttcaatatgattttcaacagagtaaacttcaatggatcacttattggaggaatcccggaaactcaggaagtggttgattattgtgcagaaaataagatctatccacaaattcggatgatcgaacctgaaatgatcaatgagacatgggataaggtcgtaaataaagaagctcgctatcgatatgtaattgacatgtcatccttaaaataa

SEQ ID NO: 84581 - protein, 375 aa, Methanosarcina acetivorans C2A
MRKLRIRIEVKSYKVNKRCINMAENIQSKGYAGKDESGKLVPWSFERRPVGNNDILIDIKYCGVCHSDIHQIKGHWGPQQYPQVPGHEIVGVVAAVGKNVTNFKVGDRAGVGCMVSSCMECESCKNGEEHHCDNNATIMTYGYLEESSPTGISQGGYSQNIVVAEHFAIKIPDSIDLQEAAPLLCAGITIYSPLMKANIKKGDKVGVAGIGGLGHMAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIRMIEPEMINETWDKVVNKEARYRYVIDMSSLK

SEQ ID NO: 84582 - DNA, 1137 bp, Streptomyces coelicolor A3(2)
  CDS (1)..(1137)
atgaggaccaccgtgggctggcaggcgaccgggccgacgctgcgccgcgcaccgctggaacggcgcgacctgcgccccgacgacctcgccgtccgggtcgactactgcggcgtctgccacacggacctgcacgccgtccgggccggggccgccgacggcagcggcccgcggcccctcgtaccggggcacgagttcacgggcgtggtgaccgagaccggcaccgccgtcacccgcttccggcccggagacccggtcgcggtcggcaacatcgtcgactcctgcggcacctgcgccatgtgccggatcggccaggagaacttctgccactccttccccaccctgacctacggcggcaccgaccgccgcgacggatcgaccaccctcggcggctactcccgtgagtacgtgctcggcgaacggttcgcgtacgccctcccggccgctctggacccggccgccgccgccccgctcctgtgcgccgggatcaccgtctgggagcccctgcgcgccctcggcgccggacccggcacccgcgtcgccgtggccggtctcggcggcctcggccacctcgccgtgaaactcgcggtcgcgctcggcgccgacacctcggtgatcagccggtcgccggacaaggccgaggacgcgcgcagactgggcgcgcgtgaactcgtcgtctcgacggaccccgagcggttggccgccgcccgcgagcggttcgacatcgtcgtggacaccgtctccgccccgcacgacctcggcgcctacctccgcctggtcgcgctggacggcacgctcagccacctcgggcacctcggaccggtcaccgtggagaccctcgacctgctcatcggccgcaagaaactcagctccgcgggcagcggcggccggaagggcaccgccgagatgctggccttctgcgccgagcacggcatcaccgccgacatcgaactcctcccctccgcccgcgtgaacgaggccctcgaccgcctggaccggggcgacgtccgccaccgcttcgtcctcgacctctccgacctcgaccactccggactccccgacctcggcctctccgacccctccgaccccgacctccgcggcccggatcggtccgggccgcaggacccggcggccggatag

SEQ ID NO: 84583 - protein, 378 aa, Streptomyces coelicolor A3(2)
MRTTVGWQATGPTLRRAPLERRDLRPDDLAVRVDYCGVCHTDLHAVRAGAADGSGPRPLVPGHEFTGVVTETGTAVTRFRPGDPVAVGNIVDSCGTCAMCRIGQENFCHSFPTLTYGGTDRRDGSTTLGGYSREYVLGERFAYALPAALDPAAAAPLLCAGITVWEPLRALGAGPGTRVAVAGLGGLGHLAVKLAVALGADTSVISRSPDKAEDARRLGARELVVSTDPERLAAARERFDIVVDTVSAPHDLGAYLRLVALDGTLSHLGHLGPVTVETLDLLIGRKKLSSAGSGGRKGTAEMLAFCAEHGITADIELLPSARVNEALDRLDRGDVRHRFVLDLSDLDHSGLPDLGLSDPSDPDLRGPDRSGPQDPAAG

SEQ ID NO: 84584 - DNA, 1041 bp, Streptomyces coelicolor A3(2)
  CDS (1)..(1041)
atgaccactgtcgccgcgtacgcagcacccgccgccaaggcgccgctggagcgcaccaccatcgagcggcgcgaggtgcgtgaacacgacgtcctgatcgacatcaagttcgccggcatctgccactccgacatccaccaggcccgcgagggctggggcgaggccatcttcccgatggtccccggccacgagatcgcgggcatcgtgtccgaggtcggccccggcgtcaccaggttcaaggtcggcgaccgggtgggcgtcggctgcatggtcgactcctgccgcgagtgcgagaactgcaaggccggccgggagcagtactgcaccagcggcaacaccggcacgtacaacgccgtcggcagggacggcgaggtcacctacggcggctactccgagaaggtcgtcgtcgacgagaacttcgtcctcggcatccccgagggcatcgccctggacgaggccgcccccctgctgtgcgccggcatcaccacctactccccgctcaagcgctggaacgcgggtcccggcaagaaggtcgccgtcgtcggcctgggcggcctcggtcacatggccgtcaagctcgcgcacgccctgggcgccgaggtgaccgtgctgtcgcagtccctgcgcaagaaggacgacggcctgaagctgggcgccgaccactactacgccaccagcgacccggccaccttcgaggagctgtccggcaccttcgacctgatcgtctccacggtctcggccccgctcgacctcggcgcctacctggggctgctgaagacggagggcacgctggccaacgtcggcgcccccgaggagccggtctccctcaacctgttcgcgctgctcggcgggggcaagtccctctccggctccatgatcggcggtatcgccgagacccaggagatgctggacttctgcgcggagcacggcatcggtgccgagatcgagctgatcgccgcctccgagatcaacgaggcctacgagcgcgtcctgtccagcgacgtgcgctaccgcttcgtgatcgacaccgcgacgatctga

SEQ ID NO: 84585 - protein, 346 aa, Streptomyces coelicolor A3(2)
MTTVAAYAAPAAKAPLERTTIERREVREHDVLIDIKFAGICHSDIHQAREGWGEAIFPMVPGHEIAGIVSEVGPGVTRFKVGDRVGVGCMVDSCRECENCKAGREQYCTSGNTGTYNAVGRDGEVTYGGYSEKVVVDENFVLGIPEGIALDEAAPLLCAGITTYSPLKRWNAGPGKKVAVVGLGGLGHMAVKLAHALGAEVTVLSQSLRKKDDGLKLGADHYYATSDPATFEELSGTFDLIVSTVSAPLDLGAYLGLLKTEGTLANVGAPEEPVSLNLFALLGGGKSLSGSMIGGIAETQEMLDFCAEHGIGAEIELIAASEINEAYERVLSSDVRYRFVIDTATI

SEQ ID NO: 84586 - DNA, 1059 bp, Xanthomonas campestris pv. campestris str. ATCC 33913
  CDS (1)..(1059): transl_table=11
atgagcaaagcccacgcctacgccgcccaaaccgccgaccagccgctggcgccgttcgtcttcgaacgtcgcgcgcccggtcccgacgatgtgcagatcgacatcgcctactgcggtgtgtgccactcggacctgcacaccgcacgcaacgaatggcacaacacggtgtatccctcggtgccgggccacgagatcgtgggccgcgtcactgccgtcggcagcgccgtgaccaacttcaaggtcggtgacctggccggtgtgggttgcatggtcgacagctgccgcagctgcgcctcctgccaggaaggcgaggagcaatattgcgaacagggcttcaccggcacctacaacggcccgatgtttggcggcggcgagaacacctatggcgggtactccgaccatatcgtggtggaccagaagtacgtgctgcacatttcccacagcgacaacctggccgccgtggccccgttgttgtgcgcgggcatcaccacctattcgccactggcgcattggaaggttggccccgggcagaaggtgggcgtggtcggcctgggtggcctgggccacatggcggtgaagatcgccaaggccatgggcgccaccgtggtgctgttcaccacctccgaaagcaagcgcgccgatgcgctgcgcctgggcgccagtgaagtggtcatttccaaggacgaggcgcagatggccgcgcagtacaacaccctggatttcatcctcaacaccgtggccgcgccgcacaacctggacccgttcctcaatgcgctcaagcgcgacggcgcgatggtgctggtgggcgtgcccgaacattcgcatccgtcaccggcggtgttcaacctggtaatgaagcgccgcacgctggccggttcgttgatcggcggcatccgccagacccaggaaatgctcgatttctgcgccaagcacaacatcgtctccgacatcgaaaccatccgcgccgaccagatcaacgaggcctacgagcgcatgctcaagggcgacgtgaagtaccgcttcgtaattgatatggacacgctggccaaggcggcctga

SEQ ID NO: 84587 - protein, 352 aa, Xanthomonas campestris pv. campestris str. ATCC 33913
MSKAHAYAAQTADQPLAPFVFERRAPGPDDVQIDIAYCGVCHSDLHTARNEWHNTVYPSVPGHEIVGRVTAVGSAVTNFKVGDLAGVGCMVDSCRSCASCQEGEEQYCEQGFTGTYNGPMFGGGENTYGGYSDHIVVDQKYVLHISHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAMVLVGVPEHSHPSPAVFNLVMKRRTLAGSLIGGIRQTQEMLDFCAKHNIVSDIETIRADQINEAYERMLKGDVKYRFVIDMDTLAKAA

SEQ ID NO: 84588 - DNA, 1059 bp, Xanthomonas axonopodis pv. citri str. 306
  CDS (1)..(1059): transl_table=11
atgagcacagcccacgcctacgctgcccaggccgccgatcaaccacttgccccattcgtgttcgaacgccgtgcgcccggccccaacgacgtgcagatcgacatcgcctactgtggcgtgtgtcactcggacctgcataccgcacgcaacgaatggcacaacacgctgtacccctcggtgcccggccacgagatcgtcggccgcgtcacggcggtgggcaatgcggtcaccggcttcaaggtcggcgacctggccggtgttggctgcatggtcgacagctgccgcagctgcgcctcctgccaggaaggcgaagaacagtattgcgaagccggcttcaccggcacctacaacgggccgatgttcggcggcggcgagaacacctacggcggctattccgaccatatcgtggtcgaccagaagtacgtgctgcgcatcacccacagcgacaacctggccgcggtggcaccgctgctgtgcgccggcatcaccacctattcgccgctggcgcactggaaggtaggcccgggccagaaggtgggcgtggtcggtctcggcggcctgggccatatggcggtgaagatcgccaaggcgatgggcgctaccgtggtgctgttcaccacctccgaaagcaagcgcgccgatgcgctgcgcctgggcgccagcgaagtggtgatttccaaggacgaagcgcagatggccgcgcagtacaacaccctggatttcatcctcaacaccgtggccgcgccgcataacctggacccgttcctcaacgcgctcaagcgcgatggcgccattgtgctggtcggcgtgcccgagcagtcgcacccgtcgccggcggtgttcaacctggtgatgaagcgccgcacgctggccggttcgctgatcggcggcatccgccagacccaggaaatgctggatttctgcgccaagcacaacatcgtctcggacatcgaaaccatccgcgccgaccagatcaacgaggcctacgagcgcatgctcaagagcgacgtgaagtaccgcttcgtgatcgatatggcgaccttggatcaggcggcttga

SEQ ID NO: 84589 - protein, 352 aa, Xanthomonas axonopodis pv. citri str. 306
MSTAHAYAAQAADQPLAPFVFERRAPGPNDVQIDIAYCGVCHSDLHTARNEWHNTLYPSVPGHEIVGRVTAVGNAVTGFKVGDLAGVGCMVDSCRSCASCQEGEEQYCEAGFTGTYNGPMFGGGENTYGGYSDHIVVDQKYVLRITHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAIVLVGVPEQSHPSPAVFNLVMKRRTLAGSLIGGIRQTQEMLDFCAKHNIVSDIETIRADQINEAYERMLKSDVKYRFVIDMATLDQAA

SEQ ID NO: 84590 - DNA, 1017 bp, Chlorobium tepidum TLS
  CDS (1)..(1017): transl_table=11
atggtgctggagcgggttgtcgatcttttgcacgagacgcaaccgctggttctgcgggagttgcccgttcccgagccggggccgggggagattctgttgagggtcgccacctgtggcgtctgccacacggagcttgacgaaatcgaggggcgcacgccgccgccgcgatttccggtgattccgggacatcaggtcattgggcgggttgttgcctgcggcgatggcgtcgcgggcatcgaaaccggcagtcgacgcggggtggcgtggatttactcttcgtgtggtcactgcgacctctgccgctccggtaacgaaaacctctgcgcggagttcagcgcgacaggccgcgacgccgatggaggctacgcggagtatatggtggctccggcggccttcacctattccattcccgatgtgttctccgacgccgaggccgctccgctcctctgcggcggcgcgatcggctaccgttcgctgatgctcgcaaacctcaaagatggtcagattctcggcctgaccgggttcggcgcatcgggccatcaggtgctcaaactcgctcgctatctctatccaaaatctccggtcttcgtcttcgcccgaagcgaaaaagactgcgatttcgcccgctcgcttggcgcggactgggctggcggtaccacagacaactcgccgtcgccctgtgattccattatcgatacgacgcccgcctggttgccagtgctttcggcgctcgaacggcttcggcccggcggacggctcgtcatcaatgcgatccgcaaggagtcgcacgatagcgagttgctcgcgggcatttcctacgaacggcacctctggatggagaaggagatcaaaagcgtggccaacattacgcgggccgatgtgtcggcgttcctcgacatcgccgcccgcatggggctgaagccggaggtgcggagctatccgctcgaagaggccaaccgtgtgctgctcgatctgcgtcacggaaaagcccgcggtgctgcggtactcattccataa

SEQ ID NO: 84591 - protein, 338 aa, Chlorobium tepidum TLS
MVLERVVDLLHETQPLVLRELPVPEPGPGEILLRVATCGVCHTELDEIEGRTPPPRFPVIPGHQVIGRVVACGDGVAGIETGSRRGVAWIYSSCGHCDLCRSGNENLCAEFSATGRDADGGYAEYMVAPAAFTYSIPDVFSDAEAAPLLCGGAIGYRSLMLANLKDGQILGLTGFGASGHQVLKLARYLYPKSPVFVFARSEKDCDFARSLGADWAGGTTDNSPSPCDSIIDTTPAWLPVLSALERLRPGGRLVINAIRKESHDSELLAGISYERHLWMEKEIKSVANITRADVSAFLDIAARMGLKPEVRSYPLEEANRVLLDLRHGKARGAAVLIP

SEQ ID NO: 84592 - DNA, 1041 bp, Oceanobacillus iheyensis HTE831
  CDS (1)..(1041): transl_table=11
atgtatactgctaaagcaagggctgtcgatgggccacatcaaccatttcacgcaacggaaattaaacggcgtaatcttgattcacatgatgttttaatcgagattaagtattcaggtatatgccattctgacattcatactgctcatggtgagtggggagaagtaaattatcccctagtaccaggacatgaaattgctggggtagtatcagatgttggacctgaagttaccaaatataaggttggtgaccgagtaggagtaggatgtatggttgactcttgtggcgaatgtgaaaattgccgcagaggagaagaacaatactgtcatcaaggaaatgtccaaacttatggcggtgttgataaatatggtgaaccaactcaaggcggatactctactcatattgtcgtaacagaagattttgtactcagaattcctgataatatcgaattggatgttgcagcaccgttactctgtgctggtattacaacgtattctccattaaatcattggaatgctggtccaggaaagaaagtagctgttgttggtatgggcggcctcggtcatatggctgttaagattgcacatgctatgggagcagaggttacggttttatccagaacattaaataaaaaagaagatggactggaattcggagcagaaaattattatgctactagtgagaaagaaactttcgagacacttgcgggatcatttgatttaattattaatacagtaagtgccaagcttgatatggatgcttactttagtcttctaaatcttgatggttccttggtaaatgtcggagcaccggcagaaccattgtccgttaatgtattctctctgattggacatcgccgttcatttgctggttctttaatcggaggaattcgcgaaactcaggaaatgctagatttctgtgcagagcataatattgttccaaaaattgaagtgatttctgcagatcaaattgatgaagcatatacacgagtattagattcagatgtgaaatatcgctttgttattgatgtcagcacaatttaa

SEQ ID NO: 84593 - protein, 346 aa, Oceanobacillus iheyensis HTE831
MYTAKARAVDGPHQPFHATEIKRRNLDSHDVLIEIKYSGICHSDIHTAHGEWGEVNYPLVPGHEIAGVVSDVGPEVTKYKVGDRVGVGCMVDSCGECENCRRGEEQYCHQGNVQTYGGVDKYGEPTQGGYSTHIVVTEDFVLRIPDNIELDVAAPLLCAGITTYSPLNHWNAGPGKKVAVVGMGGLGHMAVKIAHAMGAEVTVLSRTLNKKEDGLEFGAENYYATSEKETFETLAGSFDLIINTVSAKLDMDAYFSLLNLDGSLVNVGAPAEPLSVNVFSLIGHRRSFAGSLIGGIRETQEMLDFCAEHNIVPKIEVISADQIDEAYTRVLDSDVKYRFVIDVSTI

SEQ ID NO: 84594 - DNA, 1035 bp, Brucella suis 1330
  CDS (1)..(1035): transl_table=11
atggcaaagacgatgaaagctgcggtcgtgcgtgccttcggcaaaccgctgacgattgatgaagtgccgatacctcaacccggtcccggccagattcaggttgccattcaggcttccggcgtatgccataccgaccttcatgccgccgagggcgattggccggtaaaacccaatccgcccttcattccgggtcatgagggtgtcggtttcgtttccgccgtgggcagcggcgtcaagcatgtcaaggaaggcgaccgtgtcggcattccatggctttacactgcctgcggccattgccgccattgccttggtggctgggaaacgctttgcgaggaacagctcaataccggctattccgtcaatggcggctttgccgaatatgtggtggccgatccgaatttcgtcggccacttgccgaagaatatcgatttcaacgagattgcgccggtgctctgcgcgggcgtgacggtctataagggcctcaaggtcacggatacgaagcccggtgactgggtggtcatttcaggcataggcgggctcggccacatggctgtgcaatatgccagggccatggggctgaatgttgccgccgtcgatattgacgaccgcaagctcgatctcgcccgcagacttggcgcaaccgttacggtcaacgctaagacggttgccgacccggcagcctatattcgcaaggaaaccgatggcggtgcgcaaggcgtgctggtgacggcggtttcgcccaaggcttttgaacaggcgctgggcatggttgcgcgcggcggtactgtttcgctgaatggcctgccgcctggcgatttcccgctttccatcttcaacatggtgctcaatggcgtaacggtgcgcggctccatcgtggggacgcggcttgatttgcaggaatcgctcgattttgcagccgacggcaaggtcaaggccaccatccaaaccggcaagctggaagacatcaacgccatcttcgacgatatgcggcaaggcaatatcgaaggccgcatcgtgatggacctgactcaatag

SEQ ID NO: 84595 - protein, 344 aa, Brucella suis 1330
MAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCRHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 84596 - DNA, 1011 bp, Shigella flexneri 2a str. 301
  CDS (1)..(1011): transl_table=11
atgaagactgcagttgttacgaaggatcatcatgttgacgttacggataaaacactgcgctcactgaaacatggcgaagccctgctgaaaatggagtgttgtggtgtatgtcataccgatcttcatgttaagaatggcgattttggtgacaaaaccggcgtaattctgggccatgaaggcatcggtgtggtggcagaagttggcccaggtgtcacctcattaaaaccaggcgatcgtgccagcgtggcgtggttttacgaaggatgcggtcattgcgaatactgtaacagtggtaacgaaacgctctgccgttcagttaaaaatgccggatacagcgttgatggcgggatggaggaagagtgcatcgtggtcgccgattacgcggtaaaagtgccagatggtctggactcggcggcgcccagcagcattacctgtgcgggggtcaccacctacaaagccgttaaactgtcaaaaattcgtcccggtcagtggattgctatctacggtcttggcggtctgggtaacctcgccctgcaatacgcaaagaatgtctttaacgccaaagtgatcgccattgatgtcaatgatgagcagttaaaactggcaaccgaaatggatgcagatttagcgattaactcacgcaccgaagacgccgccaaaattgtgcaggagaaaaccggtggcgctcacgctgcggtggtaacagcagtagctaaagctgcgtttaactcggcagttgatgctgtccgtgcaggcggtcgtgttgtggctgtcggtctgccgccggagtctatgagcctggatatcccacgtcttgtgctggatggcattgaagtggtcggttcgctggtcggcacgcgccaggatctaaccgaagccttccagtttgccgccgaaggcaaagtggtgccgaaagtcgccctgcgtccgttagcggacatcaacaccatctttaccgagatggaagaaggcaaaatccgtggccgtatggtgattgatttccgtcactaa

SEQ ID NO: 84597 - protein, 336 aa, Shigella flexneri 2a str. 301
MKTAVVTKDHHVDVTDKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMEEECIVVADYAVKVPDGLDSAAPSSITCAGVTTYKAVKLSKIRPGQWIAIYGLGGLGNLALQYAKNVFNAKVIAIDVNDEQLKLATEMDADLAINSRTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 84598 - DNA, 1023 bp, Corynebacterium efficiens YS-314
  CDS (1)..(1023): transl_table=11
atgaccactttccgagctgccctcgtcgagtccttcgacgccgacattgccgtcaaggacgttgaacgccccaccccggggccgaaccaggccctggtcaagctcatcgcctccggcatttgccacacggaccttcatgccgccaagggtgactggcccgtgctgcctgagccaccgttcatcccgggccatgagggcatcggagagatcgtcgaactcgggcccggcgagcatgacgttgcggtgggggacatcgtcggtaatgcgtggctctggtccgcctgcgctaactgcgagttctgccgcactggtcgcgagactttctgcccgaacgcgcagtacggcggttacacccagaacggctccttcggtgagtacatgctcgtggatacgcgctttgcgccccgcatcccggatggtgtggactatctcgaggccgccccgattctctgtgctggtgtgacggtgtataaggcgttgaaggtatcgaatatccggccgggccagttcatggtcatctccggtatcggcggcctgggccacatcgccgtccagtacgccaaggcgatgggcatgcgccccatcgcggtggatatcgccgactccaagctggaactggcaaagtcactcggtgcggagttcaccgtcaacgcgagggatgttgacccggccgaggcggtccgggagttcacaaatggtggcgcacacggtgtgcttgtcaccgcggtccatgagaaggcgttcggccaggctctcggtatggcgcgcaccaacggcaccattgtgttcaatggcctgccgccaggggagttcccggtctcggtctttgatgttgttttccggggtttgaccatcaccggttccctggtgggtacccgccaggacatggaggaggcgctggacttctacgcccgcggcctgatcaagccgaaggttgccgagtgcgggcttgacgacgtcgccgatgtcttcgagaagctcgagagtggcggcatcgacggtcgtgtggcgatccgctactaa

SEQ ID NO: 84599 - protein, 340 aa, Corynebacterium efficiens YS-314
MTTFRAALVESFDADIAVKDVERPTPGPNQALVKLIASGICHTDLHAAKGDWPVLPEPPFIPGHEGIGEIVELGPGEHDVAVGDIVGNAWLWSACANCEFCRTGRETFCPNAQYGGYTQNGSFGEYMLVDTRFAPRIPDGVDYLEAAPILCAGVTVYKALKVSNIRPGQFMVISGIGGLGHIAVQYAKAMGMRPIAVDIADSKLELAKSLGAEFTVNARDVDPAEAVREFTNGGAHGVLVTAVHEKAFGQALGMARTNGTIVFNGLPPGEFPVSVFDVVFRGLTITGSLVGTRQDMEEALDFYARGLIKPKVAECGLDDVADVFEKLESGGIDGRVAIRY

SEQ ID NO: 84600 - DNA, 1164 bp, Corynebacterium efficiens YS-314
  CDS (1)..(1164): transl_table=11
atgcgatcgcagtccagctgccaccccggtgacaacaccggccctggggttaagctgggacacgttctgcccagcgacgttgaaagtgagcatctcaacatgaccaccccacaccaccccacgccggtccgtgcctggggcgtgaccgccttcgcccagcccctggagtccctcaccatcacccgccgtgaactgcgcgccgatgatgtttccatcgacatcgagtacgcaggcatctgccactcggatatccacaccgccaccggtgactggggtgagcgggagtacccgctggtgccgggacatgagatcgtcgggcgggtcagtgcggtcggcgatgcggtgaccaaacaccgggtcggtgaccgcgtgggcgtggggtgtttcgtcaactcctgtgggcactgcgagccctgccgtgcgggtgagcattcctactgcgacaccggggcggtcctgacctacgggtcggaggaccgctacgccgacggtgagtacacccagggcgggtactcgcaggcgatcgtggtcaaggaggatttcgtggtccgcgtgccggagtccctggacccggcggccgccaccccgctgctgtgcgcgggcatcaccacctactcaccgctgaagcaccacggggcgggaccggggaagaaggtcggcatcatcggcctgggtggcatcggccacgtggcggtgaagatcgccgtggccatgggcgcggaggtggtggtgttctcccattccacctccaagcgggaggacgccctgaaattcggtgccaccgagcacgtctccaccgcggacccaaccttcgccgagacctggggtgggcagttcgacctcatcctcaacaccgtcagcgtcaacctcgacaccgccacctacctgtcgctgctgtgtttcgacggtgccctcgttgccctcggcctgccgaatgaccccatggaggtacccacccggatgctcacctccaagcgacgcactctcaccggttcgctcgtcggtggcatcccggagacccaggagatgctggacttctgcgcggagcacaacatcaccgcggagatcgagctcatcgacgccacctccatcaacgaggcctatgagcgcaccatcaactcagatgtgcgctaccgcttcgtcatcgacgccgcgaccttctag

SEQ ID NO: 84601 - protein, 387 aa, Corynebacterium efficiens YS-314
MRSQSSCHPGDNTGPGVKLGHVLPSDVESEHLNMTTPHHPTPVRAWGVTAFAQPLESLTITRRELRADDVSIDIEYAGICHSDIHTATGDWGEREYPLVPGHEIVGRVSAVGDAVTKHRVGDRVGVGCFVNSCGHCEPCRAGEHSYCDTGAVLTYGSEDRYADGEYTQGGYSQAIVVKEDFVVRVPESLDPAAATPLLCAGITTYSPLKHHGAGPGKKVGIIGLGGIGHVAVKIAVAMGAEVVVFSHSTSKREDALKFGATEHVSTADPTFAETWGGQFDLILNTVSVNLDTATYLSLLCFDGALVALGLPNDPMEVPTRMLTSKRRTLTGSLVGGIPETQEMLDFCAEHNITAEIELIDATSINEAYERTINSDVRYRFVIDAATF

SEQ ID NO: 84602 - DNA, 1089 bp, Corynebacterium efficiens YS-314
  CDS (1)..(1089): transl_table=11
atgtgcgcgtggcctacactgcgccgcgccactatcctggctcgcatgacaattccagtgaaggcactgcagaagaccgggccggacgcaccattccagatcacgacgatccagcgccgcagcccgcgggcggatgacgtggtgatcgacatcaaggccgccggtatctgccacagcgatatccacactgtccgcaacgaatggggcgaggcgaatttcccactgaccgtcggccatgagatcgccggtgtggtctccgccgtgggttccgaggtcaccgactggaaggtcggtgaccgcgtcggcgtgggctgcctggtggattcctgtggcacctgcgagatgtgccagcagggctttgagaaccactgcctcaacggcgcggtgggcacctacaactcggtggacgtggacggcaccataacccagggcggttatgccgagaagatcgtcgtgtccgagcggtttgtctgccggatccccgacgcactggatttcgatgtcgccgctcccctgctgtgcgccggcatcaccaccttctcccccatcgtccagtggaatgtgaaggaaggcgacaaggtcgcggtcatgggcctgggcggcctggggcacatgggcgtgcagatcgctgccgccaagggcgctgaggtgaccgtgctgtcgcgctcgctgaagaaggcggaggtggcgaagtccctcggcgccgtgcggaccctggcgacctccgatgagagcttcttcaacgactaccgcggggaattcgacttcatcctcaacaccatcagcgccaacatcaacctcggcgcctacctgggcctgctcaagccccgcggggtgatggccgtggtgggtctgccaccggagaagcagcccctgagcttcggttccctcatcggcggcagcaaggtgctcaccggctccaatatcggcggcatcccggagacccaggagatgctggatttctgcgccgagcacggcctgggggcgcggatcgagaagatcagtgttcatgaggtggatgaggcctatgaccgcgtggtggccggtgatgtgcagttccgttttgtgattgacaccagcacgttctag

SEQ ID NO: 84603 - protein, 362 aa, Corynebacterium efficiens YS-314
MCAWPTLRRATILARMTIPVKALQKTGPDAPFQITTIQRRSPRADDVVIDIKAAGICHSDIHTVRNEWGEANFPLTVGHEIAGVVSAVGSEVTDWKVGDRVGVGCLVDSCGTCEMCQQGFENHCLNGAVGTYNSVDVDGTITQGGYAEKIVVSERFVCRIPDALDFDVAAPLLCAGITTFSPIVQWNVKEGDKVAVMGLGGLGHMGVQIAAAKGAEVTVLSRSLKKAEVAKSLGAVRTLATSDESFFNDYRGEFDFILNTISANINLGAYLGLLKPRGVMAVVGLPPEKQPLSFGSLIGGSKVLTGSNIGGIPETQEMLDFCAEHGLGARIEKISVHEVDEAYDRVVAGDVQFRFVIDTSTF

SEQ ID NO: 84604 - DNA, 1053 bp, Pseudomonas putida KT2440
  CDS (1)..(1053): transl_table=11
atgtataccgccatcggttatgccgctcaaacccccaccagccccctggcccccatgacgttccaacgccgcagcccgcgcccggatgacgtcgccatcgacatcctgtactgcggcgtgtgccactccgacatccaccaggcgcgcaacgaatggggcattgccgtgtacccgctgatgccgggccacgagatcatcggccgggtcacggcggtgggcgacaaggtcaccgcgcacaaggtcggtgacctggtgggcgtcggctgcatggtcgactcgtgccgtacctgtgaagcctgcgccaaggacctggagcaatattgcctcgaaggcccgaccatgacctacgccaccccggaccgggtcgacggcagcaacaccatgggcgggtactccagcagcatcgtggtcagcgagcacttcgtggtgcgcataccggccggcatggacctgcccagcgctgcacctattctgtgtgccggcatcaccacctattcgccgctcaagcaccacggcgttggcccaggccacaagatcggcatcctcggcatgggcggcctgggccacatgggcatcaaactggccaaggccctgggtgcggaagtgaccctgtttacgcgctcccaagccaaggccgaggaagctcgccgccagggggccgaccatgtgatcgtctccaccgatgccgagcagatgcgcgccgctgccggtcgtttcgatttcctgctcgacaccattccggtgcagcacgacctcaacccgtacctggaaacgctgaagttcgacggtgtgcacatcctggtcggcctgatcgaaccgatcgacccggcattgcatgcggccaatctggtgatgaagcgccgggtgctggcggggtcgttgatcggggggattgccgagactcaggaagtgctggacttctgcgccgagcacgacatccgttgcgatatcgagatgctggatatccgcaacatcaaccaggcctatgagcggatgattgccggtgatgtgaagtaccggttcgtgatcgacatggccacgctacagggctga

SEQ ID NO: 84605 - protein, 350 aa, Pseudomonas putida KT2440
MYTAIGYAAQTPTSPLAPMTFQRRSPRPDDVAIDILYCGVCHSDIHQARNEWGIAVYPLMPGHEIIGRVTAVGDKVTAHKVGDLVGVGCMVDSCRTCEACAKDLEQYCLEGPTMTYATPDRVDGSNTMGGYSSSIVVSEHFVVRIPAGMDLPSAAPILCAGITTYSPLKHHGVGPGHKIGILGMGGLGHMGIKLAKALGAEVTLFTRSQAKAEEARRQGADHVIVSTDAEQMRAAAGRFDFLLDTIPVQHDLNPYLETLKFDGVHILVGLIEPIDPALHAANLVMKRRVLAGSLIGGIAETQEVLDFCAEHDIRCDIEMLDIRNINQAYERMIAGDVKYRFVIDMATLQG

SEQ ID NO: 84606 - DNA, 1011 bp, Pseudomonas putida KT2440; identical to SEQ ID NO: 51423
  CDS (1)..(1011): transl_table=11

SEQ ID NO: 84607 - protein, 336 aa, Pseudomonas putida KT2440; identical to SEQ ID NO: 51424

SEQ ID NO: 84608 - DNA, 1089 bp, Mycoplasma penetrans HF-2
  CDS (1)..(1089): transl_table=4
atgtattttaattgtttgaaaggtatatgtatgatagatattactaaaagaattacaactaaagggaaagcattattttctaaagatggaaaaattgaagattttacttttgaaagaagagctttaaatgatgatgacatattaatcaaaataaaatattgtggtatttgtcacagtgacattcaccatggtagaagtgaatgaggaaaagctaattatccaacagtgatgggtcatgaaatagttggagaagtagttgcaacaggtaataaagtttctaaattcaaagttggagataatgcaggaattggatgtatggttaacagctgtggtaattgtgatagctgtaaagtgagtgaagaacaatattgtaatgatatggttgtaacatatggtggactagataaattcaataataatgaaatgacatatggtggatattcaaattattatgttgtaaaagaaagctttgcaattaaagttcctcaaaatgttccattagagtatattgctcctttattttgtgctgggataacaacttattcaccgattgttttttcaaaagttaaaaaaggtgataaagtagctattgctggttttggtgggcttggagtaatggcagttaaatatgcaaaattcttaggtgcagatgtatatgttattgctagaaacaataagaaagaagaagaagctaaaaaactaggtgttaaaaaactatatccttctgttgaaagtgttgatgaaaaatttgatttaataatttctactattcctacaaaatatgaagtaatggattatgttaatttattaaaagtaggtggagaattagcattattaggtctaccacctgtagaagaaggatgatctttatatccaggtaatctaatcttcaaaggacatcgtaaagtttatggatcaatcattggtggtattaaagctactcaagaaatgttagacttctctattaaacataacatttatcctgaaatcgaagtaattagtgcagatcaaataaatgaagcttttgaaaaaatgactacaggaaaagctaaatttagatatgttattgatatgagcactttaaaataa

SEQ ID NO: 84609 - protein, 362 aa, Mycoplasma penetrans HF-2
MYFNCLKGICMIDITKRITTKGKALFSKDGKIEDFTFERRALNDDDILIKIKYCGICHSDIHHGRSEWGKANYPTVMGHEIVGEVVATGNKVSKFKVGDNAGIGCMVNSCGNCDSCKVSEEQYCNDMVVTYGGLDKFNNNEMTYGGYSNYYVVKESFAIKVPQNVPLEYIAPLFCAGITTYSPIVFSKVKKGDKVAIAGFGGLGVMAVKYAKFLGADVYVIARNNKKEEEAKKLGVKKLYPSVESVDEKFDLIISTIPTKYEVMDYVNLLKVGGELALLGLPPVEEGWSLYPGNLIFKGHRKVYGSIIGGIKATQEMLDFSIKHNIYPEIEVISADQINEAFEKMTTGKAKFRYVIDMSTLK

SEQ ID NO: 84610 - DNA, 1023 bp, Staphylococcus epidermidis ATCC 12228
  CDS (1)..(1023): transl_table=11
atgaaagcagctgtagtaaccaaagatcatagagtaagtattgaagaaaaacgtttaagagaattaagacctggagaagcattagtaaagactgaatattgtggtgtatgtcatactgatttacatgttaaaaatgcagatttcggtgacgtaacaggtgtaacattaggacatgaaggaattggacgtgtcattaaaattgctgataacgtagattcattaaaggtaggggatcgtgtatctatagcatggatgtatgcagcatgtggtaattgtgagtattgcacaactggtagagaaacattatgcagggatgtccttaatgccggatatactgttgatggggcaatggctgaagaagtcattgttgatgcgaattatgcagttaaagttcccgaaaatcttgatccagcggctgcttcatctattacctgtgcaggtgtgacaacatataaagcagtaaaagtgagtggtatcgaaccaggacaatggttaggcgtatttggtgtgggaggattaggtaatttagcattgcaatacgccaaaaacgtaatgggcgcgaaagtcgttgcatttgacattaatgatgataaattaaattttgctaaagagcttggtgctgatgcaatcataaattcaactaatgttgatcctattgaggaagttaatcgtctaacgaataataaaggattagatgcaacggtgattactgctgtagctaaaacaccttttaatcaagcagttgatgttgttaaggcgggtgcacgtgtggtagcagtaggacttccagtagataaaatggatttagatattccacgtttagtgcttgatggaattgaagtcgttggttcattagttggtaccagacaagatttaagagaagcatttcaatttgctgccgaaaataaagttattcctaaaatccaattaagacaattatctgaaattaacgatatttttgatgaaatggaaaaaggaacaattacgggtcgaatggtaattgatatgaaaagcacgcactga

SEQ ID NO: 84611 - protein, 340 aa, Staphylococcus epidermidis ATCC 12228
MKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 84612 - DNA, 1026 bp, Bradyrhizobium japonicum USDA 110; identical to SEQ ID NO: 51435
  CDS (1)..(1026)

SEQ ID NO: 84613 - protein, 341 aa, Bradyrhizobium japonicum USDA 110; identical to SEQ ID NO: 51436

SEQ ID NO: 84614 - DNA, 1017 bp, Enterococcus faecalis V583
  CDS (1)..(1017): transl_table=11
atgtataaagcaattgtcgcagcaaaaggaaaaacaacaaaaattgttgaaaaagaatcgcgtccattgaaagataatgaagcgcggttgaaaatggaagtctgtggtgtctgtcatacggatttacacgttaagaatgcagattttggcgatgttagcggttgtaccttaggtcacgaaggaattgggattgtgacggaggttggaaaagacgttactagtttaaaaattggtgatcgtgcatctgttgcatggttttatgaaggctgcgggcattgcgaatattgtacttctggtcgagaaacgctttgtcgttcagtaaaaaatgctggatatacagttgatggtgccatggccgaagaatgcatcgtcacagacggttatgcagtgaaagtgccagaaaatttagcatcagagccagcttcctctattacttgtgcaggggtaacaacctacaaagcgataaaagaatctgggattcgtccaggtcaatggctaatgatttcaggattaggtgggctaggtaatctagctttacaatatgccaagcatgtctttaatgcaaaagtagtagctgttgatgtgaatgataatcagttagcttttgcgaaagaaatgggtgctgatcttttaattaatccagttaaagatcctgattttgctgcacaacttcaaaaagaaattggcggtgtccatgcagcagtagtcactgcggtagctaaatcagcatttaatggcgcagtcgatgcagtccgtgcgggaggaacggttgtcgccgttggattgcctgttgagacaatggatttatctattccacgtcttgttcttgatggcattcacgtagtcggatcgttagttggaacccgtcaagatttaagagaagctttccaattcggtgcagaaggaaaagttgttcctgtttgtcaaacacgtcaaccagaagaaattaatgctatttttgaagaaatggaacaaggaaaaattcgcgggcgcatggtcattgattttcgcagttaa

SEQ ID NO: 84615 - protein, 338 aa, Enterococcus faecalis V583
MYKAIVAAKGKTTKIVEKESRPLKDNEARLKMEVCGVCHTDLHVKNADFGDVSGCTLGHEGIGIVTEVGKDVTSLKIGDRASVAWFYEGCGHCEYCTSGRETLCRSVKNAGYTVDGAMAEECIVTDGYAVKVPENLASEPASSITCAGVTTYKAIKESGIRPGQWLMISGLGGLGNLALQYAKHVFNAKVVAVDVNDNQLAFAKEMGADLLINPVKDPDFAAQLQKEIGGVHAAVVTAVAKSAFNGAVDAVRAGGTVVAVGLPVETMDLSIPRLVLDGIHVVGSLVGTRQDLREAFQFGAEGKVVPVCQTRQPEEINAIFEEMEQGKIRGRMVIDFRS

SEQ ID NO: 84616 - DNA, 1023 bp, Streptomyces avermitilis MA-4680
  CDS (1)..(1023)
atgagtacttatcgagcagcgcaggtggccgccgcgagcggtccgttcgagatcgtccagcgtgaggtgccgcggcccggccccggccatgtccggatcgccgtggacgcctgcgggatctgccacagcgactccgtcttcgtcgacgccctgttgccgggcgtccggtttccgctggtccccgggcatgagatcgccgggcacatcgacgagctcggcgagggaacggacatcagctggcaggtgggcgaccgggtggcggtgggctggttcggcggcagctgcggccactgcccgccctgcagacagggcgacttcgtcgtgtgccagaacctgaaggtccccggatgggcgtacgacggaggctacgccgaggcggtgatcgcaccggccgacgccctggcccggatccccgacgcgctggcggcgaccgacgcggcacccctgggctgcgcgggagtgaccacgtacaacgggctgcgacgcagctccgcgcggccgggcgatctcgtcgccgtcctcggcatcggtggcctcggccacctgggggtgaagtacgcggccgccatgggcttcgagaccgtggccatcgcccgcggatccgacaaggccgacttcgccaagcagctcggcgcacaccactacatcgacagcacggcggacaccaccgtcgcggatgcgctgcagtccctcggcggcgccaaggccgtgctggccaccgccgccaactcggacgccatcacggcgaccgtggatgggctcgcgccccgcggcgagctggtggccatcggtgtggacgccgagccgctgggcatcagcccgaaccagctgctcatgggcggcaagatcatccgcggtcatccgtccggcaccgcgcaggacgtgcaggacaccatggcgttcagcgccctgcacgggatccggccgatgaccgagaccgtgccgctggaccaggccgatgaggcgtaccggaagatgatgtccggcgccgcccgcttccgcatggtgctcaccaccggctga

SEQ ID NO: 84617 - protein, 340 aa, Streptomyces avermitilis MA-4680
MSTYRAAQVAAASGPFEIVQREVPRPGPGHVRIAVDACGICHSDSVFVDALLPGVRFPLVPGHEIAGHIDELGEGTDISWQVGDRVAVGWFGGSCGHCPPCRQGDFVVCQNLKVPGWAYDGGYAEAVIAPADALARIPDALAATDAAPLGCAGVTTYNGLRRSSARPGDLVAVLGIGGLGHLGVKYAAAMGFETVAIARGSDKADFAKQLGAHHYIDSTADTTVADALQSLGGAKAVLATAANSDAITATVDGLAPRGELVAIGVDAEPLGISPNQLLMGGKIIRGHPSGTAQDVQDTMAFSALHGIRPMTETVPLDQADEAYRKMMSGAARFRMVLTTG

SEQ ID NO: 84618 - DNA, 1044 bp, Streptomyces avermitilis MA-4680
  CDS (1)..(1044)
atgaccaccactgttgccgcgtacgccgccccggccgccaaggctcccctggagcgcaccaccatcgagcggcgtgaggtcggcgagttcgacgtcctgatcgacatcaagttcgccggtatctgccactcggacatccaccaggcccgcgacggctggggcgagggcatattcccgatggttccgggccacgagatcgccggcatcgtcgccgaggtcggctccggcgtcaccaagttccaggtcggcgaccgggtgggcgtcggctgcatggtcgactcctgccgcgagtgcgagaactgcaaggcgggcctggagcagtactgcgtcgggggcaacgtcggcacgtacaacgccctcgacaagaacggtgagcccacctacggcggctactccgagaaggtcgtcgtcgacgagaactacaccgtccgcatcccggacggcctcgccctcgacgtggccgccccgctgctctgcgccggcatcaccacgtactccccgctcaagcactggaacgcgggccccggcaagaaggtcgccgtgctcggcatgggcggcctcggccacatgggcgtcaagatcgcgcacgcgctcggcgccgaggtgaccgtgctgtcccagtcgctgcgcaagaaggacgacgggctgaagctgggcgccgaccactactacgccaccagcgacccgaagaccttcgaggagctggcgggcacgttcgacatcatcctgtcgacggtctcggcgccgctggacttcggcgcgttcctgtcgctgctgaggacggacggcgccctggtgaacgtcggcgcccccgaggagccgatctccatcaacctcttctcggtgatcgccggccgcaagaccctcgcgggctccggcatcggcggcatccaggagacccaggagatgctggacttctgcgccgagcacggcctcggtgcggagatcgagctgatcagcgcgtccgagatcaacgacgcgtacgagcgggtgctgaacagcgacgtgcggtaccgcttcgtgatcgacaccgcgacgatctga

SEQ ID NO: 84619 - protein, 347 aa, Streptomyces avermitilis MA-4680
MTTTVAAYAAPAAKAPLERTTIERREVGEFDVLIDIKFAGICHSDIHQARDGWGEGIFPMVPGHEIAGIVAEVGSGVTKFQVGDRVGVGCMVDSCRECENCKAGLEQYCVGGNVGTYNALDKNGEPTYGGYSEKVVVDENYTVRIPDGLALDVAAPLLCAGITTYSPLKHWNAGPGKKVAVLGMGGLGHMGVKIAHALGAEVTVLSQSLRKKDDGLKLGADHYYATSDPKTFEELAGTFDIILSTVSAPLDFGAFLSLLRTDGALVNVGAPEEPISINLFSVIAGRKTLAGSGIGGIQETQEMLDFCAEHGLGAEIELISASEINDAYERVLNSDVRYRFVIDTATI

SEQ ID NO: 84620 - DNA, 1038 bp, Bacillus cereus ATCC 14579
  CDS (1)..(1038): transl_table=11
atgaaagcagtagtggttaataaaaacagcaaagcaaacatcgaagtgattgaaaaagaattacgtccgttacactcaggtgaagcgttagtagatgtagagtattgtggagtttgccacactgatttacacgttgcgaatcatgattttggtaacactgatggccgtattcttggtcatgagggtgtaggtattgttacgaaaatagctgatgatgttacttcactaaagataggtgaccgtgtaagtattgcatggatgttccaatcttgtggacgttgtgaatattgcgtaactggtagagaaacattttgccgtgaagttaaaaacgctggttattcagtggatggtggtatggctgaacaatgtatcgttacagctgattatgcggtaaaagtaccagaaggattagatcctgctcaagcatcatcaattacttgtgctggtgtaactacatataaagctattaaagtatcagatattaaacctagtcaacctattgtaatctatggctgcggtggattaggtaacttagctatccaatatgctaaaaatgtatttggtgcaaaggtaatcgcagtagacattaatgacgataaattagccttagcgaaagaagttggtgctgatatgactatcaatccaatttctcaaggtcctgctgataaaattgtgcaagagaagtttggtggcgcttatgctgcggtagtaacagcagtctctaaagtagcctttaactcagcagttgatgcagtacgtgcttgcggtaaagtagttgcagtagggctaccagtagaaacaatggacttaaacatcccacgacttgtactggatggaattgaagtagttggttctctagttggtactcgtaaagatttggaagaggcgtttatgtttggggcagaaggaaaagtagtgccggttgttcaaacttgttcgctagataaagtacaaaatgtattcgaagaaatggaacaaggtagaattcaagggcgtatggtaattgattttaaaaaacataattgtgattgcaaataa

SEQ ID NO: 84621 - protein, 345 aa, Bacillus cereus ATCC 14579
MKAVVVNKNSKANIEVIEKELRPLHSGEALVDVEYCGVCHTDLHVANHDFGNTDGRILGHEGVGIVTKIADDVTSLKIGDRVSIAWMFQSCGRCEYCVTGRETFCREVKNAGYSVDGGMAEQCIVTADYAVKVPEGLDPAQASSITCAGVTTYKAIKVSDIKPSQPIVIYGCGGLGNLAIQYAKNVFGAKVIAVDINDDKLALAKEVGADMTINPISQGPADKIVQEKFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKKHNCDCK

SEQ ID NO: 84622 - DNA, 1050 bp, Nitrosomonas europaea ATCC 19718
  CDS (1)..(1050): transl_table=11
atgacaatcaaagcctatggcgcccgcgcgggcgaccttcccctcgagccaatgaacatcacccggcgcacgccaagtgcgcacgatgtgcagatcgacatcacccactgcggcgtgtgccattcggatctgcaccaggtgcgctccgagtgggcgggcacgctttacccctgtgtgccggggcacgagatcgtcggccgcatcaccgccgtaggcgcacaagtatcgggctacaagccgggtgatctggtcggtgtcggctgcatcgtcgatagctgccagcactgtgccgattgcaatgacgggttggaaaactactgcgaccacatggtcctcacctataatggcccgacatccgacgcacccggtcacacgctgggcggttactctcaacagatcgtggtacacgagcgctacgtgctgcgcatccgccattctgaagcgcaactggccgccgtcgcgccgctgctgtgcgcaggcatcaccacctggtcaccgctgcgccactggaaagtggggccgggccaaaaggtcggagtagtcggtatcggcggcctgggccacatgggcatcaagctggcacatgcgatgggtgcatacgtggtcgcgttcactacatccgaatccaagcgcgaggcagccagagcactgggcgcgcatgagacggtggtctcacgtaatcccgatgaaatggccaggcacgttggaagcctcgacttcatcctcaacaccgtagccgcatcacatgacctcgatgcattttttgcgctgctcaaacgcgacggcacgatggcgctggtgggtgcccctgccacgccacacccttcgcccaacgtgttcaacctgatcatgaagcgccgcagcctggcaggttcactgatcggtggtatctccgaaacacaggagatgctggatttctgcgccaaacacaacatcgtcgccgacgtcgaaatgatccgcatcgatgaaatcaacgaagcttatgagcgcatgctcaagggtgatgtaaagtaccgcttcgttatcgattgcgcttcgctcacagcctaa

SEQ ID NO: 84623 - protein, 349 aa, Nitrosomonas europaea ATCC 19718
MTIKAYGARAGDLPLEPMNITRRTPSAHDVQIDITHCGVCHSDLHQVRSEWAGTLYPCVPGHEIVGRITAVGAQVSGYKPGDLVGVGCIVDSCQHCADCNDGLENYCDHMVLTYNGPTSDAPGHTLGGYSQQIVVHERYVLRIRHSEAQLAAVAPLLCAGITTWSPLRHWKVGPGQKVGVVGIGGLGHMGIKLAHAMGAYVVAFTTSESKREAARALGAHETVVSRNPDEMARHVGSLDFILNTVAASHDLDAFFALLKRDGTMALVGAPATPHPSPNVFNLIMKRRSLAGSLIGGISETQEMLDFCAKHNIVADVEMIRIDEINEAYERMLKGDVKYRFVIDCASLTA

SEQ ID NO: 84624 - DNA, 1092 bp, Helicobacter hepaticus ATCC 51449
  CDS (1)..(1092): transl_table=11
atgctattaaaagagaatttgacacaagcacaaagtgggcagagaatcactgccaaaggctacgcagtcgcacataaaagtgatacttttaagccctttagtttttcgcgccacgctttgggagaaactgacattttgattgagattctatatgctggaatctgccatagcgatattcatagcgcgcgtgaggaatggcataagggaatttttccaatggtgcccggacacgagattgcgggtaaagtcgtggcagtaggaagcaaggtaagcaaatttaaagttggcgattacgcaggggtaggctgtatggtcaattcttgcggtgagtgtgaggcgtgcaaaagaagccaagagcagttttgtgaaaatggcaaatgcgtctttacttatgattgccacgattgcttccacgataacgagccaacttatggcgggtattcaaataatattgtagtgagtgaaaaatttgcggtcaatgtcccacaagatgcgccgttagaaaaagttgctcccttgctttgcgcaggaatcaccacctattcgccgattaaatttagcaatgtcaaggcaggcgataaagtcgcggtagctggatttggtgggcttggtgtaatggcactcaaatacgcaatcaaaatgggtgcggaagtgagcgtgtttgcgcgtaataaaaataaagaaaaagaggcattagatcttggtgcaaaggcactttatactgatacaaagggtgtgagcgaacgatttgattttatcatttctacgattccaaccgcgtatgatgtgaatgcctatgcggagttgttgaaatttggcggagaaatggcgattgtcggcttaccacctgcagatgagaagcttagcattgatttaacgagacttgtgtttgcggcgggcaaaaaagtctatggctcactcattggcggaataaaagagacacaagaaatgcttgatttttcgctcaaacatagaatctatcccgagacagaggttatttctgtggagcaaatcaatgaggcgtatgagaatcttacaagcggcaaggcgaaattccgctatgtgattgatatgagcagcctcaaagaataa

SEQ ID NO: 84625 - protein, 363 aa, Helicobacter hepaticus ATCC 51449
MLLKENLTQAQSGQRITAKGYAVAHKSDTFKPFSFSRHALGETDILIEILYAGICHSDIHSAREEWHKGIFPMVPGHEIAGKVVAVGSKVSKFKVGDYAGVGCMVNSCGECEACKRSQEQFCENGKCVFTYDCHDCFHDNEPTYGGYSNNIVVSEKFAVNVPQDAPLEKVAPLLCAGITTYSPIKFSNVKAGDKVAVAGFGGLGVMALKYAIKMGAEVSVFARNKNKEKEALDLGAKALYTDTKGVSERFDFIISTIPTAYDVNAYAELLKFGGEMAIVGLPPADEKLSIDLTRLVFAAGKKVYGSLIGGIKETQEMLDFSLKHRIYPETEVISVEQINEAYENLTSGKAKFRYVIDMSSLKE

SEQ ID NO: 84626 - DNA, 1011 bp, Rhodopirellula baltica SH 1
  CDS (1)..(1011): transl_table=11
atgaagaccgtccatgcctacgccgtgaaagaatccaaaggaacctttgaagagttcgagtatgaacttgatcatatcggtgccaacgaggtcgacatcgatgtcgagtcatgcgggatctgccacagtgatatcagcatggtcgacaacgattgggagatgagccaatacccactcgttccagggcatgaagtgatcggcaaagtttcgtcggtgggcgatcacgttacacatttgtcagtgggtgaccgcgtgggtttgggatggcatgcgggatattgcatggtatgtgaccagtgcatgagcggtgatcacaatctttgcaacgatgctcaagcaacgattggcggacgtcacggcggattcgcggataccgttcgggctcaatcagccagcgttgtgaagattcctgattcgttgaatgccaaggaagcaggacccctgttgtgcggaggaatcacggttttcaatccctttgttcaattggatctttcaccgacctcttccgtcggcgtgatcgggatcggtggactcggacacctcgccctcaagtttgcaaatgcttggggatgtgaagtcaccgctttcacatccgagtcgaaggaagaagaagctttggagatgggggcgcaccacacaatcaattcgcgcgacatggacgcgattaagaacaccgatctgcgttttgacttggtgatttccaccatcaacgtgccgttggattggaacgcggtcctcggaaccctaaaaactcatggccgtttgcacatggtcggtgcactcacggagccgatggagattggattgctgccgcacatgctcttcaaccagctgacgttgggagcatcaccagtgggaccaccggtcattatccggcgaatgttggattttgccgcccgccaccagatcgctcccgtgaccgagcattatccgatgagcaaagtcaacgacgcgttcgaacgtttacgcagcggtgacgctcgctaccgaatcatcttggatcgcgactga

SEQ ID NO: 84627 - protein, 336 aa, Rhodopirellula baltica SH 1
MKTVHAYAVKESKGTFEEFEYELDHIGANEVDIDVESCGICHSDISMVDNDWEMSQYPLVPGHEVIGKVSSVGDHVTHLSVGDRVGLGWHAGYCMVCDQCMSGDHNLCNDAQATIGGRHGGFADTVRAQSASVVKIPDSLNAKEAGPLLCGGITVFNPFVQLDLSPTSSVGVIGIGGLGHLALKFANAWGCEVTAFTSESKEEEALEMGAHHTINSRDMDAIKNTDLRFDLVISTINVPLDWNAVLGTLKTHGRLHMVGALTEPMEIGLLPHMLFNQLTLGASPVGPPVIIRRMLDFAARHQIAPVTEHYPMSKVNDAFERLRSGDARYRIILDRD

SEQ ID NO: 84628 - DNA, 1032 bp, Bordetella pertussis Tohama I
  CDS (1)..(1032): transl_table=11
atgaaagaaacgtacagggcgatgcaggccagcaggcccggcgtgctggaactcgtcgagcggcgcacgccgcgtcccgccgccgcggaagtgttgatccgggtggaggcttgcggcatgtgcggcgccgacatcgccgatatcgagaaggccggccccaccgtgccgccccgcgtgcccggacacgaggtggtgggacgtatcgtggccctgggcggtcaggtgccgccgatctggaggctgggccagcgcgtgggcgtgggccgcctgggcggccattgcaacgagtgcgaccaatgccggcagggacgtttccagctttgcgagagccagccgatcgtcggcgccagttgcgatggcggttatgccgagatgatgctggcgcgcgccaccggactggtgtcgatcccggatgagctggatgcgcaggaagcggcgcccattctttgcgccggcgtggccacgttcaatgcattgaggaaatgcggcgctcagcccggcgacctggtggccgtcgtgggcatcggcggcctggggcacatggccttgcaatatgcgcgacgcatggggttcagggtcgtcgccatcgggcgcggtgcggatatcgccacggatgccatggcgctgggcgcgcatgcctacatcgacaatctcgagcagaacgtcgtcgccacgctcaggcgcatgggaggcgcgcaggccgtcctgaccacgatcgaccaggccgaggcagtgtcggcattgcttggcgcgttggcgcccgaaggacgcctggtcgttctcaacccgggcaagtctgcgttgcaggtttccgccggactgttggtcggtgggcaacgcagtatcgtcgggtcgctcaccggcacgccccatgacaacgaaaaagcgttgaacttcagcgtgctggtggatgcgcgcccgagcatcgaggtctggccgctggcgcgggccgacgaggcctacaggcagttgcaatccggcgcgcccaggttccgcctggtgctggccatgggaaataccgaccaagactga

SEQ ID NO: 84629 - protein, 343 aa, Bordetella pertussis Tohama I
MKETYRAMQASRPGVLELVERRTPRPAAAEVLIRVEACGMCGADIADIEKAGPTVPPRVPGHEVVGRIVALGGQVPPIWRLGQRVGVGRLGGHCNECDQCRQGRFQLCESQPIVGASCDGGYAEMMLARATGLVSIPDELDAQEAAPILCAGVATFNALRKCGAQPGDLVAVVGIGGLGHMALQYARRMGFRVVAIGRGADIATDAMALGAHAYIDNLEQNVVATLRRMGGAQAVLTTIDQAEAVSALLGALAPEGRLVVLNPGKSALQVSAGLLVGGQRSIVGSLTGTPHDNEKALNFSVLVDARPSIEVWPLARADEAYRQLQSGAPRFRLVLAMGNTDQD

SEQ ID NO: 84630 - DNA, 1176 bp, Oryza sativa (japonica cultivar-group)
  CDS (1)..(1176)
atggagcagcaacctaagatggtgaccggatgggcggcaagagacgccaacgggctgctctctcctttctcttaccccctcagagctaagggagacgaagacgtcgttgtcaagatactgttctgtggcatttgccactctgatctttctactatcaagaacgagtggggcaacgccaagtatcccgtagtaccaggtcatgaaatcgttggggtcgtcgccgaggtcgggagcagcgtggcgaggttcgccgccggcgacactgtcggcgtcgggtacatcgccagcacatgccgcgcctgcgccaactgccgcgacggcttcgagaactactgcgcgggcctcgtgccgtccttcaacgccgcgctccccgacggcgctacggtgcacggcggcttctcggagctggccgtcgtcaaccagcggtacgtcgtccggatccccggcggcggcggcggcgcgtcgccggcgccgctcgaccgcttggcgccgctgctgtgcgccggcgtcacggtgtactgccccatgaggcggctcgggctggacaggccaggggtgcacctcggcgtggccgggctcggcggcctcggccatctcgctgtcaagttcggcaaggcgttcggcgtgaaggtgaccgtgatcagcaccagcccgtggaaggaagcggaggccgtggagaggcttggcgccgacgcgttcttgctcagcaccaacgccgaacagatgaaggcagctgcgggcaccatggatggcatcatcgacacggtctcggcggtgcacgacctgacgccactcatcacgctgctgcggactcacggccagctcgtcccggtcggatcgccgggaaagccggtgcaactagccctgtaccctctgcaatcaggcccatcaccagttggcccgcgaatagattgggctggaggcccaatcagagctagatgggccgtgctcatggtgtgcgatgtggcagatgggaagagcgtggccgggagcatgatcggcgggatgagggatacgcaggagatggtcgacttcgccgtcgagcacggcgtcgccgccgaggtggaggtcatcggcatggaggacgtcaacggcgcgatggagaggctgcagaagggagacgtgaggtacaggtttgtgatcgacgtagccaacacaatggcccgtgctcgttag

SEQ ID NO: 84631 - protein, 391 aa, Oryza sativa (japonica cultivar-group)
MEQQPKMVTGWAARDANGLLSPFSYPLRAKGDEDVVVKILFCGICHSDLSTIKNEWGNAKYPVVPGHEIVGVVAEVGSSVARFAAGDTVGVGYIASTCRACANCRDGFENYCAGLVPSFNAALPDGATVHGGFSELAVVNQRYVVRIPGGGGGASPAPLDRLAPLLCAGVTVYCPMRRLGLDRPGVHLGVAGLGGLGHLAVKFGKAFGVKVTVISTSPWKEAEAVERLGADAFLLSTNAEQMKAAAGTMDGIIDTVSAVHDLTPLITLLRTHGQLVPVGSPGKPVQLALYPLQSGPSPVGPRIDWAGGPIRARWAVLMVCDVADGKSVAGSMIGGMRDTQEMVDFAVEHGVAAEVEVIGMEDVNGAMERLQKGDVRYRFVIDVANTMARAR

SEQ ID NO: 84632 - DNA, 1065 bp, Oryza sativa (japonica cultivar-group)
  CDS (1)..(1065)
atggctgctgaatgtggaagtggcaactgtgatgcttgggcagcgagagatccttcagggatcctctccccgtacaagttcaaccgcagggctgtacaaagtgacgatgtttccttgaggatcacacactgtggtgtttgttatgctgatgttgcatggacaaggaatatactcaacaattcgatgtaccctttagtccctgggcatgagatagcaggagttgtaactgaggttggtgcagacgtcaagagcttcaaagtgggtgaccatgtaggtgttggcacatacgtgaattcatgccgggactgtgagaactgcaatagctctctagagaactactgctcacaacatgtcttcactttcaatggtgttgacactgatgggactgtcacaaagggaggatattctactcacatagtagtacatgagaggtattgctttaaaatacctgatggctaccctttggaaaaggcagcacctttactttgtgctggcatcactgtatatagtccgatgatgcggcataatatgaaccagccagggaagtcactcggcgtcattggacttggtggcttgggtcacatggcagtaaaatttgggaaagcctttggactgaaagtcacagttattagtactagtgaatcaaagagaaaagaagctattgaccttcttggtgcagataatttcgtggtgtcatcggatgaaaatcagatggagaccttgaaaagctctctgaacttcattattgacacagcctccggcgatcacccattcgatccttatctcacgcttctgaaagttggtggtgtaatggcactacttagcttcccaagtgaaatcaaagtgcatcctgcaaaccttaatctcggtgggcggagtttatctggtagtgtaactggaggtacgaaggacatccaggagatgataaacttctgtgcggcaaacaaaatctacccagatatcgagatgatcaagatagattacatcaacgaggctcttcagaggcttgttgaccgggatgtcagatttcgctttgtaatcgacattgagaactcgttcaagtag

SEQ ID NO: 84633 - protein, 354 aa, Oryza sativa (japonica cultivar-group)
MAAECGSGNCDAWAARDPSGILSPYKFNRRAVQSDDVSLRITHCGVCYADVAWTRNILNNSMYPLVPGHEIAGVVTEVGADVKSFKVGDHVGVGTYVNSCRDCENCNSSLENYCSQHVFTFNGVDTDGTVTKGGYSTHIVVHERYCFKIPDGYPLEKAAPLLCAGITVYSPMMRHNMNQPGKSLGVIGLGGLGHMAVKFGKAFGLKVTVISTSESKRKEAIDLLGADNFVVSSDENQMETLKSSLNFIIDTASGDHPFDPYLTLLKVGGVMALLSFPSEIKVHPANLNLGGRSLSGSVTGGTKDIQEMINFCAANKIYPDIEMIKIDYINEALQRLVDRDVRFRFVIDIENSFK

SEQ ID NO: 84634 - DNA, 1263 bp, Oryza sativa (japonica cultivar-group)
  CDS (1)..(1263)
atggcgacggcggaggcagcggcggcggcggcgaggcgaggcggcggcggaggcagcaatcgcggggaggcgagtgacggtgcagggcggcggcagaggcgagcggcggcgggagctcgcactgctcgcggaggaggcgaggcggcggcggcggcggcggaagaggcgagcggcggcggggtgcagcggaggaggcagcggcggcggcgaggcgaggcggtcggcgagcccggtcgagcagcgccccctccacggcgaacccaccggcggagcactggagatgacgatgtggcgataaagattctgttctgtggaatctgccactctgacctgcactgcatcaagaatgagtggaagcactccatctacccacttgttcctgggcacgagatcgccggtgtggtgacggaggtggggaagaacgtcaccaggttcaaggccggcgacagggtcggcgtggggtgcatggtgaactcgtgccggtcatgcgagagctgtaacaatggcttcgagaaccactgcccggagggcgtcttcacctacaactccgtcgacaaggacggcaccgtcacctacggcggttactcgagcatggtggtggtgcacgagcgcttcgtggtcatgttcccggaggcgatgccgctcgacgtcggcgccccgctgctgtgcgccggcatcaccgtgtacacccccatgaagtaccacggcctgaacgcgccggggaagcacgtcggcgtgctcggcctgggcgggctcggccacgtcgcggtgaagttcgccagggcgttcgggttgaaggtgacggtgatcagctcgtcgccggggaagaagcgggaggcgctggagcggctcggcgccgacgcgttcgtcgtgagcagcagcgccgaggagatggaggccgcgaggtccaccatggacggcgtcatcaacacggtctccgccaacacccccatggcgccgtacctggcgttgctgaagcccaacgggaagatgatcctcgtcggcctcccggagaatcccctggaggtccctcccttctctctcgtccacgggaacaggactctggcagggagcaacatcggcggcatggcggacacgcaggagatgatcgagctggcggcgaagcacggcgtgacggcggacatcgaggtgatcggcgccgacgacgtgaacacggccatggagcgcctcgccaaggcggatgtcaggtatcgcttcgtcatcgacgtcgggaacaccctccacgccgccgccgccgagtga

SEQ ID NO: 84635 - protein, 420 aa, Oryza sativa (japonica cultivar-group)
MATAEAAAAAARRGGGGGSNRGEASDGAGRRQRRAAAGARTARGGGEAAAAAAEEASGGGVQRRRQRRRRGEAVGEPGRAAPPPRRTHRRSTGDDDVAIKILFCGICHSDLHCIKNEWKHSIYPLVPGHEIAGVVTEVGKNVTRFKAGDRVGVGCMVNSCRSCESCNNGFENHCPEGVFTYNSVDKDGTVTYGGYSSMVVVHERFVVMFPEAMPLDVGAPLLCAGITVYTPMKYHGLNAPGKHVGVLGLGGLGHVAVKFARAFGLKVTVISSSPGKKREALERLGADAFVVSSSAEEMEAARSTMDGVINTVSANTPMAPYLALLKPNGKMILVGLPENPLEVPPFSLVHGNRTLAGSNIGGMADTQEMIELAAKHGVTADIEVIGADDVNTAMERLAKADVRYRFVIDVGNTLHAAAAE

SEQ ID NO: 84636 - DNA, 993 bp, Gloeobacter violaceus PCC 7421
  CDS (1)..(993): transl_table=11
atgaaagccgccgtcgttccgaacctgcacggccgttgggaaatccgcgatctgccgattcccgaacctgggatcaaccaggtactcatccggatcaaagcgagcggcctgtgctacaccgacattcacatcaccgaaggagcctggcccgcggacagcttcccgcgtaccctcggccatgaaccagtgggcgaaattgtcgccctcggtgccggagtacgcacgcgtcgcctgggcgatcgcgtcggagtgccgtggctgcagctggcctgcgggcggtgcgaatggtgtcggcgcggcaaagcgctcttttgcaaagatcaacagggcacgggcgtgcagacccagggcggccacgccgaatatatgcttgcccaggccgaagcgaccgtgctgttacctgacgccctcgcttacgaacaggcggcttcgctattttgcgcgggctacaccgtctgggcggggctgcgctttgccgacccgaaaccccacgagcgcgtcgcagtattgggcatcggcggtcttgggcacctggcggttcagtacggcaaggcggcgggcttcgaaactttcgccatcacccactcgccttcgaaagaaaaactggtgcgctcgctcggggctgacggggtgtttccctccggggccgcgctgcgggaggcggggggggccgatgtgatcctcgcctgcagcaactcgtatcgggcgaccggcgaagctttgcaagggctgcgcccggacggccggttggtgctgatgggtcttcccagcgacaaccagaccctcgcggtgagtggcgatctgctggtcaaccgctggcggatcatcggttcgcagcaaaacggcccggagcaccttttcgaagccctcgactacgcggctaaaggcaaggtcaaagtcgttgccgagacctactcgctcgatgaaatcaaccttgctttcgaccgggtcttcagcggtgatgtgcgctttcgcgccgtgatcatcccctaa

SEQ ID NO: 84637 - protein, 330 aa, Gloeobacter violaceus PCC 7421
MKAAVVPNLHGRWEIRDLPIPEPGINQVLIRIKASGLCYTDIHITEGAWPADSFPRTLGHEPVGEIVALGAGVRTRRLGDRVGVPWLQLACGRCEWCRRGKALFCKDQQGTGVQTQGGHAEYMLAQAEATVLLPDALAYEQAASLFCAGYTVWAGLRFADPKPHERVAVLGIGGLGHLAVQYGKAAGFETFAITHSPSKEKLVRSLGADGVFPSGAALREAGGADVILACSNSYRATGEALQGLRPDGRLVLMGLPSDNQTLAVSGDLLVNRWRIIGSQQNGPEHLFEALDYAAKGKVKVVAETYSLDEINLAFDRVFSGDVRFRAVIIP

SEQ ID NO: 84638 - DNA, 909 bp, Gloeobacter violaceus PCC 7421
  CDS (1)..(909): transl_table=11
gtgtgcgcctgcggtgtctgccactcggacctgcacatgatcgacaacgactggggccgctcgcgctatccgctggtgcccgggcacgaggtggtgggcgaggtggtggagatcggatccgaggtgcgtcacctgaagcccggcgaccgagtcggcgtgggctggcagcgctcggcctgtctgcagtgcctcgactgcctgcgcggcaacgaaaatctgtgcgcccacagccaggccacgatcgtcaccggctacggcggcttcggcgattatctggcgatcgatgcgcgctttgccttcaagattccggcggggattcccacccacgtcgcaggaccgcttctgtgcggcgggatcacggtctattcggggttgcgggcggcagggatgagctcgggccaggagattggcgtcatcggggtgggcggactcggccacctggcagtccagttcgccggccgcctcggcaaccgggtgacggtcttcaccacctccgaggacaaagcccggcaggcggccgccctcggagcgcaccgggcggtgatcgtgccgccgggcgattcgcccccgccgcctgtcgaacgcctcgacatcatcatcagcacgatcccctatgccctcgatgcggtgggctatctggctcacctcgccaccgacggcaccctggtattcgtcggcgtaccgcccgaaccgctggcgttgccggtgcgcgaactcatccggggccggcggcgcctgatgggatcgggcattggcagccgctcgcgcatcgtcgaaatgctctcggtggccgagcgcttcggggtgatgccgctggttgaaacctttgcgatggccgaggcgaacgcggcgctcgagcgggtgcgccgcaatcgggtccgctaccgcgcggtgctgctggctgaataa

SEQ ID NO: 84639 - protein, 302 aa, Gloeobacter violaceus PCC 7421
MCACGVCHSDLHMIDNDWGRSRYPLVPGHEVVGEVVEIGSEVRHLKPGDRVGVGWQRSACLQCLDCLRGNENLCAHSQATIVTGYGGFGDYLAIDARFAFKIPAGIPTHVAGPLLCGGITVYSGLRAAGMSSGQEIGVIGVGGLGHLAVQFAGRLGNRVTVFTTSEDKARQAAALGAHRAVIVPPGDSPPPPVERLDIIISTIPYALDAVGYLAHLATDGTLVFVGVPPEPLALPVRELIRGRRRLMGSGIGSRSRIVEMLSVAERFGVMPLVETFAMAEANAALERVRRNRVRYRAVLLAE

SEQ ID NO: 84640 - DNA, 1020 bp, Gloeobacter violaceus PCC 7421
  CDS (1)..(1020): transl_table=11
atgactaagatgcgcgccatgatcgtacctgaagcgggcgcgaagtttcagatgatcgagcgggatttgcccgtacccgggccgcgggaggtccggctgagcgtcagcgcctgtggcgtgtgtcacagcgactctgtgacggtcgaagggacgatgcggggcatcgcctatccgcgcgtgcccggccatgaggtgatcggcacgatcgaggcgctcgggccagaggtgctcggctgggaggtgagcatgcgcgtcggcgtcggttggttcggcggctcgtgtgggtattgcgcgcactgccgacgcggctcggcgttcgcctgcgagacggtgagcgccgtcaccggtgtgacccgcgacggcggctacgcgacccacatgctggccgatgtctccgcgctcgcccatgtgccgaccgatctcgacgtggtcgaatcggcgcccttactgtgtgccggtatcaccaccttcaacgcgctgcgcaattgcggtgcggggccgggcgagttggtggcgatccacggtatcggcgggctcggtcatctcggtatccagttcgccgcgcgccagggcttccgcaccgtcgccgtcaaccgcggccgcgacaaagaggaactcgcacgctcgctcggcgcgcacgaatacatcgacagcgaagagggcgatcccgccgccgcactgctggcgatgggcggggcaaaggcgatcctcgcaaccgtcaccagcgagaaagcgatgcaggcgctcgttggcggtctcggacccaacggcacgatgatgctcatcggtgcagtgcccaccctcactgtcaacccgacagagttactcctcaagcgcgccgcggtgaagggctggtattcgggcacggcggccgattcggaggatacactgctgtttagccatcgcaacgggatcacctccatgaacgaaatctacccgttcgagaacgcacaggctgcatacgatcggatgatgagcggcaaggcgcgctttcgcgtcgtcctttcgatgggggtgtaa

SEQ ID NO: 84641 - protein, 339 aa, Gloeobacter violaceus PCC 7421
MTKMRAMIVPEAGAKFQMIERDLPVPGPREVRLSVSACGVCHSDSVTVEGTMRGIAYPRVPGHEVIGTIEALGPEVLGWEVSMRVGVGWFGGSCGYCAHCRRGSAFACETVSAVTGVTRDGGYATHMLADVSALAHVPTDLDVVESAPLLCAGITTFNALRNCGAGPGELVAIHGIGGLGHLGIQFAARQGFRTVAVNRGRDKEELARSLGAHEYIDSEEGDPAAALLAMGGAKAILATVTSEKAMQALVGGLGPNGTMMLIGAVPTLTVNPTELLLKRAAVKGWYSGTAADSEDTLLFSHRNGITSMNEIYPFENAQAAYDRMMSGKARFRVVLSMGV

SEQ ID NO: 84642 - DNA, 1041 bp, Corynebacterium diphtheriae NCTC 13129
  CDS (1)..(1041): transl_table=11
atgtctgctactgaattcccctctgcctttaccgccgctgttgtggacaagtttggctccgagctcaacatccacgacgttgaccttccagagccaggccaacaccaagcactggtcaaggtgctcacctccggcatctgccacactgacctccacgccgccgaaggcgactggccagtcaagccaaagccaccattcgtcccaggccacgagggcgtaggcgaagtggtcaaacttggcccaggtgagcatagcgttgcgctgggtgacatggtcggtaacgtctggctgtggtcagcttgtggcgagtgtgaatactgccgcaccggctgggagactatgtgtgagaaagccgagtacggtggatacaccgtcgatggctctttcggtcagtatatgctggtagatactcgctactgtgcccgcatcccagacggctgtgacctgctggaagtcgccccaattttgtgcgctggcgtgaccgtgtacaaaggactcaaggttaccgaaacccgcccaggccagttcgtggtcatctctggcgtgggcggtctgggccatatcgccgtccagtacgccgtggctatgggcatgcgcgttatcgccgtggatattgcggacgacaagctcgaactggctaaaaagcatggcgctgagtttgtggtcaatgctcgtgaagaagacccaactgaggcaattgtgaagtacaccaagggtggcgcacacggcgtgctggtcaccgcggtgcaccctcaggccttcggtcaggcaattggcatggctcgtaagaacggaaccattgtgttcaatggtcttcctccaggagagttcccagcaccgattttcgacatcgtgttcaagggcctgaccatccgcggctccctcgtgggaacgcgccaagacctcgaagaggctttggacttctacgctcgcggcatgatcaagccaacggttactgaatgcaagcttgacgacgtcaactcggtctttgctgatatgaagcaaggcaagatcgacggccgcatggctatccgctactag

SEQ ID NO: 84643 - protein, 346 aa, Corynebacterium diphtheriae NCTC 13129
MSATEFPSAFTAAVVDKFGSELNIHDVDLPEPGQHQALVKVLTSGICHTDLHAAEGDWPVKPKPPFVPGHEGVGEVVKLGPGEHSVALGDMVGNVWLWSACGECEYCRTGWETMCEKAEYGGYTVDGSFGQYMLVDTRYCARIPDGCDLLEVAPILCAGVTVYKGLKVTETRPGQFVVISGVGGLGHIAVQYAVAMGMRVIAVDIADDKLELAKKHGAEFVVNAREEDPTEAIVKYTKGGAHGVLVTAVHPQAFGQAIGMARKNGTIVFNGLPPGEFPAPIFDIVFKGLTIRGSLVGTRQDLEEALDFYARGMIKPTVTECKLDDVNSVFADMKQGKIDGRMAIRY

SEQ ID NO: 84644 - DNA, 1059 bp, Geobacter sulfurreducens PCA
  CDS (1)..(1059): transl_table=11
atgtacaaagccagagcctattctgccgccagcgccgcttcgccgctggccctcgacaccattccccgccgcgagacgaccgagcgcgacgtgcagatcgagatcctcttctgcggcgtctgccactcggatctccacacggtgcgggacgagtggaacagcgtcatgcccacggtctacccctgcgtgccggggcacgagatcgtcggccggattaccagggtcggttccgctgtcacgaaattcaaaccgggcgatcttgccggcgtcggctgcctggtcgactcggatcacacctgcccgagttgccagtcgaacctggagcagttctgcccagacgccaccttcacctacaactcgccggacaagcaccaggcagcgccggtcacctacggcggctactccgagagcatcgtggtcgatgagcgcttcgtgctgcatgtccccgccaccctcgacctggccggagtcgcgccgctgctctgcgccggcatcaccacctactcgccgattcgccgctggggcgacatcagggggaagaaggccggtgtcgtcggcctcggcggactggggcacatgggggtcaagttcgcccgtgcgttcggtgcccaggtggtggttttcaccacctctccgggcaagaaggaggatgcccttcgtctcggtgcccacgaggtcatcgtttccaccaatgcggaagagatgcagcagcacgccggcacgttcgacttcatcctcgacaccatcgccgccgaccatgacatcaacgcctacctcaacatgctcggccgcgacggcaccatcaccctggttggcgcgccggagaagccgctggaggtatccgccttcgctctcctgttcggccgccgcagcctttccgggtcgatcatcggcggcatcgccgagacccaggagatgctcgacttctgcggccagcacaacatcaccgccgatgtggaggtcatcccgattcagaagatcaatgaggcctacgagcggctgctcaagtcggatgtgaagtatcgcttttccatcgatatggcgtcgctgaaagggtaa

SEQ ID NO: 84645 - protein, 352 aa, Geobacter sulfurreducens PCA
MYKARAYSAASAASPLALDTIPRRETTERDVQIEILFCGVCHSDLHTVRDEWNSVMPTVYPCVPGHEIVGRITRVGSAVTKFKPGDLAGVGCLVDSDHTCPSCQSNLEQFCPDATFTYNSPDKHQAAPVTYGGYSESIVVDERFVLHVPATLDLAGVAPLLCAGITTYSPIRRWGDIRGKKAGVVGLGGLGHMGVKFARAFGAQVVVFTTSPGKKEDALRLGAHEVIVSTNAEEMQQHAGTFDFILDTIAADHDINAYLNMLGRDGTITLVGAPEKPLEVSAFALLFGRRSLSGSIIGGIAETQEMLDFCGQHNITADVEVIPIQKINEAYERLLKSDVKYRFSIDMASLKG

SEQ ID NO: 84646 - DNA, 1014 bp, Mycobacterium avium subsp. paratuberculosis str. k10
  CDS (1)..(1014): transl_table=11
atgccaacacatcaagccgtccagattcaatccgccggcgcagcgttggaactggtcgacaccgaaacccggccgccgggccgggacgaggtacggctgacggtcggcgcctgcggcatctgcggcaccgacgctcacttcgtcaacggtgcattccccggcctgtcgtggccgttgacgccggggcatgaaatcgccggccggatcgccgagctgggcgagggtgtcgaagggttcgcggtcggccagcgggtcgcggtcggctggttcggcgggtgctgctaccggtgcgacccttgccgcgcaggccttttcatccactgcgtaaacgggaaggtacccagctggcactatcccggcggatacgcggaatcggtgacggtcccgaccagcgcgctggcccgcatccccgaggaactcaccgacgccgaagccgccccgatgggctgcgccggggtcaccacctacaacgctctgcggcacaccaaggcgctgcccggcgatcgggtggcgatcctgggggtcggcggcctgggtcatctcggcgtgcaattcgccgccgcaatgggtttcgagaccatcgcgatcaaccgcggtaccggtaaagccgatgacgcccggaaactgggcgcccatcactacatcgactccacggccgaagaccccgccgaagcgctgcgggcgttgggcggcgcggcggtggtgctggccaccgccggcaattcgcaggccatggccgccacggtcggcggtcttgcgccgcagggcgagctggtcaccatcggcgtcacgcccgagccgctgccgatcagtcccctgcagctgataacgccgggcctcagcatcgtcggtcatccctccggcaccgccaaggacgtcgaggacaccatgcagttcgcggtcctgtccggggtgcgcgcctggatcgaggagctgccgttgtcccgggcggccgacggctacgccgccctggaaggcgggcgagcgcattaccgcaccgttttgaccatgtga

SEQ ID NO: 84647 - protein, 337 aa, Mycobacterium avium subsp. paratuberculosis str. k10
MPTHQAVQIQSAGAALELVDTETRPPGRDEVRLTVGACGICGTDAHFVNGAFPGLSWPLTPGHEIAGRIAELGEGVEGFAVGQRVAVGWFGGCCYRCDPCRAGLFIHCVNGKVPSWHYPGGYAESVTVPTSALARIPEELTDAEAAPMGCAGVTTYNALRHTKALPGDRVAILGVGGLGHLGVQFAAAMGFETIAINRGTGKADDARKLGAHHYIDSTAEDPAEALRALGGAAVVLATAGNSQAMAATVGGLAPQGELVTIGVTPEPLPISPLQLITPGLSIVGHPSGTAKDVEDTMQFAVLSGVRAWIEELPLSRAADGYAALEGGRAHYRTVLTM

SEQ ID NO: 84648 - DNA, 1041 bp, Mycobacterium avium subsp. paratuberculosis str. k10
  CDS (1)..(1041): transl_table=11
atgagcaccgtttcggcgtacgccgccacgtcggcgaccgaaccattgaccaagaccactatcgagcggcgcgaccccggcccgcgcgacgtggccatcgacatcaagttcgccggcatctgccactccgacatccacaccgcgaaaggtgaatggggccacacgaattacccggtggtggtgggccacgagatcgccggcgtcgtcaccgaggtgggcgcggaggtcaccaagtacaaggtgggcgaccacgtcggcgtgggctgcatggtgaactcctgccggcagtgcagcagctgtacggccgggctggagcagtactgcaagcgcggcgcgaccttcacctacaactcgatcgacagggacggctcggtcacccagggcggctacagccaggcgatcgtggtcgacgaggacttcgtcgtgcgcatccccgactcgctgccgctggacaaggcggccccgctgctgtgcgcgggcatcacgctgttctcgccgctgcggcactggaacgccgggcccggcacccggttggcgatcgtcggcctgggcggcctggggcacatgggcgtcaagctgggtgcggcgatgggcgccgaggtgacggtgctgtcgcagtcgctgaagaagatggaggacgggctgcggctgggcgccaagcactaccacgccaccgccgaccccgacaccttcacgaagctgcgcggcagcttcgacctgatgctcaacaccgtgtcggcgaacctcaagctcaacgactatctgagcctgctcgacgtcgacggcacgctggtcgagctgggcatccccgagcacccgatggaggtgggcgcgttcccgctggcgctggcgcggcgcagcctgtccgggtcgaacatcggcggcatcgccgagacccaggagatgctggacttctgcgccgagcacaacgtgacgccggagatcgagctgatcgagcccgactacatcaacgaggcctacgagcgcgtgctggccagcgacgtgcgctaccgcttcgtcatcgacatctcgaagctatga

SEQ ID NO: 84649 - protein, 346 aa, Mycobacterium avium subsp. paratuberculosis str. k10
MSTVSAYAATSATEPLTKTTIERRDPGPRDVAIDIKFAGICHSDIHTAKGEWGHTNYPVVVGHEIAGVVTEVGAEVTKYKVGDHVGVGCMVNSCRQCSSCTAGLEQYCKRGATFTYNSIDRDGSVTQGGYSQAIVVDEDFVVRIPDSLPLDKAAPLLCAGITLFSPLRHWNAGPGTRLAIVGLGGLGHMGVKLGAAMGAEVTVLSQSLKKMEDGLRLGAKHYHATADPDTFTKLRGSFDLMLNTVSANLKLNDYLSLLDVDGTLVELGIPEHPMEVGAFPLALARRSLSGSNIGGIAETQEMLDFCAEHNVTPEIELIEPDYINEAYERVLASDVRYRFVIDISKL

SEQ ID NO: 84650 - DNA, 1047 bp, Bdellovibrio bacteriovorus HD100
  CDS (1)..(1047): transl_table=11
atgatccaggctaaaggcatggcggcccctacctccaaagcacctcttaaaccctacacttttgagcgtcgcgacccgaaagatcatgacgttgttatcgacatcaaatactgcggcatctgccactcggacattcacatggtgcgtgatgaatggggaccgggccatttcccgatggtgccaggtcacgaaattgccggcgttgtccgcgcggtaggcccgaaggtcaccaaatacaaggtcggcgaccatgtcggcgtcggttgcctggtggattcctgtgccgaatgcgcgcactgcaaacaggatctggaacagtactgcatggaaggtcagaccctgacttacggatctatggagcgtgatggttccggcatcactcaaggtggctattcgaacgtgattgttgtcaaagaaagcttcgtcgtgcgcattccagactctttgcctttggataaggcggctccccttctgtgcgcaggaatcacgctgtattccccactggcgcactggaaagccggtcccggcaaaaaagtggctatcatgggactgggtggcctgggacacatgggtgtgaaactggccaaggccatgggtgccgaagtcaccgtgctgagccactccgaaagcaaacgtgatgacgctttaaagctgggtgcggatcgctttgtgctgaccaaaaacgccgacgcgttcaaggacaatgcaatgtactttgatctgatcatcaacacggtttcatcggcggatcttgaaatggcgcgctatttcagtttactgaaactggatgggacgctggtgtctgtgggagctcccgacaagcctctgtctgtaaacgtcttcccgctgattttgatgcgtcgaaattttgcaggatctgcgatcggcggcttgaaagaaacccaggagatgctcgacttctgcgcgaaacacaatatcactccggaaatcgaactgatcacacctgatcaggtgaacgtggcttacgaacgcgttctaaaaagcgacgtgcgctatcgattcgttctggacatggggaaaatctaa

SEQ ID NO: 84651 - protein, 348 aa, Bdellovibrio bacteriovorus HD100
MIQAKGMAAPTSKAPLKPYTFERRDPKDHDVVIDIKYCGICHSDIHMVRDEWGPGHFPMVPGHEIAGVVRAVGPKVTKYKVGDHVGVGCLVDSCAECAHCKQDLEQYCMEGQTLTYGSMERDGSGITQGGYSNVIVVKESFVVRIPDSLPLDKAAPLLCAGITLYSPLAHWKAGPGKKVAIMGLGGLGHMGVKLAKAMGAEVTVLSHSESKRDDALKLGADRFVLTKNADAFKDNAMYFDLIINTVSSADLEMARYFSLLKLDGTLVSVGAPDKPLSVNVFPLILMRRNFAGSAIGGLKETQEMLDFCAKHNITPEIELITPDQVNVAYERVLKSDVRYRFVLDMGKI

SEQ ID NO: 84652 - DNA, 1044 bp, Bacillus cereus ATCC 10987
  CDS (1)..(1044): transl_table=11
atgaaagcagtagtagttaataaaaatagtaaagcaaacattgaaattattgaaaaggaattacgtccgttacactcaggtgaagcgctagtagatgtagagtattgtggagtttgtcatactgatttacacgttgcaaatcatgattttggaaacacagatggccgtattcttggtcatgagggtataggtattgtgacgaaaattgctgatgatgttacttcactaaaggtgggggaccgtgtaagtattgcatggatgttccaatcttgtgggcgttgtgaatattgcataacgggtagagaaacattttgccgtgaagtgaagaatgctggttattcagtagatggtggtatggctgaacaatgtattgttacagcagattatgcggtgaaagtaccagaaggattagatcctgctcaagcatcatccattacatgtgcgggtgtaactacatataaagctataaaagtatcggatattaaacctggccaacctatcgtcatctatggttgtggtggattaggtaacctagctattcaatatgctaaaaacgtatttggtgcaaaggtaattgcagtagatattaatgacgataaattagccttagcaaaagaggttggcgctgatatgactatcaatccaatttctcaaggtcctgctgataagattgttcaagaagagtttggtggtgcttatgcagctgtagtaacagccgtttctaaagtagcattcaactcagcagtagatgcggtacgtgcttgtggtaaagtcgttgcagtaggtttaccagtggaaacgatggatttaaacattccacgacttgtactagatggaattgaagtagttggttctttagtcggtactcgtaaagacttagaagaggcattcatgttcggtgcagaaggaaaagtagtgccggtcgttcaaacttgttctctagataaagtacaacatgtattcgaagaaatggaacaaggtagaattcaaggacgtatggtaatcgattttaaacacaataattgtgattgcaattcactttaa

SEQ ID NO: 84653 - protein, 347 aa, Bacillus cereus ATCC 10987
MKAVVVNKNSKANIEIIEKELRPLHSGEALVDVEYCGVCHTDLHVANHDFGNTDGRILGHEGIGIVTKIADDVTSLKVGDRVSIAWMFQSCGRCEYCITGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIVQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQHVFEEMEQGRIQGRMVIDFKHNNCDCNSL

SEQ ID NO: 84654 - DNA, 1158 bp, Eremothecium gossypii
  CDS (1)..(1158)
atgcgcaagcgcaacggcgccgcggccccccgcaacggcagcgtatataacggcggctgcgggcagctactctgccgcacgcagctccagccagtagctacaatgtcgtctccctctatccccaagacgcagcacgctatcgtcttcgacaaaaacggcgggcccctcgagtaccgcgagatcgaggtgcccgagcccaagcccacggagctgctgatcaacgtcaagtactccggcgtgtgccacacggacctgcacgcgtggaagggcgactggccgctgcccacgaaactgccgctcgtcggcgggcacgagggcgcaggcgtcgtcgttgcgatgggcgagaacgtgcgcggctggcaggtcggcgacctcgccggcatcaagtggctcaacggctcgtgcatgtcgtgcgaggcgtgtgagcagggccacgagtctaactgcccggaggcggacctgtccggctacacgcacgacgggtcgttccagcagtacgccacggcggacgcggtgcaggccgcgcacatcccggccggcaccgatctggcgcaggtcgcgccgatcctgtgcgcggggatcaccgtgtacaaggcgctcaagtccgcgaacctgcgtgcgggcaactgggtcgcgatctccggcgcgtgcggcggcctgggctcgctggccatccagtacgcgcgcgccatgggctaccgcgtgctcgagatcgacggcggcgacgagaaggaggcgctgttccgcaagctgggcggcgaggtcttcgtcgacttccgcaagtccaaggacgtcgtcgccgacgtcgtcaaggcgaccggcggcggcgcgcacggcgtgatcaacgtctccgtgtcggaggccgcgatcgagagctcgaccgagtacgtgcgctcgaacggcaccgtcgtgctggtcggcctgcccggcggggccaagtgcaagtccgacgtcttcaatcacgtggtcaagtcggtgtccatcgtgggctcctacgtcggcaaccgcgcggacacgcgcgaggcgctggacttcttcgcgcgcggcctggtgcagtgcccgatcaaggttgtgggcctgtccgagctgcccgacatctacggcaagatggagcggggcgaggtcgcggggcggtatgtggtggacacgtctaagtag

SEQ ID NO: 84655 - protein, 385 aa, Eremothecium gossypii
MRKRNGAAAPRNGSVYNGGCGQLLCRTQLQPVATMSSPSIPKTQHAIVFDKNGGPLEYREIEVPEPKPTELLINVKYSGVCHTDLHAWKGDWPLPTKLPLVGGHEGAGVVVAMGENVRGWQVGDLAGIKWLNGSCMSCEACEQGHESNCPEADLSGYTHDGSFQQYATADAVQAAHIPAGTDLAQVAPILCAGITVYKALKSANLRAGNWVAISGACGGLGSLAIQYARAMGYRVLEIDGGDEKEALFRKLGGEVFVDFRKSKDVVADVVKATGGGAHGVINVSVSEAAIESSTEYVRSNGTVVLVGLPGGAKCKSDVFNHVVKSVSIVGSYVGNRADTREALDFFARGLVQCPIKVVGLSELPDIYGKMERGEVAGRYVVDTSK

SEQ ID NO: 84656 - DNA, 1086 bp, Neurospora crassa
  CDS (1)..(1086)
atgtctgtccccgaaaagttcaccggcttccaggtcaacggccccgagacctggaccgagttccacaagaacgagttccagcccaagccctttggtgactacgacgtcgacatcaagattgagtgctgtggtgtttgcggtagcgatgttcacaccatcagcggcgggtggggcgagcagaagttccctcttgctgttggacatgaaatcatcggaaccgccctccgcgtcggtcccaaagtgactctcatcaagcccggccagcgtgtcggcgtgggcgcccagtcctactcgtgcctcgactgccgtcagtgcaagaacgacaatgagacatactgccgcaagcaactagacacttatggcgccgtgtggcctgataccggcatcgtcagccagggcggttactcctctcacgtccgcacccacgagcactgggtcttcccaatccccgacgccctcccctccaccgtcgccgctcccatgctctgcgccggtctaaccgcctactcccctctggtccgcaacggctgcggccccggcaagaaagtcggcatcgtcggcctcggcggcatcggccacctgggtctcttgttcgccaaagccctcggcgccaccgtctacgtgatctcgcgcacgcactccaaagaagccgacgcccgcaaaatgggcgccgacggcttcctcgctactgccgaccccaactggaacgaagagcacattatgacgtttgatctgatcatcaacacggccaatagctttgaggggttcgacctggatgcgtacttgagcttgttggatgtccatggcaagtgggtcagtgtgggattgcccgaagatgaggaggggattcgggtgcggaaccagacgttcttgaagaatgggtgttttttcgggagtagtcatttggggagccgcagggagacgttggagatgttgcagcttgcggcggacaagggggtcaggacgtgggtggaggaggtgaagattaatgaggaaaacctaaagggggtgatgcagaagatgaagggtgccggggggaggtatcggttttgtttgaccgggtatgaggaggcttttggggcgtaa

SEQ ID NO: 84657 - protein, 361 aa, Neurospora crassa
MSVPEKFTGFQVNGPETWTEFHKNEFQPKPFGDYDVDIKIECCGVCGSDVHTISGGWGEQKFPLAVGHEIIGTALRVGPKVTLIKPGQRVGVGAQSYSCLDCRQCKNDNETYCRKQLDTYGAVWPDTGIVSQGGYSSHVRTHEHWVFPIPDALPSTVAAPMLCAGLTAYSPLVRNGCGPGKKVGIVGLGGIGHLGLLFAKALGATVYVISRTHSKEADARKMGADGFLATADPNWNEEHIMTFDLIINTANSFEGFDLDAYLSLLDVHGKWVSVGLPEDEEGIRVRNQTFLKNGCFFGSSHLGSRRETLEMLQLAADKGVRTWVEEVKINEENLKGVMQKMKGAGGRYRFCLTGYEEAFGA

SEQ ID NO: 84658 - DNA, 1095 bp, Neurospora crassa
  CDS (1)..(1095)
atgggctacccagagactttcgagggcttcgtcgttgactcgcccaagacctggaaccagttccaccgccacgagctcaagcccaagccttttggcgatgacgacatcgacgtccagatcgagtgctgcggcgtgtgcgggtccgacattcacaccgtaaccggcggctggggtgactttgagggtcctctctgtgtcggccacgaggttgtcggcaaggccatcaaggtcggcaagaacgtgaccgagatcaagcagggcgatcgcgtcggcgttggtgcccaggtgtggtcctgcctcaagtgcgatgtctgcaagagcaagaacgagcagtactgccctcacatggttgacacttacaatgccaactacgaagacggctccaccgcccacggcggctgggcctctcacatccgcgcccaccagtacttcaccttcaagatccccgacgccatcccctcccacctcgccgcgcccctcctctgcgccggcatcaccacctactccccgctcgtgcgcgccaacgtcggccccggcaagaccgtcggcatcatcggcgtcggcggtctcggccacctaggcatccagtgggcgcgcgccctaggcgccgaggtgcacgtgctcacgcactccgcctacaaggccgacgacgccaaggccctgggcgcgcaaaacgttatcgtcaccagcgacgacgagaagtgggccgagccgtacaagttcaagttcgactttttgctcaactgcgccgacgcgacgcacaagttcgacatgaagacgtacctctcggtcctcaaggtgggcggcgagttccacatgtgcggcatccccgacaagccgctgcccccgctcgaggtgttggcgttcatgcagaacggcgccaagttgtcggccaaccacttgggtaaccaccaggagatgaaggccatgttgcagctggcggccgagaagggcatcgtgcccaaggtggagacggtgcagcttggagaggatgggtgcaaggaggcggtggagagggtcaaggagggcaacaaggtgcattaccgccttactttgacgggctttgacaaggtttttggaaaggttgagtactag

SEQ ID NO: 84659 - protein, 364 aa, Neurospora crassa
MGYPETFEGFVVDSPKTWNQFHRHELKPKPFGDDDIDVQIECCGVCGSDIHTVTGGWGDFEGPLCVGHEVVGKAIKVGKNVTEIKQGDRVGVGAQVWSCLKCDVCKSKNEQYCPHMVDTYNANYEDGSTAHGGWASHIRAHQYFTFKIPDAIPSHLAAPLLCAGITTYSPLVRANVGPGKTVGIIGVGGLGHLGIQWARALGAEVHVLTHSAYKADDAKALGAQNVIVTSDDEKWAEPYKFKFDFLLNCADATHKFDMKTYLSVLKVGGEFHMCGIPDKPLPPLEVLAFMQNGAKLSANHLGNHQEMKAMLQLAAEKGIVPKVETVQLGEDGCKEAVERVKEGNKVHYRLTLTGFDKVFGKVEY

SEQ ID NO: 84660 - DNA, 1107 bp, Neurospora crassa
  CDS (1)..(1107)
atgtctggcaccgattacaagttcgaaggctggctcggctttgacaagagctctgcccatggcaacatgcagtggggcgagttcgagcccaagccctgggaggagaccgatattgatatcaagatcgagtgctgcggcgtctgcggttccgacattcacactctgaggagcggttggggccctaccaactacccttgctgcgtcggtcacgaggttgtcggtaccgtcgtccgtgctggttccaaggttgagggcggcatcaaggtcggcgaccgtgttggtgttggtgctcagagcgatgcctgccgcaaccgcaccgacaagcactgcaagatctgcgccgacggcaactacaactactgccgcgtccaccacgttggtacctacaacggtgtctacatgaacggcggcaagtcttacggcggttacgctacctaccagcgtgtcccctctttcttcgccgtcaagattcccgagtcgatgccctcttctcacgccgcccccatgctttgcgccggtgtcaccacctacgctcccctcaagttccacggtgtcggccccggcaagcgcgtcggtgtcatcggtctcggtggtctcggccactttggtgtgatgtgggccaaggccctcggcgccgatgaggtcgttgtcatctcccgcagctccagcaagaaggcggatgccatggccatgggtgctaccggcttcatcgccactggcgaggaccccgagtggctcaacaagaacaggtcgtctctcgacatcattctctgcaccgcctcctccgccgatatgcccttcaacgactacctcttccttctcgacctcgatggtgtcttcatccaggtcggcgcccccgacgatgatctcccccgcatcaagcagatggccctcatcttcaaccgcatcaagctcaccggttccctcatcggctcgcccgacgatatccgcgagatgttccagctcgcggttgacaagaaggtccagccctggatcagcgagatccccatgaaggaggccaacaaggccattgtcgacttcgaggacggcaagcccaggtaccgtttcgtcctcaagaacgaggactacactcctgttcaggcttag

SEQ ID NO: 84661 - protein, 368 aa, Neurospora crassa
MSGTDYKFEGWLGFDKSSAHGNMQWGEFEPKPWEETDIDIKIECCGVCGSDIHTLRSGWGPTNYPCCVGHEVVGTVVRAGSKVEGGIKVGDRVGVGAQSDACRNRTDKHCKICADGNYNYCRVHHVGTYNGVYMNGGKSYGGYATYQRVPSFFAVKIPESMPSSHAAPMLCAGVTTYAPLKFHGVGPGKRVGVIGLGGLGHFGVMWAKALGADEVVVISRSSSKKADAMAMGATGFIATGEDPEWLNKNRSSLDIILCTASSADMPFNDYLFLLDLDGVFIQVGAPDDDLPRIKQMALIFNRIKLTGSLIGSPDDIREMFQLAVDKKVQPWISEIPMKEANKAIVDFEDGKPRYRFVLKNEDYTPVQA

SEQ ID NO: 84662 - DNA, 1020 bp, Magnaporthe grisea 70-15
  CDS (1)..(1020)
atgtcactcccatctacctacaaggccgccatcttcaaggcacagggccagcagttgacccttgaggaccagccgatgaaggagcctggtcgcggtgagattctcgtcaaggttgaggcctgcggcgtctgccattcggattcattcgtgcagaataatgcttttggtggtggtttccctcgcatccctggccatgagataattggccgcgtcgcagcagttgggccagaagtcagcggatgggaagctggccagcgtgtggggtctggctggcatggtggacacgatggaacctgcaaggcatgcaacaaaggcctgcatcagatgtgcgaggctaaaaccatcaacggcataatcaaggacggcggctatgccgaatactgcatcatcaggtccgaagcagctgtccgcatccctgatcatgtcgacgcagccaaatacgcacctatactgtgcgccggcgtgacgaccttcaactcgataaagcgccagggcatcgcggcaggcgagacggtagccattcagggactgggtggcctaggtcacctggcgatccagtactcccagcgcatgggctaccgcgtcgtggccatctcgagaggctccgacaaggagaaggcggccagagagctgggcgcgcacgagtacatcgacgcagccaaggaagatcccgccgcagctctccaaaagctcggcggagctgcacttattgttgccaccgcgccccatgcaaacgcaatctcccccctgatcggcggcctggggctaatgggaaaattgctgctcctagcggttccgggtgacttgagcgtgaacaccaacataatgattggacaaggctgctcagtcaccgcgtggccctctggcaatgctctcgactctgaagaagccatcaacttcaccgagctgcagaatgttgactgcaaagttgagactttccctctagaaaaggcacaagaggcgttcaacgtaatgatggacggttccgtgcggttccgatcagtcctgacaatgacttga

SEQ ID NO: 84663 - protein, 339 aa, Magnaporthe grisea 70-15
MSLPSTYKAAIFKAQGQQLTLEDQPMKEPGRGEILVKVEACGVCHSDSFVQNNAFGGGFPRIPGHEIIGRVAAVGPEVSGWEAGQRVGSGWHGGHDGTCKACNKGLHQMCEAKTINGIIKDGGYAEYCIIRSEAAVRIPDHVDAAKYAPILCAGVTTFNSIKRQGIAAGETVAIQGLGGLGHLAIQYSQRMGYRVVAISRGSDKEKAARELGAHEYIDAAKEDPAAALQKLGGAALIVATAPHANAISPLIGGLGLMGKLLLLAVPGDLSVNTNIMIGQGCSVTAWPSGNALDSEEAINFTELQNVDCKVETFPLEKAQEAFNVMMDGSVRFRSVLTMT

SEQ ID NO: 84664 - DNA, 1095 bp, Magnaporthe grisea 70-15
  CDS (1)..(1095)
atggccgctaccgactacaagtttgagggctggctgggtgacagccccgagtcagccaacggcaagatgcgttggggagagtttgagcccaagaagtggacggaggacgatgtcgacatcaagatctcccactgcggtatctgcggttcggatctgcacaccctctcatctggctggggccctacaccttacccctgctgtgtcggccacgagattgtcggccgagccgtccgcgtcggcagcaatgtcaaggacatcaaggttggcgaccgggtcggtgttggcgcgcaggcccgcagctgcatgagcgccgactgccccgagtgctccatcggccgtgagaactactgctccaccaagggccagctgatcaacacatacggctccgtctaccccggcgacgaaggcaagtcgtacggcggctacgccacctacaaccgcaccaacgccaagttctgcatcaagatccccgacggcgtgccctccgagtacgccgcgcccctcatgtgtggtggtgtgacggtgtggtctccgctcaaggacaacaagtgcgggcctggcaagaacgtcggcatcgtcggcgtcggcggcctgggtcactttgccgtgctcttcgccaaggccatgggcgccgacaaggtggttggcgtgtcgaggcgcgagtccaagcgcaaggaggtcatgtccctgggcgccgacgactacatcgcgaccgaggacgagaaggactgggagaagcaccaccgccgcagcctggacctcatcatctgcaccgtctcgcacacgggcatgccgctcgacaagtacctgatgctgctcaagcccaacggcatcctgatcaacgtcggcgtccccgagggcggcgccctgcccaacctcaacgccttcaccctcgtcatcaacgccgtcagcgtcggcggcagcctgatcggcagccccagcgagatccgcgagatgctcgaattcgtcgccgagcacaacatcaagcccctgatcgagaccaggccgatgaaggaggccaaccaggccatcctcgacatggagcacggcaaggccaggtaccgctacgtgctggtcaacgaggacaacgagtaa

SEQ ID NO: 84665 - protein, 364 aa, Magnaporthe grisea 70-15
MAATDYKFEGWLGDSPESANGKMRWGEFEPKKWTEDDVDIKISHCGICGSDLHTLSSGWGPTPYPCCVGHEIVGRAVRVGSNVKDIKVGDRVGVGAQARSCMSADCPECSIGRENYCSTKGQLINTYGSVYPGDEGKSYGGYATYNRTNAKFCIKIPDGVPSEYAAPLMCGGVTVWSPLKDNKCGPGKNVGIVGVGGLGHFAVLFAKAMGADKVVGVSRRESKRKEVMSLGADDYIATEDEKDWEKHHRRSLDLIICTVSHTGMPLDKYLMLLKPNGILINVGVPEGGALPNLNAFTLVINAVSVGGSLIGSPSEIREMLEFVAEHNIKPLIETRPMKEANQAILDMEHGKARYRYVLVNEDNE

SEQ ID NO: 84666 - DNA, 1083 bp, Magnaporthe grisea 70-15
  CDS (1)..(1083)
atgccttacccagaaaagttcacgggcttccaggtcaagagcccggacagctggaccgaattccacaagaacgagttcgaccccaagccctttggtgactacgatgtcgacattgagatcgagtgctgcggtgtctgcggcagtgacgtccacactgtctctggtggctggggagagcagaagttccctctggttgtcggacatgagatcgttggcaaggccatcaaggtcggccccaaagtcacactgatcaaggagggccagcgcgttggtgttggtgcacaatcctatgcctgcctggactgcaagcagtgcaaaaacgacaatgagacatactgcaagaagcagctcgacacatacggctccgtctggcccgactccggagttgtctcacaaggaggctactcgtctcatgtccggactcatgagcactgggtcttccccatccccgacgccctagccagcaccatcgctgcccctatgctctgcgccggtctgacggcctacagcccacttgtgcgcaacggcgtcggtcccggcaagaaggtcggcatcctcggcatgggaggaatcggacactttgggctgctcttcgccaaggccctgggcgccgaggtctgggccatctcgcgcagccgcgccaaggaggccgactgcaaggccatgggcgccgacggcttcctggccacgtcggagaagggctggaacgagccgcacgccatgacctttgacgccatcctcaacacggccagcagcttcgagggttgggactttggcgcctacctgggcctgctggacgtgcacggcaagtttgtcgccgtcggtctgcccgagggcgagggcatgaagatccgcaaccaggacctgctcagcaacggcgtcttcatcggcgcgtcgcacctgggctccaggagggagaccatcgagatgctgcagctcgcggcggacaagggcatcaagtcgtgggtcgaggagatccagatcggtgaggatgggctcaaggaggcgctgacgagggttcacaagacggatgtgcggtaccgtttctgcatgactggatacgacaaggtattcaccgcatga

SEQ ID NO: 84667 - protein, 360 aa, Magnaporthe grisea 70-15
MPYPEKFTGFQVKSPDSWTEFHKNEFDPKPFGDYDVDIEIECCGVCGSDVHTVSGGWGEQKFPLVVGHEIVGKAIKVGPKVTLIKEGQRVGVGAQSYACLDCKQCKNDNETYCKKQLDTYGSVWPDSGVVSQGGYSSHVRTHEHWVFPIPDALASTIAAPMLCAGLTAYSPLVRNGVGPGKKVGILGMGGIGHFGLLFAKALGAEVWAISRSRAKEADCKAMGADGFLATSEKGWNEPHAMTFDAILNTASSFEGWDFGAYLGLLDVHGKFVAVGLPEGEGMKIRNQDLLSNGVFIGASHLGSRRETIEMLQLAADKGIKSWVEEIQIGEDGLKEALTRVHKTDVRYRFCMTGYDKVFTA

SEQ ID NO: 84668 - DNA, 1083 bp, Magnaporthe grisea 70-15
  CDS (1)..(1083)
atgggttacccagagactttcgagggcttctgcgtcgattctcccaagacgtggaacaagttttccaagcaggagctcaagcccaagccctttgaggactacgacatcgacgtggagatcgcagcgtgcggtgtgtgcggttcagacatccacactctcacgggcggctggggtgactttcaaggcccactctgcgtcggccatgaggtggtcggtcgcgccgtccgggtgggcagcaaggtccggtccgagatcaaggagggcgaccgcgtcggcgtgggtgcgcaggtctgggcctgcctcaaatgcaaggtctgcgagagcaagaacgaaaactactgcccgcacatggtggacacgtacaatgcaaagtatgaggacggcagcagcgcccacggcggctacgccagccacatccgtgcgcacgagtactttacctttaagattcccgacgggctagagactgagattgctgcgccgttgctctgtgccggaatcacggtctactcccccctgttccgcgccggagtcgggccaggaaagaaggtcgccgtcgtcggcatcggcggtctgggccacctgggtgtgcagttctccaaggccctcggcgccgagacgtacgccatcacgcactccaagaacaaggtcgaggacgcaaagaagctgggtgcgaaggaggttattgtcagctctgataaggactggcacaagccctacgccttcacatttgactttatcctcaacgccgccgacgccctggaccagttcgatctccctgcctatatgtcgacgctcaacatagagggccagttccacaccgtcggcatctcggacaagcccgtgccccagctcactgcattcgcctttgcccccaacgccgccaagctgaccggcagccacctcggcaaccaccaagagatggatgccatgttgaaactggccgccgagaagaacgtcaagccgtgggtcgagacgatcgacgtatcggaagagggctgtaagaaggccgtcgagggcgtcaaggataacaaggtccgttataggtacacactgactggctttgacaaggcgtttagccgttga

SEQ ID NO: 84669 - protein, 360 aa, Magnaporthe grisea 70-15
MGYPETFEGFCVDSPKTWNKFSKQELKPKPFEDYDIDVEIAACGVCGSDIHTLTGGWGDFQGPLCVGHEVVGRAVRVGSKVRSEIKEGDRVGVGAQVWACLKCKVCESKNENYCPHMVDTYNAKYEDGSSAHGGYASHIRAHEYFTFKIPDGLETEIAAPLLCAGITVYSPLFRAGVGPGKKVAVVGIGGLGHLGVQFSKALGAETYAITHSKNKVEDAKKLGAKEVIVSSDKDWHKPYAFTFDFILNAADALDQFDLPAYMSTLNIEGQFHTVGISDKPVPQLTAFAFAPNAAKLTGSHLGNHQEMDAMLKLAAEKNVKPWVETIDVSEEGCKKAVEGVKDNKVRYRYTLTGFDKAFSR

SEQ ID NO: 84670 - DNA, 1068 bp, Gibberella zeae PH-1
  CDS (1)..(1068)
atgtctacacaacaaaagttcgagggttgggtcgctgaaaagtccacaaaggaacaggacttggtctggaaggaatatgagatgaagccctttgaagacacggatattgagattcgtattactcattgtggtgtctgtggaactgacgaccatatctccaaaaacggctggggatctaccaaatatcccatcatcgttggacatgaaatcgtgggtgtagcaacccgcatcggttccaaagccgaaggcgacatcaaagaaggcgatatagtcggagtaggtgcccaaagcgatgcatgttttgaacgcgacggtccatgcgaggagtgtgccaatggtctttataactactgctccaagaacacccctacgtacggcggtgtacactggtgcggaactccatctacaggtggttacgcacgatatcatcgctgcccatccagattcgtcgtcaaaatccctcagggcctagctcccgaacttgcggctccgatgctgtgtgctggtgcaaccatgtatgcgcccttgaattatttcggagcaaccggccgaaaggttgctatcattggaattggtggattgggccatttcggtatcatgtttgctaaagctcttgatgctgccgaagttgtagccatttcgagaggttctgataagaagggtgatgcccttactcttggagctgacgagcatattgctacgagtgaagaaggctgggctgagaagaataagaggagatttgacttgatcatcaacacagcagatggatccaacatgccatggaatgaatacttgggtcttctgagagtagatggcacaatggtttcggtcggtgcacctgagaagccaatcccgatcaacatcttctctctactcccaatccgtggcagattcacatctacttcagttgctactcccaacgaggtgcgagacatgcttcagttggctgccgataaaagtctcaagccatgggttgaggaacgtccaatgagagaggcgaacgaagcattgaaggaccttcaagctggaaagcctagatttcgatatgttcttgtcaatgaggactga

SEQ ID NO: 84671 - protein, 355 aa, Gibberella zeae PH-1
MSTQQKFEGWVAEKSTKEQDLVWKEYEMKPFEDTDIEIRITHCGVCGTDDHISKNGWGSTKYPIIVGHEIVGVATRIGSKAEGDIKEGDIVGVGAQSDACFERDGPCEECANGLYNYCSKNTPTYGGVHWCGTPSTGGYARYHRCPSRFVVKIPQGLAPELAAPMLCAGATMYAPLNYFGATGRKVAIIGIGGLGHFGIMFAKALDAAEVVAISRGSDKKGDALTLGADEHIATSEEGWAEKNKRRFDLIINTADGSNMPWNEYLGLLRVDGTMVSVGAPEKPIPINIFSLLPIRGRFTSTSVATPNEVRDMLQLAADKSLKPWVEERPMREANEALKDLQAGKPRFRYVLVNED

SEQ ID NO: 84672 - DNA, 1086 bp, Gibberella zeae PH-1
  CDS (1)..(1086)
atggccgaatacgagttcaagggatggttgggcaaggatgccgagtccgccaacggaaagatggaatggggttcattcgagcccaagaagtgggaggagaacgacgtcgatatcaagatcactcactgcggcgtctgcggttctgaccttcacactctccgatctggctggggcgagacacctttcccctgctgtgtcggccacgagatcgtcggcaaggccgtcaaggttggcaagaacgtcaagaacatcaaggtcggcgaccgcgtcggtgtaggtgcccaggctcgcagctgtctccgtgaggactgcattgagtgctctgccggccgagtcaactactgcgacaacatggtcagcacctacggctccgtctaccccgacggcatcggcaagtcttacggtggatacgccgactacaaccgtaccgactctcgtttcgtcgtcaagatccccgaggcgcttccctctgagcttgccgctcccatgctctgcggtggtgtcaccgtctacgctcctctccgcaacaacggctgcggtcccggaaagactgttggtatcgtcggtgtcggtggcctgggtcacttcggtatcctcttcgcaaaggctctcggcgccgacaaggtcgtcggtatctcccgcaaggcctccaagagggacgaggttctcgctctcggcgctgactcttacatcgccactgacgacgatgaggactgggccaacaagtacgccaagaccgtcgacatcattgtctgcaccgtctccagcagcaagatgcccttcagcgactacttcaagctcctccgccacggcggcaacttcatccaggtcggtgctcccgactctggcctgctccctcccgtcaacgccttcactctcatcaagggtggattcaagctcagcggcagccttatcggctctcccgccgatatcgaggagatgcttgagcttgctgttaagaagaatgtcaagccctggattgagaagcgacccatggaggacgccaaccagaccattatcgatattgaggagggcaaggcccgataccgatacgttttggtgaaccagaagaacattgagcagtaa

SEQ ID NO: 84673 - protein, 361 aa, Gibberella zeae PH-1
MAEYEFKGWLGKDAESANGKMEWGSFEPKKWEENDVDIKITHCGVCGSDLHTLRSGWGETPFPCCVGHEIVGKAVKVGKNVKNIKVGDRVGVGAQARSCLREDCIECSAGRVNYCDNMVSTYGSVYPDGIGKSYGGYADYNRTDSRFVVKIPEALPSELAAPMLCGGVTVYAPLRNNGCGPGKTVGIVGVGGLGHFGILFAKALGADKVVGISRKASKRDEVLALGADSYIATDDDEDWANKYAKTVDIIVCTVSSSKMPFSDYFKLLRHGGNFIQVGAPDSGLLPPVNAFTLIKGGFKLSGSLIGSPADIEEMLELAVKKNVKPWIEKRPMEDANQTIIDIEEGKARYRYVLVNQKNIEQ

SEQ ID NO: 84674 - DNA, 996 bp, Gibberella zeae PH-1
  CDS (1)..(996)
atggtctctttcaaggtcttccgcggtaccccagagggcaagatcgtcgccgacaacgtcgagcgcgagctcgagaaccacgaggtctttatcgagacaacacactctggtgtttgcggtactgataagctctacatgaccagcggcgttgtcctgggtcacgagggtgtcggtatcgtcaaggctgttggttccgccgtcacaaacgtcaagaacggcgacagagtcggattcggctacactcaccagatctgcggccactgcgacaactgctgcaccgaccgcgaccagtactgccgtgaccgccagatttacggcttctctgatttcaacaacggctctttctcctacggagctgtttgggattccaagactgtttgccctattcccgagggttacgattccgctgatgctgctcctctgctctgcgctggatctactgtctggacatgtcttacccagtacggtctccgacctcttgagtcagtaggcatcgttggtattggtggacttggccatctcgctatcaagctggccgccgccatgggcaaccacgttgttgtcttctccagctccgagtccaagcgacaggaggctatggactacggtgcttccgagttccacgtttacaagtctggtgacaaggctcccgagggtctcaagcccgtcaagcacctccttctctgcggcagtgccaacatcgactacagcggtcttgcctccatcgtcgactacgacggctccatctaccctctcaccgctgctctcgaggccactcccgttcccctgactgagctctctctcaagggtatccgcatccagggatctcttgtcggttctcgcgacagcgtccgcaagctccttgagtttgtcgccagaaagaacatcactcctactaccatgaagtactccctcaacgaggagggtattgagaaggctctgcacgacctcaaggacggtaaggtccgatacagagctgttcttgtcaaggagtaa

SEQ ID NO: 84675 - protein, 331 aa, Gibberella zeae PH-1
MVSFKVFRGTPEGKIVADNVERELENHEVFIETTHSGVCGTDKLYMTSGVVLGHEGVGIVKAVGSAVTNVKNGDRVGFGYTHQICGHCDNCCTDRDQYCRDRQIYGFSDFNNGSFSYGAVWDSKTVCPIPEGYDSADAAPLLCAGSTVWTCLTQYGLRPLESVGIVGIGGLGHLAIKLAAAMGNHVVVFSSSESKRQEAMDYGASEFHVYKSGDKAPEGLKPVKHLLLCGSANIDYSGLASIVDYDGSIYPLTAALEATPVPLTELSLKGIRIQGSLVGSRDSVRKLLEFVARKNITPTTMKYSLNEEGIEKALHDLKDGKVRYRAVLVKE

SEQ ID NO: 84676 - DNA, 1086 bp, Gibberella zeae PH-1
  CDS (1)..(1086)
atgtctgtacaaattccatctcaacaacgcgcagcagtccgtcaaggatccggcccagatgcaagagctcccatcaagaccgtccccgtacctagcccaggtccgggccaaattctcgtcaaggtcaattggaccggtctctgcggctcagacaaatctcttctccacgatgaatggagcgactttggcatctgtatgaaggacgtcaccaatggtattgccggccacgagggagccggatctgttgtagcagtgggtcaaggtatggagcagcgatggaagattggtgatcgagctggtgtgaagtggattgctagcgtttgcggtgagtgcgacttttgtatggttggctccgatgaggtgcattgcccggagcagacaaacagtgggttttcagtgccggggacattccaggagtacgtcgttgcggatgggaaatattcatcgaaactacctgatggtgttactgatgaagaggctggacctattatgtgtggtggtgttaccgcgtatactgcttgcaagagatccggagttactccaggacagtggctagtcattcctggtgcaggcggaggtctcggccacttcgcaatccaatatgccaaagcaatgggcatgcgtgtcattgccattgacggcggtgacgagaagcgcgacttatgcctcaaactcggagctgaagtctttatcgacttcaagaccaccaaagacattgcaacccaagtactcaaggtcactacacacggtgctcacggcgtcatcgtcacagccgcaacccgagcagcgtatgaatcagccccaaactatcttcgtccaaatggaacagtcgttgctgtaggacttccccaggacccaaccgttcttgctggcgcgccgccgatgcttgtcgcgctgcgaaggctgaagattgtggggagtgtcacgggaagtatgaaggatgttgaggaagctcttgaatttactgccagagggcttgttcacccgattctgtcaaagggcaaacttgaggatcttgatgattgggtacacaagttggcgactggtcaggtcgcaggccgttgtgttctcaaggttgcagcatga

SEQ ID NO: 84677 - protein, 361 aa, Gibberella zeae PH-1
MSVQIPSQQRAAVRQGSGPDARAPIKTVPVPSPGPGQILVKVNWTGLCGSDKSLLHDEWSDFGICMKDVTNGIAGHEGAGSVVAVGQGMEQRWKIGDRAGVKWIASVCGECDFCMVGSDEVHCPEQTNSGFSVPGTFQEYVVADGKYSSKLPDGVTDEEAGPIMCGGVTAYTACKRSGVTPGQWLVIPGAGGGLGHFAIQYAKAMGMRVIAIDGGDEKRDLCLKLGAEVFIDFKTTKDIATQVLKVTTHGAHGVIVTAATRAAYESAPNYLRPNGTVVAVGLPQDPTVLAGAPPMLVALRRLKIVGSVTGSMKDVEEALEFTARGLVHPILSKGKLEDLDDWVHKLATGQVAGRCVLKVAA

SEQ ID NO: 84678 - DNA, 1026 bp, Gibberella zeae PH-1
  CDS (1)..(1026)
atgcctcaacaacttattggatccgagtataccgtctatcgttccggtgacggtaatggaggcttcaccccaaccaccgtcaaggtgactaccctcggtccccatgacattcttgtgcgcatcacacatagcggcgtatgccatacagacatcacgttttgtcagatgggtgctcccatagctcttgggcacgagggtgtcggcatcgtcgaagccgtgggatctctcgtgacacagttcaacgtcggagatcgcgctggtggtggtttccatcgagacgcgtgcggccactgcaagtattgtctttccggaaaagacatatactgctacaatcgtgtcatcttcggtgaaggcgacttcgataacgggacttttggcaagtattatatcggaaaggagacatacttgcacaagatccccgagggcctcgccagcgagcatgccgcgcctcttcagtgtgccggtgcgactgtttatgctgctctcaaggctaccgtcacccctgagaaaagggtaggtatcctgggaatcggcggactaggccatcttgctattcagtacgcaaacaagatgggtgcggatgttattatatacagcacgagcaccagtaaggagacggaggcacgtcaacttggtgcaaaggagttccatctcctggacaacatgtttgatgatgttaaggcacccatcgatgttctcgtcatctgcggaactaagtatcctgattgggatcgtgtcatggcaaaggaatttctcgccagggacggtgttatcgtccctcttgctgcccctgtacacggacctctgagcctgcctgctggagccatgttcttccagggatatcacgtcttttcgagtttggttggttcccgcaatgtccacgatgagatgctggagttctcagcccgacatggcatcaagcccatggttcagatcttcaagcatgagggtgctgagacgatcagggaagtatttgagcttgtacaaatgaacaagatgagatacagggctgttttggagatgtga

SEQ ID NO: 84679 - protein, 341 aa, Gibberella zeae PH-1
MPQQLIGSEYTVYRSGDGNGGFTPTTVKVTTLGPHDILVRITHSGVCHTDITFCQMGAPIALGHEGVGIVEAVGSLVTQFNVGDRAGGGFHRDACGHCKYCLSGKDIYCYNRVIFGEGDFDNGTFGKYYIGKETYLHKIPEGLASEHAAPLQCAGATVYAALKATVTPEKRVGILGIGGLGHLAIQYANKMGADVIIYSTSTSKETEARQLGAKEFHLLDNMFDDVKAPIDVLVICGTKYPDWDRVMAKEFLARDGVIVPLAAPVHGPLSLPAGAMFFQGYHVFSSLVGSRNVHDEMLEFSARHGIKPMVQIFKHEGAETIREVFELVQMNKMRYRAVLEM

SEQ ID NO: 84680 - DNA, 1083 bp, Gibberella zeae PH-1
  CDS (1)..(1083)
atgtctgtccccgacaagttccagggcttccagtcccccagcgccgagcactggaccgacttccagaagaactcattcgagcctcgtccctttggtgaatacgatgtcgacatcaaggttgagtgctgcggtgtttgcgccagtgatcgccacaccatcagcggagactggggtgcctgcccttaccctcttgctgtcggccacgaggttgtcggcaaggtcctccgtgtaggcgacaaggtcactctcgccaaggttggagaccgtgtcggcgccggtgcccaggtttggtcctgtatggactgccgtcagtgcaagaatgacaacgagacctactgcaaggaccagattgacgcctatggcgctgattaccttgacaccggattcaagacccagggtggttactcttcccacagccgagtgcatgagtactgggtctaccccatccccgaggctctgtcaagcacccaagctgctcccatgctctgcgccggtatcaccgtatacagccctctgaagcgtctcggcgccggtcctggaaagaaggtcggtatcgtcggtatcggtggtctcggtcactacggtgtcatcttcgccaaggctctgggtgccgaagtctgggccatctcccgctcgcgagccaaggaggaggatgcccgcaagatgggcgccgacggtttcctggccacgggtgagaagaactggaccgagggccacaagatgacatttgacatcatcatcaacaccgctacctcgttcgatggcttcgctctcagcgagtacctcagcctcctcgatattcacggccactggaactcggtcggtctgcctggtggcgacggaatcgagatccgcaaccaggactttattaccaacggttgctacatcggcacgtctcacttgggaagccgacgtgagatgctcgagatgcttcagctcgctgctgacaagggtctcaagtcatggattgaggagatccccatctccaccaagggtcttcagcaggccatgcaggctttggagaagagctctgttcgttaccgatcttgcatgacaaactacgatgaggcctttggtgcttga

SEQ ID NO: 84681 - protein, 360 aa, Gibberella zeae PH-1
MSVPDKFQGFQSPSAEHWTDFQKNSFEPRPFGEYDVDIKVECCGVCASDRHTISGDWGACPYPLAVGHEVVGKVLRVGDKVTLAKVGDRVGAGAQVWSCMDCRQCKNDNETYCKDQIDAYGADYLDTGFKTQGGYSSHSRVHEYWVYPIPEALSSTQAAPMLCAGITVYSPLKRLGAGPGKKVGIVGIGGLGHYGVIFAKALGAEVWAISRSRAKEEDARKMGADGFLATGEKNWTEGHKMTFDIIINTATSFDGFALSEYLSLLDIHGHWNSVGLPGGDGIEIRNQDFITNGCYIGTSHLGSRREMLEMLQLAADKGLKSWIEEIPISTKGLQQAMQALEKSSVRYRSCMTNYDEAFGA

SEQ ID NO: 84682 - DNA, 1083 bp, Gibberella zeae PH-1
  CDS (1)..(1083)
atgggttaccctgatactttcgaaggcttctgcgtcgacagccccaaatcatggaacaagtttgagaagcaaacccttacacccaagacctggggagaccgcgatattgatgtcgagatcgaatgctgcggtgtctgcggctctgatgtccacaccgtcactggtggctggggagactttgagggtcctctctgtgttggtcacgaagttgttggcaaggctgtacgagttggtgacaaggtcagcgagatcaaggttggcgaccgtgttggtgttggtgctcaggtttcttcttgtctcaagtgcaagctctgcaacaacaagaacgaaaactactgccctgacatggtcgacacttacaactgcaaataccctgatggcagtgtcgctcacggtggtttcgcttctcacatccgtgctcacgagtactttaccttcaagattcccgatgccctcaagagcgagcaggtcgctcctcttctctgcgccggcatcaccacttactctcctctcgtgagagctggcgttggcccaggcaaggtcgtcgcagttcttggcatcggaggtctcggccatatgggtgtccaatgggccaaggctttgggtgctgaggtttacgccatgacgcactccccctccaaggttgaggacgcaaagaagctgggcgcaaaggaggttatcgtcacctctgaggagggatgggccgacaagtacaagttcacctttgactttatcctcaactgtgccgacatgacacacaagttcgacatgaacgcctacatgggcaccctcaacattggcggcgagttccacaacgttggtcttcccgacgagccccttccccagttcactgctggtacatttgctggcaatgctggcaagataaccggcagccatctcggtaacaaccaggagatgaacgctatgcttaagcttgctgctgagaagaacattgttgcttgggttgagacgattgacatttccgagaagggatgtgctgaggcgatcgagcgtgtaaaggagaacaaggtgcgctaccgatttaccttgactggattcgaaaaggtatttaagaaggattaa

SEQ ID NO: 84683 - protein, 360 aa, Gibberella zeae PH-1
MGYPDTFEGFCVDSPKSWNKFEKQTLTPKTWGDRDIDVEIECCGVCGSDVHTVTGGWGDFEGPLCVGHEVVGKAVRVGDKVSEIKVGDRVGVGAQVSSCLKCKLCNNKNENYCPDMVDTYNCKYPDGSVAHGGFASHIRAHEYFTFKIPDALKSEQVAPLLCAGITTYSPLVRAGVGPGKVVAVLGIGGLGHMGVQWAKALGAEVYAMTHSPSKVEDAKKLGAKEVIVTSEEGWADKYKFTFDFILNCADMTHKFDMNAYMGTLNIGGEFHNVGLPDEPLPQFTAGTFAGNAGKITGSHLGNNQEMNAMLKLAAEKNIVAWVETIDISEKGCAEAIERVKENKVRYRFTLTGFEKVFKKD

SEQ ID NO: 84684 - DNA, 1023 bp, Gibberella zeae PH-1
  CDS (1)..(1023)
atgtcttctcttccccaaacatacaaggcctgtgtcatcgagaaagccaatgctcccttcacactcaaggatgtccccctgaagcacccctcaaagggccaaattctcgtcaaggtcctcgcctgcggtgtctgtttctcagacgtgggtgtgagcgaaggccacatgggcgacgtctttccccgcgtccccggccatgaaatcatcggcgatgtcgtcgaagtcggcgaagacgttgacaactttaagaacggcgaccgagttggtggaccttggcacggcggccatgatcgaacttgccgacagtgtcaacgagcgcagttccaaatgtgcgaccacaaggaggtcaatggtgtgagtcgagatggtggcttcgctgagtatgtcctccttcgctcagaggctgttgtccgggtacccaaggagattgaacccgccgacgctgctcctcttctttgcgctggtgtcactgtctttaacggtatccgcaagatgcacgttgagcagggccgcatcgtcgcagttcagggtctcggtggcctaggtcatcttgcagtacagtacgcctacaagatgggttacgaagtcgccgttctttcttcaaccgacgacaaggccgactttgcaaagaagctcggcgctcaccactacatcaacaccaagactagcgacgtcggcgaagaactcaacaagcttggaggtgcatcaatcatcgtccagacagcacccaaccccaaggccatctctcctctcatccaaggactcgcccccgaaggcaagttgctcaacctcgcgcccgttggtggtgcagagtttgataccgtggctttggtgctgaagggcgccagcgttgttggctggcccagcggtcatgctcttgactccgaggaggcgctgcgcttctctttgacgcatggagtcaagtgtatggttgagaagtatccattggaaaaggtccaggatgcagtcgatagcctgaaggctggcaagcctcgattcaggaatgtcttggtaatggagtaa

SEQ ID NO: 84685 - protein, 340 aa, Gibberella zeae PH-1
MSSLPQTYKACVIEKANAPFTLKDVPLKHPSKGQILVKVLACGVCFSDVGVSEGHMGDVFPRVPGHEIIGDVVEVGEDVDNFKNGDRVGGPWHGGHDRTCRQCQRAQFQMCDHKEVNGVSRDGGFAEYVLLRSEAVVRVPKEIEPADAAPLLCAGVTVFNGIRKMHVEQGRIVAVQGLGGLGHLAVQYAYKMGYEVAVLSSTDDKADFAKKLGAHHYINTKTSDVGEELNKLGGASIIVQTAPNPKAISPLIQGLAPEGKLLNLAPVGGAEFDTVALVLKGASVVGWPSGHALDSEEALRFSLTHGVKCMVEKYPLEKVQDAVDSLKAGKPRFRNVLVME

SEQ ID NO: 84686 - DNA, 1074 bp, Ustilago maydis 521
  CDS (1)..(1074)
atgcctcgcggatacggtatcgccgactccaagaattggaccgacttcaaggtctacgatttcgacctcaagaaggagactgacgacgatgtcgacattgctatcacccactgtggtgtctgcggttcggatgtccataccatctccggtggttggggccctctgaagcacgacttctgcattcctggtcatgagatcattggcatcgccaccaaggtcggcaagaacgtcaaggacatcaaggttggcgaccgagtcggcgtcggtgcccaggtcgattcttgtggtgaatgcgtaccttgccaagatgaagaagagcagtactgtcgcggaaatggcaccaagaaactagtagatacgtacaacgatacgtacagtgaatgcggcacaaaggctatgggtggctattcgacccacatcaggactcagcagcagtttgtcttcccgattcctgacaagatcaagtccgagcatgctgctcctatgctttgcggtggtcttacgctcttctcacctctgatccgcaacggcgctggcccaggaaaacgggttggaatcgttggaatcggcggccttggtcactttggtgtcatgtttgcccacgctctcggtgccgaagtggttgccatctcgcactctcctcgcaagcgcgaggatgcgctcaagatgggtgccaaagagttcgtctccaccggcgagaaccccaactgggccgaggagtacaagaacaagcctttcgacttgatcatcaacactgcctcctccaacgccgttgacctccgcacgatccttaccacgctcaaggtacacggccgtctcatttgcgtcggaatgcccgaagatgtcttcaaggttcgcatccaggactttgccggtaatggttgcctgatgggctcctcccatatcggaagcaagaaggaggctcttcagatgctcgagctcgctgctgagaaggatatccagccttgggtcgagattctccctatgaaggactgcagcaaggccgtcaagagggtggcagacaacgacatccgctaccgattcgtgctcgagcaggatctcgagaagcactaa

SEQ ID NO: 84687 - protein, 357 aa, Ustilago maydis 521
MPRGYGIADSKNWTDFKVYDFDLKKETDDDVDIAITHCGVCGSDVHTISGGWGPLKHDFCIPGHEIIGIATKVGKNVKDIKVGDRVGVGAQVDSCGECVPCQDEEEQYCRGNGTKKLVDTYNDTYSECGTKAMGGYSTHIRTQQQFVFPIPDKIKSEHAAPMLCGGLTLFSPLIRNGAGPGKRVGIVGIGGLGHFGVMFAHALGAEVVAISHSPRKREDALKMGAKEFVSTGENPNWAEEYKNKPFDLIINTASSNAVDLRTILTTLKVHGRLICVGMPEDVFKVRIQDFAGNGCLMGSSHIGSKKEALQMLELAAEKDIQPWVEILPMKDCSKAVKRVADNDIRYRFVLEQDLEKH

SEQ ID NO: 84688 - DNA, 1110 bp, Ustilago maydis 521
  CDS (1)..(1110)
atggtgcaagatccgcgcgagacgcagctcgaggtgacgccaaccaaccgcgtagccattttttatgaaaacggtgggccggacaagatctcgatcaagcagctggacaacatcaagccatccgagctgaacgctggagaagtgcttgttcgggtgctgttcacgggcgtctgccactcggacctgcacgccttgcaaggcgactggcctttcccacccaagcttccgctgattggcggtcatgagggagccggagttgttgttgctctaggagctggatcgcaggaatacgtgcagatcggcgaccgcgttgggatcaagtggatcgccgatgcatgcctcaactgcgaatactgtcgcttatcgcacgagatcaactgtgcacagtacaagtcaagtggatgtgagtgtggatcggcgttgaagctcgtcggtttcgagcgagacaaatacgttcgacacacggctcgatacctaaccaagattccggacgcgctggacctcgcacaggcggcgtcgatcctgtgtgctggagtgacgatctaccgtgcgctcaaggaggcgcaccttgaagcgggcaactgggtcgtgattcccggatcgggtggagggttaggccacttgggcgtgcagtatgcgctcaatgccggactgcgcgtgattgggattgatacggggagtgacaagcagcacatgtcgctctcgctcggatgcgaagtgtttgtcgatttcaaaacctcggacgtggccacggcgatcaaagcggccacgggaggaattggtgcgcacgcagctgtggtggcagcagctagctcagctgcttacgagcttgccttggactacatccgccccaggggcacactagtgattgtcggaatgcccaactcgatcttgcctctctcgatcttcaagacagtgctaatgacgcacaaaatcgtcggctccgccgtaggcaaccggcaagacgccgtcgaggcgctcgacatcgcttccagaggaaaggtcaaggtgcactttaccatgaagggcctcaccgatctaccgcatgtcttccaggacatgatccacggtcgcattgctggaagaatcgtcttggacgtcgacaagtga

SEQ ID NO: 84689 - protein, 369 aa, Ustilago maydis 521
MVQDPRETQLEVTPTNRVAIFYENGGPDKISIKQLDNIKPSELNAGEVLVRVLFTGVCHSDLHALQGDWPFPPKLPLIGGHEGAGVVVALGAGSQEYVQIGDRVGIKWIADACLNCEYCRLSHEINCAQYKSSGCECGSALKLVGFERDKYVRHTARYLTKIPDALDLAQAASILCAGVTIYRALKEAHLEAGNWVVIPGSGGGLGHLGVQYALNAGLRVIGIDTGSDKQHMSLSLGCEVFVDFKTSDVATAIKAATGGIGAHAAVVAAASSAAYELALDYIRPRGTLVIVGMPNSILPLSIFKTVLMTHKIVGSAVGNRQDAVEALDIASRGKVKVHFTMKGLTDLPHVFQDMIHGRIAGRIVLDVDK

SEQ ID NO: 84690 - DNA, 1098 bp, Ustilago maydis 521
  CDS (1)..(1098)
atgtcgagtacagatgcgctcttcgaaggatgggtaggacacgacaagtcgtgtatcggcaacatgaagtgggaaacctacactcccaagcaatggcgcgaaacggacatcgagatcaagattgagtgttgcggcgtgtgcgcttcggacctgcacactgcgcggtcaggatggggaccgacgcgctatccttgcgttgtcggccatgagattgtcggcactgtcgcacgcgtgggaaagcaggtttccggctttaacatcggcgaccgtgtcggtgtgggtgctcagtcggactcgtgcaagagttgcgaggcctgcaagaacggcgacgagccttggtgcgaaaagggcatcgtaggcacgtacaacggcgattactcgagcaccgacggttcaggcttctcgatgggtgggtacgcaaaatactcgcgtgtgccggctcactttgcggtccacatcccggactccttaccttccacagtggctgccccactcatgtgcggcggcgtcacggtctacaacccactcaagaccaacggatgcgggaatgaaggcgtcaaacgagtcggtgtcgtaggtatcggcggtctcggccactttgccctcatcttcgctaaagctctcggagccgaaaagatcgtcgccatctcgcacacgcattccaaagaagatctcgcgcgcaagctcggcgctactaatttcatcgcttcaggcgacgaggacccctggtctgcccataagcgctcgttggacctgctcatcttgactaacaacaacgctgatatgcccatcaccgactacctcaccctggtccggcctcatggaaaagtcgtcgctgtgggcgtgcccgaggagccatgcatgcccacgcctctgcccgctttggcttttagcggcgtcttcttgggcggctcgcttatcggtgggcccgccatcatcaaggagatgcttgaattggccgccaagcaaaacttgaagcccatgattgagcaacgtgacatgaaggacgccaaccaggtggtcaaagatatggatgccggcaagcctcgattccgatatgtgatggtgaacaaagactacgagcctgtcaaagcttga

SEQ ID NO: 84691 - protein, 365 aa, Ustilago maydis 521
MSSTDALFEGWVGHDKSCIGNMKWETYTPKQWRETDIEIKIECCGVCASDLHTARSGWGPTRYPCVVGHEIVGTVARVGKQVSGFNIGDRVGVGAQSDSCKSCEACKNGDEPWCEKGIVGTYNGDYSSTDGSGFSMGGYAKYSRVPAHFAVHIPDSLPSTVAAPLMCGGVTVYNPLKTNGCGNEGVKRVGVVGIGGLGHFALIFAKALGAEKIVAISHTHSKEDLARKLGATNFIASGDEDPWSAHKRSLDLLILTNNNADMPITDYLTLVRPHGKVVAVGVPEEPCMPTPLPALAFSGVFLGGSLIGGPAIIKEMLELAAKQNLKPMIEQRDMKDANQVVKDMDAGKPRFRYVMVNKDYEPVKA

SEQ ID NO: 84692 - DNA, 1017 bp, Ustilago maydis 521
  CDS (1)..(1017)
atgtcgtctctgcccaaaacttacaaagcggccgtctttgaaaagacaggtcagccccttacgtttaaggatatcgagctcaagcatcccgaagacggtcagatcctcgtcaaggtcgaggcttgcggtgtctgccactcggacgcacacgttcaggcgggcgccttcggacctcttcctcgtgtccctggccatgagattgtcggcaaggtcgtcgaggtgggtccccatgtcaccaggtggaagagcggcgatcgtgtcggcggcgcttggcacggaggccacgacggcacctgccgccagtgcaaccaaggccttttccagatgtgtgataatggacagatcaacggtgtcacccgggacggtggatacgccgagtactgccttctccaggccgaggcagcggtgcgtttgccctcggacggtgatgccgtgcagatggcccctctaatgtgtgccggtgtcactgttcataacggcatccgcaaaatgaacatcactcctggcgaagtcgtcgctatccagggtcttggaggccttggtcaccttgccgtccagtacgcgcgcaagatgggttaccgcacagtcgcgctttcccgaggtaccgacaagaaggactttgccatgaaacttggcgccaccgattacatcgacaccagcagccaagatgctgccgaggctctgcagaagatgagtggtgcggccctgattgtggctaccgcgcccaatccagaacacatctcgcccctggtcggcggttgcaagccgatgggcaaacttctgatcctcgctcccgttggagacgtccgcgtaaactcgatcgccatgattactaagggcatttcggtacacggctggccatccggccatgccctcgactcggaggacgccgttgaatttagtcaacgattcggtgttgaatgcatgtgcgagaccttccctctagccaaggcaaacgaggcgttcgagcatatgatggccaacaaggctcgcttccgtgctgtccttacaatgtga

SEQ ID NO: 84693 - protein, 338 aa, Ustilago maydis 521
MSSLPKTYKAAVFEKTGQPLTFKDIELKHPEDGQILVKVEACGVCHSDAHVQAGAFGPLPRVPGHEIVGKVVEVGPHVTRWKSGDRVGGAWHGGHDGTCRQCNQGLFQMCDNGQINGVTRDGGYAEYCLLQAEAAVRLPSDGDAVQMAPLMCAGVTVHNGIRKMNITPGEVVAIQGLGGLGHLAVQYARKMGYRTVALSRGTDKKDFAMKLGATDYIDTSSQDAAEALQKMSGAALIVATAPNPEHISPLVGGCKPMGKLLILAPVGDVRVNSIAMITKGISVHGWPSGHALDSEDAVEFSQRFGVECMCETFPLAKANEAFEHMMANKARFRAVLTM

SEQ ID NO: 84694 - DNA, 1095 bp, Aspergillus nidulans FGSC A4
  CDS (1)..(1095)
atgccgtatcctgaagaagctgaaggattccaggtggacagtccggaaacctataccgatttcaagaagcgctttttcaaactgaaaccgttcggcgactatgatgtcgacatcaagatagaagcgtgcggcgtttgtggaagcgatgtgcacactattagcgtcataggtggttggggctcccagaaattccccctctgtgtcggacacggtccagaaatcattggccgtgccgtgcgcgttggtcccaaggtgactctgatcaaagaaggccagcgtgtcggcgtcggcgcccagtcgtattcctgcggcgagtgcaaacaatgcaagaacgagaacgaaacatactgcccggtgctcatgatcgatacatacggcgccgaatggcccgacactggaatcgttagccagggcggatactcatcgcacgtccgcactcatgagcactgggtctttcccatccccgacgtcctggagacgaaccttgtcgcgcccatgctgtgtgctggattgactgcgtactcgcccttggttcgcaatggcgctgggcccggcaagaaagtcggtatcgtcggcctaggtggaattggtcactttggtgttatgttcgccaaggctctgggagcagagacctgggcgatttcccggtcgcgggccaaggaggcagatgcccgcaagctaggagccgatggctacatcgctactgcagaggagggctgggaaaagcctcatcggtgctcttttgacctgatcatcaactgtgccaattcatccaaggggttcgacctggagaagtacctctccatgatggacgtccacggccgatggatcagtgtaggcctgccagaagaggaaggacaagtgatcaaggcgcaaaatctaatttccaatggtgtgctgatcggtgcgagccatcttggaagtcgccgtgagatgctggagatgctgcaactggccgctgacaaggggctaagaggctgggtggaagaactgcaaattggcagtgaaggattaaaggaggcgatggaacggatgaagaagggagacgtccactaccggtttacgatgacggggtatgacaaggtatttgggtga

SEQ ID NO: 84695 - protein, 364 aa, Aspergillus nidulans FGSC A4
MPYPEEAEGFQVDSPETYTDFKKRFFKLKPFGDYDVDIKIEACGVCGSDVHTISVIGGWGSQKFPLCVGHGPEIIGRAVRVGPKVTLIKEGQRVGVGAQSYSCGECKQCKNENETYCPVLMIDTYGAEWPDTGIVSQGGYSSHVRTHEHWVFPIPDVLETNLVAPMLCAGLTAYSPLVRNGAGPGKKVGIVGLGGIGHFGVMFAKALGAETWAISRSRAKEADARKLGADGYIATAEEGWEKPHRCSFDLIINCANSSKGFDLEKYLSMMDVHGRWISVGLPEEEGQVIKAQNLISNGVLIGASHLGSRREMLEMLQLAADKGLRGWVEELQIGSEGLKEAMERMKKGDVHYRFTMTGYDKVFG

SEQ ID NO: 84696 - DNA, 1086 bp, Aspergillus nidulans FGSC A4
  CDS (1)..(1086)
atggcgcagcaggactacaaattcgaaggatggatgggtctagacaagaatgccgccgatggcaacatggtctggcaggagtttgagcccaaggaatgggaggaaacagatgtcgatatcaagatcacgcactgcggtatctgcgggtctgatttacatactctccgaagtggctggaggcccgctctttatccgtgctgtgtaggtcacgagattgttggtactgccgtccgtgttggatccaaggccgtcgggggcatcaaattaggagaccgcgttggtgtcggtgcgcagagcgacgcttgtgtgggccgattcggcgactgccccgagtgtgcaatgggctgggagaactactgctcgcacaaatttgtctctacctacaacagcgtccatttcaatgggggaaagtcctatggtggatatgccctgtacaaccgctgtccttcccactttgtggtcaagatcccggatgccgtaccctctgctgaggccgctccaatgctttgtggtggtgtcacgctctatagcccattgaagcataacaactgtgggcctggaaagcgtgttggtattatcggcgtcggaggtcttgggcacttcggcgtgctctttgccaaggctctgggcgctgataaggttgttgctatctcacgtaagaacggtaagagtgaggatgcactgaagatgggcgctgatcagtatattgctaccgatgatgagccggactgggctacaaaatacgctcgttctttggacttgattgtatgcaccgtgtcctcgactaagatgcccttggccgaatacgtgggcctgcttgcaacgaacggcagcttcgttcaagttggactaccggaagacggagtgctcaatgcacctgtggcaaacttaaggcgccgccttaagatggaaagctctctcgttggaagtcccaatgaaatcagggaaatgtttgccttagttgcggagaaaggcatcaagccatggattgaaacggtcccgatgaaggacgccaacaaggcgattgttgatatgcacgagggcaaagctcgataccgctacgtgctagtcaacgaggagcattag

SEQ ID NO: 84697 - protein, 361 aa, Aspergillus nidulans FGSC A4
MAQQDYKFEGWMGLDKNAADGNMVWQEFEPKEWEETDVDIKITHCGICGSDLHTLRSGWRPALYPCCVGHEIVGTAVRVGSKAVGGIKLGDRVGVGAQSDACVGRFGDCPECAMGWENYCSHKFVSTYNSVHFNGGKSYGGYALYNRCPSHFVVKIPDAVPSAEAAPMLCGGVTLYSPLKHNNCGPGKRVGIIGVGGLGHFGVLFAKALGADKVVAISRKNGKSEDALKMGADQYIATDDEPDWATKYARSLDLIVCTVSSTKMPLAEYVGLLATNGSFVQVGLPEDGVLNAPVANLRRRLKMESSLVGSPNEIREMFALVAEKGIKPWIETVPMKDANKAIVDMHEGKARYRYVLVNEEH

SEQ ID NO: 84698 - DNA, 1104 bp, Aspergillus nidulans FGSC A4
  CDS (1)..(1104)
atggctgctcctgaaatccccaagaagcaaaaggctgtcatctacgacaaccccggtaccgtctctaccaaggtcgtcgagctggatgtacctgagcccggcgacaatgaagtcctgatcaatctcactcattccggcgtttgccactcagattttggtattatgaccaacacgtggaagatactacccttccctactcagcccggacaagtcggtggccatgaaggcgttggcaaagtggtgaagctcggcgcgggcgctgaagcatcaggattgaagatcggggacagagtcggtgttaagtggatttccagcgcctgtgggcagtgccctccatgccaggacggcgccgacggcctctgcttcaaccaaaaggtatcaggttactacacccctggcacattccagcaatacgtgctcggtcctgcgcaatacgttaccccaattcccgatggcctcccatcagccgaagcggcgccccttctctgtgccggtgtcacagtctacgcttctcttaagcgcagtaaagcccaaccaggtcaatggatcgtcatctccggcgctggcggcggccttggccacttagccgtccagatcgcagccaagggcatgggcctgcgtgtgattggcgttgaccacgggagtaaagaagagctcgtcaaggcgtcaggcgccgagcacttcgtggatatcaccaagttcccaacgggcgataaattcgaggccatctcctcgcacgtcaaatcgcttacaacgaagggtcttggtgcgcatgctgtcatagtttgcacggcgtccaatattgcttacgctcagtctttgctcttcctccggtacaacggaacgatggtctgcgtgggtatccccgagaacgagccgcaggctatcgcaagtgcgtacccaggcctgtttatccagaagcatgtgcatgtcactgggtcggctgtcggaaataggaacgaggcgattgagactatggagtttgcggcgaggggtgtcattaaggcgcacttccgggaggagaagatggaggccttgactgaaattttcaaagagatggaggaggggaagttgcaggggcgggtggtgcttgatctttcttag

SEQ ID NO: 84699 - protein, 367 aa, Aspergillus nidulans FGSC A4
MAAPEIPKKQKAVIYDNPGTVSTKVVELDVPEPGDNEVLINLTHSGVCHSDFGIMTNTWKILPFPTQPGQVGGHEGVGKVVKLGAGAEASGLKIGDRVGVKWISSACGQCPPCQDGADGLCFNQKVSGYYTPGTFQQYVLGPAQYVTPIPDGLPSAEAAPLLCAGVTVYASLKRSKAQPGQWIVISGAGGGLGHLAVQIAAKGMGLRVIGVDHGSKEELVKASGAEHFVDITKFPTGDKFEAISSHVKSLTTKGLGAHAVIVCTASNIAYAQSLLFLRYNGTMVCVGIPENEPQAIASAYPGLFIQKHVHVTGSAVGNRNEAIETMEFAARGVIKAHFREEKMEALTEIFKEMEEGKLQGRVVLDLS

SEQ ID NO: 84700 - DNA, 1080 bp, Aspergillus nidulans FGSC A4
  CDS (1)..(1080)
atgtccaccgactacaagttcgaaggatggcttggccttgatgccggttccgttgatggcaagatgcagtggaaggagtttgagccaaagccctgggaggagaccgacgtcgacatcaagatctcccactgcggtatttgcggttcagacctgcacactctgcgcagcggatggggccccacaaactacccctgctgcgtgggccatgaaatcgtcggtacagctgtccgcgtcggctctcaagtgaagcacatcaaagttggcgaccgcgtcggtgttggcgcgcagagcgagtcctgcgtcggccgcaaaggcgagtgcaacgaatgcgcaacctccaacgagccctactgcaccaaacacttcgccgggacatacaacggtgttttcatgaacggaggcaagtcctacggtggctacgccctatacaaccgctctcccgcgcacttcgccatcaagatccctgacgctattccctccgcccacgcggcgcccatgatgtgtggtggtgtcaccgtctactccccgcttaagcactacggctgcggacctggaaagacggttggtattattggaatcggtggacttggccactttggtgtccttttcgctaaagccctcggtgcggaccgcgtcgttgcgatctcgcgcaaatcggataagcgcgccgatgcgctgaagctgggcgcagacgagtacgtcgcgaccgccgaggatacagagtggatggcgaacaacaagcgctcgctcgacctgattgtttgcactgtctcatcatccaagatgcccatcaacgactacgtctccctactcaaggtcgacggcaccatgatccaagtcggtgctcctgaggatggagctctgactattccggctttcacgctcattgccaaccgcgttaagctcggaggttcgttgattggctctcctgacaccatccgtgagatgctggagcttgccgcggagaagggtgtcaagccctgggtggaggagcggcccatgaaggatgcgaaccaggccatcaaggatatggatgctggtgatgcccggtaccgctatgttctggtcaatgaccactaa

SEQ ID NO: 84701 - protein, 359 aa, Aspergillus nidulans FGSC A4
MSTDYKFEGWLGLDAGSVDGKMQWKEFEPKPWEETDVDIKISHCGICGSDLHTLRSGWGPTNYPCCVGHEIVGTAVRVGSQVKHIKVGDRVGVGAQSESCVGRKGECNECATSNEPYCTKHFAGTYNGVFMNGGKSYGGYALYNRSPAHFAIKIPDAIPSAHAAPMMCGGVTVYSPLKHYGCGPGKTVGIIGIGGLGHFGVLFAKALGADRVVAISRKSDKRADALKLGADEYVATAEDTEWMANNKRSLDLIVCTVSSSKMPINDYVSLLKVDGTMIQVGAPEDGALTIPAFTLIANRVKLGGSLIGSPDTIREMLELAAEKGVKPWVEERPMKDANQAIKDMDAGDARYRYVLVNDH

SEQ ID NO: 84702 - DNA, 990 bp, Aspergillus nidulans FGSC A4
  CDS (1)..(990)
atgtcgttcaaagtcttcaaaggatccgagaagggggtcatcgaatccaccaccaagaaacccgccctcgagggggacagggtgctcgtcaaagtctcccactcaggtgtctgcggcaccgacctccactacaaggccgccgacatggtgcttgggcacgagggtgtgggatacgttgaggaagtcgggccggatgtcaaggacctgaagaagggcgaccgggtcggctggggctacgagcacgactgctgcggtcgctgcaagcactgtctgtctggcttcgagaccttctgccccgagcgcgcaatgtacggttttgcagacctggatcagggctcgttcgccagccatgcggtctggcgcgaagcgttcctgttcaagctcccggacgggctcgataacgagtcggctgcgcccctgatgtgcggcggatcgaccgtgtacaacgccctggtgggcgccgaggtcacgcccacagataccgtcggcatcgtgggaatcggcgggctaggccatctagccatccagttcgctgcgaagatgggttgctacgtgatcgttttcagcgggaccgactcaaagaaggaggaagccatgaagctgggcgcgaaggaatttgtcgcaacaaaggacgccaaggagctcaagaccagtcgcaaacttaacaatctgatcgtcacgacgagttttctgccggaatgggaactgttcctgaacgtcctcgacaaccgcgcgaccatcagcccgctgacggtctcagataagccctttacaatccccaatcaggagatgctcgtcaagggactgcgcgtgcagggcggcatcgtggcggcgcgccaggtgcaccgcgaaatgttgcagtttgcagctttccatggggtaaagccgatcgtgatgcggtatccgatgaatgagaaagggatcaacgagtgcatgaagacgctagaggaagggaagatgcggtaccggggtgtattggcggcggagtag

SEQ ID NO: 84703 - protein, 329 aa, Aspergillus nidulans FGSC A4
MSFKVFKGSEKGVIESTTKKPALEGDRVLVKVSHSGVCGTDLHYKAADMVLGHEGVGYVEEVGPDVKDLKKGDRVGWGYEHDCCGRCKHCLSGFETFCPERAMYGFADLDQGSFASHAVWREAFLFKLPDGLDNESAAPLMCGGSTVYNALVGAEVTPTDTVGIVGIGGLGHLAIQFAAKMGCYVIVFSGTDSKKEEAMKLGAKEFVATKDAKELKTSRKLNNLIVTTSFLPEWELFLNVLDNRATISPLTVSDKPFTIPNQEMLVKGLRVQGGIVAARQVHREMLQFAAFHGVKPIVMRYPMNEKGINECMKTLEEGKMRYRGVLAAE

SEQ ID NO: 84704 - DNA, 2754 bp, Aspergillus nidulans FGSC A4
  CDS (1)..(2754)
atggagcagcaaggtgatttgcaggctgcctcaaactacattaataatgtcttactggcccggggcctggttaagagcggccgaccgattgattttgcgaacccggagaacgaggagggcggagtggcaaccacgatggcgaggatcatcaacttggttaacgatttggttctgagaagagaccgtgaagcagaacatcgagagaacctagcgacgacgattcggacactgcgagcggaagaatctcacaaggcggtagaaatgtctgaactatcgcgatcgctggcgctggcggaagcgcaagaacgagctctcaagaccagcatgtcaagcgcagaggcgacaatccgggggctgaaagatcaggtccagcgtatgaagacgactgtgcaacaagtacgatcccaatgtgccaacgatattcgaaagcgcgatctcgagctacagaagttgaaggcccatcttgcggaccgacaacgaggcaagcgtgatggtctgggcgtgacgacaatcaatattaaccctgctgctagtcaatcgtcgcggaggtacctgtcagggggtgagggtgtgcatgatccaggatacagcttgaagcaggaaacgaacgaattccttacacagttgctacagaatcttagcgacgagaatgattcgcttatctctcttgcgcggaacactgtttttactttgaaggaattacaaggcttatcgtcaacagaagagccggctgttgacaacgggtacttgcaggggtcagctagtactgctcaaaggtcaacctacgggggcgctgccgtcacaagtctgcctgcttcttgcgaagagctatcgggtgaaatggaccaagtactggaacatcttcgaacactgcttacaaacccatcattcgtgccgcttgaagaggttgaagtgcgcgatgaagagatcaaacgactgcgcgagggctgggagaagatggagagccgttggagacaggcagtaaccatgatggatggttggcataagcggattgcacatgggggaggatctgtccgtgcagaagagctccgcatgggactgaaactcaatgatcatgtcgacccaagatattcgcaagtccgagacaatgacgtggctatgccgtcgcctattttcgaggaccaagaggatgaagaagatgaatactttggagtggaggcgacagagacagagccgaacgatgacgccgagcccgcaccagatgagcctcaggagacttccagccgagccctgaaagagcggaccgataatacagcgtcggcgaagcatccgccgcggaaggaggtatcttttaccgagaaagaccgcaagtctccatcgaaaaaacaacaggaggacgacacgatgccgattaaagctcatcaatctgatgctgtaactcgacggccatcaaggaaacgagttgagcccaaagggccacgtccggcccctacccggatgagcgtgcctcagaaactggcggcggctgaaagtgaggctcgcgcggcagagaaagcacgccaagagcaagagagccgaaagaggagtcgtggaagtaaagttgctcggaagaagacaggagatcggcgacgcagcacactgacgagcgatgagctgggggagttactgggcatgaaaccttctgattctctagggacaatgccagacacattcacaggctgggtcgcgcacggccctaaatccccccttacgtacggagccttcactcccaaacctttcgaggaaaccgacattgaagtccaaataacccactgtggcatctgcggcagtgacatccacaccatccgctctggctgggccccagcagactatccctgcgttgtcgggcacgagataatcggcacagcaacgcgcatcgggcgcgccgtcaataataagcaaaacatccaacccggcgaccgcgtcggcataggcgcacaatgctcctcctgcctacgtccagactgcgaagcctgcgccgacggtgaagaatcctactgcccgaagatggtgggaacctacaatagccgtttccccgatgggagcaaagcctatggtgggtatgcgaatcggtggcgcggccctggccactttgttttccgcatccctgagcaattgagtagtgcggaggccgcgccgttgctctgcggtggtgttactgtattcgcgccgctacgacgctttggcgctggacccgggaaacgcgtaggaatagtgggtatcggcggactagggcatatggggttactgtttgcgagggcgctggggagtgacgccgttgttgcaatctcgcggtcttcgtcgaaaaagagtgatgcaattgggccattaccgaacaaattaggcgcggacgcatttattgcaacgggggaagacaagaactgggcgaaaacgcatgcgagatctctggatatcatcatctgcactgtgtctggggagaatatgccgttgtcggggtacctgaggctactgaagcggaacggggtctttgtgcaggttggcgcgcctgaggagccgctgcctccgctcagagccttctcacttattcagaagggtgtcaaggtgacggggtcgtcgattggctctcctgaagatattcggcaaatgctgaacctggcggctgagaagggcgttcggccgtgggtgcagaccaggcctatggaggaggtgaatctggcgctgcaggagatgcatgaggggaaagcgagatatcggtttgtgttggaaaatggggcgaaggcagggaagctatag

SEQ ID NO: 84705 - protein, 917 aa, Aspergillus nidulans FGSC A4
MEQQGDLQAASNYINNVLLARGLVKSGRPIDFANPENEEGGVATTMARIINLVNDLVLRRDREAEHRENLATTIRTLRAEESHKAVEMSELSRSLALAEAQERALKTSMSSAEATIRGLKDQVQRMKTTVQQVRSQCANDIRKRDLELQKLKAHLADRQRGKRDGLGVTTININPAASQSSRRYLSGGEGVHDPGYSLKQETNEFLTQLLQNLSDENDSLISLARNTVFTLKELQGLSSTEEPAVDNGYLQGSASTAQRSTYGGAAVTSLPASCEELSGEMDQVLEHLRTLLTNPSFVPLEEVEVRDEEIKRLREGWEKMESRWRQAVTMMDGWHKRIAHGGGSVRAEELRMGLKLNDHVDPRYSQVRDNDVAMPSPIFEDQEDEEDEYFGVEATETEPNDDAEPAPDEPQETSSRALKERTDNTASAKHPPRKEVSFTEKDRKSPSKKQQEDDTMPIKAHQSDAVTRRPSRKRVEPKGPRPAPTRMSVPQKLAAAESEARAAEKARQEQESRKRSRGSKVARKKTGDRRRSTLTSDELGELLGMKPSDSLGTMPDTFTGWVAHGPKSPLTYGAFTPKPFEETDIEVQITHCGICGSDIHTIRSGWAPADYPCVVGHEIIGTATRIGRAVNNKQNIQPGDRVGIGAQCSSCLRPDCEACADGEESYCPKMVGTYNSRFPDGSKAYGGYANRWRGPGHFVFRIPEQLSSAEAAPLLCGGVTVFAPLRRFGAGPGKRVGIVGIGGLGHMGLLFARALGSDAVVAISRSSSKKSDAIGPLPNKLGADAFIATGEDKNWAKTHARSLDIIICTVSGENMPLSGYLRLLKRNGVFVQVGAPEEPLPPLRAFSLIQKGVKVTGSSIGSPEDIRQMLNLAAEKGVRPWVQTRPMEEVNLALQEMHEGKARYRFVLENGAKAGKL

SEQ ID NO: 84706 - DNA, 1083 bp, Candida glabrata CBS138
  CDS (1)..(1083)
atgagctctgaagataagtttcaaggtatcgctgttctagatcacaaggactggaagaacccaaaaaaggttgaattcccagccaagccattctacgaccacgatatcgacatcaaaattgatgcttgtggtgtttgtggtagtgacatccactgtgccgccggtaactggggtaagaagcaaactccattggttgtcggtcatgaaatcattggtaaggtcgtcaagattggcccaaagtgtaacactggtttgaaggttggtgaccgtgttggtgttggtgctcaagtcttctcttgtttggaatgtgaccgttgtaagaatgacaacgaaccatactgtcccaagttcgtcactacatactctcaaccatatgaagacggctacgtctctcaaggtggttatgccaactatgtcagagtccatgagcattttgctgttaagattccagaaaacattccagaccatttggctgctccattgctatgtggtggtattactgtttactctccattgctaagaaacggttgtggtccaggtaagaaggtcggtatcgtcggtatcggtggtattggtcacatgggtctattatttgctaaggccatgggcgctgaagtttacgctatttctcgttctaacgctaagaaggaagattccttgaagttaggagctgaccactacattgccaccaaggaagaaccaaactggggtgaaaagtactttgacactttcgatttaattgtcgtctgcgcttcatctttaactgatgttgacttcgatgtcatgccaaaggctatgaaggttggtggtagaattgtctctatttctattccagacgaagatcaaactttgacaatgaagccatttggtttgctaggtgtttccatcgctaacagtgctttgggttcaattaaggaaattgagcagttgctaaaattggtttctgagaaggatatcaagatctgggttgaaactttgccagttggtgaagctggtgtgaaggaagctttcgaaaggatggacaagggtgatgttaagtatagattcactctggtcgactttgacaaggagtttggtaactaa

SEQ ID NO: 84707 - protein, 360 aa, Candida glabrata CBS138
MSSEDKFQGIAVLDHKDWKNPKKVEFPAKPFYDHDIDIKIDACGVCGSDIHCAAGNWGKKQTPLVVGHEIIGKVVKIGPKCNTGLKVGDRVGVGAQVFSCLECDRCKNDNEPYCPKFVTTYSQPYEDGYVSQGGYANYVRVHEHFAVKIPENIPDHLAAPLLCGGITVYSPLLRNGCGPGKKVGIVGIGGIGHMGLLFAKAMGAEVYAISRSNAKKEDSLKLGADHYIATKEEPNWGEKYFDTFDLIVVCASSLTDVDFDVMPKAMKVGGRIVSISIPDEDQTLTMKPFGLLGVSIANSALGSIKEIEQLLKLVSEKDIKIWVETLPVGEAGVKEAFERMDKGDVKYRFTLVDFDKEFGN

SEQ ID NO: 84708 - DNA, 1080 bp, Candida glabrata CBS138
  CDS (1)..(1080)
atgactactgacacatttaaaggtattgccgttgtagaccacaaggactggaaaaacccaaagaaggttgaatttccagccaaaccattctacgacaatgatgttgacattaagattgaagcgtgtggtgtgtgtggtagtgatatccactgtgctgccggtaactggggtcaaaaacaaacgccactagttgttggtcatgaaatcatcggtaaagtcgttaaagttggtccaaaatgtaaaactggtttgaagatcggtgaccgtgttggtgtcggtgcccaagtgttttcatgtttagaatgtgagcgttgtaagaatgataatgagccatactgtgctaggtttgttaccacatactctcagccatacgaagacggctatgtctctcagggtggttacgctaactatgttagggtgcatgagcattttgcggttccaattccagaaaatattccttcagaatatgctgctccacttctatgtggtggtttgactgtatactctccactattaagaaacggttgcggtccaggtaagaaagtcggtattcttggtattggtggtattggtcacatgggtattctatttgctaaggcaatgggtgccgaagtatacgctatttctcgttctaatgctaagaaagaagactctctaaaattgggtgctgatcattacattgccactaaagaggaaccagattggggtacaaagtactttgacactttcgatttgattgttgtctgtgcctcttcattgactgatgttgattttgatgtcatgccaaaggcaatgaaagttggtggtagaattgtttctatttctgtgccagaacaagacgaagtcctaacgatgaagccatttggtttgattggtgtctccatcgccaattctattttaggctccattgctgagatgaaacaattactaaagttagtctcagaaaacaatatcaaaatttgggttgaaacactacctgttggtgaagccggtgttaaggaagctttcgaaagaatggataaaggtgatgttagatacagattcactttggttgattacgaaaaggaatttggtaactaa

SEQ ID NO: 84709 - protein, 359 aa, Candida glabrata CBS138
MTTDTFKGIAVVDHKDWKNPKKVEFPAKPFYDNDVDIKIEACGVCGSDIHCAAGNWGQKQTPLVVGHEIIGKVVKVGPKCKTGLKIGDRVGVGAQVFSCLECERCKNDNEPYCARFVTTYSQPYEDGYVSQGGYANYVRVHEHFAVPIPENIPSEYAAPLLCGGLTVYSPLLRNGCGPGKKVGILGIGGIGHMGILFAKAMGAEVYAISRSNAKKEDSLKLGADHYIATKEEPDWGTKYFDTFDLIVVCASSLTDVDFDVMPKAMKVGGRIVSISVPEQDEVLTMKPFGLIGVSIANSILGSIAEMKQLLKLVSENNIKIWVETLPVGEAGVKEAFERMDKGDVRYRFTLVDYEKEFGN

SEQ ID NO: 84710 - DNA, 1101 bp, Kluyveromyces lactis NRRL Y-1140
  CDS (1)..(1101)
atgtcgtacccagataattttgaaggttttgcagtagtcgatagccacaaaaaatggttaagtccagaaaaggttgtataccctgccaagcaatttaatccaagagatgttgacattgaaattgaggcatgtggtgtttgcggtagtgatgttcactgtgccaagggtaattggggtgaaatgaagttgccgttggttgttgggcatgaaatcattggtaaagtggttagacttggtgataagtgtgataccggtttgaaggttggtgaccgtgttggtgttggtgcacaagtcagtgcttgtttggactgtaaccgttgtaacaatgacaacgaacaatactgtccaaaattcgttaccacttactctcaaccatactttgaagatggttatgttggtcaaggtggttacgcatctcacatcagagtccacgaacatttcgtgattccaatcccagaatctttagaaaccaacaatgttgcaccattgctatgtggtggtgccactgtgtattctccattgaagagaaatggatgtggcccaggtaagaaagtcggtatcgttggtatcggaggtattggtcacatgggtattctattagccaaagccatgggtgccgaagtgtacgccatctctagatcccatgccaaggaggaaacatccaagcaattgggtgcagaccattacattgccactgaagatgaaggttgggaaaccaagtatttcgatacattggatttcatggttctatgtggtaactcattgtcggccgttgatttcggcaagctaccaaagattttgaaagctcaaggtgttattgcatccatttctgtccctgatcagcatgaagccatacatttacatccagcgcaacttctaggattccagattactcaatcttgtctagcatctcgtgcagaaatcattgaaatgttgaacttggtggctgaaaagaagatcaaactatgggttgaaacggttccaatcagtgaggaaaatatctccacagtgttcaaaagaatggaaagcggtgatgttcgtttcagattcacactaactgactttgataaacagtttgaccaattcaaagccaagaaatag

SEQ ID NO: 84711 - protein, 366 aa, Kluyveromyces lactis NRRL Y-1140
MSYPDNFEGFAVVDSHKKWLSPEKVVYPAKQFNPRDVDIEIEACGVCGSDVHCAKGNWGEMKLPLVVGHEIIGKVVRLGDKCDTGLKVGDRVGVGAQVSACLDCNRCNNDNEQYCPKFVTTYSQPYFEDGYVGQGGYASHIRVHEHFVIPIPESLETNNVAPLLCGGATVYSPLKRNGCGPGKKVGIVGIGGIGHMGILLAKAMGAEVYAISRSHAKEETSKQLGADHYIATEDEGWETKYFDTLDFMVLCGNSLSAVDFGKLPKILKAQGVIASISVPDQHEAIHLHPAQLLGFQITQSCLASRAEIIEMLNLVAEKKIKLWVETVPISEENISTVFKRMESGDVRFRFTLTDFDKQFDQFKAKK

SEQ ID NO: 84712 - DNA, 1095 bp, Debaryomyces hansenii CBS767
  CDS (1)..(1095)
atgactatcccacagtatttcaaaggatttgccgtagataagccagagaactggaacaagccgaagttggtagaatacaagccaaaggagttggcatcccatgatgttgtgttggaaaacatctgctgcggattatgtggtagtgacattcacaccatcaagggtgcatggaagccactcaatagagacgatcttgttgttggacacgaaatagttggtaaggttattgctgtcggtaaggacgtcaaggacatcaagataggggacagatgcggtgttggtgcctgctccaagtcttgtatggactgtgaaagatgtgaaacagacaacgaacagtactgtcctcgaaaggtgagtacttacaatgctaaggacttcgatactggctacatctcccaaggtggttactcttctcattctatcgcacacgaacaatatgttttcccaattccagacgcattagaatcagccgttgcggctccattgatgtgtgctggtttgaccgtgttttctccattggtcagaaaccttggtgaagatgcaaagggtaagactgttggtatcatcggtattggtggtttaggacacttggctatccaattcgctaatgctttaggtgctaacgttgttgccttctccagatcatcttccaagaaggaccaagcaatagaaatgggtgcccacgactttattgctactggtgaacaaaagaactggaagagcaacaacgctgataaattcgattttatcttaaactgtgcatccggtattgacggcttaaacttgaacgattacttgtctgttttgaaagtggatgctaagttcgtttctgttggtttaccaccagttggtgacaccttcgaagtttctccattcagtttcattggtaatgcatgtagtttcggtggttccttacttggttccaagagagaagccttgtacatgttgcaattatcagctgaaaagaacattaagccatggattgaagaagttccaattactgcggaaagttgtggtaccgctttaactaggtgtgatgaaggtgatgttagatatagattcgtcttcaccgaattcgacaaagcctttagttag

SEQ ID NO: 84713 - protein, 364 aa, Debaryomyces hansenii CBS767
MTIPQYFKGFAVDKPENWNKPKLVEYKPKELASHDVVLENICCGLCGSDIHTIKGAWKPLNRDDLVVGHEIVGKVIAVGKDVKDIKIGDRCGVGACSKSCMDCERCETDNEQYCPRKVSTYNAKDFDTGYISQGGYSSHSIAHEQYVFPIPDALESAVAAPLMCAGLTVFSPLVRNLGEDAKGKTVGIIGIGGLGHLAIQFANALGANVVAFSRSSSKKDQAIEMGAHDFIATGEQKNWKSNNADKFDFILNCASGIDGLNLNDYLSVLKVDAKFVSVGLPPVGDTFEVSPFSFIGNACSFGGSLLGSKREALYMLQLSAEKNIKPWIEEVPITAESCGTALTRCDEGDVRYRFVFTEFDKAFS

SEQ ID NO: 84714 - DNA, 1071 bp, Debaryomyces hansenii CBS767
  CDS (1)..(1071)
atgacacaaggagatcaatttgaaggttttgctgttaccgatcctaaaaactttacagatgttacgaaaattaaattcacaccaaagacattcgaagaatatgatattgatgttaaaattcatgcctgtggggtttgtggttctgatgtccacactgcttctggtgcttggggtgaagccatgctcccagttattgtaggacatgaaattattggtgaagttgtcaaggtgggctcaaaggttaccactgtcaaaaatggggacagagttggtgttggtgctcaagtttgggcatgcttaaagtgtgatgtttgtaagtcaggagaagaaacttattgtccacatctcattaatacatataatgataaatatcccgatggatccataagttacggaggatacctgtcccatattagagttcatgaatattttacttttaaaattcctgaaaaattgtcttccgaaaatgcagccccaatgctttgtgcaggtataactacatatgccccattgaagaagaatactcgaccaggtatgaaagtcggtattgtcggtattggtggattgggtcacttcgctattatgtgggcaagggccttgggttgtgaagttttctcgttctcgagaactgattccaagaaaaaaactgctctagaactaggtgctgatcatttcgttgacactactgcgaaggactggaataaagacttgcaattcaaattagatttaatcttatcatgtgcaagttcctccaaggatttttctattggtgaatatacttcgatgttaaccattggcggtaaatttatcagcgccggtataccagaagctccgtttagtgttaatcctgttgacctattgaaaaacgcatgttacttgggttcgtcacatttaggtaacagacaagaaatgattgagatgttaaaccttgcagctgaaaagaatgttacttgttggaatgaaactattccaataagtaaagctggtattaaagaagctcttgagaagaattgtcaaaataaagtcagatatagaattacgttgactgattatgataagcaatttgaataa

SEQ ID NO: 84715 - protein, 356 aa, Debaryomyces hansenii CBS767
MTQGDQFEGFAVTDPKNFTDVTKIKFTPKTFEEYDIDVKIHACGVCGSDVHTASGAWGEAMLPVIVGHEIIGEVVKVGSKVTTVKNGDRVGVGAQVWACLKCDVCKSGEETYCPHLINTYNDKYPDGSISYGGYLSHIRVHEYFTFKIPEKLSSENAAPMLCAGITTYAPLKKNTRPGMKVGIVGIGGLGHFAIMWARALGCEVFSFSRTDSKKKTALELGADHFVDTTAKDWNKDLQFKLDLILSCASSSKDFSIGEYTSMLTIGGKFISAGIPEAPFSVNPVDLLKNACYLGSSHLGNRQEMIEMLNLAAEKNVTCWNETIPISKAGIKEALEKNCQNKVRYRITLTDYDKQFE

SEQ ID NO: 84716 - DNA, 1233 bp, Oryza sativa (japonica cultivar-group)
  CDS (1)..(1233)
atggcgccgacgacgacggccacggcggcggcggagcaggcgccgccgccgcagcatacgaggaaggcggtggggctcgccgcgcacgacgactccggccacctcacacccatccgcatctcgcgcaggaaaactggagatgacgacgtcgctataaaggtgctgtactgtgggatttgtcactctgacctgcacaccatcaagaatgagtggagaaacgctgtctacccagttgttgcagggcacgagatcaccggggtggtgaccgaggtggggaagaacgtggcgaggttcaaggccggcgacgaggtcggcgtcgggtgcatggtgaacacctgcggcggctgcgagagctgccgggacggctgcgagaactactgctccggcggggtcgtcttcacctacaactccgtcgaccgggacggcacgcgcacctacggcggctactccgacgcggtggtcgtcagccagcgcttcgtcgtgcgcttcccctcctccgccggcggcggcgccggcgccgcgctgccgctggacagcggcgcgccgctgctgtgcgccggggtgacggtgtacgcgccgatgaggcagcatgggctgtgcgaggccgggaagcacgtcggcgtggtggggctcggcgggctcggccacgtcgccgtcaagttcgccagggcgttcgggatgagggtgacggtgatcagcacgtcgccggtgaagaggcaggaggccctggagaggctcggcgccgacggcttcatcgtcagcaccaacgccagtgagatgaagtgcaactttgcaaggctatgcaagccgaagaaatctttgaatacaactgatgcacctcattgccgacagagcatcttaagattgtttggtcaagctgcgatgggcaccatgcatggcatcatcaacacggcctctgcaagcacatccatgcactcttacctggcactcttgaagcccaagggcaagatgatcttggttggcctgcctgagaagcctctccagatcccaaccttcgctttggttggagggggcaagatactagctgggagctgcatggggagcatcagtgaaacgcaggagatgatcgacttcgccgccgagcacggggtggccgccgacatcgagctgatcggcgccgacgaggtgaacacggccatggagcgcctcgccaagggcgacgtcaggtaccgcttcgtcgtcgacatcggcaacaccctcaggtcggattga

SEQ ID NO: 84717 - protein, 410 aa, Oryza sativa (japonica cultivar-group)
MAPTTTATAAAEQAPPPQHTRKAVGLAAHDDSGHLTPIRISRRKTGDDDVAIKVLYCGICHSDLHTIKNEWRNAVYPVVAGHEITGVVTEVGKNVARFKAGDEVGVGCMVNTCGGCESCRDGCENYCSGGVVFTYNSVDRDGTRTYGGYSDAVVVSQRFVVRFPSSAGGGAGAALPLDSGAPLLCAGVTVYAPMRQHGLCEAGKHVGVVGLGGLGHVAVKFARAFGMRVTVISTSPVKRQEALERLGADGFIVSTNASEMKCNFARLCKPKKSLNTTDAPHCRQSILRLFGQAAMGTMHGIINTASASTSMHSYLALLKPKGKMILVGLPEKPLQIPTFALVGGGKILAGSCMGSISETQEMIDFAAEHGVAADIELIGADEVNTAMERLAKGDVRYRFVVDIGNTLRSD

SEQ ID NO: 84718 - DNA, 1083 bp, Oryza sativa (japonica cultivar-group)
  CDS (1)..(1083)
atggaggtcacccccaaccacacgcagaccgtctccggctgggccgccatggacgagtccggcaagatcgtgcccttcgtcttcaagagaagggagaacggggtggacgacgtgacgatcaaggtgaagtactgcgggatgtgccacacggacctgcacttcatccacaacgactgggggatcaccatgtacccggtggtgccggggcacgagatcaccggcgtggtgaccaaggtgggcaccaacgtggccgggttcaaggtgggcgaccgcgtgggcgtggggtgcatcgcggcgtcgtgcctcgactgcgagcactgccggcggtcggaggagaactactgcgacaaggtggcgctcacctacaacggcatcttctgggacggcagcatcacctacggcggctactccggcatgctggtggcgcacaagcggttcgtcgtgcggatcccggacaccctcccgctggacgccgcggcgccgctgctgtgcgcgggcatcacggtgtacagccccatgaagcagcacggcatgctgcaggccgacgcggccggccggcggctcggcgtggtcggcctcggcggcctcggccacgtcgccgtcaagttcggcaaggcgttcggcctccacgtcaccgtcatcagcacgtctccggccaaggagcgcgaggccagggagaacctcaaggccgacaacttcgtcgtcagcaccgaccagaagcagatgcaggctatgacgaggagccttgactacatcattgacacggtcgcggcgacgcactctctgggtccgatcctggagctgctcaaggtcaacggcaagctggtgctcgtgggcgcgccggagaagcccgtcgagctcccttccttccctctcatcttcggtaagaggacggtgagtgggagcatgacgggtgggatgaaggagacgcaggagatgatggacatttgcggggagcacaacatcacctgcgacatcgagatcgtgtccacggacaggatcaacgatgcgctcgccaggttggcgcgcaacgacgtccgctaccgcttcgtcatcaacgttgggggcgactccaagctctag

SEQ ID NO: 84719 - protein, 360 aa, Oryza sativa (japonica cultivar-group)
MEVTPNHTQTVSGWAAMDESGKIVPFVFKRRENGVDDVTIKVKYCGMCHTDLHFIHNDWGITMYPVVPGHEITGVVTKVGTNVAGFKVGDRVGVGCIAASCLDCEHCRRSEENYCDKVALTYNGIFWDGSITYGGYSGMLVAHKRFVVRIPDTLPLDAAAPLLCAGITVYSPMKQHGMLQADAAGRRLGVVGLGGLGHVAVKFGKAFGLHVTVISTSPAKEREARENLKADNFVVSTDQKQMQAMTRSLDYIIDTVAATHSLGPILELLKVNGKLVLVGAPEKPVELPSFPLIFGKRTVSGSMTGGMKETQEMMDICGEHNITCDIEIVSTDRINDALARLARNDVRYRFVINVGGDSKL

SEQ ID NO: 84720 - DNA, 1092 bp, Oryza sativa (japonica cultivar-group)
  CDS (1)..(1092)
atgggcagcctcgccgccgagaagaccgtcaccgggtgggccgccagggacgcctccggccacctcaccccctacaactacaccctcaggaagactgggcctgaagatgtggtggtgaaggttttgtattgtggtatctgccatactgacatccaccaggccaagaaccaccttggtgcttccaagtaccccatggtccctggccatgaggtggtcggcgaggtggtggaggtcgggccggaggtgaccaagtacagcgccggcgacgtcgtcggcgtcggcgtcatcgtcggctgctgccgcgagtgccatccgtgcaaggccaatgtggagcagtactgcaacaagaggatttggtcctacaacgacgtctacaccgacggccggccaacccagggcggcttcgcctccgccatggtcgtcgaccagaagtttgtggtgaagatcccggcggggctagcgccggagcaggcggcgccgctgctgtgcgccgggctgacggtgtacagcccactgaagcacttcgggctgatgtcgccaggtctccgcggcggcgtcctggggctcggcggcgtggggcacatgggcgtgaaggtggccaagtcgatggggcaccacgtgacggtgatcagctcgtcggcgaggaagcgcggcgaggccatggacgacctgggcgccgacgcctacctcgtcagctccgacgcggcggcgatggcggccgccggcgactcgctggactacatcatcgacaccgtgccggtgcaccacccgctggagccgtacctggcgctgctgaagctggacgggaagctgatcctgatgggggtgatcaaccagccgctgagcttcatctcgcccatggtgatgctcggccggaaggccatcaccggcagcttcatcgggagcatggccgagacggaggaggtgctcaacttctgcgtcgacaaggggctcacctcccagatcgaggtcgtcaagatggactacgtcaaccaggccctcgagcgcctcgagcgcaacgacgtccgctaccgcttcgtcgtcgacgtcgccggcagcaacatcgacgacgccgacgcgccgcccgcctga

SEQ ID NO: 84721 - protein, 363 aa, Oryza sativa (japonica cultivar-group)
MGSLAAEKTVTGWAARDASGHLTPYNYTLRKTGPEDVVVKVLYCGICHTDIHQAKNHLGASKYPMVPGHEVVGEVVEVGPEVTKYSAGDVVGVGVIVGCCRECHPCKANVEQYCNKRIWSYNDVYTDGRPTQGGFASAMVVDQKFVVKIPAGLAPEQAAPLLCAGLTVYSPLKHFGLMSPGLRGGVLGLGGVGHMGVKVAKSMGHHVTVISSSARKRGEAMDDLGADAYLVSSDAAAMAAAGDSLDYIIDTVPVHHPLEPYLALLKLDGKLILMGVINQPLSFISPMVMLGRKAITGSFIGSMAETEEVLNFCVDKGLTSQIEVVKMDYVNQALERLERNDVRYRFVVDVAGSNIDDADAPPA

SEQ ID NO: 84722 - DNA, 1104 bp, Cryptococcus neoformans var. neoformans JEC21
  CDS (1)..(1104)
atggtggacggaggagctgctattcctggaacgtatgtaccgtactgcatcgactttactggcggacgggcttcccgcaacatttcactggatgggctgcctactctcctcagcgtggcgacgaaattgaactcaaaccccacagctataccccaaggaagtttgaagatgatgatgtcatcgtcaaagtcgagtgctgaggtctttgcggtgtatagcgacgtccacatggttcgtatgaaaacacctggtcctaccatcactggtcacgagatcgtcggtaccgttgtcaaggctggtcccaagtctgagcacaaggtgggggagcgcgtcggtttcggtggtcaggctgggtcttgcagaagttgtgctaggtgcaaggacgagtttgaaaactattgccccaaatctcagaacgctttcttgtctccccttgagagcgaaagccagccatacacccagggcggctttagcgattactaccaggccaagggccatttcgccattaagatccctgaagaagtctcttccgtcgatgccgcccctcttctttgtgctggtgtgaccgttttcactcacctcaaacactataaggctggtcccggagtgaaggttggtgtcgtcggcactggtggtttgggacatgtgggtctcgccaccggtgcccatgttactgccatctcttccagtagtagcaagcgagaggacgctgctaagcttggtgctgatgcccaccttgacacttctgacgaaaaagctgtcaaggctgctttcagcacccttgatctcatcatctgcaccagttatcaggacaacatgcctctcaaggaggtttaccttcctttgctccgtcctctaggaaacattgtgatcctcggtctcgcggagtctggttaccctactctcggtgtatgggacttgctcggtaaatcggtcactagctctatgatcggctccccgaaagaccacgcagacatgttcgccactgtagtcaaacacaatatccgtccttgggtgcagaccagacccatagcgaaagctggcaaggccttcaccgatttcaggaagggtgttcccaagtaccgattcgtccttactgcttaa

SEQ ID NO: 84723 - protein, 367 aa, Cryptococcus neoformans var. neoformans JEC21
MVDGGAAIPGTYVPYCIDFTGGRASRNISLDGLPTLLSVATKLNSNPTAIPQGSLKMMMSSSKSSAEVFAVYSDVHMVRMKTPGPTITGHEIVGTVVKAGPKSEHKVGERVGFGGQAGSCRSCARCKDEFENYCPKSQNAFLSPLESESQPYTQGGFSDYYQAKGHFAIKIPEEVSSVDAAPLLCAGVTVFTHLKHYKAGPGVKVGVVGTGGLGHVGLATGAHVTAISSSSSKREDAAKLGADAHLDTSDEKAVKAAFSTLDLIICTSYQDNMPLKEVYLPLLRPLGNIVILGLAESGYPTLGVWDLLGKSVTSSMIGSPKDHADMFATVVKHNIRPWVQTRPIAKAGKAFTDFRKGVPKYRFVLTA

SEQ ID NO: 84724 - DNA, 1104 bp, Cryptococcus neoformans var. neoformans JEC21
  CDS (1)..(1104)
atggttgccgacaacgaattcaaaggctgggctggtttggacgagaaggcctgcgacggccacatgtcattccaggagttcactcccaagaagtgggatgaagacgacgtcgatgtcaaaattttgtactgcggtatctgtggttcagatgtctcctctttaactggtgaatggggacctgtaaaggacatctgcccccaggtttgcggccacgaaatcgttggtgaggttgtgagggtcggcacctctcccgaaaacggccttaagattggtgacctcgtcggtattggtgcccagtcagactcttgtcgtgaatgcgaatggtgcaaggaaggcaaggaaaactactgtgctacccaaaccatcacttttaactacccctacaaccgtggtcccaatggcaaggggtccatcgcccgaggtggttttgccaagtactggcgaggaccttccaagtttgctgtcccgcttccttccggcctcgagcctgacgttgcggcacctatgctttgtggtggtgtcaccgtctacagccccctcgcccgttttgaaatcggtaccaagcgcaagcgcgtcggtgtcatcggtgtcggtggtctcggtcacatggctatcctttttgccaaggctatgggcgccgaggtgactgctatctctcgaactgatgcgaagaaggaggacgccttcaagcttggtgctaccgattactttgctactggtggtgacttgcaggaggctgtcaaggctcgcactcgatctctcgactttattctctgtactatcaaccctgaaagcttctccatcagcgactacctccccctcctcacccccgccggtgtcttctgcatcgtcggcgtcatccccacccctttgcaagtccccgctttccctcttatcatgaacagcgcttgcgtcgccggttccaacatcggtagccccaaggagattactgaaatgttcgaattcgccgttaagcacaacattaagccttggatccagaagtggaacttcgacgatatcaacaaggcgttgccttctttccaaaaaggtgatcctaggtataggttcgtcttggtcaacgccgataatggcggcaagctttaa

SEQ ID NO: 84725 - protein, 367 aa, Cryptococcus neoformans var. neoformans JEC21
MVADNEFKGWAGLDEKACDGHMSFQEFTPKKWDEDDVDVKILYCGICGSDVSSLTGEWGPVKDICPQVCGHEIVGEVVRVGTSPENGLKIGDLVGIGAQSDSCRECEWCKEGKENYCATQTITFNYPYNRGPNGKGSIARGGFAKYWRGPSKFAVPLPSGLEPDVAAPMLCGGVTVYSPLARFEIGTKRKRVGVIGVGGLGHMAILFAKAMGAEVTAISRTDAKKEDAFKLGATDYFATGGDLQEAVKARTRSLDFILCTINPESFSISDYLPLLTPAGVFCIVGVIPTPLQVPAFPLIMNSACVAGSNIGSPKEITEMFEFAVKHNIKPWIQKWNFDDINKALPSFQKGDPRYRFVLVNADNGGKL

SEQ ID NO: 84726 - DNA, 1062 bp, Cryptococcus neoformans var. neoformans JEC21
  CDS (1)..(1062)
atggctatcactcacgctaccggctacgctatctcttcccctgacaactacctcaactttgagcttaaaaagtacgagcttgagcctcttgaggacgaccgtattactgtcgctgtagagtgctgtggtgtctgcggatctgaccaccacactatctctggtggctggggtcctttccagaccaagtttgtcgtcactggccatgaagtcgttggcaaggtcgtcgaggttggctctaaggtttctgagttcaaggttggcgacagagtcggtgttggtgcccaagttggctcatgtggaaagtgcaagtcctgcaagggccctaacgagaactactgtgtccagcccgttcacggctacaacacccactggtacgatggttctgagcaccaaggtggctactctacccacgtcagggcccaggagcgattcgttttcagcattcccgagtccctcaagtctactgatgctgcttccatgttgtgcgctggtatcaccaccttcgctccccttgtaaggaacggtgctggtcccggcaagaaggttggtgtggttggtctcggtggcctcggtcactacgccgttctcttcggtactgctcttggcgctgaggtcaccgttttctctcgttccgacgccaagaaggaggatgctatgaagatgggtgccaagaacttcatcgctacgggcgaggagggtttccaaaagggccatgagctcgagtttgacctcatcatcgtcactgcttcctccaacaagctccccgtcaacgagctcctctcttgtcttgatgttgacaagaagcttgtcttcgtcggtatgcctgacgaaggcttgaccaacatcacttctcaagctctttctggcaatggtgcctctcttgcctctagccacttgggtaacaggcaggaggtgcagcgaatgttgaagcttgcggctgagaagaatgttaagccttgggttgagatcttgcagatgaaagacgcggccaaggctatcaaggccgttgagaacagcactgtcaggtacaggtctattcttatccaggacatcgacgcctaa

SEQ ID NO: 84727 - protein, 353 aa, Cryptococcus neoformans var. neoformans JEC21
MAITHATGYAISSPDNYLNFELKKYELEPLEDDRITVAVECCGVCGSDHHTISGGWGPFQTKFVVTGHEVVGKVVEVGSKVSEFKVGDRVGVGAQVGSCGKCKSCKGPNENYCVQPVHGYNTHWYDGSEHQGGYSTHVRAQERFVFSIPESLKSTDAASMLCAGITTFAPLVRNGAGPGKKVGVVGLGGLGHYAVLFGTALGAEVTVFSRSDAKKEDAMKMGAKNFIATGEEGFQKGHELEFDLIIVTASSNKLPVNELLSCLDVDKKLVFVGMPDEGLTNITSQALSGNGASLASSHLGNRQEVQRMLKLAAEKNVKPWVEILQMKDAAKAIKAVENSTVRYRSILIQDIDA

SEQ ID NO: 84728 - DNA, 1086 bp, Cryptococcus neoformans var. neoformans JEC21
  CDS (1)..(1086)
atgaccactcttcaaggcgtttctatccccaagactcagactgctgccgtcgtcccctcggtcggagatcccatcaagattgacaaccaggccaaggtcattcaggccaacgagctcaagtccggccagtgtctcgtcaagattacccataccggtgtctgccacactgacttgcacgccaagcagggtgactggccaattccccccaagaaccctttgattggtggtcatgaaggtgtcggtcacattgtcgccattggtgctaacactgtcaactcccccgtccagctcggtgaccgagtgggtatcaagtggctcgccaactcctgtctcacctgtgaggcttgccgacgaggcttcgagatgaactgtgaccacgcagagctctctggctacaccattgatggtaccttcgccgaatacgttgtctctttcgtcaaccacgttacccccatcccgccgtcccttgactctgctggtgccgcctctatcctctgtgctggtgttacctcttataaggcactcaaggtttccaacacgaaggtcggtgattgggttgcccttcccggtgctggtggcggtctcggtcaccttgctatccagtacgccaaggccatgggtctcaaggtcgttgccatcgacactggggctgccaaggagaagctcgtcaagtctctcggtgccgatgcttgggttgacttcaagaccactaaagacctcgttgccgacgtcaaggctgccactgggggtcaaggtccagccgctgctgttgtgactgcttcccacaagactggttactctcaggctatcgactacctaaagccctctggtactttggtcgctgtcggtctccccaacgctgagatgggtgccaacgtcttctggacagtcttcaagagtatccgaatccagggttcttacgttggtaaccgacaggacgctatcgaatccctccagcttgttgaggatggaaaggtcaaggtcatctttgagcagaagcctcttgccgaccttaaggccgtctacgagggtctcgaagaaggcaagattgccggccgaatagtcctccaggtcgcgaaggagtag

SEQ ID NO: 84729 - protein, 361 aa, Cryptococcus neoformans var. neoformans JEC21
MTTLQGVSIPKTQTAAVVPSVGDPIKIDNQAKVIQANELKSGQCLVKITHTGVCHTDLHAKQGDWPIPPKNPLIGGHEGVGHIVAIGANTVNSPVQLGDRVGIKWLANSCLTCEACRRGFEMNCDHAELSGYTIDGTFAEYVVSFVNHVTPIPPSLDSAGAASILCAGVTSYKALKVSNTKVGDWVALPGAGGGLGHLAIQYAKAMGLKVVAIDTGAAKEKLVKSLGADAWVDFKTTKDLVADVKAATGGQGPAAAVVTASHKTGYSQAIDYLKPSGTLVAVGLPNAEMGANVFWTVFKSIRIQGSYVGNRQDAIESLQLVEDGKVKVIFEQKPLADLKAVYEGLEEGKIAGRIVLQVAKE

SEQ ID NO: 84730 - DNA, 1269 bp, Cryptococcus neoformans var. neoformans JEC21
  CDS (1)..(1269)
atgatgacgatttcttccaggcgaatctcgaccttcaccacagccctcaagtccattgttacccgtttgcctccgaactcaacgcatataagacccatctccacacgtctttctgccccttttcttcaccatccatctatatccgcaaccacatcacgtattatccatacaacccgagcaaacatgtctactctctctaacttcaccatccccaaaacccagattgccgctgttgtcaaaactaccggcgctgagctcgcgattgacaaggagcaccctgtcaagcaggcctcggagctcaggcctggcgaatgtttggtcaaaatctcccacactggtgtctgccataccgacttgcacgccaagtctggcgactggcctattcccccatcccatcctcttatcgggggtcatgaaggtgtcggtactatcgtcgctattggtgaccatactgctgcttctcccgtcaagctcggtgatcgagtcggtatcaagtggctcgccgacagctgtctcagctgtgagctttgtcgacgcggctatgagatgaactgtcccaacgtcaagctctctggctataccaccgacggtactttctccgaatacgtcgtctccttcgtcaaccatgttactcctattcccgaatccctcgactctgccggggccgcctccattctctgtgctggtgtcaccacctacaaggctctcaaggtctccaacaccaaggtcggtgactgggtcgctcttcccggcgctggcggtggtctcggtcatcttgccgtccaatatgcaaaggccatgggtctcaaggtcgtcgctatcgatactggcgctgccaaggagaagctcgtcaagtctctcggtgctgacgcttgggtcgactttaaaacttccaaggatattgtggccgacatcaaggccgctactggcggtgacggtcctgccgccgctgtggtcaccgctgccaacaagacgggttactctcaggcaatcgagtacttgaagcctagcggtacccttgtggctgtcggtatgcctgacgctgagatgggcgcaaacgttttctggacagtgttcaagagcattaggatccagggtagctacgtcggtaacagacaggacgcgattgaggcacttgatatcgctgcgtctggccacgtcagggtcgtctttgaagagaaaggtcttgaatcgttgaaggacgtttacgaggaccttgaggctggtaagattgctggccgagttgttctcaaggtttccgacgagtaa

SEQ ID NO: 84731 - protein, 422 aa, Cryptococcus neoformans var. neoformans JEC21
MMTISSRRISTFTTALKSIVTRLPPNSTHIRPISTRLSAPFLHHPSISATTSRIIHTTRANMSTLSNFTIPKTQIAAVVKTTGAELAIDKEHPVKQASELRPGECLVKISHTGVCHTDLHAKSGDWPIPPSHPLIGGHEGVGTIVAIGDHTAASPVKLGDRVGIKWLADSCLSCELCRRGYEMNCPNVKLSGYTTDGTFSEYVVSFVNHVTPIPESLDSAGAASILCAGVTTYKALKVSNTKVGDWVALPGAGGGLGHLAVQYAKAMGLKVVAIDTGAAKEKLVKSLGADAWVDFKTSKDIVADIKAATGGDGPAAAVVTAANKTGYSQAIEYLKPSGTLVAVGMPDAEMGANVFWTVFKSIRIQGSYVGNRQDAIEALDIAASGHVRVVFEEKGLESLKDVYEDLEAGKIAGRVVLKVSDE

SEQ ID NO: 84732 - DNA, 1206 bp, Cryptococcus neoformans var. neoformans JEC21
  CDS (1)..(1206)
atgatgacgatttcttccaggcgaatctcgaccttcaccacagccctcaagtccattgttacccgtttgcctccgaactcaacgcatataagacccatctccacacgtctttctgccccttttcttcaccatccatctatatccgcaaccacatcacgtattatccatacaacccgagcaaacatgtctactctctctaacttcaccatccccaaaacccagattgccgctgttgtcaaaactaccggcgctgagctcgcgattgacaaggagcaccctgtcaagcaggcctcggagctcaggcctggcgaatgtttggtcaaaatctcccacactggtgtctgccataccgacttgcacgccaagtctggcgactggcctattcccccatcccatcctcttatcgggggtcatgaaggtgtcggtactatcgtcgctattggtgaccatactgctgcttctcccgtcaagctcggtgatcgagtcggtatcaagtggctcgccgacagctgtctcagctgtgagctttgtcgacgcggctatgagatgaactgtcccaacgtcaagctctctggctataccaccgacggtactttctccgaatacgtcgtctccttcgtcaaccatgttactcctattcccgaatccctcgactctgccggggccgcctccattctctgtgctggtgtcaccacctacaaggctctcaaggtctccaacaccaaggtcggtgactgggtcgctcttcccggcgctggcggtggtctcggtcatcttgccgtccaatatgcaaaggccatgggtctcaaggtcgtcgctatcgatactggcgctgccaaggagaagctcgtcaagtctctcggtgctgacgcttgggtcgactttaaaacttccaaggatattgtggccgacatcaaggccgctactggcggtgacggtcctgccgccgctgtggtcaccgctgccaacaagacgggttactctcaggcaatcgagtacttgaagcctagcggtacccttgtggctgtcggtatgcctgacgctgagatgggcgcaaacgttttctggacagtgttcaagagcattaggatccagggtagctacgtcggtaacagacaggacgcgattgaggcacttgatatcgctgcgtctggccacgtcagggtcgtctttgaagagaaaggtcttgaatcgttgaaggagtaa

SEQ ID NO: 84733 - protein, 401 aa, Cryptococcus neoformans var. neoformans JEC21
MMTISSRRISTFTTALKSIVTRLPPNSTHIRPISTRLSAPFLHHPSISATTSRIIHTTRANMSTLSNFTIPKTQIAAVVKTTGAELAIDKEHPVKQASELRPGECLVKISHTGVCHTDLHAKSGDWPIPPSHPLIGGHEGVGTIVAIGDHTAASPVKLGDRVGIKWLADSCLSCELCRRGYEMNCPNVKLSGYTTDGTFSEYVVSFVNHVTPIPESLDSAGAASILCAGVTTYKALKVSNTKVGDWVALPGAGGGLGHLAVQYAKAMGLKVVAIDTGAAKEKLVKSLGADAWVDFKTSKDIVADIKAATGGDGPAAAVVTAANKTGYSQAIEYLKPSGTLVAVGMPDAEMGANVFWTVFKSIRIQGSYVGNRQDAIEALDIAASGHVRVVFEEKGLESLKE

SEQ ID NO: 84734 - DNA, 1128 bp, Parachlamydia sp. UWE25
  CDS (1)..(1128): transl_table=11
ttgttatttcaatatataagagttttaattggtttaatctgtttaaaaacgttaaaggagctaactatggttaaagtttcaggatatgccgctcagcaagcgacaacacctttaactccattcacatttgatcgacgcgaattaagatcagaggatgtgcaaatagaaattctatattgtggggtttgccattccgatttacatacagcgcgcaatgaatggaaaagtacaatttatccttttgttcctggtcatgagattgtgggaagagttttagaagttggtaaagatgttaaagattttaaaaaagatgacgtagttgctgttggatgtatggtcgattcttgtcgaacttgctctagttgtaaagaacatttagagcaatattgtgaaaatggaccagtttttacctataatagctatgataagtatgatcaatccattacacaaggaggctattcaacccaaatcgttgtagaccatcaatttgttcttcatgttccaaaagaatttaaagaaaaagattatccaggtgtagctcctttactttgtgcaggaattacgacttactcacctttgaagcattggaatgttggaaagggaagtaaagtaggcgtcgttggtctcggaggtcttgggcacatggccatcaaattagcccatgcaatggaagctcatgttgtcctttttactacatcaaaaaataaagaacaggatgcgaaaagattaggagctgatgaggttgttatttcaaaaaatgaagaagatgttaaaaaacataacgctacttttgattttatcctcgatacagtggccgcttcccataatttagatcctttgattgctttattaaaaagagagggaactttatgtttggtgggtgctcctgaatttcctcatccttctcctactgtcagccaacttatttttaaacgtaggcaaattgcaggatctttaattggaggaattcaagaaacgcaagaaatgctcgacttctgcgcgaagcgtcgaattacggccgatgtggaagtcatcccgatcgagaaaatcaatgacgcttatgagcgcatgctaaagggtgatgttaaataccgctttgtcatagacagcgtatctttgaaaaagtag

SEQ ID NO: 84735 - protein, 375 aa, Parachlamydia sp. UWE25
MLFQYIRVLIGLICLKTLKELTMVKVSGYAAQQATTPLTPFTFDRRELRSEDVQIEILYCGVCHSDLHTARNEWKSTIYPFVPGHEIVGRVLEVGKDVKDFKKDDVVAVGCMVDSCRTCSSCKEHLEQYCENGPVFTYNSYDKYDQSITQGGYSTQIVVDHQFVLHVPKEFKEKDYPGVAPLLCAGITTYSPLKHWNVGKGSKVGVVGLGGLGHMAIKLAHAMEAHVVLFTTSKNKEQDAKRLGADEVVISKNEEDVKKHNATFDFILDTVAASHNLDPLIALLKREGTLCLVGAPEFPHPSPTVSQLIFKRRQIAGSLIGGIQETQEMLDFCAKRRITADVEVIPIEKINDAYERMLKGDVKYRFVIDSVSLKK

SEQ ID NO: 84736 - DNA, 1011 bp, Picrophilus torridus DSM 9790
  CDS (1)..(1011): transl_table=11
atgaaggctgcattattatataaaaatgagaaaaaactgagaatagaggatgttcctgttccagagataaacgacgatgaggttctaatcaaggtaaaggctgcagggatatgccatacagagttacatttcattgataatgttttaaatgccggtaaatatccgattataccagggcatgaggttgccggaatagtatacaaaaaaggtaaaaatgtgaaggatcttgatttaaatgataaggtgcttttatattattaccgtggctgcggtaaatgtgatttctgcattaatggccaggagaacctatgcacaaatccggaaatggaatatggatttataaatgacggcggcttttcagaatatataaaggccagggagactgaccttgtaaagctcaacgatgatatcgatatatattcaattgccccaatagcatgcagcataagcaccggaatacacgcattaaacatggccaaaccggaattgaatgacagggttcttgtttacggtgttggaggcgttggcttcggattgatacagcttaataaattaaggggctgcagggttttttctgcatcaagaaatgataaaaaactggacattgcaaaaaagcttggctctgattataatataaatacatgcaatgagaatatagtaaataaagtaaaaagcatgggcggtgttgatattatatacgatcttgttggttcaaatgaaacaataaagaatgatatagaaatgctgaataaggctggtaaactggtattaataggctatgacggcagtaatgtaaatataaatccgctggatctgataataaatgaaataaaaataatatcatgcgttggtaatacaagatacgagctggaagaggctgtaagattatttaacgagaacaggataaaaattgtaatagacagatttgatgaattaaaaaatataaacaatgaccttgagataataagaaatggcgaggccatgggcagaatcgtaataaaatttgattaa

SEQ ID NO: 84737 - protein, 336 aa, Picrophilus torridus DSM 9790
MKAALLYKNEKKLRIEDVPVPEINDDEVLIKVKAAGICHTELHFIDNVLNAGKYPIIPGHEVAGIVYKKGKNVKDLDLNDKVLLYYYRGCGKCDFCINGQENLCTNPEMEYGFINDGGFSEYIKARETDLVKLNDDIDIYSIAPIACSISTGIHALNMAKPELNDRVLVYGVGGVGFGLIQLNKLRGCRVFSASRNDKKLDIAKKLGSDYNINTCNENIVNKVKSMGGVDIIYDLVGSNETIKNDIEMLNKAGKLVLIGYDGSNVNINPLDLIINEIKIISCVGNTRYELEEAVRLFNENRIKIVIDRFDELKNINNDLEIIRNGEAMGRIVIKFD

SEQ ID NO: 84738 - DNA, 1011 bp, Picrophilus torridus DSM 9790
  CDS (1)..(1011): transl_table=11
atgaaggcaatggtactagaaaaggtaggaaaagtggaggaaaatccattaaaatacaaggacgttgatataaagaagccagagggttttgaaattttgataaaaaaccttgcctgtggtgtatgccattcaaatctgcatatgatagagggggactgggttcagtacggtcttcctggaaaatcaaatataattccgggccacgagataatcggccgcgttgaggagcttggcgataatgttacagatttaaagaagggtgatatagtcggtcttcagccactttacagtgcatgtggaaagtgtgagtactgtttatccggcagggagcatctatgcccatatggtaaatggaccggtgaaaccgttgatggcggctatgcagaatacatgatagccgattcaaggtacgttaataaggttccatcaaacatagacccggttaatgcaccattattctgcccgggtgttacagcatatactgcggtaaaaaaagcagaactatcgccagacaagactgtttacatagttggaataggcggtgtcggtcacatagcactgcagatagcaaagctttacggttcaagggttgttgctgtaacaacatcaaagaaccatgaggatcttgcatataagatgggcgccgatgatgttgtaatcatggaccgcaactatgaaaatgccgacatgctcgcaaagactgcagatgctgcaataatctttgcgcctgccgatgctgcaataaagaactcaataaagtttgtaaaggacggcggtgttgttgttcagggagttcgtggcaaccagggtgagtttgattttacaagggagttaaaaattaagggatcaaagatcggcacaaggcaggacatgaacgaggtattaaagcttgcagcagatggtaaaataaaggtcgagtcgaaaacatataaactggaggaggcaaatgaggctttaaaggccttaaagcatggcgaggtaaacggcagggccgttcttaagatgtattaa

SEQ ID NO: 84739 - protein, 336 aa, Picrophilus torridus DSM 9790
MKAMVLEKVGKVEENPLKYKDVDIKKPEGFEILIKNLACGVCHSNLHMIEGDWVQYGLPGKSNIIPGHEIIGRVEELGDNVTDLKKGDIVGLQPLYSACGKCEYCLSGREHLCPYGKWTGETVDGGYAEYMIADSRYVNKVPSNIDPVNAPLFCPGVTAYTAVKKAELSPDKTVYIVGIGGVGHIALQIAKLYGSRVVAVTTSKNHEDLAYKMGADDVVIMDRNYENADMLAKTADAAIIFAPADAAIKNSIKFVKDGGVVVQGVRGNQGEFDFTRELKIKGSKIGTRQDMNEVLKLAADGKIKVESKTYKLEEANEALKALKHGEVNGRAVLKMY

SEQ ID NO: 84740 - DNA, 1032 bp, Acinetobacter sp. ADP1
  CDS (1)..(1032): transl_table=11
atgggaagtttaatgaaagctgcagtagtcactgcttttaatcaaccgttagagatcaaggatgtagaaataccgaaagttacttcaggcaaagtattggtgaagatgattgcaacgggagtctgtcataccgatttacacgctatgcacggtgattggccgatcaaacccagtctccctttcattcctggacacgaaggtgtaggtgaggtggtcgaaattggagaaggcattacacacttaaaaattggcgatacagtgggtgttccttggttatattcggcatgtggtcattgtgaccattgttacgccggctgggaaacattatgtaagcaacagcaaaactctggttactctgtaaatggtagttttgcagaatactgtctggccgatggcgaatatgttggagtgattcctgagggcgtagatttacttgaaatcgcgccaattttatgtgcaggggtaactgtatataaaggtttaaaaatgacagaagccaaaactggtgattgggttgcaatttctggtattggtggcttaggtcatgttgccgtacagtatgcaaaaacgatgggctttaatgtggttgcaattgatgtagatgacagcaaattggaacttgccaaacagttaggtgcagatgtgggaatcaatgcacttaaagttgatgtaaaagaagaggtcctaaaagcgacaggtgaaggttgtcatggggtattggtgactgctgtttctcctaaggcttttgaacaggcagtatccgttgtacgacgtggtggaaccatggttttaaacggcttaccaccaggtaaatttgacctttcaatttttgatatggtgctggatggaatcaccgtgcgtggttcgattgtaggaactcggctggatctgaaagaagcgttggatattgcagcgcgtggaaaagtaaaagcacatattagcgtagaacccctagaaaatatcaatgatatttttgagcgaatggaacagggtaaaattgatggacgtattgtgattgaccttaaactctaa

SEQ ID NO: 84741 - protein, 343 aa, Acinetobacter sp. ADP1
MGSLMKAAVVTAFNQPLEIKDVEIPKVTSGKVLVKMIATGVCHTDLHAMHGDWPIKPSLPFIPGHEGVGEVVEIGEGITHLKIGDTVGVPWLYSACGHCDHCYAGWETLCKQQQNSGYSVNGSFAEYCLADGEYVGVIPEGVDLLEIAPILCAGVTVYKGLKMTEAKTGDWVAISGIGGLGHVAVQYAKTMGFNVVAIDVDDSKLELAKQLGADVGINALKVDVKEEVLKATGEGCHGVLVTAVSPKAFEQAVSVVRRGGTMVLNGLPPGKFDLSIFDMVLDGITVRGSIVGTRLDLKEALDIAARGKVKAHISVEPLENINDIFERMEQGKIDGRIVIDLKL

SEQ ID NO: 84742 - DNA, 1023 bp, Acinetobacter sp. ADP1
  CDS (1)..(1023): transl_table=11
atgacaactaatgtgattcatgcttatgctgcaatgcaggcaggtgaagcactcgtgccttattcgtttgatgcaggcgaactgcaaccacatcaggttgaagttaaagtcgaatattgtgggctgtgccattccgatgtctcggtactcaacaacgaatggcattcttcggtttatccagtcgtggcaggtcatgaagtgattggtacgattacccaactgggaagtgaagccaaaggactaaaaattggtcaacgtgttggtattggctggacggcagaaagctgtcaggcctgtgaccaatgcatcagtggtcagcaggtattgtgcacgggcgaaaataccgcaactattattggtcatgctggtggctttgcagataaggttcgtgcaggctggcaatgggtcattcccctgcccgacgaactcgatccgaccagtgctggtcctttgctgtgtggcggaatcacagtatttgatccaattttaaaacatcagattcaggctattcatcatgttgctgtgattggtatcggtggtttgggacatatggccatcaagctacttaaagcatggggctgtgaaattactgcgtttagttcaaatccaaacaaaaccgatgagctcaaagccatgggggccgatcacgtggtcaatagccgtgatgatgccgaaattaaatcgcaacagggtaaatttgatttactgctgagtacagttaatgtgcctttaaactggaatgcgtatctaaacacactggcacccaatggcactttccattttttgggcgtggtgatggaaccaatccctgtacctgtcggtgcgctgctaggaggtgccaaatcgctaacagcatcaccaactggctcgcctgctgccttacgtaagctgctcgaatttgcggcacgtaagaatatcgcacctcaaatcgagatgtatcctatgtcggagctgaatgaggccatcgaacgcttacattcgggtcaagcacgttatcggattgtacttaaagccgatttttaa

SEQ ID NO: 84743 - protein, 340 aa, Acinetobacter sp. ADP1
MTTNVIHAYAAMQAGEALVPYSFDAGELQPHQVEVKVEYCGLCHSDVSVLNNEWHSSVYPVVAGHEVIGTITQLGSEAKGLKIGQRVGIGWTAESCQACDQCISGQQVLCTGENTATIIGHAGGFADKVRAGWQWVIPLPDELDPTSAGPLLCGGITVFDPILKHQIQAIHHVAVIGIGGLGHMAIKLLKAWGCEITAFSSNPNKTDELKAMGADHVVNSRDDAEIKSQQGKFDLLLSTVNVPLNWNAYLNTLAPNGTFHFLGVVMEPIPVPVGALLGGAKSLTASPTGSPAALRKLLEFAARKNIAPQIEMYPMSELNEAIERLHSGQARYRIVLKADF

SEQ ID NO: 84744 - DNA, 1020 bp, Erwinia carotovora subsp. atroseptica SCRI1043
  CDS (1)..(1020)
atgacgataatcaagagttatgccgcaccggaagcaggcgcagcgctggagttgtatgagtttgatgcgggtgaactgcaggcggaagatgtcgaagtcgtggttgattactgcggcgtgtgccattccgatctctcgatgatcgataacgaatggggaatgtcgagctatccgctggttgccgggcatgaagtaattggtcgtgtgcacgcgttgggtgacgcggcgaagaacaaaggattaaagattggtcagcgcgtcggcattggctggacggcacgcagctgtgggcactgcgatgcctgtatcagcggcagccaaaccaactgtcagcaaggcagcgtgccaacgattctgaacaaaggcggttttgccgataagatccgagcgaactggcaatgggctatcccgcttcctgattccattgatatcgaatcggcgggtccgctactgtgcggcggcatcaccgtcttcaaaccgctgttaatgcaccatgtcactgcgaccagccgcgtcggcgtgatcggtatcggcggtctggggcatattgcgattaagctcctgcatgcgatgggctgtgaggtcacggcgttcagctcaaacccgtccaaagagcaggaagtgttggcgatgggtgccgataaagtcgtcaacagtcgcgatccgcaggcgctgaccgcactggcaggccagttcgatctgatcatcaacaccgtgagcgtcgatctggaatggcaaccctacttcaacgcgctcgcctacaacgggaagttccataccgtcggcgcagtaatgaagccatttagcgttccagcctttacgctcatcgcgggcgaccgcagcgtttctggttcttctactggctcaccgcatgagctgcgttctctgatgaagctctccgcacgtgccaacgtgaagccacagacggaactgttcccaatgtcgaaaatcaacgatgctatccagcacgtacgtgacggcaaagcccgttatcgcgttgtactgaaagctgatttttaa

SEQ ID NO: 84745 - protein, 339 aa, Erwinia carotovora subsp. atroseptica SCRI1043
MTIIKSYAAPEAGAALELYEFDAGELQAEDVEVVVDYCGVCHSDLSMIDNEWGMSSYPLVAGHEVIGRVHALGDAAKNKGLKIGQRVGIGWTARSCGHCDACISGSQTNCQQGSVPTILNKGGFADKIRANWQWAIPLPDSIDIESAGPLLCGGITVFKPLLMHHVTATSRVGVIGIGGLGHIAIKLLHAMGCEVTAFSSNPSKEQEVLAMGADKVVNSRDPQALTALAGQFDLIINTVSVDLEWQPYFNALAYNGKFHTVGAVMKPFSVPAFTLIAGDRSVSGSSTGSPHELRSLMKLSARANVKPQTELFPMSKINDAIQHVRDGKARYRVVLKADF

SEQ ID NO: 84746 - DNA, 1050 bp, Erwinia carotovora subsp. atroseptica SCRI1043
  CDS (1)..(1050)
atgcttgtaaacgcgtatggagcccatgcgggcgacaaacctcttgagccgttgaagatcgttcgacgtgcgccgggagctcatgatgttcagattgagattgcgtactgcggtatttgccattcggacctgcatcaggtgcgtgctgaatgggctggaacgcagtttccctgcgtacctggacatgaaatcgtcggaagggtgtctgcggtagggccacatgtttccgcttttaaggctggcgatctggtcgggatcggctgcatcgtggacagttgtcggcactgtgaagaatgcgatgagggtttagagaactactgtgacgggatggtcggcacgtataacggcccgacagcagacgaacccggatggacgcttggcggctactctcagcaaatcgtggtgcatgagcgctatgtgctgcgtgtccgccattctgaggcagagctggctgccgtcgcgcctctgctgtgcgcgggaattaccacctattcaccgcttcggcactggaatgcagggcccggtaagaaggttggcgttgtagggatcggcgggcttggccacatggggatcaaactggcgcatgcgatgggggcctatgtcgtagcgttcaccacgtctgaatccaaacgtgaagatgcaaaagcgctgggggcaaacgaggttgtggtgtctcgtaatgctgaggaaatggcggcgcacgcaggcagcttcgatttaattctgaataccgtggccgctccgcacgatctggatgcgtttctggtcctgctgaaacgagatggcgcgttgacgctagtcggtgcgcctgcgtcgccacatccttctcccaacgtgttcaatctgatcatgaagcgtcgtacggtggcggggtcgatgattggtggcattcctgagacgcaggagatgctggatttttgtgccgagcacgggattgtttcagatattgagctgatccgggctgacgaaatcaatgaggcctacgagcggatgctcaaaggtgatgtgaaatatcgctttgtcattgataacgccacgctgagtgcctga

SEQ ID NO: 84747 - protein, 349 aa, Erwinia carotovora subsp. atroseptica SCRI1043
MLVNAYGAHAGDKPLEPLKIVRRAPGAHDVQIEIAYCGICHSDLHQVRAEWAGTQFPCVPGHEIVGRVSAVGPHVSAFKAGDLVGIGCIVDSCRHCEECDEGLENYCDGMVGTYNGPTADEPGWTLGGYSQQIVVHERYVLRVRHSEAELAAVAPLLCAGITTYSPLRHWNAGPGKKVGVVGIGGLGHMGIKLAHAMGAYVVAFTTSESKREDAKALGANEVVVSRNAEEMAAHAGSFDLILNTVAAPHDLDAFLVLLKRDGALTLVGAPASPHPSPNVFNLIMKRRTVAGSMIGGIPETQEMLDFCAEHGIVSDIELIRADEINEAYERMLKGDVKYRFVIDNATLSA

SEQ ID NO: 84748 - DNA, 1062 bp, Propionibacterium acnes KPA171202
  CDS (1)..(1062): transl_table=11
atgcccatcatcgtcaaggcgcttcagaaggatggaccggaccggcctttcaaagttgtcgagattgaacgacgagacccgcgtcccgacgacgtcgtcatcgacattaaagctgctggaatctgtcattctgacattcacaccattcgcaacgagtggggccaggcgcacttcccgctgaccgtcggtcatgagattgccggaatcgttgaggctgttggttccgaggtcacgaagtacaaacctggagaccgagtaggcgtcggatgtctggtcaactcgtgcggacactgtgagcagtgcgaggccggggaggagcaggcgtgtctcaacgggccggtcggtacttacaacgcccatgatgtcgacggaagtatcacccagggcggctactctcagaaaatcgtcgtcaacgagaggtttgtttgccgcatccccgattccctggacttcgtagaggcagctccgctgctgtgcgccggcatcaccacctattcgccgatcgcccagtggaacgtcggacctggccagaaggtagccgtgctggggctcggcggactgggccatatgggggtccagattgccgctgctaaaggagcggatgttacggtgctctcacgtagcctgcgcaaggagaaattcgccgaaaagctcgcggccacgcggacccttgctaccagcgacgacaacttcttccgtgatcaccggggagagttcgatttcatactcaacaccattagtgctctgattgacgtgtcggcttaccttaagctactcaagccgcgtggcgtcatggcttgtgtcggtctgccacctgaggaacttggactgcaggttggttctctcatcaacggttccaaggtgcttgccggttcaaatatcggtggcatcccccagacccaggatatgctcgatttctgcgccgagcatcgcctcggggcatgggtggaaaagatcggggttgacgaggtcgacgcggcatatgaccgggtggttgcgggcgatgtgagattccgcttcgttattgacactgcaactttcagagcagtcggagctggatga

SEQ ID NO: 84749 - protein, 353 aa, Propionibacterium acnes KPA171202
MPIIVKALQKDGPDRPFKVVEIERRDPRPDDVVIDIKAAGICHSDIHTIRNEWGQAHFPLTVGHEIAGIVEAVGSEVTKYKPGDRVGVGCLVNSCGHCEQCEAGEEQACLNGPVGTYNAHDVDGSITQGGYSQKIVVNERFVCRIPDSLDFVEAAPLLCAGITTYSPIAQWNVGPGQKVAVLGLGGLGHMGVQIAAAKGADVTVLSRSLRKEKFAEKLAATRTLATSDDNFFRDHRGEFDFILNTISALIDVSAYLKLLKPRGVMACVGLPPEELGLQVGSLINGSKVLAGSNIGGIPQTQDMLDFCAEHRLGAWVEKIGVDEVDAAYDRVVAGDVRFRFVIDTATFRAVGAG

SEQ ID NO: 84750 - DNA, 1053 bp, Leifsonia xyli subsp. xyli str. CTCB07
  CDS (1)..(1053): transl_table=11
gtgctcatcgaaaggaaaactcccatgcgtgcagccgtcgtcacgtccttcaccgagccgatcgtcgtggaggacgtccccctccccacgccgggacccggccaggtgctcgtgcgtatcgagacctgcggtctctgccataccgacatccatgccgcccacggggactggccggtgcgcccctcgcttccgttcattcccggacacgaaggcgtcggccgcgtcactgccctcggcgagggtgtcaccgcgcccgccgtcggaacccgagtggcactcgcgtggctgggaagcgcgtgcgggtcgtgccgctactgcgagaccggtcgcgagaacctctgtgtctctcagcagaacaccggctactccatcgacggggcgtacgcggaatatgcagtcgcggacgcgagattcgccgtgcccgtacccgattcggtgtcgtcgatggatgccgcgcccctcacgtgcgccggggtcaccgcatacgtcgccgtcaagacggcacgtgtgcggccggcggaacgggtggtcgtcttcggggtgggagggctcgggcatctcgcggtgcagtacgcgcgattggtgggagcggaggtcatcgccgtagacgtgaccgacgagaagctcgcactcgccaccgagctcggagccgaccacgtcgtcaacgcccgcacctcggaccccgtgcaggagatccacgccctcggcggtgccgatgccgtcatcgttctcgcagtcgcccccgccgtgttcgaccaggcgttccgctccctcagccggggagggcgcctcatcttggtgtcgcttcccgcgaacggagtgatggggatccccgtcttcgagaccgtgcttaacggcattaccgtggccggttcgatcgtcgggacgcgggaggacctcgccgaagtcttccgccttcaagcgctcggccggacacgggtcatcgcgcagccccgagaactggagcaagcccccgaagcgatgcaggaagtgctcgacggcaccgtgccggcacgtctggtgttcgatctggcgcacgtagggagccactga

SEQ ID NO: 84751 - protein, 350 aa, Leifsonia xyli subsp. xyli str. CTCB07
MLIERKTPMRAAVVTSFTEPIVVEDVPLPTPGPGQVLVRIETCGLCHTDIHAAHGDWPVRPSLPFIPGHEGVGRVTALGEGVTAPAVGTRVALAWLGSACGSCRYCETGRENLCVSQQNTGYSIDGAYAEYAVADARFAVPVPDSVSSMDAAPLTCAGVTAYVAVKTARVRPAERVVVFGVGGLGHLAVQYARLVGAEVIAVDVTDEKLALATELGADHVVNARTSDPVQEIHALGGADAVIVLAVAPAVFDQAFRSLSRGGRLILVSLPANGVMGIPVFETVLNGITVAGSIVGTREDLAEVFRLQALGRTRVIAQPRELEQAPEAMQEVLDGTVPARLVFDLAHVGSH

SEQ ID NO: 84752 - DNA, 1065 bp, Burkholderia mallei ATCC 23344
  CDS (1)..(1065): transl_table=11
atgagcacgacttacgcttacgcggcaacgagcgccaccacgccgctcgcgccgttcgaatttgcgcgccgcgcgctgcgcgatctcgatgtgcagatcgagatcctttactgcggcgtttgccactccgatctccaccaggcccgcaacgagtggaagaacacgacttatccggtcgtgccgggccatgaaatcgtcggccgcgtgacggcggtcggcgcgcaggtcacgcgcttcgaagcgggcgagctcgtcggcgtgggctgcctcgtcgattcgtgccgcacgtgcccgagctgcgcgcaagggctcgagcagtattgcgagaacggtttcgtcggcacctacaacggccgcgaccgcgcaaccggcgacatcacgtacggcggctattcgacgcagatcgtcgtcgacgaagcgttcgtgctgcgcgtgcccgacacgctcgacccggcgggcgcggcgccccttctctgcgcgggcatcacgacgtattcgccgctgcgccagtggggcgccgggcccggcaagaaggtcggcatcgtcggcctgggcggcctgggccacatgggcgtgaagctcgcacgcgcgatgggcgcgcacgtcgtgctgttcacgacgtcgccgtcgaagatcgaggacggcaagcggctcggcgcgcacgaggtcgtgatctcgaaggacgaggcgcagatgaacgcgcatctgaacagcttcgacttcatcctgaacacggtcgccgcgcagcacgatctgaatccgttcatcggcctgctgaagctcgacggcacgatgacgctcgtcggcgcgccggagcacgatcatccgtcgccgcgcgtgttcaacctgatctacaagcgccgccgcctcgcgggatcgctgatcggcgggattgccgagacacaggaaatgctcgatttctgcgcgcagcacggcatcacgtcggacatcgaagtgattccgatgtcgcagatcaacgcggcctacgagcggatgctgacgagcgacgtgaaatatcggttcgtgatcgacatcggatcgatcaggccgcagcgcgcggcgtga

SEQ ID NO: 84753 - protein, 354 aa, Burkholderia mallei ATCC 23344
MSTTYAYAATSATTPLAPFEFARRALRDLDVQIEILYCGVCHSDLHQARNEWKNTTYPVVPGHEIVGRVTAVGAQVTRFEAGELVGVGCLVDSCRTCPSCAQGLEQYCENGFVGTYNGRDRATGDITYGGYSTQIVVDEAFVLRVPDTLDPAGAAPLLCAGITTYSPLRQWGAGPGKKVGIVGLGGLGHMGVKLARAMGAHVVLFTTSPSKIEDGKRLGAHEVVISKDEAQMNAHLNSFDFILNTVAAQHDLNPFIGLLKLDGTMTLVGAPEHDHPSPRVFNLIYKRRRLAGSLIGGIAETQEMLDFCAQHGITSDIEVIPMSQINAAYERMLTSDVKYRFVIDIGSIRPQRAA

SEQ ID NO: 84754 - DNA, 1068 bp, Methylococcus capsulatus str. Bath
  CDS (1)..(1068): transl_table=11
atgcctacagccaaagcctatgccgctttttccgcagactcggcgctggcgccgttcgtcctgcagcggcgcgacccactgccccaggacatccgcatcggaatcctgtactgcggtgtctgccattccgacctgcaccaggcacgcaatgagtggaatgcgaccacatatccttgtgtgccaggccatgagatcgtcggcaaggtccttgaagtcggccgcagcgtgacgaagttcaagcccggcgacacggtcgcggtgggctgcatggtggattcctgccggacctgcccgaactgcgtggacgccctggaacagcactgcgagcacggccccgtcttcacctacaacagccccgatccgcacggcggcggcatgaccttcggtggctatgccgagagcatcgtggtcgacgaggccttcgtgctgcggataccggacggactggacctcgcggccgccgccccgctgttgtgcgccgggattaccacctattcgcccctgcggcactggaaagtgggggcgggtcagcgggtcggggtcgtcggtctgggtggactgggacacatggcgctcaagttcgcgcataccttcggcgccgaaacggtgctgttcacgacgacgccggacaaggcggaggatgcccgtcggctgggagcggacgaggtcgtcgtgtcgagggatcccgaggccatggcgcggcaggccggccggttcgatttcatcctcgacaccgtctcggcgccccatgacatcgatgcctatctgaacctgctgaggcgggacggcacgctgaccctggtcggcgtacctccgcaaggggtacaggtcatgcccttcagcctgatcggcgggcgccggcgactggctggttcattgatcggcggcatccgggaaacccaggagatgctggatttctgcggcgaacacggcatcgtctgcgacatcgagctgattccgatccaaggaatcaacgacgccttcgagcgcatgctcaaaagcgacgtgaaataccgtttcgtgatcgacatggcgacgctgaacggggagtcgtccggagggcgatga

SEQ ID NO: 84755 - protein, 355 aa, Methylococcus capsulatus str. Bath
MPTAKAYAAFSADSALAPFVLQRRDPLPQDIRIGILYCGVCHSDLHQARNEWNATTYPCVPGHEIVGKVLEVGRSVTKFKPGDTVAVGCMVDSCRTCPNCVDALEQHCEHGPVFTYNSPDPHGGGMTFGGYAESIVVDEAFVLRIPDGLDLAAAAPLLCAGITTYSPLRHWKVGAGQRVGVVGLGGLGHMALKFAHTFGAETVLFTTTPDKAEDARRLGADEVVVSRDPEAMARQAGRFDFILDTVSAPHDIDAYLNLLRRDGTLTLVGVPPQGVQVMPFSLIGGRRRLAGSLIGGIRETQEMLDFCGEHGIVCDIELIPIQGINDAFERMLKSDVKYRFVIDMATLNGESSGGR

SEQ ID NO: 84756 - DNA, 1056 bp, Nocardia farcinica IFM 10152
  CDS (1)..(1056): transl_table=11
atgagcaccgctgccgccgcctatgccgtgtccgccgccgacggatccttcgagaaggtcaccatcgcccggagggagctcgggccgcacgacgtgctgatcgatgtgaagtacgcgggcatctgccactccgacatccacaccgcccgtgacgagtggggtggcacccgctacccgtgcgtgcccggccacgagatcgcgggcatcgtcgccgcggtcggctcggcggtcacgaaataccggcccggcgaccgggtgggtgtgggctgcatggtcgactcgtgcggtcagtgcccgccgtgcctggccgacgaggagcagtactgcctgcgcggcgccaccatgacctacaacaccccggtgccggaggaggtgcagcccggcgggcacaccctgggcggctactccacccaggtcgtcgtcaccgagaacttcgtggtccgcatccccgagggcatcggcctcgacatcgcggcgccgctgctgtgcgcgggcgtgacgctgttctcgccgctgcggcactggcaggccgggccgggcaagcgcgttgccatcgtcgggatgggcgggctcggccacatcggggtgaagctggccgccgcgatgggcgccgaggtcaccgtgctcagccattcgctgagcaagcaggaggacggcaagcgcttcggcgcgcaccactactacgccaccggcgacaagcagaccttccgcgatctgcgcaaccggttcgacctgatcatcaacaccgtctcggccgacctgcccatcgacagctacatgcgcctgctgcgcctggacggcaccctggtgatcctcggcctgcccgagaacccgctcagcgtgcggcctttcaccctcgccaattaccgccgctcactggccggttcgatgatcggcggcatcgcccagacccaggagatgctgaacttctgcgccgagcacggtatcggcgccgagatcgagctcatctccgccgacgagatcgacaacgcctacgaccgggtggtcgccagcgacgtgcggtaccgcttcgtgatcgacgccgccaccatgtag

SEQ ID NO: 84757 - protein, 351 aa, Nocardia farcinica IFM 10152
MSTAAAAYAVSAADGSFEKVTIARRELGPHDVLIDVKYAGICHSDIHTARDEWGGTRYPCVPGHEIAGIVAAVGSAVTKYRPGDRVGVGCMVDSCGQCPPCLADEEQYCLRGATMTYNTPVPEEVQPGGHTLGGYSTQVVVTENFVVRIPEGIGLDIAAPLLCAGVTLFSPLRHWQAGPGKRVAIVGMGGLGHIGVKLAAAMGAEVTVLSHSLSKQEDGKRFGAHHYYATGDKQTFRDLRNRFDLIINTVSADLPIDSYMRLLRLDGTLVILGLPENPLSVRPFTLANYRRSLAGSMIGGIAQTQEMLNFCAEHGIGAEIELISADEIDNAYDRVVASDVRYRFVIDAATM

SEQ ID NO: 84758 - DNA, 987 bp, Legionella pneumophila str. Paris
  CDS (1)..(987): transl_table=11
atgcatgctatgatcatggaaaagcctggatgtgcattgcaatatcaggaagtcaataaaccaaatccaaatgaaaatgaacttttaattaaagtatcagcttgtgggatttgtagaactgacttgcatgttgtcgatggtgagctgaaaaatcccaagactccccttattccaggccaccaaattgtaggaactgttgagcaggttggatccgctgtaaagaaatttgcaattggacagcgagttggagtcccttggctaggtggaagttgcgggatctgtaatttttgcacctctggccgagaaaatttatgtgatcaagcctgctttaccgggtatcaaatagatggtggtttcgctgagttctgtgtagcaaattaccatttttgcttccctattcctgatggatacccggatcatcaggcagcaccattattttgtgctggtttaattggatatcgtgccttgctaaaggctggtaacgcaactcatttaggcctatatggatttggagcggcagcacatatactgattcaagtagcttgccaaaaaggaataaaaatttatgcgtttacaagcccaggtgatcaggaaactcaaaaatttgcataccgattaggtgctgtctgggccggagattctacgcaatcaccacctcatcttcttgatgcagcaatcatttttgcacccgttggtgcattagtgcctcaggctcttcacaatactgtaaaaggaggtactgtggtttgtgctggtatacatatgtcggatattcccagctttccttatgaaatactgtggggtgaacgcactgtatgttcaattgccaatctaactcgcaaagatggagaagagttcctgtctctggcccctaaaatcccagttaagacaaaagttcaaacctatccccttactgaagttaatcgagcactggatgatttaagacatggcaggtatagaggagccggggttattgttatgaaataa

SEQ ID NO: 84759 - protein, 328 aa, Legionella pneumophila str. Paris
MHAMIMEKPGCALQYQEVNKPNPNENELLIKVSACGICRTDLHVVDGELKNPKTPLIPGHQIVGTVEQVGSAVKKFAIGQRVGVPWLGGSCGICNFCTSGRENLCDQACFTGYQIDGGFAEFCVANYHFCFPIPDGYPDHQAAPLFCAGLIGYRALLKAGNATHLGLYGFGAAAHILIQVACQKGIKIYAFTSPGDQETQKFAYRLGAVWAGDSTQSPPHLLDAAIIFAPVGALVPQALHNTVKGGTVVCAGIHMSDIPSFPYEILWGERTVCSIANLTRKDGEEFLSLAPKIPVKTKVQTYPLTEVNRALDDLRHGRYRGAGVIVMK

SEQ ID NO: 84760 - DNA, 1047 bp, Legionella pneumophila str. Lens
  CDS (1)..(1047): transl_table=11
atgtcagaaactattggttatgctgcccacaaagcgggagcccctttaaaacctttcacttttgaacgccgccctgttggtgcacacgacgtagcaattgatattctattttgtggtatctgtcattccgatttgcatcaagtcaataatgattgggcaggagcgttctatcctatggttcctggacatgaaatcattggacgagtcaaggaggtaggacatcaagtccaccggttcaaagcaggagatttagtgggcgttggctgtatggttgactcctgccgtcaatgcacctattgccatcagaatgaagaacaatattgtaaatccggcgcaacctacacctataacagtcaagacaatcatctgggaggggtgacttacgggggatattccaagcatgttgtcgtcacggaagattttgtattaaaaattgatgaatcacttgatcctgccgccgccgcaccattgctctgtgccggaataaccacttactcccccttgaaaagggctaaagtaggtaaaatgagtaaagtaggaatcgttggcctgggtggcttaggacatatggcagtcaaattagcccgtgccatgggggcttatgtgactgtatttaccacttctataaacaagataaaagcgggtaaagatttgggagctcatgatgttgtcttgtctaccgacagcaatgtcatgcaaacactggccaatcaatatgattttattcttgatactgtttctgccaaacatgatcttggccaatatttaaaccttcttaaagtggatggacaactaacccaggttgggcttccatcagatccacttgaagttaccatgtttcctgttattttaaagagactgagcattaacggctcattgattggcggcattaaagagacacaagaagttttggatttttgcgccaggcatgggatcaccgcagacattgaattaataaaaatgcatgaagtaaattctgcctatgaaagactgctaaaaggagatgtgaaatatcgatttgttatcgatatgtcaaccttggattaa

SEQ ID NO: 84761 - protein, 348 aa, Legionella pneumophila str. Lens
MSETIGYAAHKAGAPLKPFTFERRPVGAHDVAIDILFCGICHSDLHQVNNDWAGAFYPMVPGHEIIGRVKEVGHQVHRFKAGDLVGVGCMVDSCRQCTYCHQNEEQYCKSGATYTYNSQDNHLGGVTYGGYSKHVVVTEDFVLKIDESLDPAAAAPLLCAGITTYSPLKRAKVGKMSKVGIVGLGGLGHMAVKLARAMGAYVTVFTTSINKIKAGKDLGAHDVVLSTDSNVMQTLANQYDFILDTVSAKHDLGQYLNLLKVDGQLTQVGLPSDPLEVTMFPVILKRLSINGSLIGGIKETQEVLDFCARHGITADIELIKMHEVNSAYERLLKGDVKYRFVIDMSTLD

SEQ ID NO: 84762 - DNA, 1017 bp, Haloarcula marismortui ATCC 43049
  CDS (1)..(1017): transl_table=11
atgtctgatacaatgcaagcggcagtcgtacccgagccaggggatgacttcgaggtcgtcgaacgagacgtacccgagccggaccccggcgaggtacgggtctcggtcgacgcctgtggcatctgtcacagcgacgtgttcgccaaagaagggaccaacccggtcgtctcctatccgcgggttcccggccacgaggtggcgggccacgtagacgccgtcggcgacgctgtcgacgcctgggacgtgggcgacagagtcggcgtcggctggcacggcggccactgttcgacgtgtgaccagtgtcggcaggggaacttcctccagtgtgagaacggtgaaatcactgggctgagctacgacggcgggtacgcggagtacatgaccgcaccgtcggaggcgctcgcaaagattccggaatcacttgatgcggcggccgcggcaccgctcctctgtgcgggcgtgacgacgttcaacgcgctgcggaacagcgatgcgaacgtcggcgacctcgtcgccgtgcagggtgtcggcggcctcggtcacctcggtatccagtatgcacacgcggctggcttcgagacggccgcgatctcccgaacgcccgaaaaagaatcgctggcgaaagagcttggagccgaccacttcattaacgcggcggagacagacgccgggcagcgactgcaggagcttggtggggccgatgtggtgctggcgacggcaccgtcgagtgacgccatcagttccatcgtcagcggcatcggtgtcgacggctccgtcgtggttgtgggcgtccccggcgaaccggtagcggtgagcggacagcaactcgtccagacccggggcgctgtcgagggctgggcctccggacacgcacgcgactcacaggacacgcttgagttcagttcgcttcgcgacatcgcaccggaaatagagacctacccgctcgaagaggtgaatgaggcctacggccggatgatcgacaacgaagcacgattccgggccgtgcttgaactgtaa

SEQ ID NO: 84763 - protein, 338 aa, Haloarcula marismortui ATCC 43049
MSDTMQAAVVPEPGDDFEVVERDVPEPDPGEVRVSVDACGICHSDVFAKEGTNPVVSYPRVPGHEVAGHVDAVGDAVDAWDVGDRVGVGWHGGHCSTCDQCRQGNFLQCENGEITGLSYDGGYAEYMTAPSEALAKIPESLDAAAAAPLLCAGVTTFNALRNSDANVGDLVAVQGVGGLGHLGIQYAHAAGFETAAISRTPEKESLAKELGADHFINAAETDAGQRLQELGGADVVLATAPSSDAISSIVSGIGVDGSVVVVGVPGEPVAVSGQQLVQTRGAVEGWASGHARDSQDTLEFSSLRDIAPEIETYPLEEVNEAYGRMIDNEARFRAVLEL

SEQ ID NO: 84764 - DNA, 1269 bp, Acanthomoeba polyphaga mimivirus
  CDS (1)..(1269)
atgtctttagaggaaaaattaaacaagtattccaataaattaagtatgacaaacaatttaaataaaatagatgtttacaataaaaaaataaataaatacaaagaacgtcaaatttattcaaaccttaaaaaacctcaaccgatagatgaaagtgttatttccctgtattcacttaaaaatgaatatcaaaaaagtcccgataaaatgactgcattgggattcggtgttaccgatgttggtaaacctgttgaattgctagtatttgaccgtaaaaaaccaacaaataacgaagtgtcaattgaaatttattatactggtatttgtcatagcgattggcattttattgttggtgaatggaaagctgattttccattaattcccggacatgaacttattggtcgagttattgatattggaccaaatgttgataaatacagtattggagatattgtatgtgtatctcctgttatagattcatgtggtcattgtaaaatgtgcacacatcatattgaacaacattgtatgaatggagctactgaaatttataatcaaaaaacaagattgcctggtgatataaaaccttctggtcctattacatacggtggatattctaatattgtgataattaaacaacattttgtttataaatttcctaaaaatttggatattgaacgttgtgcaccattaatgtgtgctggtgcaacaacatattctcctcttagacaagccaaagttggtcccggaatgaaagttggaattgtcggaattggtggattaggtcacattgctgttaaaattgcgaaagcaatgggagctcatgttgtggctattaccagaacagaatggaaatttaaagattctgtcaataatttaggagccaatgaatctattttatcaactaatgtttggcaaatgaaccaacacaaaggtagttttgattttattttgagtactattccaatggctcatgatattgtaccttatattgaattactcaaatacaaagcaacaatatgtacagttggtgaattgttcccaactgtaattaatggtatggatttggctcaacatccatgttttcttcaatcttctcttattgctggctcagatgaaatcaaagaaatgttagcattttgttctgagcataatattatgcctgatgtacagattattaaagctgataaaattaatgacacaagacagaaattattagaaagtaaagctaaatatagatatgttattgatattagagcatctcttaataagtaa

SEQ ID NO: 84765 - protein, 422 aa, Acanthomoeba polyphaga mimivirus
MSLEEKLNKYSNKLSMTNNLNKIDVYNKKINKYKERQIYSNLKKPQPIDESVISLYSLKNEYQKSPDKMTALGFGVTDVGKPVELLVFDRKKPTNNEVSIEIYYTGICHSDWHFIVGEWKADFPLIPGHELIGRVIDIGPNVDKYSIGDIVCVSPVIDSCGHCKMCTHHIEQHCMNGATEIYNQKTRLPGDIKPSGPITYGGYSNIVIIKQHFVYKFPKNLDIERCAPLMCAGATTYSPLRQAKVGPGMKVGIVGIGGLGHIAVKIAKAMGAHVVAITRTEWKFKDSVNNLGANESILSTNVWQMNQHKGSFDFILSTIPMAHDIVPYIELLKYKATICTVGELFPTVINGMDLAQHPCFLQSSLIAGSDEIKEMLAFCSEHNIMPDVQIIKADKINDTRQKLLESKAKYRYVIDIRASLNK

SEQ ID NO: 84766 - DNA, 1011 bp, Geobacillus kaustophilus HTA426
  CDS (1)..(1011): transl_table=11
atgaaagccgccgttgttcacaaattcaagcaaaaacttcaaattgaagaagtggagaaaccaaaactaggatatggcgaagtgcttgtgaaaattgaagcttgtggcgtctgccataccgatttgcatgcggctcatggggattggccggtaaaaccgaaacttccacttattcctggtcatgaaggggtaggaattgttgttgagatcggtgagggagtgaaatcaatccaaattggcgaccgtgttggcattccatggttatactcagcatgcggtgaatgtgaatattgtttaagcggtcaagaaacactttgtccacatcaattaaacggtggatactctgtcgatggcagttatgcagaatattgcaaagccccggccaattatgtcgcacgaattcctaaaaacctcgatcccgtacaagttgctcctattctttgtgctggggtcacaacgtataaagcattaaaagtttcaaatgccaagcctggcgaatgggtcgctatttatggaatcgggggattgggccatattgctcttcaatatgccaaggcaatgggattaaatgttgttgctgttgatatcagtgatgaaaaggcagaacttgcggcaaagttgggtgctgatattacgatcaatggattgcaagaagaccctgtagcagccattcgtgaaaaagtaggcggagtacaagcggctattagcgttgctgtaacgaaaaaagcgttcgaacaagcttatcaatccgtgcgacgcggcggctgccttgtcatagttggactgcctcacgatgaactgccgattcctatttttgacactgtattaaatggcgttacgataaaaggttcgatcgtcggtacacgaaaagatatgcaagaagctctagatttcgccgcacgcggaaaagttcgccctattgtggaagcggtaccattagaaaaaattaacgaagtatttgaacggatggaaaaaggtcaaatcaatggccgcgttgttttaacaatgtaa

SEQ ID NO: 84767 - protein, 336 aa, Geobacillus kaustophilus HTA426
MKAAVVHKFKQKLQIEEVEKPKLGYGEVLVKIEACGVCHTDLHAAHGDWPVKPKLPLIPGHEGVGIVVEIGEGVKSIQIGDRVGIPWLYSACGECEYCLSGQETLCPHQLNGGYSVDGSYAEYCKAPANYVARIPKNLDPVQVAPILCAGVTTYKALKVSNAKPGEWVAIYGIGGLGHIALQYAKAMGLNVVAVDISDEKAELAAKLGADITINGLQEDPVAAIREKVGGVQAAISVAVTKKAFEQAYQSVRRGGCLVIVGLPHDELPIPIFDTVLNGVTIKGSIVGTRKDMQEALDFAARGKVRPIVEAVPLEKINEVFERMEKGQINGRVVLTM

SEQ ID NO: 84768 - DNA, 1050 bp, Idiomarina loihiensis L2TR
  CDS (1)..(1050): transl_table=11
atgaccaaagcctatgccgcacaatcggaaacttctgagttagcgcctcacccaatagaacgtcgtgagctgcgtagcgacgatgttgctattgatatcacttactgtggcgtatgccataccgatattcattatgcagaaaacgactggggtggaaccatttatccggtcgtgccggggcacgagattatcggaaaagtcacggctgtcggtgacaacgtgaaggggtttaaagtaggagactcggttggggttggttgcatggttgactcttgtcgcgaatgctcttcatgtgagcaggggctggagcagtactgtctgaatggaatggttccaacatacaacggtgaagacttgcacgataaaagtgtgacttacggcggctactcagaaaagatagtggtcagtgatcgttttgtggtgcgggtgccggaaaaactcgatccggcaaaagcggcgccgttattgtgtgcgggcattaccacttactctccgctgcgtcactttggtgtaaaagaagggcataaagtgggcgttattggcatgggtggcctgggtcacatgggcgtcaagttcgccaaagccatgggtgccgaagtcactatcttcacccgttcggaaagcaaagttgctgaagcaaaacggcagggcgcagacaatgtcatcatctcaaccgacgatgagcaaatggaagcggccgctgagacttttgatttcttgttggataccgtaccggtgcaacatgatttaaacccttatattaactgtcttaaagttgatggcactcatattctggtcggtttactggaacctgtagacccagcgttgcaagcaggagctctggtcatgaaacgccgggtgttggcagggtctttaattggcggtattcctgaaactcaggaaatgctggatttttgtgcggagcacaacattcactgtgacgtggaaatgcttgatatccagaatattaatgaagcctttgtgcggatgaaaaaaggtgatgttaaataccgtttcgttattgatatggacacgttaaaacagtcttaa

SEQ ID NO: 84769 - protein, 349 aa, Idiomarina loihiensis L2TR
MTKAYAAQSETSELAPHPIERRELRSDDVAIDITYCGVCHTDIHYAENDWGGTIYPVVPGHEIIGKVTAVGDNVKGFKVGDSVGVGCMVDSCRECSSCEQGLEQYCLNGMVPTYNGEDLHDKSVTYGGYSEKIVVSDRFVVRVPEKLDPAKAAPLLCAGITTYSPLRHFGVKEGHKVGVIGMGGLGHMGVKFAKAMGAEVTIFTRSESKVAEAKRQGADNVIISTDDEQMEAAAETFDFLLDTVPVQHDLNPYINCLKVDGTHILVGLLEPVDPALQAGALVMKRRVLAGSLIGGIPETQEMLDFCAEHNIHCDVEMLDIQNINEAFVRMKKGDVKYRFVIDMDTLKQS

SEQ ID NO: 84770 - DNA, 1050 bp, Bacillus clausii KSM-K16
  CDS (1)..(1050): transl_table=11
atgagtaaaacaagcgaacgaagaatgatgaaagcggcggtcgttaatcagttcaatcaacaattagagattaaggaagttccggtacctaccgtggagtatggagaggtgcttgtcaaaattaaggcttgcggtgtttgtcatacagacttgcatgccgctcatggagattggccagtaaagccaaagcttcctcttattcctggtcatgagggagtaggtattgtagaggaaataggagaaggggtcacttcgataaaggtaggagatcgggtcggcattccgtggctttactctgcatgtggagagtgtgagtattgtttaacaggccgtgagacgttatgccctgaccaattaaatgcaggttattcagtggatgggggatatgcagagtattgtaaggcgcctgccaattatatagtgaaaatacctgagaatcttgattttgctgaagtgtcccctattttttgcgcaggggtgacgacttacaaagcattaaaagtagccgatgccaaagccggtgactgggttgccatttatggaatcggtggattgggtcacgttgctttgcagtacgcaaaagcaatgggctataacgtcgtcgctgtcgatattatggaggacaaacttgaattagcaaaacgtcttggagctgatttaacagtcaatggacttcaggtagaccctgttcaagaaataaaagaaaaagtgggcggagttcaagcagctattagcgtggcagtcacaaaaaaagcatttgagcaagcttacggatctgtcaaaagaggagggacattagtcgttgtgggccttccaaacgatgaattgcccattccgattttcgatacggtgctaaacggtgtaaccgtgaaaggctcaatcgtagggacgcgcaaagacttgcaagaatcgattgaatttgcagcacaagggaaagtgcgaaccaacatcgaaacacagccgctcgataaaattaacgaagtgtttgaaagaatggagaatggaaaaattaacggtcgtgttgtgttaacaattgatgaaaccgcttaa

SEQ ID NO: 84771 - protein, 349 aa, Bacillus clausii KSM-K16
MSKTSERRMMKAAVVNQFNQQLEIKEVPVPTVEYGEVLVKIKACGVCHTDLHAAHGDWPVKPKLPLIPGHEGVGIVEEIGEGVTSIKVGDRVGIPWLYSACGECEYCLTGRETLCPDQLNAGYSVDGGYAEYCKAPANYIVKIPENLDFAEVSPIFCAGVTTYKALKVADAKAGDWVAIYGIGGLGHVALQYAKAMGYNVVAVDIMEDKLELAKRLGADLTVNGLQVDPVQEIKEKVGGVQAAISVAVTKKAFEQAYGSVKRGGTLVVVGLPNDELPIPIFDTVLNGVTVKGSIVGTRKDLQESIEFAAQGKVRTNIETQPLDKINEVFERMENGKINGRVVLTIDETA

SEQ ID NO: 84772 - DNA, 1032 bp, Gluconobacter oxydans 621H
  CDS (1)..(1032): transl_table=11
atggctgatacaatgctcgccgccgtcgtccgtgaattcggcaagccgctctccatcgagcggctacccatcccggacatcaagccccaccagatcctcgtgaaggtcgatacctgtggcgtctgccacactgacctgcacgccgcgcgcggggactggccgtccaagcccaacccgccgttcattcccgggcatgaaggcgtcggacacatcgtcgccgtcggcagtcaggtcggcgatttcgtcaagaccggcgatgtcgtgggcgtgccctggctctactccgcctgcggtcactgcgaacactgtctgggcggctgggaaacactctgcgaaaagcaggacgacaccggctacaccgtcaatggctgcttcgccgaatatgtcgtggcagacccgaactacgtcgcacacctgccctcgaccatcgacccgcttcaggcctcgccggtcctgtgcgcggggctgacggtctataagggcctgaaaatgacggaggcccgccccggccagtgggtcgcagtctcgggcgtcggcggtctcggccagatggccgtgcagtacgccgtcgccatgggcatgaatgtcgtcgcggtggacatcgatgacgaaaaactcgccacagccaaaaagctcggcgcatccctgaccgtcaacgccaaggacacggacccggccaggttcatccagcagcagatcggcggcgcacatggcgctctcgtcaccgctgtcggacggacggcgttttcgcaggccatgggctatgcccgccgcggcggcaccatcgtcctgaacggactgccgcccggcgatttcccggtctcgatcttcgacatggtcatgaacggcaccaccatccgtggctccatcgtcggaacacggctggacatgatcgaggccatggatttcttcgcccgcggcaaggtcaaatccgtcgtcacccccggaaaacttgaaaacatcaatacgatcttcgacgatctgcagaatggtcgcctcgaaggccggacagtgctcgacttccggtcctga

SEQ ID NO: 84773 - protein, 343 aa, Gluconobacter oxydans 621H
MADTMLAAVVREFGKPLSIERLPIPDIKPHQILVKVDTCGVCHTDLHAARGDWPSKPNPPFIPGHEGVGHIVAVGSQVGDFVKTGDVVGVPWLYSACGHCEHCLGGWETLCEKQDDTGYTVNGCFAEYVVADPNYVAHLPSTIDPLQASPVLCAGLTVYKGLKMTEARPGQWVAVSGVGGLGQMAVQYAVAMGMNVVAVDIDDEKLATAKKLGASLTVNAKDTDPARFIQQQIGGAHGALVTAVGRTAFSQAMGYARRGGTIVLNGLPPGDFPVSIFDMVMNGTTIRGSIVGTRLDMIEAMDFFARGKVKSVVTPGKLENINTIFDDLQNGRLEGRTVLDFRS

SEQ ID NO: 84774 - DNA, 1014 bp, Xanthomonas oryzae pv. oryzae KACC10331
  CDS (1)..(1014): transl_table=11
ttgccccgttcgtgttcgaacgccgcgtgcccggccccaacgacgtacagatcgacatcgcctactgcggcgtgtgtcactcggacagtgcatatcgcacgcaacgaatggcacaacacactgtacccgtcggtacccggccacgagatcgttggccgcgtcacggcggtgggcaatgcggtcaccggcttcaaggtgggcgacctggccggcgtcggttgcatggtcgacagctgccgcagctgcgcctcctgccaggaaggagaagaacagtattgcgaagccggcttcaccggcacctataacgggccgatgttcggcggcggcgagaatacctacggcggttattccgaccatatcgtggtcgatcagaaatacgtgctgcgcatcactcacagcgacaacctggcggcggtggcaccgctgctgtgcgccggcatcaccacctattcgccgctggcgcactggaaggtgggtccgggccagaaggtgggggtggtcggcctcggcggcctgggccacatggcggtgaaaattgccaaggcgatgggcgccaccgtggtgctgttcaccacctccgagagcaagcgcgccgatgcgctgcgcctgggcgccagcgaagtggtcatttccaaggacgaagcgcagatggccgcgcagtacaacaccctggacttcatcctcaacaccgtggccgcaccgcacaacctggacccgttcctcaacgcgctcaagcgtgacggcgcgatggtgctggtcggtgtgcccgagcagtctcacccgtcgccggcggtgttcaacctggtgatgaagcgccgcaccctggccggctcgctgatcggcggcatccgccagacccaggaaatgctggatttctgcgccaagcacaacatcgtctcggacatcgaaaccatccgcgccgaccagatcaacgccgcctacgagcgcatgctcaagagcgacgtgaagtaccgcttcgtgattgacatggcgaccttggataaggcggcctga

SEQ ID NO: 84775 - protein, 337 aa, Xanthomonas oryzae pv. oryzae KACC10331
MPRSCSNAACPAPTTYRSTSPTAACVTRTVHIARNEWHNTLYPSVPGHEIVGRVTAVGNAVTGFKVGDLAGVGCMVDSCRSCASCQEGEEQYCEAGFTGTYNGPMFGGGENTYGGYSDHIVVDQKYVLRITHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAMVLVGVPEQSHPSPAVFNLVMKRRTLAGSLIGGIRQTQEMLDFCAKHNIVSDIETIRADQINAAYERMLKSDVKYRFVIDMATLDKAA

SEQ ID NO: 84776 - DNA, 1047 bp, Neisseria gonorrhoeae FA 1090
  CDS (1)..(1047): transl_table=11
atgaaaatgcaggcagttgttgtgaataaaaatgtagcgggcgatgtggaagtagtcgaacgcgaggttcgcccgttggaatacggcgaggcattggtcgaagtcgaatattgcggcgtgtgccataccgacctgcacgttgcggcaggcgactacggcgaaaaaccgggccgcgtgctgggacacgagggcatcggtttggttaaagaagttgccgacggtgtgaaaaatctgaaagtcggcgaccgcgtcagcatcgcctggctgttccaaagctgcggctcttgcgaatactgcaataccggccgcgaaaccctgtgccgttccgtattgaacgcgggctacaccgccgacggcggtatggcgacccactgcatcgtgagtgccgattacgcggtcaaagtccctgaaggtttggatcctgcgcaagcttccagcattacttgtgccggcgtgaccacttataaagccattaaagtttccggcgttcgtcctggtcaatggattgcgatttacggcgcgggcggcttgggcaacttgggtgtccaatacgcgaaaaaagtattcggcacgcacgttgtcgccatcgacatcaacgacgacaagctggcatttgccaaagaaaccggcgcggatttggttgtcaacgccgccaaagaggacgctgccaaagtgattcaggaaaaaaccggcggcgcacacgctgcggtcgtaaccgccgtatctgctgccgcattcaactctgccgtgaattgcgtccgcgcgggcggacgtgtggttgccgtcgggctgccgccggaatcgatggatttgtccatcccgcgtttggttttggacggcatcgaagtggtcggctctttggtcggcacgcgcaaagatttggaagaagccttccaattcggcgcggaaggtttggttgtgccgaaagtccaactgcgtgctttggatgaagcacccgccattttccaagaaatgcgcgaaggcaaaatcaccggccgtatggtgatcgatatgaaaaaagaatgcggctgcgatcatcaccactga

SEQ ID NO: 84777 - protein, 348 aa, Neisseria gonorrhoeae FA 1090
MKMQAVVVNKNVAGDVEVVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGTHVVAIDINDDKLAFAKETGADLVVNAAKEDAAKVIQEKTGGAHAAVVTAVSAAAFNSAVNCVRAGGRVVAVGLPPESMDLSIPRLVLDGIEVVGSLVGTRKDLEEAFQFGAEGLVVPKVQLRALDEAPAIFQEMREGKITGRMVIDMKKECGCDHHH

SEQ ID NO: 84778 - DNA, 1050 bp, Xylella fastidiosa Ann-1
  CDS (1)..(1050)
atgggcttcgctgctctatcggctactggcccgcttgaacggttcgctttcggacggagagctcccagaccggatgacgtcgtcattgatatcctttactgcggtgtctgccacactgatctgcatcttgcccgtaaccacagcggctttactacttatccaatcgtgcccggccacgagatcatcggttgtgtacgcgagatcggcaagacagtcacccgctttaagcggggcgatctggttggtgttggttgcatggtcgattcttgccagcactgccagccttgtctcaaagggtgggaacaggactgcattgaaggttcgatcttcacctataacagtactgatcggcgggatggcagtatcacctatggtggctattcagatgtcattgtcgtgcgtgataagttcgtgctgtcgttgcctgatggtctcgatccagccggagccgcgccgctgctttgtgcgggcatcacgacatggtcgccgttgcgtcgctggaatgtcggcaaagacagcaaggttgcggtggtcggtcttggcggcctcggacacatggccttgaagctggctaaggctcttggagccgatgtgacgttgttcacgcgttcttccggcaaagagggagatgccttccgtcttggagccgatcgtgttgtgttgtccagcgatctggagcagatgaaagctgtctacagccgctttgacgttatcatcgataccgttccttatgatcacgacgtcaatccctatatgcccacccttgtacttgaaggtgtgctcgtactcgtcggctatttgggaccgctcagtatgcctgtgaacgctggaggtgtggtacgtggccgtagggccatttcgggttcgttcattggcggtgcgcatgaaacccagcaaatgctcgatttctgtgggcagcacggcattgtctcggatgtcgagatcattcccatccagaaaattaacgaggcctatgagcgtatgttgaaaagtgacgttaagtatcgtttcgtcattgacatgacttcgctgacatcatcaggagcttga

SEQ ID NO: 84779 - protein, 349 aa, Xylella fastidiosa Ann-1
MGFAALSATGPLERFAFGRRAPRPDDVVIDILYCGVCHTDLHLARNHSGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYLGPLSMPVNAGGVVRGRRAISGSFIGGAHETQQMLDFCGQHGIVSDVEIIPIQKINEAYERMLKSDVKYRFVIDMTSLTSSGA

SEQ ID NO: 84780 - DNA, 1029 bp, Azotobacter vinelandii
  CDS (1)..(1029)
atggcccagacgatgaaagcggccgttgtcgtcgaattcggcaaaccgctggaaattcgcgaagtgccggtgcccacgcccggccccggacaactgctggtgaagatcgccgcctgcggcgtctgccacaccgacctgcacgccgccgaaggcgactggccggtcaagcccgaaccgccgttcattcccggccacgagggcgtgggccaggtggtcgccgtgggcgccggtgtcggccacgtcaaggaaggcgaccgggtcggcataccctggctgcactccagttgcggtcactgcgagcactgcctgggcggctgggaaaccctctgcctggcgcagagcaataccggctactcggtgaacggcggcttcgccgaatacgccctggccgatgccgagtacgtcggccacttgccggacaacgccgacttcatcgagatcgcgcccatcctctgcgccggggtgaccgtctacaagggcttgaagatgaccgacacccggcccggccagtgggtggcgatctccgggatcggcggtctcggccatatggccgtgcagtacgccagggccatgggcctgaacgtcgccgccgtggacgtcgacgacgccaagctggaactcgcccggcggctcggcgccagcctcacggtcaatgcccgcgaccaggacccgacggccttcctgcacaaggaaatcggcggcatgcacggcgtgctggtcaccgccgtctcgccgaaggccttcgagcaggccctgggcatggcccgccgcggaggcaccgtcgccctcaacggcctgccgcccggcgagttcagcctgtcgatcttcgacatggtgctcaacggcaccacggtgcgtggctccatcgtcggcacccgcctggacctgcaggaagcgctggacttcgccggtcagggcaaggtccgcgccacggtcgccagcgaaccgctggagaacatcaacgacatcttcgcccgcatgcacaaggggcagatcgaagggcgcatagtcctcgacctcgccgcctga

SEQ ID NO: 84781 - protein, 342 aa, Azotobacter vinelandii
MAQTMKAAVVVEFGKPLEIREVPVPTPGPGQLLVKIAACGVCHTDLHAAEGDWPVKPEPPFIPGHEGVGQVVAVGAGVGHVKEGDRVGIPWLHSSCGHCEHCLGGWETLCLAQSNTGYSVNGGFAEYALADAEYVGHLPDNADFIEIAPILCAGVTVYKGLKMTDTRPGQWVAISGIGGLGHMAVQYARAMGLNVAAVDVDDAKLELARRLGASLTVNARDQDPTAFLHKEIGGMHGVLVTAVSPKAFEQALGMARRGGTVALNGLPPGEFSLSIFDMVLNGTTVRGSIVGTRLDLQEALDFAGQGKVRATVASEPLENINDIFARMHKGQIEGRIVLDLAA

SEQ ID NO: 84782 - DNA, 1050 bp, Azotobacter vinelandii
  CDS (1)..(1050)
atggttgtaaaagcatacggagcctatgccggcgacaagcccctcgaaccgctggagatcacccgccgccccccggggccgcatgatgtccagatcgacatcacctattgcggtatctgccattccgacctgcatcaggtgcgcgccgagtgggccggcacccggttcccctgcgttccgggccatgagatcgtcggccgcgtgtcggccgtcggtgcgcatgtgtcggacttccgtgcgggcgacctggtgggcatcggctgcatcgtcgacagttgcaggcactgcgaagaatgcgacgccggcctggaaaactactgcgatggcatggtcggcacctacaacttcccgacgccggacgagccgggctggacgctgggcggctactcgcagcggatcgtcgtgcacgaaggttacgtgctgcgcatccggcaccccgaagatcagctcgccgccgtggcgccgctgctgtgtgcgggcatcacgacctactcgccgctgcgtcactggcaggccggcccgggcaagaaggtcggcatcgtcggcatcggcggcctgggccacatgggcatcaagctcgcccatgcgatgggcgcgcacgtggtggcgttcaccacctccgcgtccaaacgcgaggacgccaaggcactcggcgccgacgaggtcgtggtatcgcgcaatcccggggaaatggcggcccatgcgaagagcttcgacctgatcctgaataccgttgccgcgccgcacgacctcgatgccttcctgagcctgttgaagcgggacggcaccctgacgctggtgggcgcgccggcctcgccccacccttcccccgacgtgttcaacctgatcttcaagcgccgctcgatcgccggctcgatgatcggcggcatcccggaaactcaggaaatgctcgacttctgcgccgagcacggcatcgtcgcggacatcgagctgatcagggccgagcagatcaacgaggcctacgaacggatgctcaggggcgacatcaagtaccgcttcgtgatcgactccgccaccctggcgggttga

SEQ ID NO: 84783 - protein, 349 aa, Azotobacter vinelandii
MVVKAYGAYAGDKPLEPLEITRRPPGPHDVQIDITYCGICHSDLHQVRAEWAGTRFPCVPGHEIVGRVSAVGAHVSDFRAGDLVGIGCIVDSCRHCEECDAGLENYCDGMVGTYNFPTPDEPGWTLGGYSQRIVVHEGYVLRIRHPEDQLAAVAPLLCAGITTYSPLRHWQAGPGKKVGIVGIGGLGHMGIKLAHAMGAHVVAFTTSASKREDAKALGADEVVVSRNPGEMAAHAKSFDLILNTVAAPHDLDAFLSLLKRDGTLTLVGAPASPHPSPDVFNLIFKRRSIAGSMIGGIPETQEMLDFCAEHGIVADIELIRAEQINEAYERMLRGDIKYRFVIDSATLAG

SEQ ID NO: 84784 - DNA, 1014 bp, Azotobacter vinelandii
  CDS (1)..(1014)
ttggctccctacacgttcgagcggcgcgaactgcgtcccgacgatgttgccctggagattctctactgcggcgtgtgccactccgacctgcacaccgcccgcaacgactggggcatgagctactacccgatcgtgccgggccacgagatcgtcggccgggtgatcgagaccggcacgcaggtgaccggcttcaaggccggcgactatgtggcggtcggctgcatggtcgatagctgccgtgaatgcgaccagtgccgcaagggcgacgagcagctctgccgccaaggccccatctacacctacagcggccacgaccgcatcagcggcgagccgacccagggcggctacgccaagcacctggtggtgagcgaggcgttctgcctgcacatgcccgaggggctggatctggccaaggccgcgccgctgctgtgcgccgggattaccacctactcgccgctgcgcacctggaatgtcggctccggcagccgggtcggcgtgatcggcctgggtggcctgggccacatggcggtgaagctggccgtgggcctgggcgccgaagtgaccgtgctcagccgcagcgccgacaagcgggccgatgcgttggcgctgggcgccgcccgcctgctggtgtctgcggacgaaggcgcaatggccgaggccgcgggcagcttcgatctgatcatcgacacggtgcccgccaagcatgacctcgatccctatctgccgctgctggacgtggatggcaccctggtcatcgtcggccagctcggcccgatgagcgatttcagcaccgtcccgttgctgtccggccgccgccgcgtcgccggctcaccgatcggcggcatccgcgagacgcaggaactgctcgacttctgcgcgaagaagaacatcctgccggactgcgaaatgatccgcatggaccagatcaacgaggccttcgagcgtatggagaaggccgacgtgcgctaccgcttcgtgatcgacatggcctcactgtccgccgcagcggcttga

SEQ ID NO: 84785 - protein, 337 aa, Azotobacter vinelandii
MAPYTFERRELRPDDVALEILYCGVCHSDLHTARNDWGMSYYPIVPGHEIVGRVIETGTQVTGFKAGDYVAVGCMVDSCRECDQCRKGDEQLCRQGPIYTYSGHDRISGEPTQGGYAKHLVVSEAFCLHMPEGLDLAKAAPLLCAGITTYSPLRTWNVGSGSRVGVIGLGGLGHMAVKLAVGLGAEVTVLSRSADKRADALALGAARLLVSADEGAMAEAAGSFDLIIDTVPAKHDLDPYLPLLDVDGTLVIVGQLGPMSDFSTVPLLSGRRRVAGSPIGGIRETQELLDFCAKKNILPDCEMIRMDQINEAFERMEKADVRYRFVIDMASLSAAAA

SEQ ID NO: 84786 - DNA, 1050 bp, Actinobacillus pleuropneumoniae serovar 1 str. 4074
  CDS (1)..(1050)
atgatgaaaatgcgtgctgctgtggttgccccacaatgtgatggaacagttgaaattgttgaacgtgacattcctgaaatcaaaaatggcgaagcccttgtagaagttgaatattgcggtgtatgtcataccgatttacacgtcgctgccggtgattacggtaaaaaaccggggcgtatattaggtcatgaagggatcggtatcgttaaatcgatcgcaccggatgtgactaatttaaaagtcggtgatcgtgtcagtattgcatggatgttcgagagctgcggctcgtgcgaatattgcactaccggacgtgaaacgctttgccgtagcgtgaaaaatgccggctatacggtggacggcggtatggcgacgcactgtgtcgtaacggcagattatgcggtaaaagtaccggacggtttggatccggcacaagcaagtagtatcacttgcgccggtgtaaccacttataaagggattaaagtctcgggcgtacgtgcgggacaatggattgcgatttacggtgccggcggtttaggcaacttggcggtgcaatatgcgaagaaagtattcggcgcacgtgtgattgcaatcgatattaatgatgacaaactggcgtttgccaaagaagtcggtgcggatttaaccattaacccgttgaaagaagacagcgtacaagtgattcaagaaaaagtcggcggtgcgcatgcggcggttgtgacggcggtatctaaagtggcgtttaacgctgcggtgaactgcgttcgagcaggcggtcgcgtggtggctatcggtctgccgccggaaaccatggatctctctatccctcgtatcgtattggacggtatcgaaattgtcggctcgttggtcggtactcgtcaagatcttgccgaggcgttccaattcggtgcggaaggtttagtagtaccgttagtgcaattacgtcgcttggacgaagcgaatgacattttccaagaaatgcgtgacggtaaaattcaaggtcgaatggtgatcgatatgaaaaaaggctgcggttgcggttgtagtcactaa

SEQ ID NO: 84787 - protein, 349 aa, Actinobacillus pleuropneumoniae serovar 1 str. 4074
MMKMRAAVVAPQCDGTVEIVERDIPEIKNGEALVEVEYCGVCHTDLHVAAGDYGKKPGRILGHEGIGIVKSIAPDVTNLKVGDRVSIAWMFESCGSCEYCTTGRETLCRSVKNAGYTVDGGMATHCVVTADYAVKVPDGLDPAQASSITCAGVTTYKGIKVSGVRAGQWIAIYGAGGLGNLAVQYAKKVFGARVIAIDINDDKLAFAKEVGADLTINPLKEDSVQVIQEKVGGAHAAVVTAVSKVAFNAAVNCVRAGGRVVAIGLPPETMDLSIPRIVLDGIEIVGSLVGTRQDLAEAFQFGAEGLVVPLVQLRRLDEANDIFQEMRDGKIQGRMVIDMKKGCGCGCSH

SEQ ID NO: 84788 - DNA, 1062 bp, Pseudomonas aeruginosa UCBPP-PA14
  CDS (1)..(1062)
atgaccctacagatccgcggctacgccgcccagtccgccagcgccccgctggccgcccatcgcttcgaacgccgcgcgccgcgcgccgacgacctggtgatcgacatcctctactgcggcgtctgccactcggacctccatcaggcgcgcaacgaatggcacaacagcctgtacccgctggtgccgggccacgagatcatcggccgggtcgccagcgtcggcgaggcggtgagcggtttcgcggtcggcgaactggtcggcgtcggctgcatggtcgactcctgccggcactgcgccgcctgctccgagggcctggagcagtattgcgcggaatacccgaccctgacctacaacggccgcgaccgccacgacggcctgccgaccttcggcggctactcggagcgcatcgtggtctcggccaggttcgtcctgcgcattccccagggactcgatccgaaggcggcggcgccgctgctgtgcgccgggatcacgtcctactcgccactgcgtcactggaagatcggccccggtagccgggtggcggtggtcggcctgggcggcctcggtcacatgggcctgaagttcgccagggcgctcggtgccgaggtggccctgttcacccgctcgccgggcaaggaagaggaagcgcggcggctcggcgccgaccaggtgatcctttccaccgacccacagcggatggccgccgtcgccggacgcttcgacctgatcctggacaccgtgccgcaccagcacgacctcaatccctacctggcgaccctcaagcgcgacggcaccctcgtgctggtcggcctgctcgagccgctggagccggcggtgcacggtgcgcaactggtgatggggcgccgctcgatcgccggctcggccatcggcggcatcgccgagacccaggaaatgctggatttctgcgcgacccacgggatcgcctgcgacatcgagatgatcgagatccagcagatcaaccaggcctacgagcggatgctggccagcgacgtgaagtatcgcttcgtgatcgacatggcctccctgccgaagtccttctga

SEQ ID NO: 84789 - protein, 353 aa, Pseudomonas aeruginosa UCBPP-PA14
MTLQIRGYAAQSASAPLAAHRFERRAPRADDLVIDILYCGVCHSDLHQARNEWHNSLYPLVPGHEIIGRVASVGEAVSGFAVGELVGVGCMVDSCRHCAACSEGLEQYCAEYPTLTYNGRDRHDGLPTFGGYSERIVVSARFVLRIPQGLDPKAAAPLLCAGITSYSPLRHWKIGPGSRVAVVGLGGLGHMGLKFARALGAEVALFTRSPGKEEEARRLGADQVILSTDPQRMAAVAGRFDLILDTVPHQHDLNPYLATLKRDGTLVLVGLLEPLEPAVHGAQLVMGRRSIAGSAIGGIAETQEMLDFCATHGIACDIEMIEIQQINQAYERMLASDVKYRFVIDMASLPKSF

SEQ ID NO: 84790 - DNA, 1035 bp, Pseudomonas aeruginosa UCBPP-PA14
  CDS (1)..(1035)
atgaccatgaccctgccacagaccatgaaagccgcggtcgtgcacgcctacggcgcgccgctgcggatcgaggaagtcaaggttccgctgcccggccccgggcaggtactggtgaagatcgaagcctccggcgtctgccacaccgacctgcacgccgccgagggcgactggccggtgaagccgccgttgccgttcattcccggtcacgaaggcgtcggctacgtcgccgcggtgggcagcggagtgacccgggtgaaggaaggcgaccgggtcggcatcccctggctgtacaccgcctgcggctgctgcgagcactgcctgaccggctgggagaccctctgcgagagccagcagaacaccggctactcggtgaacggcggctatgccgaatacgtattggccgacccgaactacgtcggaattctgccgaaaaacgtcgaattcgctgaaatcgcgccgatcctctgcgccggcgtcaccgtctacaaggggctcaagcagaccaacgcgcgccccggccagtgggtggcgatctccggcatcggcggcctcggccacgtcgccgtgcagtacgccagggccatgggcctgcacgtcgccgccatcgacatcgacgacgccaagctggaactggcgcgcaagctcggtgccagcctgacggtcaacgcccggcaggaagacccggtggaggcgctccagcgcgacatcggcggcgcccacggggtgctggtcacagcggtatccaacagcgccttcggccaggccatcggcatggcccgccgcggcggcaccattgccctggtcggcctgccgccgggtgacttcccgacgccgatcttcgacgtggtgctcaagggcctgcacatcgccggctccatcgtcggcacccgcgcggacctgcaggaagccctcgacttcgccggcgaaggcctggtcaaggcgaccatccatccgggcaagctggacgacatcaaccagatcctcgaccagatgcgcgccgggcagatcgaggggcgcatcgtccttgagatgtga

SEQ ID NO: 84791 - protein, 344 aa, Pseudomonas aeruginosa UCBPP-PA14
MTMTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEALQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 84792 - DNA, 1020 bp, Ralstonia eutropha JMP134
  CDS (1)..(1020)
atgatgaaagctgcggtggtgcgtgcattcggcgcgccgctcacgatcgatgaagtgcccgtgccgcaacccgggcccggccaggtccaggtgaagattgaagcctccggtgtctgccataccgacctgcacgccgccgacggcgactggccggtcaaacccacgctgccgtttatccccggccatgaaggcgtcggctatgtatcggccgtcggcagcggcgtcagccgcgtgaaggaaggtgaccgcgtcggcgttccgtggctgtacagcgcctgtggctattgcgagcactgcctgcaaggctgggaaacgctgtgcgaaaagcagcagaacaccggctattcggtcaacggcggctacggcgagtatgtggtggccgacccgaactacgttggcctgctgcccgacaaggtgggcttcgtcgaaatcgcgccgatcctgtgcgcgggcgtcacggtgtacaagggcctgaaggtcacggatacgcgccccggccagtgggtggtgatctccggcatcggcggcctgggccatgtggccgtgcagtacgccagggcgatgggcctgcgcgtggcggctgtcgacatcgacgatgccaagctcaacctcgccagacggctcggcgcggaagtggccgtcaacgcgcgcgatacggatccggccgcatggctgcagaaggaaatcggcggcgcgcatggcgtgctggtcaccgccgtgtcgcccaaggccttttcgcaggcgatcggcatggtgcggcgtggtggaaccattgccctgaacggtctcccgccgggcgatttcggcacgccgatcttcgacgtggtgctcaagggcatcaccatccgaggctcgatcgtcggcacgcgcagcgacttgcaagagtcgcttgattttgccgcgcatggcgacgtgaaagccacggtctcgacagcgaagctggacgacgtcaacgatgtgttcggacggctgcgcgaaggcaaggtggaaggccgcgtggtgctggacttctcgcggtga

SEQ ID NO: 84793 - protein, 339 aa, Ralstonia eutropha JMP134
MMKAAVVRAFGAPLTIDEVPVPQPGPGQVQVKIEASGVCHTDLHAADGDWPVKPTLPFIPGHEGVGYVSAVGSGVSRVKEGDRVGVPWLYSACGYCEHCLQGWETLCEKQQNTGYSVNGGYGEYVVADPNYVGLLPDKVGFVEIAPILCAGVTVYKGLKVTDTRPGQWVVISGIGGLGHVAVQYARAMGLRVAAVDIDDAKLNLARRLGAEVAVNARDTDPAAWLQKEIGGAHGVLVTAVSPKAFSQAIGMVRRGGTIALNGLPPGDFGTPIFDVVLKGITIRGSIVGTRSDLQESLDFAAHGDVKATVSTAKLDDVNDVFGRLREGKVEGRVVLDFSR

SEQ ID NO: 84794 - DNA, 1059 bp, Methylobacillus flagellatus KT
  CDS (1)..(1059)
atgaccaaagccattagttatgcagcacatgatcccaaatctcctttggccccattttctttcgagcggcgtcaggttggagcgaatgatgtccagatcgaaatcctattttgtggcgtttgccactccgacctgcaccaggcgcgtaacgaatggggaaactccattttcccagtcgtgcctggccacgaaatcgtagggcgcgtgacccaggtcggcagcaatgtcaaaaaattcaaggtaggcgacttggcaggcgtaggctgcatggtggactcatgcaacgcctgccccgactgtgcggaaggcctggagcagtactgcaaccacgctgtatttacgtataacagcccggacaagcacatgcccggccaggtcacttacggaggctactccaacctgattgtggtggacgaacgtttcacattgaagatttcagacaagctcgatctagcggcgacagcgccactgctctgcgccggcattacgacgtattcccctctgcgtcattggaatgtcggcccgggacaaaaggtcggcatcgtgggcctgggcggtcttggacacatgggcgtcaaattcgccaaagcactcggggcgcacacggtgttgttcaccacctctcccagcaaggtagaagacgcaaaacgcctgggtgccgatgaagtcatcatctccaaggatcctgagcaaatgcagcagcacctgcaaagtttcgatttcatcctcaacacagtcgccgcaccgcacgaccttgaccagttcatggccctgctcaagcgcgatggctccatgtgcctggtaggcgtgcccgacagcccgcacccttcccccagcgtcgccaacctgatattcaagcgccgcaagctggccggatccttgatcggcggcatcaaggaaacccaggaaatgctggatttctgcgccgaacacaatatcacttccgacatcgagctgatcccgatccaggaaatcaacaatgcattcgagcgcatgctgaagagcgacgtgaaataccgcttcgtgattgatatcgccagcctcaggcaagcggcttaa

SEQ ID NO: 84795 - protein, 352 aa, Methylobacillus flagellatus KT
MTKAISYAAHDPKSPLAPFSFERRQVGANDVQIEILFCGVCHSDLHQARNEWGNSIFPVVPGHEIVGRVTQVGSNVKKFKVGDLAGVGCMVDSCNACPDCAEGLEQYCNHAVFTYNSPDKHMPGQVTYGGYSNLIVVDERFTLKISDKLDLAATAPLLCAGITTYSPLRHWNVGPGQKVGIVGLGGLGHMGVKFAKALGAHTVLFTTSPSKVEDAKRLGADEVIISKDPEQMQQHLQSFDFILNTVAAPHDLDQFMALLKRDGSMCLVGVPDSPHPSPSVANLIFKRRKLAGSLIGGIKETQEMLDFCAEHNITSDIELIPIQEINNAFERMLKSDVKYRFVIDIASLRQAA

SEQ ID NO: 84796 - DNA, 1053 bp, Burkholderia cepacia R18194
  CDS (1)..(1053)
atgagcactacctatgcctacgcggcgaccgattcgcagtcgccgctcgccccgttcgaattccagcgtcgcgcgctgcgcgacctcgacgtccagatcgacgtcctctactgcggcgtctgccactcggacctgcaccaggcccgcaacgaatggcgcaacacgatctatccggtcgtgccgggccatgaaatcgtcggccgcgtgaccgcgaccggcccgcaggtttcgcgcttcaaggtcggcgagctggtcggcgtcggctgcctcgtcgattcgtgccgcacctgcccgagctgcgccgacggcctcgagcaatattgcgagaacggcttcgtcggcacctacaacggccaggatcgcgtgacgggcgacatcacgttcggcggctattcgacgcagctcgtcgtcgacgaggcgttcgtgctgcgcgtgcccgacacgctcgacccggccggcgccgcaccgctgctgtgcgcggggatcacgacctactcgccgctgcggcagtggaacgtcggccccggcaagaaggtcggcatcgtcgggctcggcggcctcggtcacatgggcgtgaagctggcgcgcgcgatgggtgcgcacgtcgtgctgttcaccacgtcgccgtcgaagatcgaggacggcaagcgggtcggcgcgcacgaagtcgtgatctcgaaggacgaagcgcagatgaacgcgcacctgaacagcttcgacttcatcctgaacacggtcgccgcgcagcacgacctgaacccgttcctgcacctgctgaagcgcgacggcacgatgacgctggtcggcgcgccggagcacgaccatccgtcgccgcaggtgttcaacctgatcttcaagcgccgccgcctcgcgggctcgctgatcggcgggatcgcggaaacgcaggaaatgctcgacttctgcgcggagcacgggatcacgtcggatatcgaaacgattccgatgcagcagatcaacgcggcctacgagcggatgctgaagagcgacgtgaagtaccggttcgtgatcgacatggcgtcgatcaagcattga

SEQ ID NO: 84797 - protein, 350 aa, Burkholderia cepacia R18194
MSTTYAYAATDSQSPLAPFEFQRRALRDLDVQIDVLYCGVCHSDLHQARNEWRNTIYPVVPGHEIVGRVTATGPQVSRFKVGELVGVGCLVDSCRTCPSCADGLEQYCENGFVGTYNGQDRVTGDITFGGYSTQLVVDEAFVLRVPDTLDPAGAAPLLCAGITTYSPLRQWNVGPGKKVGIVGLGGLGHMGVKLARAMGAHVVLFTTSPSKIEDGKRVGAHEVVISKDEAQMNAHLNSFDFILNTVAAQHDLNPFLHLLKRDGTMTLVGAPEHDHPSPQVFNLIFKRRRLAGSLIGGIAETQEMLDFCAEHGITSDIETIPMQQINAAYERMLKSDVKYRFVIDMASIKH

SEQ ID NO: 84798 - DNA, 1032 bp, Pseudomonas fluorescens PfO-1
  CDS (1)..(1032)
atgagcaatagcaccgaacccacgacattcaccggctgggccgccacctcggccggcgcgccgctggagcgcttcagttacgaccccggcccgctgggagatgaagaggtcgaagtcgccgtggaatattgcggcgtctgtcactccgaccagtcgctgatcgacaacgactggggcatcagccaatacccgttcattcccggccatgaagtggtcggccgcatcgtgcgcacaggcccgcaggtacgtggtctggaagtcggtcagcgcgtggggatcggctggtacaagggcagctgcatgcattgctcgtcctgcatcggcggttcgcatcacctttgcgccaccgccaaaccgacgatcatcggcagccatggcggattcgccgatcgccttcgcacccactgggcctgggcgctgaaactcccggacaacctcgacccggccctcgccggcccgctgttctgcgccggctccacggtcttcaatccgctggtggaattcgacatcaagccgaccgaccgggtcggcgtggtgggcatcggcggcctgggccacctggcgctgcgttttctcaatgcctggggttgcgacgtcacggccttcacctcctctctgagcaaacaggacgaagccaaacgactcggcgcccacaaggtcgtcgcctccaccgacagcgaagcgctgaaagcgattgccggcaccctggactttctgctgatcaccgccaacgccaacctcgactggacggccatgctcgccactctgcgcggcaagggccggctgcacttcgtcggcatcgtgcccgacgcgattccggtgcacgtgttcaacctgatccctcaacagaaatccctgtcagcctccccggtcggatcgcccgccacggcagcgaccatgctggaattctgcgcgcggcatcagatcctgccgcaggtcgaggagtttccgatgagcaaggtcaatgaagccgtcgaccatttgcgcagcggcaaggcgcggtaccggattgtgttgaacgccagcaaatga

SEQ ID NO: 84799 - protein, 343 aa, Pseudomonas fluorescens PfO-1
MSNSTEPTTFTGWAATSAGAPLERFSYDPGPLGDEEVEVAVEYCGVCHSDQSLIDNDWGISQYPFIPGHEVVGRIVRTGPQVRGLEVGQRVGIGWYKGSCMHCSSCIGGSHHLCATAKPTIIGSHGGFADRLRTHWAWALKLPDNLDPALAGPLFCAGSTVFNPLVEFDIKPTDRVGVVGIGGLGHLALRFLNAWGCDVTAFTSSLSKQDEAKRLGAHKVVASTDSEALKAIAGTLDFLLITANANLDWTAMLATLRGKGRLHFVGIVPDAIPVHVFNLIPQQKSLSASPVGSPATAATMLEFCARHQILPQVEEFPMSKVNEAVDHLRSGKARYRIVLNASK

SEQ ID NO: 84800 - DNA, 1083 bp, Rhodospirillum rubrum
  CDS (1)..(1083)
ttgctctaccaggagcatccccctttgtcgatccccaccctgggcttcgccgcccaatccgcgaccacccccctcgcgccgttttcctttgaacgccgcgatccccggcccgatgatgtcaccatcgacatcctctattgcggggtctgccactccgatatccatcaagcgcgcaacgagtggcacaacagcctgtttcccatggtgcccggccatgaaatcatcggcacggtgtcggcggtcggcgccaaggttagcggcttcaaggtcggtgaccgggtgggcgttggctgcatggtcgattcctgccgggagtgcgcgccctgcaaagccgatctcgagcaatattgcgaagacggcgccaccctgacctacaacggccgcgaccgccacgaccatagcctgaccttcggcggctattccgagcgcatcgtcgtttccgaagccttcgtgctgcgccttcccgatgcgctggacgccaaatcggccgcgcccttgctctgcgcgggcatcaccacctattcgccgctgcgccattggcaggtggggccgggaagccgcgtcgccgtcatcggcctgggcggcctgggccatatggggctgaaactcgccaaggcgatgggggccgaggtcagcttgttcacccgctcgcccggcaaggaagacgaggccaaacgcctgggcgccgatcatgtggtgttgtcgaccgatgaggcgcgcatgaaggcggtggccggccacttcaacctgatcatcgacaccgtgccccacccccacgatctcaacccctatgtctccaccctggccttggacggcaccttggtgctggtcggcctgcttggtcccatcgagccggtgatcgacagcgtgccgctggtcatcggccgtcgggcggtggccggctcggcgatcggcggcatcgccgaaacccaggagatgcttgatttctgcgccgccaagggcgtgacggccgatgtggaaatgcttgatatcaacaatatcaacgccgcctatgaccgcatgctcaaaagcgacgtccgctaccgcttcgtgatcgacatggcgacgcttcgcggcgcatga

SEQ ID NO: 84801 - protein, 360 aa, Rhodospirillum rubrum
MLYQEHPPLSIPTLGFAAQSATTPLAPFSFERRDPRPDDVTIDILYCGVCHSDIHQARNEWHNSLFPMVPGHEIIGTVSAVGAKVSGFKVGDRVGVGCMVDSCRECAPCKADLEQYCEDGATLTYNGRDRHDHSLTFGGYSERIVVSEAFVLRLPDALDAKSAAPLLCAGITTYSPLRHWQVGPGSRVAVIGLGGLGHMGLKLAKAMGAEVSLFTRSPGKEDEAKRLGADHVVLSTDEARMKAVAGHFNLIIDTVPHPHDLNPYVSTLALDGTLVLVGLLGPIEPVIDSVPLVIGRRAVAGSAIGGIAETQEMLDFCAAKGVTADVEMLDINNINAAYDRMLKSDVRYRFVIDMATLRGA

SEQ ID NO: 84802 - DNA, 1020 bp, Ralstonia metallidurans CH34
  CDS (1)..(1020)
atgatgaaagccgcagtcgtgcgcgcgttcggcgcacctctgactatcgacgaggtgcccgtgccgcagcctggccctggccagatccaggtcaagatcgaagcgtccggcgtttgccacaccgatctgcatgcggcgcagggcgactggccggtcaagccgtcgctgccattcattcccggccatgaaggcgtgggattcgtgtcggcagttggtgccaatgtcaaacgcgtgaaggaaggggatcgcgtcggcgtgccgtggctctacagcgcctgcggttactgcgaacactgcctccagggctgggaaacgctgtgtgagaagcagcagaacaccggctactccgtcaacggtggctacggcgagttcgtggtggccgatccgaactatgtcggtctgctgccgaagaatgtcgacttcatcgaaatcgcgccgatcctgtgcgctggggtgacggtctacaagggtctcaaggtcaccgacacacggccggggcagtgggtggtgatctcgggaatcggtggtctgggccacgtggccgtacagtatgcgagggcaatgggcctgcgcgtggccgccgtcgacattgacgacgcgaagctcgctttcgcgcgcaagctcggtgccgaagttgcaatcaatgctcgcactaccgaccctgctgctttcttgcagaaggaaattggcggcgcgcacggtgtattggtcaccgcagtctcgccgcaggcgttctcgcaggctatcggcatggtgcgacgcggtggcacgatctcgctgaacggcctgcctccgggagacttccccaccccgatcttcgacgtggtgctgaaggccatcactatccgtggctccattgtcggcacgcgtagcgatctgcaggaagcgctcgaatttgccgccagcggtgtggtgaaagccacggtatccacggaaaaactggactcgatcaatagtatcttcgaccgcatgaaggccggccagatcgaaggccgcattgtgctggacttcagccgctga

SEQ ID NO: 84803 - protein, 339 aa, Ralstonia metallidurans CH34
MMKAAVVRAFGAPLTIDEVPVPQPGPGQIQVKIEASGVCHTDLHAAQGDWPVKPSLPFIPGHEGVGFVSAVGANVKRVKEGDRVGVPWLYSACGYCEHCLQGWETLCEKQQNTGYSVNGGYGEFVVADPNYVGLLPKNVDFIEIAPILCAGVTVYKGLKVTDTRPGQWVVISGIGGLGHVAVQYARAMGLRVAAVDIDDAKLAFARKLGAEVAINARTTDPAAFLQKEIGGAHGVLVTAVSPQAFSQAIGMVRRGGTISLNGLPPGDFPTPIFDVVLKAITIRGSIVGTRSDLQEALEFAASGVVKATVSTEKLDSINSIFDRMKAGQIEGRIVLDFSR

SEQ ID NO: 84804 - DNA, 1035 bp, Burkholderia fungorum LB400
  CDS (1)..(1035)
atgaaaacgcacatgcaagccgctgtggtcgaacagttcggcaagccgctggtactgaaggagctcgccattccgacaccgggtccgggccaggtgctggtcaagaccgaggcctgcggcgtatgccataccgatctgcatgcgaccaacggcgactggccgctcaagcccggtttgccattcacgccggggcatgagggtattggtattgtcgccgccctcggcgcgggtgtgacggcggtgaaggagggcgaccggatcggcgtgccctggctgtattccgcctgtgggcactgcgagtactgccttgcggcacgcgagcccgtctgcgccgaagcacagttcggcggctacacgaagaacggcggctttgccgaatacatcgtggctgacccgaactacgtcgctcacataccggcaggtctggctgcccgcgaagcagcaccgctcatctgcgccggcatcacttcgtacaagggcatcaaggagacccaggcgcggccgggtgaatgggtcgtgatctcaggcgtcggcggactagggcacctgggtatccagtacgccaaagcgatgggcttgcaggtgtgcgccgtcgatatcgacgacggcaagctagcccatgcgaaacgcctcggcgccgacgccgtggttaatgcgaacgacggcgacccgattgccgccgtgataagggccactggcggcggcgcgcatggcgtgctgattacggcgccctctcttggggcgttcaaacagggcgtcggcatgacgcgcaaatgcggtacctgcgtgctggtcggactgccgccgggtgaattccccacgccgctgttcgatgtcgtggccaactgcatcacgattcgcggctcgttcgtcggcaatcgccgcgatatggcggaagcgctggcctttgccgccgacggcaaggtcagggccgacatcgagctgcagccgctgtcggcgatcaacaacgtgttccagcgtctgggacacggcgatgtaccgtcgcgcgtggtgctcgagttcgcgagccactga

SEQ ID NO: 84805 - protein, 344 aa, Burkholderia fungorum LB400
MKTHMQAAVVEQFGKPLVLKELAIPTPGPGQVLVKTEACGVCHTDLHATNGDWPLKPGLPFTPGHEGIGIVAALGAGVTAVKEGDRIGVPWLYSACGHCEYCLAAREPVCAEAQFGGYTKNGGFAEYIVADPNYVAHIPAGLAAREAAPLICAGITSYKGIKETQARPGEWVVISGVGGLGHLGIQYAKAMGLQVCAVDIDDGKLAHAKRLGADAVVNANDGDPIAAVIRATGGGAHGVLITAPSLGAFKQGVGMTRKCGTCVLVGLPPGEFPTPLFDVVANCITIRGSFVGNRRDMAEALAFAADGKVRADIELQPLSAINNVFQRLGHGDVPSRVVLEFASH

SEQ ID NO: 84806 - DNA, 1011 bp, Burkholderia fungorum LB400
  CDS (1)..(1011)
atgaaggcagtgcaggtggcgcaggctggcggacccctggaactcgtcgaacgggacgtgccggaaccgggtgccggacaggtgctcatcaagatccaggcgtgcggtatctgccacagcgacgtgctaacaaaagaagggcagtggccgggtctggaatatccgcgggtgcccgggcacgaaattgcaggcgtgatcgatacggtcggcgcaggcgtcgaagaatggcaggcgggacagcgcgtcggcgtcggctggcacggcggccattgcggacactgcgagcattgccgccgcggcgattttgttctgtgccagcgcgcgctcgtgcccggcatcagctacgacggcggctatgccgagttcatgctggcgcccgtcgaggcactggcgcgcattcccgacgatctcgccgatgtcgatgccgctccgcttctatgcgcgggcatcacgacattcaacgcgctgcgcaatagcggcgcgcgcgccggcgatgtggtcgccattctgggcattggcgggctcggccatctcggcgtgcagttcgcgcgaaagatgggcttcgtcaccgtggccatcgcgcgcgggcaggacaaggcaagtcttgcgaaacaactcggcgcccatcactacatcgacagcacggcggcgaatgtggcgcaagcgttgcaggcgctgggcggcgctcgcgtcattctcgccaccgtcacgagcggcaaggcgatgagcgccgtggtgggcggcctcgggctgaacggtaagctgatcatggtaggactctcggacgagcccgtcgaagtgccggtcgcgcagttcatcatgggacgaaattcggtgcagggctggccgtcgggcacgtcggcggattctcaggacacgcttgcgttcagcgcactctcgggaatcaaaccgatgatcgaagaattcccgctaacgaaagcggccgaagcctacgagcggatgatgagcggcgccgcgcggttcagggtcgtgctcaacacggggcggtag

SEQ ID NO: 84807 - protein, 336 aa, Burkholderia fungorum LB400
MKAVQVAQAGGPLELVERDVPEPGAGQVLIKIQACGICHSDVLTKEGQWPGLEYPRVPGHEIAGVIDTVGAGVEEWQAGQRVGVGWHGGHCGHCEHCRRGDFVLCQRALVPGISYDGGYAEFMLAPVEALARIPDDLADVDAAPLLCAGITTFNALRNSGARAGDVVAILGIGGLGHLGVQFARKMGFVTVAIARGQDKASLAKQLGAHHYIDSTAANVAQALQALGGARVILATVTSGKAMSAVVGGLGLNGKLIMVGLSDEPVEVPVAQFIMGRNSVQGWPSGTSADSQDTLAFSALSGIKPMIEEFPLTKAAEAYERMMSGAARFRVVLNTGR

SEQ ID NO: 84808 - DNA, 1062 bp, Methanosarcina barkeri str. fusaro
  CDS (1)..(1062)
atggcggaaaatattcaatcaaaaggttatgctggaaaagatgagtccggaaagctagttccctggtcttttgaaagaagacctgtaggtgataatgacattctaattgacattaaatactgtggagtttgtcattctgacattcatcagatcaaaggacactggggaccacaacaatatccacaagtgcctggtcatgaaattgtgggtgtggttgctgctgttggaaagaatgtaacaaagttcaaagtaggtgatcgtgcaggagttgggtgcatggttagcagttgtatggagtgtgaaagctgcaagaatggtgaagaacatcattgcgacaacaatgcaactataatgacatatggttatcctgaagaatcatcacctaccggtataagccagggaggatattctcaaaatatcgttgtcacagagcattttgcaataaagataccagattccatagatctacaggaagctgctccattactatgtgctggtattactacttattcacctttaatgagagccaatttcaaaaaaggggataaagtaggagttgcaggaattggtgggctggggcacgtagctattaaattagccgtatcaaaaggtgccgaagtttatgcctttacaaccactgaaagcaaaaaagaagattgccttgcattcggagcaacagaagttattgttgttaactcaccaagcgacctacaaccatggaaaggaaaaatggattacatgatatccacaattccatacgcatacgaaatgtcatcatacattgattgcgtaaaaccatacggatacttcactcaagtaggacaaccaattggaggagaactcacaattaacaacttcaatatgattttcaatagagtaaacttcaatggatcacttattggaggaataccagaaacacaagaagttgttgattattgtgcggaaaataagatctatccgcaaattcagatgatcaaacctgaaatgatcaatgagatatgggagaaggtcgtaaataaagaagcccgctatcgatatgtaattgacatgtcatccttataa

SEQ ID NO: 84809 - protein, 353 aa, Methanosarcina barkeri str. fusaro
MAENIQSKGYAGKDESGKLVPWSFERRPVGDNDILIDIKYCGVCHSDIHQIKGHWGPQQYPQVPGHEIVGVVAAVGKNVTKFKVGDRAGVGCMVSSCMECESCKNGEEHHCDNNATIMTYGYPEESSPTGISQGGYSQNIVVTEHFAIKIPDSIDLQEAAPLLCAGITTYSPLMRANFKKGDKVGVAGIGGLGHVAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIQMIKPEMINEIWEKVVNKEARYRYVIDMSSL

SEQ ID NO: 84810 - DNA, 1044 bp, Cytophaga hutchinsonii
  CDS (1)..(1044)
atgatacaagcaaaaggatacgccgcgcaaaatgaaaaaacggatcttgctccctggaattttgaacgcagagacgttggaccgcacgatgtacagtttgatattcactactgtggtgtatgtcattctgatctgcatcagatccgcaacgattggttcaagggaattttcccgatggtgcccgggcatgaaattgttggaaagatcgtaaaggtcggggcacatgtaacgaaatttaaaatcggcgaccttgcaggtacaggctgtctggttgattcctgcagaacctgtgataactgcaaagacggcctggaacagtattgtgtaaacggaaacagcggtacgtataacagcctggaacaggataaaaagacacctacttatggcggctattccaataccattgttgtacacgaagatttcgtattgcacatcagtgataagctggatcttgcagcagcagcaccgttgctgtgtgcaggcattaccacctattctccgctgcgtcactggaaagtaggcaaggggcataaactggcagtattaggtttaggcggtcttggccacatggccgtgaaatttggtgttgcctttggtgcggaagttacggtgttgagcacatcaccgaacaaagaagccgatgccaaaaaattaggtgcgcataaatttgtggttacgtctgatgccgcacaggtaaatagtgtgaaaggatattttgattttattctggatactgtatctgcaccgcatgatgtaaatatgtacatgtctttattgaaaacaaacggcgtacacatctgtgttggtgttccgcccacaccgtatgaagtacatgcgttcagcatcatcggcggcagaaagagcctggcgggttccaatatcggtggtttgccggaaacacaggaaatgcttgatttctgcgcgcagcataatattacgtcagatattgaacggattgatattaaaaatattcatgcttcgtatgaacgcatgttaaaaggggatgtgcgttatcgttttgttattgacatgtcaaccttataa

SEQ ID NO: 84811 - protein, 347 aa, Cytophaga hutchinsonii
MIQAKGYAAQNEKTDLAPWNFERRDVGPHDVQFDIHYCGVCHSDLHQIRNDWFKGIFPMVPGHEIVGKIVKVGAHVTKFKIGDLAGTGCLVDSCRTCDNCKDGLEQYCVNGNSGTYNSLEQDKKTPTYGGYSNTIVVHEDFVLHISDKLDLAAAAPLLCAGITTYSPLRHWKVGKGHKLAVLGLGGLGHMAVKFGVAFGAEVTVLSTSPNKEADAKKLGAHKFVVTSDAAQVNSVKGYFDFILDTVSAPHDVNMYMSLLKTNGVHICVGVPPTPYEVHAFSIIGGRKSLAGSNIGGLPETQEMLDFCAQHNITSDIERIDIKNIHASYERMLKGDVRYRFVIDMSTL

SEQ ID NO: 84812 - DNA, 1005 bp, Microbulbifer degradans 2-40
  CDS (1)..(1005)
atgattaaagcttatgccgccatggagccgggtgcagcccttgtgccttttgaatacgaaccaggcccgttggcgaataacgaggtagaacttaaggtagagtcgtgcggcatatgtcacagcgacttaagtatgctcgataacgaatggggttttacccagtacccctttgtgggtggccacgaagtgataggcatagtggaggcggtgggtagcagcgtaaataacgtggcagtgggccaacgcgtgggccttggttggcattcgggttactgtaatacctgcgcttcgtgtcaatcgggggatcaaaacctatgcaattctgcccagcctactattgctggccaccatggtggttttgccgataaggtacgcgcagatgcaaatgcggttgtggccttgccagagggggtaaacccagactccgctgggccattgttttgcggtggcattaccgtatttaacccgttagtgcagtttggtattaaacctacatcgaaagtgggcgtaataggtattggtggtttagggcatattgcactgcaatttttaaatgcgtggggctgcgaggtaacggcgtttacctccagtgaaagcaaaaaagaagaagcgctaaagttaggcgcgcaccatgtgctaaacagcagcgatgctgcacaactagaagcagctgctgggcgttttgattttattatttctactgttaacgtaaagctagattggaacgaatatttagctacccttgcgcccaaagggcgtttacattttgtaggcgcaaccttggcgccgctggatattaatgtatttcagcttatcggcagccagcgcgaaatctcaggctcgccggttggcagcccgggtaccataagccaaatgttagattttgctgcgctccacaatattcagcccgttactgaatattttcgtttcgatcaaataaatgaagctctcactaaattgcgcgaaggtaaagcccattaccgcattgtattaacaaacaagtaa

SEQ ID NO: 84813 - protein, 334 aa, Microbulbifer degradans 2-40
MIKAYAAMEPGAALVPFEYEPGPLANNEVELKVESCGICHSDLSMLDNEWGFTQYPFVGGHEVIGIVEAVGSSVNNVAVGQRVGLGWHSGYCNTCASCQSGDQNLCNSAQPTIAGHHGGFADKVRADANAVVALPEGVNPDSAGPLFCGGITVFNPLVQFGIKPTSKVGVIGIGGLGHIALQFLNAWGCEVTAFTSSESKKEEALKLGAHHVLNSSDAAQLEAAAGRFDFIISTVNVKLDWNEYLATLAPKGRLHFVGATLAPLDINVFQLIGSQREISGSPVGSPGTISQMLDFAALHNIQPVTEYFRFDQINEALTKLREGKAHYRIVLTNK

SEQ ID NO: 84814 - DNA, 1143 bp, Oenococcus oeni PSU-1
  CDS (1)..(1143)
atgcttaattatcgtgatttaatggtctttctatttgctacaaaagaaggaattaagatattcaaagaaagtcgagaactaaaaatgaaagctgcagttgttcgtgaaaaaaatgatgggtttgttgatctgatagatgattggaaaccacgtgaattaggctttggcgatgcattggtagatgttgagtattgtggtctttgccacaccgatctgcattgtgcaagcggagattttggcgatccaaatactttaggcgaacgcaacggagatttccgtcgtgtcgctggacatgaaggagttggaattgtttctaaattgggcgaaggggcagaccaatatttgaaggttggcgatcgtgtttcaatcgcttggttctatgacgcttgtggtgtttgcgactattgtgtatccggtaacgagactttttgtcgcaaggtaagaaattccggttatacagttgatggcgcaatggctcaacaggttgttgtcgatgctaaatatgcagttaaagttcctgaaggacttgatccggctcaggcttcttcgattacttgtgccggagttacaatgtacaaatctttgaaagtcggcgaaaccaaacctggtcagtgggtatctgtacatggtgccggcggattaggcaatttggctgttcagtacgctcataatgtttttggtgcccatgttgttgcaattgatggaaatccggataagctggaagccgctaaagaaggtggcgctgaagttttgattaaccgtaagcagcccggcatcgatgttgctgctgaagttcaaaaggacactggcggtgtccacaacgcccaagttacggctgttaatgatgcagctttcaagcaggctgttgattcgcttcggccaatgggcaagcttgttgctgttgctcttccgcagggcgatatggaacttaatattgttaaaactgttttggatgggatcgaagttcgtggctcattagttggaacaagagctgatttgaaagaagctttccaatttggcgccgaaggtaaggttaccccaattgttgaaaaggttgatttgaatgatattaatgatgtgattgaagaaatgaaagagggcacgatcactggtcgcaaagtctttgattttactcacatgtga

SEQ ID NO: 84815 - protein, 380 aa, Oenococcus oeni PSU-1
MLNYRDLMVFLFATKEGIKIFKESRELKMKAAVVREKNDGFVDLIDDWKPRELGFGDALVDVEYCGLCHTDLHCASGDFGDPNTLGERNGDFRRVAGHEGVGIVSKLGEGADQYLKVGDRVSIAWFYDACGVCDYCVSGNETFCRKVRNSGYTVDGAMAQQVVVDAKYAVKVPEGLDPAQASSITCAGVTMYKSLKVGETKPGQWVSVHGAGGLGNLAVQYAHNVFGAHVVAIDGNPDKLEAAKEGGAEVLINRKQPGIDVAAEVQKDTGGVHNAQVTAVNDAAFKQAVDSLRPMGKLVAVALPQGDMELNIVKTVLDGIEVRGSLVGTRADLKEAFQFGAEGKVTPIVEKVDLNDINDVIEEMKEGTITGRKVFDFTHM

SEQ ID NO: 84816 - DNA, 918 bp, Nostoc punctiforme PCC 73102
  CDS (1)..(918)
atgcgtaacgagtggagcagcataatttccaccgtttatccgattgtccccggtcatgagatcgtgggccgtgtcactgaggttggctcggcagtgaccaagtacaagcccggcgacctcgcggcggttggttgcttggtcgattcggatggtacctgtcttaattgcaaagctggccttgagaatttctgcccgaatcaaatcctcaccttcaactctccagacaagcaccttggtggcgttacttatgggggctactccgatagcattgtcgttgatgaacgcttcgtgctgcgtgttccctccaacctcgatctcgccggggctgcaccacttctttgtgctggaatcacaacctattcaccgatgcgtcactggggtgtcactgaaggcaagaaagttggcctagtcggtcttggcggactggggcacatgggcgtgaagtttgctcatgcgtttggtgcccacgttgtcgtcttcaccacctcacccgataaaaaggaagacgcgctccgcctgggtgccgacgaagtggtcgtctcccgcaatgccgacgagatgcagaaacacgctggcagcttcgatttcatcctcgacaccgtttctgccaagcacgacatcaacgcctatctcaacctactccgcctcgacggcaatatcacccttgtcggcgcaccggagaagcccctggatgtcgcggcattcagcctgatcatggcccgtcgcagtctctccggctcaaacatcggcggcatccccgaaacccaagagatgctcgacttttgcggcaagcataacatcaccgccgatgtcgaagtcattcctatccagaaggtcaacgaagcctacgatcgcctgctcaagtctgatgtgaaataccgctttgtgattgatatggcatccctgaaatctgaataa

SEQ ID NO: 84817 - protein, 305 aa, Nostoc punctiforme PCC 73102
MRNEWSSIISTVYPIVPGHEIVGRVTEVGSAVTKYKPGDLAAVGCLVDSDGTCLNCKAGLENFCPNQILTFNSPDKHLGGVTYGGYSDSIVVDERFVLRVPSNLDLAGAAPLLCAGITTYSPMRHWGVTEGKKVGLVGLGGLGHMGVKFAHAFGAHVVVFTTSPDKKEDALRLGADEVVVSRNADEMQKHAGSFDFILDTVSAKHDINAYLNLLRLDGNITLVGAPEKPLDVAAFSLIMARRSLSGSNIGGIPETQEMLDFCGKHNITADVEVIPIQKVNEAYDRLLKSDVKYRFVIDMASLKSE

SEQ ID NO: 84818 - DNA, 978 bp, Chloroflexus aurantiacus
  CDS (1)..(978)
atggtcttcaccgcacctggtcaaccgctcgaataccgtgatcttccggtgccaacaccacagcccgaagaggtcttgattcgggttgaggcgtgtgctgtctgtcgtaccgatcttcatattatcgatggggaattaccagcgccgaacctgccacttgttccaggtcatcaaattgtcggtactatcgagcgtctcggcgagcgggtcacacgctggacggttgggcaacgggttggggtgccctggctgggctggacgtgtggcgagtgccgtttttgccgtgatgggcgcgaaaatctttgcgatcaggcgcagtttaccggctatacccgacccggcggctttgccgaatataccgttgccgatcaacgtttctgctttgctctacccaccgactacgacgcaaccgcagttgcaccgttgctctgcgctggtctgatcggatatcgggcactccgcctggccggtactggcgagcgactgggtatctacggcttcggtgccgcagcacacctgatgacgcaggttgcacgctggcagggtcgcgaagtcttcgccttcacccgtcccggtgatactgaagggcaacgttttgcccgcgaattaggcgcagtctgggccggcagttcaaccgagctgccgccggtgccactcgatgccgcaatcatctttgccccggtaggcgatctcgttccgtatgcgttacgtgccgtcgagaaagggggcgttgtcgtctgtggcggcattcatatgagccagattcctgccttcgcctacgaattgctgtggggcgagcgcgtattgcgctcggtcgccaacctaacccgtgaggacggcgaggcattcctgcagatcgcgccacaaatcccggtgcggacaaccgtccagacctttccactcaccgaactgaacacagccctgaacgcactccgccaggggaagttacagggtgccgccgtgatccagatttcgtaa

SEQ ID NO: 84819 - protein, 325 aa, Chloroflexus aurantiacus
MVFTAPGQPLEYRDLPVPTPQPEEVLIRVEACAVCRTDLHIIDGELPAPNLPLVPGHQIVGTIERLGERVTRWTVGQRVGVPWLGWTCGECRFCRDGRENLCDQAQFTGYTRPGGFAEYTVADQRFCFALPTDYDATAVAPLLCAGLIGYRALRLAGTGERLGIYGFGAAAHLMTQVARWQGREVFAFTRPGDTEGQRFARELGAVWAGSSTELPPVPLDAAIIFAPVGDLVPYALRAVEKGGVVVCGGIHMSQIPAFAYELLWGERVLRSVANLTREDGEAFLQIAPQIPVRTTVQTFPLTELNTALNALRQGKLQGAAVIQIS

SEQ ID NO: 84820 - DNA, 1080 bp, Campylobacter coli RM2228
  CDS (1)..(1080): transl_table=11
atggactctaaaatctttttagaaaatggtcgcattcaaagcaagggttatgctatgcttagcaaagatgcgaaattcacaccctttgaattcacacgccacgctgtgggtgataatgatattttgattaaaattttatacgcaggaatttgccatagcgacatccacactgcaagaagcgagtggggagaggctgtttatccttgtgtgccagggcatgagatagcaggagaagtgatcgcagtgggtaaaaatgtgagcaaatttaaagtaggggattatgcaggggttggctgtatggtaaattcatgcggagaatgcgaagcatgcaaaaaatcccaagagcaattttgcgaaaaaggacaaactatctatacttacaatagctgcgatatttttcatgataatgaaaacacctatggaggctactcaaacaacatagtcgtaagtgaaaaatttgctgtttgtgtgccaaaagatgcaccgatggaaaaagtcgcgcctttgctttgtgcaggaattaccacttattctccgcttaaattttcaaacattaaagctggctcaagcgtagcggtagcgggatttggcggagttggtatgatggcggttaaatatgctgtgaaaatgggtgcaaaagtaagtgtttttgctagaaatgaaaacaaaaaagccgatgctttggctatgggcgtgagttctttttatacaagcacagataaaaatgctgtaaaagaacgctttgatcttattatctctaccatcccaactccttatgatcctagtgcttatatggatttgcttaaatttggcggtgaaatggcgatagtgggtttgccacctcacgaagttgctccaagtatcagcgtgataacctttgtgcataaagcgggtaaaaaagtctatggttcactaatcggcggaatcgcagaaactcaagaaatgcttgatttttctttaaagcataaaatttaccctgaaaccgaactcatcacttcaaaagatatcgacaaagcttatgaaaatctcacttcaggaaaagcaaaattccgctatgtgatcgatatgagagatgagtaa

SEQ ID NO: 84821 - protein, 359 aa, Campylobacter coli RM2228
MDSKIFLENGRIQSKGYAMLSKDAKFTPFEFTRHAVGDNDILIKILYAGICHSDIHTARSEWGEAVYPCVPGHEIAGEVIAVGKNVSKFKVGDYAGVGCMVNSCGECEACKKSQEQFCEKGQTIYTYNSCDIFHDNENTYGGYSNNIVVSEKFAVCVPKDAPMEKVAPLLCAGITTYSPLKFSNIKAGSSVAVAGFGGVGMMAVKYAVKMGAKVSVFARNENKKADALAMGVSSFYTSTDKNAVKERFDLIISTIPTPYDPSAYMDLLKFGGEMAIVGLPPHEVAPSISVITFVHKAGKKVYGSLIGGIAETQEMLDFSLKHKIYPETELITSKDIDKAYENLTSGKAKFRYVIDMRDE

SEQ ID NO: 84822 - DNA, 1041 bp, Streptomyces griseus
  CDS (1)..(1041): transl_table=11
atgaccaccgttgccgcctatgccgctccccgtgccaaggccccgctggagcgcaccacgatcgaacgccgcccggtgggagagttcgacatcctgatcgacatcaagttcgccggcatctgccactccgacatccaccaggcccgcgacggctggggcgagggcatcttcccgatggtgcccggccacgagatcgccgggatcgtcgccgagaccggccccggcgtcacccggttcaaggtcggcgaccgcgtcggcgtcggctgcatggtcgactcctgcggtacgtgcgacgcctgcctgatgggccgcgagcagcactgcgccgaggggaacacccagacgtacaacgcgctcgaccgcaacggcgagcccacctacggcggctactccacccacctcgtcgtgaccgagaagttcgcactctccatccccgagggcatcgccctcgacgaggccgcgccgctcctgtgcgcgggcatcaccacgtactccccgctcaggcgctggggcgcgggcccgggcaagaaggtcgccgtcgtcggcctcggaggcctcggccacatggccgtcaagatcgcgcacgccctcggcgccgaggtcaccgtcctctcccagtcgctgcggaagaaggatgacggactcaagctgggcgccgaccactactacgcgaccggcgacccgcggaccttcgaggaactggcgggcacgttcgacgtgatcctctccacggtctcggccccgctcgacttcggggcctacctcgccctgctgcgcaccgagggcaccctggtcaacgtgggcgcccccgaggagccggtctcgctgaacctgttctccctgatcctgggcaacaggtcgatcgcgggttccgctatcggcggcatcgaggagacccaggagatgctggacttctgcgccgtgcacgggctcggcgccgagatcgaggtgatcggggccggccaggtcaacgaggcctacgagcgcgttctcgccagcgacgtccgctaccgcttcgtgatcgacacggcgacgatctga

SEQ ID NO: 84823 - protein, 346 aa, Streptomyces griseus
MTTVAAYAAPRAKAPLERTTIERRPVGEFDILIDIKFAGICHSDIHQARDGWGEGIFPMVPGHEIAGIVAETGPGVTRFKVGDRVGVGCMVDSCGTCDACLMGREQHCAEGNTQTYNALDRNGEPTYGGYSTHLVVTEKFALSIPEGIALDEAAPLLCAGITTYSPLRRWGAGPGKKVAVVGLGGLGHMAVKIAHALGAEVTVLSQSLRKKDDGLKLGADHYYATGDPRTFEELAGTFDVILSTVSAPLDFGAYLALLRTEGTLVNVGAPEEPVSLNLFSLILGNRSIAGSAIGGIEETQEMLDFCAVHGLGAEIEVIGAGQVNEAYERVLASDVRYRFVIDTATI

SEQ ID NO: 84824 - DNA, 1089 bp, Acacia mangium x Acacia auriculiformis
  CDS (1)..(1089)
atgggaagcattgaaggagaaagaacaacagttggatgggctgcaagagaccctactgggattctctctccatacaccttcaatctcaggaacacggggcctgatgatgtgtatattaaggttcactactgtggaatctgccactccgatctgcatcagattaagaatgatcttggcatgtccaattatcccatggttcctgggcatgaggtggttggagaagtgatcgaggtgggttccaatgtgaccaagtttaaggtcggagaagtggttggagcaggactcatcgttggcagctgccggaattgcagggcatgcaaatctgacattgagcaatattgtggcaagaagatctggaattacaacgatgtgtacaccgatggaaaacccccccaaggtggctttgctgaaaccatgatcgtcgatcaaaacttcgttgtgaagataccggaggggatgtcaccggagcaagtggcgccactgttatgcgccggcgtgacggtgtacagtccactgtcacactttgggctgagagatagtgggctaagaggaggaatattgggacttggaggagtgggacacatgggtgtgaaagataggggaagggcggattggaaacacccagtgtgccaggtgataggctcgtcggagaagagaaagaaggaggctagggagaccttggagcaaacgattatgtggttaagttcagatgaaactcagatgcagaagattgctgattctctggattatattattgataccgtaccggtgggtcaccctcttgagcctaatctttctttgctaaaaattgatggcaagttgatcttaatgggtgttatcaacactcctttgcaattcgttagccccatggtcatgcttgggaggaagacgataacaggaagcttcatagggagcataaaggagacagaagagatgttagaattctggaaagagaagggtctgagttcaatgatagagatggtgaagatggattacataaacaaggcacttgagaggttggagaagaacgatgtgaggtataggttcgtggttgacgttgctggcagcaaacttgatgatcatcagtga

SEQ ID NO: 84825 - protein, 362 aa, Acacia mangium x Acacia auriculiformis
MGSIEGERTTVGWAARDPTGILSPYTFNLRNTGPDDVYIKVHYCGICHSDLHQIKNDLGMSNYPMVPGHEVVGEVIEVGSNVTKFKVGEVVGAGLIVGSCRNCRACKSDIEQYCGKKIWNYNDVYTDGKPPQGGFAETMIVDQNFVVKIPEGMSPEQVAPLLCAGVTVYSPLSHFGLRDSGLRGGILGLGGVGHMGVKDRGRADWKHPVCQVIGSSEKRKKEARETLEQTIMWLSSDETQMQKIADSLDYIIDTVPVGHPLEPNLSLLKIDGKLILMGVINTPLQFVSPMVMLGRKTITGSFIGSIKETEEMLEFWKEKGLSSMIEMVKMDYINKALERLEKNDVRYRFVVDVAGSKLDDHQ

SEQ ID NO: 84826 - DNA, 1089 bp, Populus tremula x Populus tremuloides
  CDS (1)..(1089)
atgtccaagtcaccagaagaagaacaccctgtgaaggccttcgggtgggctgctagggatcaatctggtcatctttctcccttcaacttctccaggagggctactggtgaagaggatgtgaggttcaaggtgctgtactgcgggatatgccattctgaccttcacagtatcaagaatgactggggcttttccatgtaccctttggttcctgggcatgaaattgtgggggaagtgacagaagttgggagcaaggtgaaaaaggttaatgtgggagacaaagtaggcgtgggatgcctggttggtgcatgtcactcctgtgagagttgtgccaatgatcttgaaaattactgtccaaaaatgatcctgacatactcctccatctaccatgacggaaccatcacttacggtggctactcagatcacatggtcgccaatgaacgctacatcattcgattccccgataacatgccgcttgacggtggcgctcctctcctttgtgccgggattacagtgtatagtcccttgaaatattttggactcgatgaacccggtaagcatatcggtatcgttggcttaggtggacttggtcacgtggctgtcaaatttgccaaggcctttggatctaaagtgacagtaattagtacctccccttccaagaaggaggaggctttgaagaacttaggtgcagactcatttttggttagtcgtgaccaagagcaaatgcaggctgccgcaggaacattagatggcatcatcgatacagtttctgcagttcacccccttctgccattgtttggactgttgaagtctcatgggaagcttatcttggtgggtgcaccggaaaagcctcttgagctacctgccttttctttgattgctggaaggaagatagttgccgggagtggtattggaggcatgaaggagacacaagagatgattgattttgcagcaaaacacaacatcacagcagatatcgaagttatttcaacggactatcttaatacggcgatggaacgtttggctaaaaacgatgtcagataccgattcgtcattgacgttggcaatactttggcagctacgaagccctaa

SEQ ID NO: 84827 - protein, 362 aa, Populus tremula x Populus tremuloides
MSKSPEEEHPVKAFGWAARDQSGHLSPFNFSRRATGEEDVRFKVLYCGICHSDLHSIKNDWGFSMYPLVPGHEIVGEVTEVGSKVKKVNVGDKVGVGCLVGACHSCESCANDLENYCPKMILTYSSIYHDGTITYGGYSDHMVANERYIIRFPDNMPLDGGAPLLCAGITVYSPLKYFGLDEPGKHIGIVGLGGLGHVAVKFAKAFGSKVTVISTSPSKKEEALKNLGADSFLVSRDQEQMQAAAGTLDGIIDTVSAVHPLLPLFGLLKSHGKLILVGAPEKPLELPAFSLIAGRKIVAGSGIGGMKETQEMIDFAAKHNITADIEVISTDYLNTAMERLAKNDVRYRFVIDVGNTLAATKP

SEQ ID NO: 84828 - DNA, 1074 bp, Picea abies
  CDS (1)..(1074)
atgggaagcttggaatctgaaaaaactgttacaggatatgcagctcgggactccagtggccatttgtccccttacacttacactctcaggaacaaaggacctgaggatgtcatagtaagggtcatttactgtggaatctgccactctgacttagttcaaatgcataacgaaatgggcatgtctaattacccaatggtccctgggcatgaagtggtgggagtggtaacagagattggtagcgaggtgaagaaattcaaagtgggagaacatgtaggggttggttgcattgttgggtcgtgtcgcagttgcagtaactgcaatggcagcatggaacaatactgcagcaagaggatttggacctacaatgatatgaaccatgacggcacccctactcaaggaggatttgccagcagtatggtggttgatcagatgtttgtggttcgaatcccggagaatctacctctggaacaagcagcccctctgttatgtgcaggggttacagtttacagcccaatgaaacatttcggcatgacagagcctggaaagaaatgtgggatattgggtttaggaggcgtggggcacatgggtgtcaagattgccaaagcctttgggcttcacgtgacagtcataagctcgtctgataagaagaaagaagaagcccttgaagtcctcggcgccgatgcttatcttgttagcaaggatgctgaaaagatgcaggaagcagcagagagcctagattacataatggacaccataccagttgcccatccgttggaaccatatcttgcccttctgaagacaaatggaaagctagttatgctgggcgttgtaccagagccgttgcactttgttactcctctcttaatactagggaggaggagcatagctgggagtttcatcggcagcatggaggaaacgcaggaaactttagatttctgtgcagagaagaaggtttcatcgatgattgaggttgtgggcctggactacatcaatactgccatggaaaggcttgtgaagaacgatgtccgttacagatttgtggtggatgtggccagaagcaatctggataaataa

SEQ ID NO: 84829 - protein, 357 aa, Picea abies
MGSLESEKTVTGYAARDSSGHLSPYTYTLRNKGPEDVIVRVIYCGICHSDLVQMHNEMGMSNYPMVPGHEVVGVVTEIGSEVKKFKVGEHVGVGCIVGSCRSCSNCNGSMEQYCSKRIWTYNDMNHDGTPTQGGFASSMVVDQMFVVRIPENLPLEQAAPLLCAGVTVYSPMKHFGMTEPGKKCGILGLGGVGHMGVKIAKAFGLHVTVISSSDKKKEEALEVLGADAYLVSKDAEKMQEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLVKNDVRYRFVVDVARSNLDK

SEQ ID NO: 84830 - DNA, 1047 bp, Mucor circinelloides
  CDS (1)..(1047)
atgtctgaagaaactttcactgcctgggcctgtaaatccaagtctgctcctcttgaacccatggagatgaccttctgtcactgggatgatgatatggtccaaatggatgtcatctgttgtggtgtctgtggtaccgatcttcacactgtcgatgaaggttggggacctactgaattcccttgtgttgttggtcacgaaatcatcggtaacgtcaccaaggtcggtaagaacgttactcgcatcaaggtcggtgatcgttgtggtgttggttgtcaatctgcttcttgtggcaagtgtgatttctgtaagaagggtatggagaacttgtgttccacccacgctgtctggaccttcaacgatcgttatgacaacgctaccaaggacaagacctatggtggtttcgccaagaagtggagaggtaaccaagactttgtcgtccacgtccccatggacttctctcctgaagttgctgcctctttcttgtgtggtggtgtcactacttatgcccccctcaagcgttacggtgtcggtaagggctccaaggtcgctgttctcggtctcgggggtctcggtcactttggtgtccaatgggccaaggctatgggtgccgaagttgttgctttcgatgttatccctgacaaggtcgatgatgccaagaagctcggctgtgatgactacgttctcatgcaaaaggaagagcagatggaaccacactacaacacatttactcacatccttgccaccaagattgtcaacaagtgttgggaccaatacttcaagatgttgaagaacaacggtatcttcatgttgtgtgatatccctgaagtccctctctctggtatgtctgcctttgtcatggccggtaagcaactcaccattgctggtaccttcatcggttctccctctgtcatccaagagtgtctcgatttcgctgccaagcacaatgtccgcacctgggtcaacaccttccctatggagaagatcaacgaagctttcgaattcgttcgtcaagccaagcctcgttacagagctgtcgtcatgaactaa

SEQ ID NO: 84831 - protein, 348 aa, Mucor circinelloides
MSEETFTAWACKSKSAPLEPMEMTFCHWDDDMVQMDVICCGVCGTDLHTVDEGWGPTEFPCVVGHEIIGNVTKVGKNVTRIKVGDRCGVGCQSASCGKCDFCKKGMENLCSTHAVWTFNDRYDNATKDKTYGGFAKKWRGNQDFVVHVPMDFSPEVAASFLCGGVTTYAPLKRYGVGKGSKVAVLGLGGLGHFGVQWAKAMGAEVVAFDVIPDKVDDAKKLGCDDYVLMQKEEQMEPHYNTFTHILATKIVNKCWDQYFKMLKNNGIFMLCDIPEVPLSGMSAFVMAGKQLTIAGTFIGSPSVIQECLDFAAKHNVRTWVNTFPMEKINEAFEFVRQAKPRYRAVVMN

SEQ ID NO: 84832 - DNA, 1089 bp, Oryza sativa
  CDS (1)..(1089)
atggagcacaacggcacggcggcgctcggctgggcggcgagggacacctctggccacctctcaccgttcagcttcacaagaagggttcagcaggaagacgacgtgacgatcaaggtgctctactgtggcatctgccacaccgacctgcacatcatcaagaacgagtggggcaacgccatgtaccccgtcgtccccgggcacgagatcgtcggcgtcgtcaccggcgtcggcgccggcgtgacaaagttcaaggccggcgacacggtgggcgtgggctacttcgtcgactcgtgccgcgcctgcgacagctgcggcaaggggtacgagaactactgcccgacgatggtgatcacgtcgaacggcacggactacggcggcgccaccacccagggcggcttctccgacgtcatggtcgtgaggcaggactacgtggtgcgcgtcccggcgagcctgccgccggacggcgcggcgccgctgctgtgcgccggcgtgacggtgtacagcccgatggtggagtacggcctgaacggtcccgggaagcacctcggcgtggtcggcctcggcgggctgggccacctgggtgtcaagttcggcaaggcgttcgggatgaaggtgacggtgatcagctcgtcgccggcgaagcggggggaggcgctggggcggctcggcgccgacgcgttcctgtcgagccgcgacggcgagggaatggcggcggcggcggcgacgatggacgggatcatcgacacggtgtccgcggggcacccgctggtgccgctgctgtcgctgctgaagcccaaggggcagatggtggtggtgggcgcgccggcgatgccgctgcagctgcccgcgtacgccatcatcgagggcgggaagcgcgtcgccgggaacggcgtgggcagcgtggccgagtgccaggcgatgctggacttcgccggcgagcacggcatcgccgcggacgtcgaggtggtcgccatggacgccgtcaacgccgccctcggccgcctcgagaggaacgacgtgaggtaccgcttcgtcgtcgacgtcgccggcacaatgcacgctgccgccgccgccgctgcgtcgtcctag

SEQ ID NO: 84833 - protein, 362 aa, Oryza sativa
MEHNGTAALGWAARDTSGHLSPFSFTRRVQQEDDVTIKVLYCGICHTDLHIIKNEWGNAMYPVVPGHEIVGVVTGVGAGVTKFKAGDTVGVGYFVDSCRACDSCGKGYENYCPTMVITSNGTDYGGATTQGGFSDVMVVRQDYVVRVPASLPPDGAAPLLCAGVTVYSPMVEYGLNGPGKHLGVVGLGGLGHLGVKFGKAFGMKVTVISSSPAKRGEALGRLGADAFLSSRDGEGMAAAAATMDGIIDTVSAGHPLVPLLSLLKPKGQMVVVGAPAMPLQLPAYAIIEGGKRVAGNGVGSVAECQAMLDFAGEHGIAADVEVVAMDAVNAALGRLERNDVRYRFVVDVAGTMHAAAAAAASS

SEQ ID NO: 84834 - DNA, 918 bp, Oryza sativa
  CDS (1)..(918)
atgtaccccgtcgtccccggccacgagatcgtcggcgtcgtcaccggcgtcggcgccggcgtgaccaagttcaaggccggcgacacggtgggcgtgggctacttcgtcgcgtcgtgccgcggctgcgagtgctgcgggaatgggtacgagaactactgcgccaagatggtaaccacctgcaacggcgtcgaccacgaccacggcggcggcgcggccacccagggcggcttctccgacgccatcgtcgtcaacgagcactacgtgctccgcgtgccggcggggctgccgctggacagcgcggcgccgctgctgtgcgccggcgtgacggtgtacagcccgatggtgatccacggcctgaacgcgccggggaagcacgtcggcgtcgtcggcctcggcgggctcggccacgtcgccgtcaagttcgccaaggcgttcgggatgcgcgtcaccgtcatcagcacgtcgccggggaagcggcaggaggcactggagcacctcggcgccgacgagttcctcgtcagccgcgacgcgggccagatggcggcggcggcggccaccatggacgggatcctcaacacggtgtcggcctggcacccgatcgcgccgctgttctcgctgatgaagccgatggcgcagatggtgttcgtcggcgggccgaccaggccgctggagctgccggcgtacgccatcgtgcccggagggaagggcatcaccggcaactgcgtcggcggcatcagggactgccaggccatgctcgacttcgccggcgagcacggcatcactgccgaggtggaggtcatcaagatggactacgtcaacacggcgatggagcggctggagaagaacgatgtccgctaccgcttcgtcatcgacgttgccggcagcagcctcgccggctccggcgacgccaagatataa

SEQ ID NO: 84835 - protein, 305 aa, Oryza sativa
MYPVVPGHEIVGVVTGVGAGVTKFKAGDTVGVGYFVASCRGCECCGNGYENYCAKMVTTCNGVDHDHGGGAATQGGFSDAIVVNEHYVLRVPAGLPLDSAAPLLCAGVTVYSPMVIHGLNAPGKHVGVVGLGGLGHVAVKFAKAFGMRVTVISTSPGKRQEALEHLGADEFLVSRDAGQMAAAAATMDGILNTVSAWHPIAPLFSLMKPMAQMVFVGGPTRPLELPAYAIVPGGKGITGNCVGGIRDCQAMLDFAGEHGITAEVEVIKMDYVNTAMERLEKNDVRYRFVIDVAGSSLAGSGDAKI

SEQ ID NO: 84836 - DNA, 1086 bp, Oryza sativa
  CDS (1)..(1086)
atggaggagcatggcaaggcggctgtcggctgggcggccagggacgactccggcgtcctctccccgtacaacttctccaggagggctcagaaggacgatgacgtcaccatcaaggtgctctactgcggcatctgccacaccgacctgcacgtcgtcaagaacgattggggcaacgccatgtaccccgtcgtccccggccacgagatcgtcggcgtcgtcaccggcgtcggcgccggcgtgaccaagttcaaggccggcgacacggtgggcgtgggcttcttcgtcgggtcgtgccgcacctgcgacagctgcggcaaggggtacgagaactactgcccgacgatggtgatcacgtcgaacggcaaggactacggcggcgcggccacccagggcggcttctccgacgccatcgtcgtgaacgaacactacgtgctccgcgtgccggcggggctgccgctggacggcgcggcgccgctgctgtgcgccggcgtgacggtgtacagcccgatggtgatccacgggctgaacgcgccggggaagcacgtcggcgtggtcggcctcggcgggctcggccacgtcgccgtcaagttcgccaaggcgttcgggatgcgcgtcaccgtcatcagcacgtcgccggggaagcggcgggaggcgctggagcacctcggcgccgacgagttcctcgtcagccgcgacgcgggccagatggcggcggcggcgggcaccatggacgggatcctcaacacggtgtcggcgtggcacccggtcgcgccgctgttcgcactgatgaagccgatggcgcagatggtgttcgtcggcgcgccgaccaggccgctggagctgccggcgtacgccatcgtcccgggagggaagggcatcaccggcaactgcgtcggcggcatcagggactgccaggccatgctcgacttcgccggcgagcacggaatcaccgccgaggtggaggtgatcaagatggactacgtcaacaccgcgatggagcggctggagaagaacgacgtccgctaccgcttcgtcatcgacgtcgccggcagcagcctcggcggctccggcgacgacaagatataa

SEQ ID NO: 84837 - protein, 361 aa, Oryza sativa
MEEHGKAAVGWAARDDSGVLSPYNFSRRAQKDDDVTIKVLYCGICHTDLHVVKNDWGNAMYPVVPGHEIVGVVTGVGAGVTKFKAGDTVGVGFFVGSCRTCDSCGKGYENYCPTMVITSNGKDYGGAATQGGFSDAIVVNEHYVLRVPAGLPLDGAAPLLCAGVTVYSPMVIHGLNAPGKHVGVVGLGGLGHVAVKFAKAFGMRVTVISTSPGKRREALEHLGADEFLVSRDAGQMAAAAGTMDGILNTVSAWHPVAPLFALMKPMAQMVFVGAPTRPLELPAYAIVPGGKGITGNCVGGIRDCQAMLDFAGEHGITAEVEVIKMDYVNTAMERLEKNDVRYRFVIDVAGSSLGGSGDDKI

SEQ ID NO: 84838 - DNA, 1080 bp, Oryza sativa
  CDS (1)..(1080)
atggagcacgacggcacggcggcgctcggctgggcggcgcgggacgcctccggccacctctcaccgttcagcttcacaagaagggttcaggaggaagacgacgtgacgatcaaggtgctctactgcggcatctgtcacaccgacctgcacaccatcaagaacgagtggggcaacgccatgtaccccgtcgtccccggccacgagatcgtcggcgtcgtcgccggcgtcggcgccggcgtgaccaggttcaaggccggcgacacggtgggcgtgggctacttcgtcgactcgtgccgcgcctgcgacagctgcggcaagggggacgagaactactgcccgacgatggtgatcacgtcgaacggcacggactacggcggcgccaccacccagggcggtttctccgacgtcatggtcgtgaggcaggactacgtgttgcgcgtcccggcgagcctgccgccggacggcgcggcgccgctgctgtgcgccggcgtgacggtgtacagtccgatggtggagtacggcctgaacgcccccgggaagcacctcggcgtggtcggcctcggcgggctgggccacctgggcgtcaagttcggcaaggcgttcgggatgaaggtgacggtgatcagctcgtcgccggcgaagcgggaggaggcgctggagcggctcggcgccgacgcgttcctgtcgagccgcgacggcgaggggatggcggcggcggcggcgacgatggacgggatcatcgacacggtgtccgcggggcacccgctggtgccgctgctgtcgctgctgaagcccaaggggcagatggtggtggtgggcgcgccggcggcgccgctgcagctgcccgcgatcgccatcatcgatggcgggaagcgcgtcgccgggagcggcgggggcagcgtggccgagtgccaggcgatgctggacttcgccggcgagcacggcatcgccgcggacgtcgaggtggtcgccatgggcgacgtcaacgccgccctcggccgcctcgagaggaacgacgtgaggtaccgcttcgtcatcgacgtcgccggcaccctgcacgccgccgccgcgccgtcctag

SEQ ID NO: 84839 - protein, 359 aa, Oryza sativa
MEHDGTAALGWAARDASGHLSPFSFTRRVQEEDDVTIKVLYCGICHTDLHTIKNEWGNAMYPVVPGHEIVGVVAGVGAGVTRFKAGDTVGVGYFVDSCRACDSCGKGDENYCPTMVITSNGTDYGGATTQGGFSDVMVVRQDYVLRVPASLPPDGAAPLLCAGVTVYSPMVEYGLNAPGKHLGVVGLGGLGHLGVKFGKAFGMKVTVISSSPAKREEALERLGADAFLSSRDGEGMAAAAATMDGIIDTVSAGHPLVPLLSLLKPKGQMVVVGAPAAPLQLPAIAIIDGGKRVAGSGGGSVAECQAMLDFAGEHGIAADVEVVAMGDVNAALGRLERNDVRYRFVIDVAGTLHAAAAPS

SEQ ID NO: 84840 - DNA, 1083 bp, Catharanthus roseus
  CDS (1)..(1083)
atggcgaaatcaccggaagtcgagcatccagttaaggcctttggatgggctgctagagacacttctgggcatctctctccttttcatttctcccgaagggctaccggagaacatgatgtgcaattcaaagttttatactgcgggatctgtcactcggatcttcacatgatcaagaacgaatggggcttcacgaaatatcccattgtacctgggcatgaaattgtgggtatagttacagaggttggtagtaaggttgagaaattcaaggttggggataaagtaggagtgggttgccttgtgggatcatgccggaaatgtgatatgtgcactaaagatcttgaaaattattgtccgggccaaatactcacatacagcgctacttatactgatggaacaactacctatggaggctattctgatctaatggttgctgatgaacactttgtgattcgttggcctgagaatttgcctatggatattggtgctcctttgctttgtgctgggattactacatacagtccattgagatattttggacttgataaaccaggaacccatgttggcgtcgttggtcttggtggtcttggccatgtagctgtgaaatttgccaaggcttttggtgccaaagttactgtcattagcacatctgagagtaaaaaacaggaagccttagagaaacttggtgctgattctttcttggttagtcgtgaccctgaacagatgaaggcagcagcggctagtttggatggaattattgacaccgtttctgcaattcatccaatcatgcccctgcttagcatattgaagtctcatgggaagctaattcttgttggtgcaccagaaaagccacttgagttgccatcgttccctcttattgctgggaggaaaataatagctggaagtgcaattggagggttgaaagaaactcaagaaatgatagattttgcagcaaagcacaatgttttgcctgatgtggaacttgtctcgatggattatgtaaacactgcaatggagaggctactgaaagctgatgttaaatatcgttttgtcattgatgtagccaacacactgaaatctgcataa

SEQ ID NO: 84841 - protein, 360 aa, Catharanthus roseus
MAKSPEVEHPVKAFGWAARDTSGHLSPFHFSRRATGEHDVQFKVLYCGICHSDLHMIKNEWGFTKYPIVPGHEIVGIVTEVGSKVEKFKVGDKVGVGCLVGSCRKCDMCTKDLENYCPGQILTYSATYTDGTTTYGGYSDLMVADEHFVIRWPENLPMDIGAPLLCAGITTYSPLRYFGLDKPGTHVGVVGLGGLGHVAVKFAKAFGAKVTVISTSESKKQEALEKLGADSFLVSRDPEQMKAAAASLDGIIDTVSAIHPIMPLLSILKSHGKLILVGAPEKPLELPSFPLIAGRKIIAGSAIGGLKETQEMIDFAAKHNVLPDVELVSMDYVNTAMERLLKADVKYRFVIDVANTLKSA

SEQ ID NO: 84842 - DNA, 1047 bp, Saccharomyces pastorianus
  CDS (1)..(1047)
atgtctattccagaaactcaaaaagccattatcttctacgagtccaacggtaagttggaatacaaagatattccagttccaaagccaaaggccaacgaattgttgatcaacgttaaatactctggtgtctgtcacactgacttgcacgcttggcacggtgactggccattgccagttaagctaccattagttggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaagaatacgctaccgctgacgctgttcaagccgctcacattcctcaaggtactgacttggctgaagtcgccccagttttgtgtgctggtatcaccgtctacaaggctttgaagtctgccaacttgagagcaggccactgggtggccatttctggtgctgctggtggtctaggttctttggctgttcaatatgctaaggcgatgggttacagagtcttaggtattgatggtggtccaggaaaggaagaattgtttacctcgctcggtggtgaagtattcatcgacttcaccaaagagaaggacattgttagcgcagtcgttaaggctaccaacggcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataa

SEQ ID NO: 84843 - protein, 348 aa, Saccharomyces pastorianus
MSIPETQKAIIFYESNGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQEYATADAVQAAHIPQGTDLAEVAPVLCAGITVYKALKSANLRAGHWVAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 84844 - DNA, 1056 bp, Saccharomyces bayanus
  CDS (1)..(1056)
atgtcttcgcaagctattcccgaaagccaaaaggcaatcgttttttatgaaacaaacggtaagctggaatacaaggacattgcagtcccagagcctaaagccaatgaaattctagttcatgtcaaatattccggtgtttgtcacagcgatttacacgcatggcgtggcgattggccattccaattgaaatttccattgattggtgggcatgagggtgcaggtgttgttgttaagttgggctccaacgtcaagggctggaaagtcggtgacttggcaggtatcaaatggttgaacggtacgtgtatgtcctgtgaatattgtgaagttggtaacgaatctcaatgtccccatttggatggtaccggcttcactcatgatggtacttttcaagagtatgcaactgccgatgctgttcaggctgctcatctcccagagaatgtcgaccttgcggaagttgccccaattttgtgtgcaggggttacagtttataaagcactgaaaagagccaatttaattcccggtcaatgggttactatttctggtgcttgcggaggattaggttccctggccattcagtatgctacggctatgggttacagggtcattggtattgacgaaggggagaccaaaaaacagctattcgaaggactaggtggggaagtatttatcgatttcacaaaagaaaaggatatcgttggtgccgttatcaaagccactgacggtggttcccatggtgttatcaacgtgtctgtttctgaagcagccatcgaagcttcaacgagatactgtagacccaacggtactgttgtcttggttggtatgccggctcatgcttattgcaaatccgacgtcttcaatcaagttgttaaatccatttccattgtcggatcttgcgttggtaacagagctgacacaagggaagctttggactttttcgccagaggattgattaaatctccaattcacttggctagcctatctgatgttccagagatttttgaaaagatggaaaagggtgaaatcgttggcagatatgttattgacacttctaaataa

SEQ ID NO: 84845 - protein, 351 aa, Saccharomyces bayanus
MSSQAIPESQKAIVFYETNGKLEYKDIAVPEPKANEILVHVKYSGVCHSDLHAWRGDWPFQLKFPLIGGHEGAGVVVKLGSNVKGWKVGDLAGIKWLNGTCMSCEYCEVGNESQCPHLDGTGFTHDGTFQEYATADAVQAAHLPENVDLAEVAPILCAGVTVYKALKRANLIPGQWVTISGACGGLGSLAIQYATAMGYRVIGIDEGETKKQLFEGLGGEVFIDFTKEKDIVGAVIKATDGGSHGVINVSVSEAAIEASTRYCRPNGTVVLVGMPAHAYCKSDVFNQVVKSISIVGSCVGNRADTREALDFFARGLIKSPIHLASLSDVPEIFEKMEKGEIVGRYVIDTSK

SEQ ID NO: 84846 - DNA, 1047 bp, Saccharomyces bayanus
  CDS (1)..(1047)
atgtctattccaaaaactcaaaaaggtgttattttctacgaatccaacggtaagttggaacataaggacatcccggtcccaacgccaaagccaaacgagctgttgatcaacgtcaagtactctggtgtgtgtcacaccgacttgcacgcttggcacggtgactggccattggccaccaagttgccattggtgggtggccacgaaggtgccggtgttgttgttgccatgggggagaacgtgagaggctggaaggtcggcgatcttgccggtatcaagtggttgaacagttcctgtatggcgtgcgaatactgtgaattgggtaacgagtccaactgtcctcacgcggacttgtctggttacacccacgacggttctttccaacaatacgctaccgccgacgccgtgcaagccgttcacattcctgaagggacggatctggctgaagtcgccccaatcctatgtgccggtattacggtctacaaggctttgaagtccgccaacttgagggctggccactgggtggccatctctggtgctgctggtggtctaggttccttggctgtccagtacgccaaggccatgggttacagagtcgtgggtatcgatggtggtcccgggaaagaagaattgttcacatcgcttggtggtgaggttttcatcgacttcacgaaagaaaaggacattgttggtgctgtcatcaaggccaccgacggcggtgctcacggtattgtcaacgtctccgtttccgaggccgctatcgaagcttccaccagatactgtagagccaacggtaccgtcgtcttggtcggtttgccagccggtgccaaatgtacttccgacgttttcaaccacgtcgtcaagtccatctccattgtcggatcctacgtcggtaacagagccgacaccagagaagccttggacttcttcgccagagggctggtcaagtctccaatcaaggttgtcggattgtctcatttaccagaaatttacgaaaagatggaaaagggccaaatcgctggtagatacgttgtcgacacttataaataa

SEQ ID NO: 84847 - protein, 348 aa, Saccharomyces bayanus
MSIPKTQKGVIFYESNGKLEHKDIPVPTPKPNELLINVKYSGVCHTDLHAWHGDWPLATKLPLVGGHEGAGVVVAMGENVRGWKVGDLAGIKWLNSSCMACEYCELGNESNCPHADLSGYTHDGSFQQYATADAVQAVHIPEGTDLAEVAPILCAGITVYKALKSANLRAGHWVAISGAAGGLGSLAVQYAKAMGYRVVGIDGGPGKEELFTSLGGEVFIDFTKEKDIVGAVIKATDGGAHGIVNVSVSEAAIEASTRYCRANGTVVLVGLPAGAKCTSDVFNHVVKSISIVGSYVGNRADTREALDFFARGLVKSPIKVVGLSHLPEIYEKMEKGQIAGRYVVDTYK

SEQ ID NO: 84848 - DNA, 1008 bp, Dictyostelium discoideum
  CDS (1)..(1008)
atgaaagcagctgtttttaaacaaataggtggggatttagagattgttgaagttccagtaccagaaccaaaacaaggttgggttagaatcaaagttcattcatgtggtgtatgtcacagtgataatgcttgcaaatatggaaattttggaaattcatatccacgtattccaggtcatgaagtatttggtgaaattgaaaaattgggtgaaggtgttgatccaaattatttcaaaattggtaaattagttggtgttggttggtttggtggtaatcattgtggtaaatgtagagaatgtttaaatgatcaatggatattttgtaaggaatcattaatttgtggtattcattatgatggtggatatgctgaatatatggttgcaccatcagattcattagcatttgtaccagaaggaatgaatgctgaggaaactgcaccattattatgtgctggtattactgtattcaattcatttagaaatcaaaatatcaaagttggttcattggttggtgttcaaggtttaggtggtcttggtcatttagcaattcaattttgcaagaaaatgggttatgaagttattgcaatgtcaagtggtgatcaaaaagagaaattagcaaaagaattaggtgcagctcattatgttaatatttcaaaagatggttggattgatcaaatgaaggcaattggttcagttcaatgtattttattaactgctccatcttcatcaattgttcaatcatctttggatgctttaggtgtgaatggaaagttagtacttttagctcttttaccagaaccattcaatgcaaattctctaactttaattggtggtaataaatcaattattggttggtcttcaggtgattctcgtgatacagaacaaacattgaactttgcaaataaaaatcaagtaaaagcaatggttaaaactttcccattggaaaatgttaatgaagctttacttaaaattgctgatgctagatttagacatgtagtaaagattttataa

SEQ ID NO: 84849 - protein, 335 aa, Dictyostelium discoideum
MKAAVFKQIGGDLEIVEVPVPEPKQGWVRIKVHSCGVCHSDNACKYGNFGNSYPRIPGHEVFGEIEKLGEGVDPNYFKIGKLVGVGWFGGNHCGKCRECLNDQWIFCKESLICGIHYDGGYAEYMVAPSDSLAFVPEGMNAEETAPLLCAGITVFNSFRNQNIKVGSLVGVQGLGGLGHLAIQFCKKMGYEVIAMSSGDQKEKLAKELGAAHYVNISKDGWIDQMKAIGSVQCILLTAPSSSIVQSSLDALGVNGKLVLLALLPEPFNANSLTLIGGNKSIIGWSSGDSRDTEQTLNFANKNQVKAMVKTFPLENVNEALLKIADARFRHVVKIL

SEQ ID NO: 84850 - DNA, 1116 bp, Candida boidinii
  CDS (1)..(1116)
atgctttctcaagttttcagaagatcaatgatcaacagatcatccttaatgacccgtttccaatccactttcaccatcccagaaaaacaaatgggtgttatttttgaaaccaacggtggtccattagaatataaggaaattccagttccaaaaccaaagccaactgaaattttaattaacgttaaatactctggtgtttgtcacactgatttacacgcctggaagggtgactggccattaccagttaaattaccattagttggtggtcacgaaggtgccggtgttgttgttgccaagggtgaatccgttaccaatttcgaaattggtgacttagccggtattaaatggttaaacggttcttgtatgtcctgtgaattctgtgaagaaggtaacgaatctaactgtttagatgctgatttatccggttacactcacgacggttctttccaacaatatgctactgctgatgctatccaagctgctaagatcccagaaggtactgacttagctgaagttgctccaatcttatgtgctggtgttaccgtctacaaggctttaaagactgctgacttagctgctggtcaatgggttgccatttctggtgctgctggtggtttaggttcattagctgttcaatacgccaaggctatgggtttaagagtcttaggtattgatggtggtgctgctaagaaagaattatttcactctatgggtggtgatgtcttcattgatttcaaagaagaaaaagatattgttaaagctatccaagatgctaccaacggtggtccacatggtgttattaacgtttctgtctctgaagctgctatctctcaatcttgtgattacgttagaccaactggtaaagttgtcttagttggtttaccagccggtgctgtttgtaaatcaccagttttccaacacgttgttaaatctcttgaaatcaagggttcttacgttggtaacagagctgataccagagaagctttagaattcttctccagaggtcaagttaaatctccaatcaagattgttggtttatctgaattaccaatggtttacggtttaatggaaaagggtgctatcttgggtagatacgttgttgatacttcttactaa

SEQ ID NO: 84851 - protein, 371 aa, Candida boidinii
MLSQVFRRSMINRSSLMTRFQSTFTIPEKQMGVIFETNGGPLEYKEIPVPKPKPTEILINVKYSGVCHTDLHAWKGDWPLPVKLPLVGGHEGAGVVVAKGESVTNFEIGDLAGIKWLNGSCMSCEFCEEGNESNCLDADLSGYTHDGSFQQYATADAIQAAKIPEGTDLAEVAPILCAGVTVYKALKTADLAAGQWVAISGAAGGLGSLAVQYAKAMGLRVLGIDGGAAKKELFHSMGGDVFIDFKEEKDIVKAIQDATNGGPHGVINVSVSEAAISQSCDYVRPTGKVVLVGLPAGAVCKSPVFQHVVKSLEIKGSYVGNRADTREALEFFSRGQVKSPIKIVGLSELPMVYGLMEKGAILGRYVVDTSY

SEQ ID NO: 84852 - DNA, 1083 bp, Camptotheca acuminata
  CDS (1)..(1083)
atggcgaaatcaccagcggaagagcacccagtgaaggctttcggatgggcagctagcgacacatctggtgttctttctcccttgacattctcgagaagggcgaccggcgagaaagacgtgaagttcaaagtgatgtattgtggaatctgtcactctgatcttcactgtctcaggaacgaatggggctctactatctatcccatcatacccgggcatgagattgcaggcatagttacagaggtgggcagcaaggtagagaagtttaaagtaggggacaaggttggtgtgggttgcatggttggatcatgtcgttcatgcaatgattgtgacaacaatattgagaattattgtccaaaaatgatgttcacatacagttccatctatcatgatggaactgttacatatggaggttactctgatattatggttaccgatgagcactttgttgttcgttggcccgataacttgcctctggattctggtgctcctctactgtgtgctgggatcacaacttatagtcccctgagatattatgggcttgacaagcctggaatgaatttgggtgtggtgggtctaggtggtcttgggcatgtagctgtgaaatttgctaaggctcttggggtcaaggtgaccgtgatcagtacatcgctcaacaagaaggaggaagcgattgaacgactaggtgctgattcatttttggtcagccgtgacccggatcagatgcaggccgccgcaggcacattagatggtatccttgatactgtctctgcaactcatcctctccttccattgcttggtctgatcaaatctcatggaaagcttgtgctggttggtgcaccagagaagccacttgagcttccagtcatgcctttgcttatggggaggaagatagttggtgggagtaacatgggagggatgaaggagacacaagaaatgcttgattttgcagcaaaacacaatattacagcagatgttgaagtggttccgatggactatgtaaacactgctatgaagcgtctagaaaaaggtgatgttagatatcgatttgtccttgacattgctaacacattgaaggctacctag

SEQ ID NO: 84853 - protein, 360 aa, Camptotheca acuminata
MAKSPAEEHPVKAFGWAASDTSGVLSPLTFSRRATGEKDVKFKVMYCGICHSDLHCLRNEWGSTIYPIIPGHEIAGIVTEVGSKVEKFKVGDKVGVGCMVGSCRSCNDCDNNIENYCPKMMFTYSSIYHDGTVTYGGYSDIMVTDEHFVVRWPDNLPLDSGAPLLCAGITTYSPLRYYGLDKPGMNLGVVGLGGLGHVAVKFAKALGVKVTVISTSLNKKEEAIERLGADSFLVSRDPDQMQAAAGTLDGILDTVSATHPLLPLLGLIKSHGKLVLVGAPEKPLELPVMPLLMGRKIVGGSNMGGMKETQEMLDFAAKHNITADVEVVPMDYVNTAMKRLEKGDVRYRFVLDIANTLKAT

SEQ ID NO: 84854 - DNA, 1023 bp, Dictyostelium discoideum
  CDS (1)..(1023)
atgacaaaaacaacaatgaaagcagcagcatttacacagaagaatggtaaaatagagattattgagttaccaatcccagaaccaactcaaggttggattagaattaaagttcacgcctgtggtgtttgtcaaggtgaaaatgtttgtaaacatggtgtaatgggtaattcatttccaagagttccaggacatgaggttgtaggtgaaattgataaattaggagaaggtgtttgtaatgaagaatataaaattggtgaatttgtaggtgttggttggtttggtggtaatcaatgtggtaaatgtgaaacatgtttagagaatgaatggaaacattgtaagaaagtaaacacttgtggtgttacttatgatggtggttatgcagagtatatgattgcaccaattagtgcacttgttaaaataccaaaaggaatggacccacttgaagctgcaccattgttatgtgcaggtgtaacagtttataattcatttagacatcaagacattaaagtaggttcattggttggtgttacaggtattggtggtttaggtcattatgcaattcaattctgtaagaaaatgggttaccaagtgattgcaatgtcaagtggtaattcaaaagaacaactctcaaaagaattgggtgcagattattatgttgatatgtcaaaggataattacattcaagagattcaatcaattggttcagttaaatgtattttagcaactgcaccaattgcatcaactgttcaaggtttattagagtctttaggtataaatggtaaattggtgattttggctgctttccatgaaccattccatgcagattcattgacaatgattggtggttctaaatcaatcgttggttgggcttctggtgataatcgtgattctcttgatactttaaattttgctcgtaataataatattaaatcattagtaaatactttcccattggaaaaagcaaatgaagcttttgaaaatattggtcaagcaaaatttagacatgttattaaattattataa

SEQ ID NO: 84855 - protein, 340 aa, Dictyostelium discoideum
MTKTTMKAAAFTQKNGKIEIIELPIPEPTQGWIRIKVHACGVCQGENVCKHGVMGNSFPRVPGHEVVGEIDKLGEGVCNEEYKIGEFVGVGWFGGNQCGKCETCLENEWKHCKKVNTCGVTYDGGYAEYMIAPISALVKIPKGMDPLEAAPLLCAGVTVYNSFRHQDIKVGSLVGVTGIGGLGHYAIQFCKKMGYQVIAMSSGNSKEQLSKELGADYYVDMSKDNYIQEIQSIGSVKCILATAPIASTVQGLLESLGINGKLVILAAFHEPFHADSLTMIGGSKSIVGWASGDNRDSLDTLNFARNNNIKSLVNTFPLEKANEAFENIGQAKFRHVIKLL

SEQ ID NO: 84856 - DNA, 963 bp, Dictyostelium discoideum
  CDS (1)..(963)
atggaagatagaaaaacaatgagcgctggagtttttaaaaaagtaggtgggaatttagaaatagttaaaatgtcaataccaaaaccaaaacaaggtattttgaaaaatgaatatccaagagtttcaggtcatgaagtattaggtgaaattgaaaaattaggtgatggtgttgatccaattaaatttaaaattggtcatttggttggagttggttggaatggtggtaatcattgtggtagttgtagagaatgtttaaataataatcgtttattttgtaaaaattcattaattactggtattagtattgatggtggatatgctgaatatattgtagtaccatcagatgcattggcattcataccagaaggaatgaatgctgaagaaactgcaccattattatgtgctggtgtaacagtgtactgttcattaaaaaaccaaaattttaaaaaaggttcattagttggtgttttaggtattggtggtcttggtcatttggcaattcaattttgtaagaaaatgggttatgaagttattgccatgtcaaggggaaattcaaaagagaaaacatctagagaattaggagcttcacattttgtagacattgcaaaggaaggatgggttgaacaaatgaaacaaattggctcagttgaatgtatactattaacagcaccatttcctcatttggttcaaccttctttggaagctttgggtgtaaatggaaagttattgcttctttgtatcattccagaaccattttttgctgattctctaactatgattttgggtaataaatcaattgttagctggtatgttggtaattcaaatgatatccaagatactttagattttgcacacaaaaatcatataaaacctattatccaaacttttccattacaagctgttaatgaagttttagataagataaatgaagctaattttagaagtgtgattaaaattttataa

SEQ ID NO: 84857 - protein, 320 aa, Dictyostelium discoideum
MEDRKTMSAGVFKKVGGNLEIVKMSIPKPKQGILKNEYPRVSGHEVLGEIEKLGDGVDPIKFKIGHLVGVGWNGGNHCGSCRECLNNNRLFCKNSLITGISIDGGYAEYIVVPSDALAFIPEGMNAEETAPLLCAGVTVYCSLKNQNFKKGSLVGVLGIGGLGHLAIQFCKKMGYEVIAMSRGNSKEKTSRELGASHFVDIAKEGWVEQMKQIGSVECILLTAPFPHLVQPSLEALGVNGKLLLLCIIPEPFFADSLTMILGNKSIVSWYVGNSNDIQDTLDFAHKNHIKPIIQTFPLQAVNEVLDKINEANFRSVIKIL

SEQ ID NO: 84858 - DNA, 1017 bp, Moraxella sp
  CDS (1)..(1017): transl_table=11
atgaaagcggctgtattacatgaatttggtcagtctctgcagattgaagaagttgatatcccaacgccaggtgctggcgagatagtggtcaagatgcaagcgtcaggcgtttgtcatactgacttacatgccgttgaaggagactggccggtaaaacctagcccacccttcatccctggacatgaaggcgtaggcctgataacagctgttggcgaaggcgtcacccatgtcaaagaaggcgaccgcgttggtgttgcttggctgtactccgcctgtggtcactgtacgcattgtttaggtggttgggagaccttatgcgagagtcaacaaaactctggatattcagttaacggcagttttgcagaatacgttctagccaatgctaactatgtcggaattatccctgaaagcgttgactctatcgagattgcacccgttttatgtgcaggtgtcactgtatataaaggtcttaaaatgaccgacaccaagccaggcgattgggtcgtcatttcaggcatcggcggactgggtcatatggcagttcaatatgccattgcgatgggtcttaacgttgctgctgtcgatattgatgatgacaagcttgcgtttgctaaaaaactgggcgcaaaagtcactgttaatgcgaaaaacactgaccctgctgaatatctgcaaaaagaaatcggcggtgctcatggtgcactagtgacagcagtatcggcaaaagcttttgatcaagcattaagcatgttacgacgcggtggtactttagtatgtaatggtctaccgcctggcgatttccccgtttcaatcttcgatacagtattgaacggtattaccattcgtggctcgatcgttggtacacgtctcgacttacaagagtcgctagatatggcagcagcaggcaaagtaaaagccactgtcaccgctgagccgttagagaatatcaatgacatctttgagcgtatgcgtcaaggcaaaatcgaaggtcgcattgtcattgactacactatgtag

SEQ ID NO: 84859 - protein, 338 aa, Moraxella sp
MKAAVLHEFGQSLQIEEVDIPTPGAGEIVVKMQASGVCHTDLHAVEGDWPVKPSPPFIPGHEGVGLITAVGEGVTHVKEGDRVGVAWLYSACGHCTHCLGGWETLCESQQNSGYSVNGSFAEYVLANANYVGIIPESVDSIEIAPVLCAGVTVYKGLKMTDTKPGDWVVISGIGGLGHMAVQYAIAMGLNVAAVDIDDDKLAFAKKLGAKVTVNAKNTDPAEYLQKEIGGAHGALVTAVSAKAFDQALSMLRRGGTLVCNGLPPGDFPVSIFDTVLNGITIRGSIVGTRLDLQESLDMAAAGKVKATVTAEPLENINDIFERMRQGKIEGRIVIDYTM

SEQ ID NO: 84860 - DNA, 1080 bp, Solanum tuberosum
  CDS (1)..(1080)
atggcaaaatcatctgaaaatgaacatccaattaaggcatttggatgggcaactagacacacttctggagttctttctcctttcaatttttcaagaagggtgacaggtgaaaaacatgtgcaatttaaagttatgtattgtggaatttgtcattctgatcttcatcaactcaagaatgaatggggaaataccaagtacccgatggtgcctgggcatgaggttgttggtgttgtaattgaggttggaagcaaggtggagaaatttaaggttggagacaaagtaggtgttggatgtatggtaggatcatgtcgaaaatgtgagaattgtaccgtggatctcgagaattactgccctcgtcagattcctacttacaatggctatagcttagacggaaccctcacgtttggaggttactctgacatgatggtatccgatgagcattttgtagtacgttggcctgaaaacttgtcgatggacgctgctcccctgttatgtgctggaattactacttatagtcctttgaaatattttggactcgataagcctggaatgcacattggtgttgttggtcttggagggctcggacatatggctgttaagtttgctaaggcattcggaaccaaagtgactgtcattagtacatctgcaaataagaagcaagaagcaattgagcgtttaggcgcagactctttcttgatcagtcgcgatcctgagcagatgaaggctgcaatgaacacattggatgggattatcgacactgtttcggcggtgcaccctattcttccattgcttatgttgatgaaatctcatggtaagctagttatggttggtgcaccagaaaaaccggtggagttgcccgtgtttcctctacttatgggaaggaagctagtggctggaagttgcataggagggatgaaagagactcaagaaatgttggacttcgcagcaaagcataacataacaccagatattgaagttgtgcctatggactatgtgaacacagcgttggaacgtcttctgaaatcggacgtgaagtatcgtttcgtgctcgacattggcaatacattaaacaagaaatga

SEQ ID NO: 84861 - protein, 359 aa, Solanum tuberosum
MAKSSENEHPIKAFGWATRHTSGVLSPFNFSRRVTGEKHVQFKVMYCGICHSDLHQLKNEWGNTKYPMVPGHEVVGVVIEVGSKVEKFKVGDKVGVGCMVGSCRKCENCTVDLENYCPRQIPTYNGYSLDGTLTFGGYSDMMVSDEHFVVRWPENLSMDAAPLLCAGITTYSPLKYFGLDKPGMHIGVVGLGGLGHMAVKFAKAFGTKVTVISTSANKKQEAIERLGADSFLISRDPEQMKAAMNTLDGIIDTVSAVHPILPLLMLMKSHGKLVMVGAPEKPVELPVFPLLMGRKLVAGSCIGGMKETQEMLDFAAKHNITPDIEVVPMDYVNTALERLLKSDVKYRFVLDIGNTLNKK

SEQ ID NO: 84862 - DNA, 1050 bp, Myxococcus xanthus
  CDS (1)..(1050): transl_table=11
atgattcccgttcgcggctatgccgcccaggacgccaagtcccccctcgccccgttccagttcgagcgccgcgagcccggccccagcgacgtgcagattgaaatcctctactgcggcgtctgccactccgacctgcaccaggtgcgcgacgaatggggcggctcccggttccccatggtcccaggccacgaaatcatcggccgcgtggtccgcgtgggggaccaggtgaagaaggtcaaggtcggggacatggccggcgtcggctgcatggtcgactcctgccgcacctgccccagttgccaggagggcctggagcagtactgcgagaagggcaacgtccagacgtacaacggcaaggagaaggacgggcagacagcgacccagggcggctacagcgaggccatcgtcgtggacgaggccttcacgctgaagattccggagaacctggacccggccgccgccgcgccgctgctgtgcgccggcatcaccacatactcgccgctgcggcactggaaggtgcagccgggtcagcgcgtgggcgtggtgggcctgggcggactgggccacatgggcgtgaagctggccaaggccatgggcgcccacgtcaccgtcttcagccacaccgacagcaagaagcaggacgccacgcgcctgggcgccgacgccgtcgtggtctcctcgaacaaggaggagatggccgcgcagacgggtgggttcgacttcatcctcgacaccgtctccgcgcagcacgacatcaacgcgtacctgcggctgctgcgacgggacgggcacctggtcctcgtcggcgccccggagaagcctctcgacgtccgccccttctccctcatccccacgcggcggagcttctcgggctcgatgattgggggtatccaggaaacgcaggaaatgctagacttctgcggcaagcacaacatcgtctccgacatcgagctgatttccatccagcaggtgaacgacgcctacgagcggctgctgaagggagacgtgaagtaccggttcgtcatcgacctcgcgagtctgcggaagtag

SEQ ID NO: 84863 - protein, 349 aa, Myxococcus xanthus
MIPVRGYAAQDAKSPLAPFQFERREPGPSDVQIEILYCGVCHSDLHQVRDEWGGSRFPMVPGHEIIGRVVRVGDQVKKVKVGDMAGVGCMVDSCRTCPSCQEGLEQYCEKGNVQTYNGKEKDGQTATQGGYSEAIVVDEAFTLKIPENLDPAAAAPLLCAGITTYSPLRHWKVQPGQRVGVVGLGGLGHMGVKLAKAMGAHVTVFSHTDSKKQDATRLGADAVVVSSNKEEMAAQTGGFDFILDTVSAQHDINAYLRLLRRDGHLVLVGAPEKPLDVRPFSLIPTRRSFSGSMIGGIQETQEMLDFCGKHNIVSDIELISIQQVNDAYERLLKGDVKYRFVIDLASLRK

SEQ ID NO: 84864 - DNA, 1089 bp, Populus tremula x Populus tremuloides
  CDS (1)..(1089)
atgtctagatcaccagaagaagaacatcaacataaggcttttggctggactgccaaagatagttctggggtcctttctccctttcatttctcaagaagggacaatggagttgaagatgtgaccataaaaatcctgtactgtggagtttgccattctgacttgcacgccgccaagaatgaatgggggttttccagatatcctttggttcctgggcatgaaattgttggtattgtgacaaaaattggaagcaatgtgaagaagttcaaagtggacgatcaggttggtgttggcgtaatggtgaactcctgtaagtcatgcgagtattgcgaccaggactcggagaattactgccctaaaatgatatttacttacaatgcccaaaactatgatgggacaaaaacttatggtggttattctgatacaattgtggttgaccagcactttgtgctccatattcctgatagcatgcctgctgatggggctgcaccgctattatgtgctgggatcacagtgtacagcccaatgaaatattatggaatgactgaaccagggaagcatttgggaatcgtaggattgggggggcttggtcatgttgctgtgaagattggtaaggcctttggtttgaaagttacagtcatcagttcatcatcaagaaaggagagggaagcacttgatagacttggtgctgattcattccttgtgagcagtgaccctgagaaaatgaaggcagcatttggcactatggattacatcattgacaccgtgtctgcagttcatgctttggctccccttctaagtctgctgaagacaaatggaaaacttgttactttgggcttgcctgagaagccccttgagctgcctatcttccctttggtcttggggcgaaagctagttggtggaagtgatattggagggatgaaagagactcaagagatgttggacttctgtgcgaagcacaatattatcgcagatgttgaggtgatccgaatggatcaaatcaacacagccatggataggcttgcgaaatcggatgtcaggtaccggtttgtgattgatgtggccaactccctgtcacaatctcagttatga

SEQ ID NO: 84865 - protein, 362 aa, Populus tremula x Populus tremuloides
MSRSPEEEHQHKAFGWTAKDSSGVLSPFHFSRRDNGVEDVTIKILYCGVCHSDLHAAKNEWGFSRYPLVPGHEIVGIVTKIGSNVKKFKVDDQVGVGVMVNSCKSCEYCDQDSENYCPKMIFTYNAQNYDGTKTYGGYSDTIVVDQHFVLHIPDSMPADGAAPLLCAGITVYSPMKYYGMTEPGKHLGIVGLGGLGHVAVKIGKAFGLKVTVISSSSRKEREALDRLGADSFLVSSDPEKMKAAFGTMDYIIDTVSAVHALAPLLSLLKTNGKLVTLGLPEKPLELPIFPLVLGRKLVGGSDIGGMKETQEMLDFCAKHNIIADVEVIRMDQINTAMDRLAKSDVRYRFVIDVANSLSQSQL

SEQ ID NO: 84866 - DNA, 1098 bp, Arabidopsis thaliana
  CDS (1)..(1098): r means g or a
atgggaagtgtagaagcaggagaaaagaaggctttaggatgggctgcaagagatccttctggtgttctctctccttactcctacactttaaggagcacaggagcagatgatgtgtatataaaggttatatgctgtggaatatgccatactgatattcaccaaattaaaaatgatcttggaatgtctaattatcctatggttcctgggcacgaggtagtaggtgaggtgttggaagtgggatcagatgtgagcaagttcaccgtaggagatgtagtcggagtcggcgtggtcgttggatgctgcggtagctgcaaaccatgcagctcagaacttgagcagtattgtaacaagagaatctggagttacaacgatgtctacaccgatggaaaacctactcaaggtggcttcgccgacaccatgatcgtcaatcaaaagtttgtggtgaagattccagaaggaatggcggtggagcaggctgcaccgctactctgcgcgggagtaacggtttatagtccgttgagccacttcggtctaatggcgagtgggcttaaaggagggattctagggttaggtggagtagggcacatgggtgtgaagatagctaaagcaatgggacaccatgtgactgtgataagctcatcagataagaaaaaagaagaagctatcgaacatttaggagctgacgactatgtggtgagctctgatccagcagagatgcaaagactcgcagattcccttgactacatcattgrcaccgtaccggtgtttcaccctctcgacccttacttggcttgtcttaaactcgacgggaaattgattctcatgggtgttatcaacactcctcttcagttcgtgacccctctcgtcattcttgggaggaaagtgatatcagggagctttatagggagcattaaagagacagaagaagtgttggctttctgcaaagagaaagggcttacgtcgacgattgaaactgtgaagatcgatgagcttaacattgcgtttgagaggcttcgcaagaacgatgttcgttacagatttgtggttgatgttgcaggaagtaatctggtggaggaggctgcaacaactacaaactaa

SEQ ID NO: 84867 - protein, 365 aa, Arabidopsis thaliana
  misc_feature (251)..(251): Xaa can be Gly or Asp
MGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAIEHLGADDYVVSSDPAEMQRLADSLDYIIXTVPVFHPLDPYLACLKLDGKLILMGVINTPLQFVTPLVILGRKVISGSFIGSIKETEEVLAFCKEKGLTSTIETVKIDELNIAFERLRKNDVRYRFVVDVAGSNLVEEAATTTN

SEQ ID NO: 84868 - DNA, 1083 bp, Arabidopsis thaliana
  CDS (1)..(1083)
atggcgaaatctccagaaacagagcatccgaacaaagtctttggttggggtgctagagacaaatccggtgttctctctccttttcacttctctagaagagacaatggtgaaaatgatgtgacagtgaagatcttgttctgtggagtttgccacactgatttacacaccatcaaaaacgactggggatactcgtattacccagtagttccagggcatgaaatcgttgggatcgctacaaaagttggtaagaacgtgactaaattcaaagaaggagatcgtgtcggagtaggagtgatcagtggctcgtgccaatcttgcgaatcttgtgaccaagatcttgaaaactactgtcctcaaatgtctttcacatacaatgcgattggatccgatggaaccaagaattacggtggctattcggagaacattgtggttgatcaacggtttgttttgcggtttccggagaatttaccgagcgattcgggtgcgccgttgctgtgtgctggaatcactgtgtatagtccaatgaagtattatggtatgactgaggcagggaagcatttaggggttgctggacttggtgggcttggtcatgttgctgttaagattggtaaagcttttggtttgaaagttactgtcattagttcttcttctacgaaagcagaggaagccattaatcatcttggtgctgattcgtttcttgtcacaactgatcctcagaaaatgaaggctgcaattggaacaatggactacattatcgatacgatatcagcagtacatgctctgtatccgttgctcggtttactcaaagtcaacggaaagctcattgctttaggcttacctgagaagcctctcgagctaccaatgttccctcttgttctcggaaggaaaatggttggaggaagtgacgtgggagggatgaaggagacacaagagatgcttgatttctgcgctaagcacaacattacagctgatattgaattgattaagatggatgagattaacactgcgatggagaggcttgctaagtctgatgttaggtacaggttcgtgatcaacgtggctaactccttgagccctccatga

SEQ ID NO: 84869 - protein, 360 aa, Arabidopsis thaliana
MAKSPETEHPNKVFGWGARDKSGVLSPFHFSRRDNGENDVTVKILFCGVCHTDLHTIKNDWGYSYYPVVPGHEIVGIATKVGKNVTKFKEGDRVGVGVISGSCQSCESCDQDLENYCPQMSFTYNAIGSDGTKNYGGYSENIVVDQRFVLRFPENLPSDSGAPLLCAGITVYSPMKYYGMTEAGKHLGVAGLGGLGHVAVKIGKAFGLKVTVISSSSTKAEEAINHLGADSFLVTTDPQKMKAAIGTMDYIIDTISAVHALYPLLGLLKVNGKLIALGLPEKPLELPMFPLVLGRKMVGGSDVGGMKETQEMLDFCAKHNITADIELIKMDEINTAMERLAKSDVRYRFVINVANSLSPP

SEQ ID NO: 84870 - DNA, 1224 bp, Lolium perenne
  CDS (1)..(1224)
atggcggaaggcttgccggcgctcggttgggctgcgagggacgcctccggtcacctctccccttacagcttctcgagaagcgttccgaaggacgacgatgtgacgatcaaggtgctcttctgcgggatctgccacactgacctccacatcatcaagaacgactggggcaacgccctctaccccatcgtcccagggcatgagatcgtgggcgtcgtcgccagcgtcggcagcggcgtcagcagcttcaaggccggcgacacggtgggcgtgggctacttcctcgactcctgccgcacctgctacagctgcagcaaggggtacgagaacttctgccccaccctgacgctcacctccaacggcgtcgacggcggcggcgccaccacccagggcggcttctccgacgtcctcgtcgtcaacaaggactacgtcatccgcgtcccggacaacctgcccctggccggcgcggcacctctcctctgcgccggcgtcacagtctacagccctatggtggagtacggcctcaacgcccccgggaagcacctcggcgtcgtcggcctgggcgggctcggccacgtcgccgtcaagttcggcaaggccttcgggatgaccgtcaccgtcatcagctcctcggacaggaagcgcgacgaggcgctcggccgcctcggcgccgacgccttcctcgtcagcagcgaccccgagcagatgaaggcggcggcgggcaccatggacggcatcatcgacacggtgtccgcgggccacccgatcgtgccgctgctcgacctgctcaagcccatggggcagatggtcgtggtgggcgcgcccagcaagccgctcgagctcccggccttcgccatcatcggcggcggcaagcgcctcgccgggagcggcaccggcagcgtcgcacactgccaggccatgctcgacttcgcgggcaagcacggcatcaccgccgacgtcgaggtcgtcaagatggactacggtcaacaccgccatcgagcggctagagaagaacgacgtcaggtaccgcttcgtcatcgacgtcgccggcagccacctgcagggcaccgccgcttaacttgtgctacacaatgtggacgcgcgctcgtttggtccagaaaaaggttcgccggctcacagccacatgaacaagtcaatgagtcgttggtgtgttgtttatcttcattccacatatgggacgcagttccagattttcatgtcaaataa

SEQ ID NO: 84871 - protein, 407 aa, Lolium perenne
MAEGLPALGWAARDASGHLSPYSFSRSVPKDDDVTIKVLFCGICHTDLHIIKNDWGNALYPIVPGHEIVGVVASVGSGVSSFKAGDTVGVGYFLDSCRTCYSCSKGYENFCPTLTLTSNGVDGGGATTQGGFSDVLVVNKDYVIRVPDNLPLAGAAPLLCAGVTVYSPMVEYGLNAPGKHLGVVGLGGLGHVAVKFGKAFGMTVTVISSSDRKRDEALGRLGADAFLVSSDPEQMKAAAGTMDGIIDTVSAGHPIVPLLDLLKPMGQMVVVGAPSKPLELPAFAIIGGGKRLAGSGTGSVAHCQAMLDFAGKHGITADVEVVKMDYGQHRHRAAREERRQVPLRHRRRRQPPAGHRRLTCATQCGRALVWSRKRFAGSQPHEQVNESLVCCLSSFHIWDAVPDFHVK

SEQ ID NO: 84872 - DNA, 1104 bp, Monascus anka
  CDS (1)..(1104)
atggctgaacctcaaatcccaaccaagcagaaagctgcgatctatgataaaccgggtacggtctccaccaaagttgtggagatagatgtgcctgaacccggaccgggagaagttcttgtcaatttgactcactcgggtatatgccactcggattatggtgtcatgacaaactcttggaaactgctcccctacccaacccagcccggacagattggcggccatgaaggagtcggaaaggtagtcaagttcggccctggagccaatggaaccgggttgaagattggcgatagggtaggaatcaaatgggtgtccagtgcatgcgggaactgtcacccatgccacgcaggcgcagacggaatctgcctcaaccagaaaatctccggctactacaccccgggcacattccaacaatacgcgacaggcccagctaactacgtaaccccgatccccgaaaacctctcttcggccgaggccgcgccccttctctgcgccggcgtcaccgtctacgcagccctgaaacgcagcaaagcccaaccaggccagtggattgtgatttccggcgcagacggcggcctgggccacctagccgtccaaatagccagtcgaggcatgggcctgcgcgtgatcggcatcgaccacggcagtaaagcagccctcgttaaggaatcaggtgcggagcatttcgtcgatatcaccgcattcccgaaagacgacaatggcgctgccatcgcggcacacgtgaagtccctcacgacagagaagttgggggcccacgccgttatcgtctgcacggcgtcaaacgcggcgtacgcgcaggcatttctcttcctgcgcttcaatggtacgctggtctgtgtggggatgccggaacatgagtcccaggctattgctacggcatatccggctgccatcgttttcaaccaggctactattaccggttcggcagtggggaatcggatagaggcgattgaggtgctagattttgccgctaggggtattatcaaatctcatgttaggatggctaagttggaggatttgacagatttgtttaatgagatggcagagggaaagttgcaggggagagtggtcttggatctttcttag

SEQ ID NO: 84873 - protein, 367 aa, Monascus anka
MAEPQIPTKQKAAIYDKPGTVSTKVVEIDVPEPGPGEVLVNLTHSGICHSDYGVMTNSWKLLPYPTQPGQIGGHEGVGKVVKFGPGANGTGLKIGDRVGIKWVSSACGNCHPCHAGADGICLNQKISGYYTPGTFQQYATGPANYVTPIPENLSSAEAAPLLCAGVTVYAALKRSKAQPGQWIVISGADGGLGHLAVQIASRGMGLRVIGIDHGSKAALVKESGAEHFVDITAFPKDDNGAAIAAHVKSLTTEKLGAHAVIVCTASNAAYAQAFLFLRFNGTLVCVGMPEHESQAIATAYPAAIVFNQATITGSAVGNRIEAIEVLDFAARGIIKSHVRMAKLEDLTDLFNEMAEGKLQGRVVLDLS

SEQ ID NO: 84874 - DNA, 1020 bp, Agrobacterium tumefaciens
  CDS (1)..(1020): n means a or g or c or t/u
atggccaaaaccatgaaggcagcggtngtncgcgcatttggcaaaccgctgaccatcgaggaagtggcgataccggatcccggcccggctgaaattctcatcaattacaaggcgaccggcatttgccacacggacctgcacgccgcaacgggcgactggccggtcaaacccaatccaccattcatccccggccatgaaggcgtcggctacgtcgccaagatcggcgctggcgtgaccggcatcaaggaaggcgaccgcgccggcacgccgtggctttataccgcctgcggatgctgcattccgtgccgtaccggctgggaaactctttgcccaagtcagaagaactcgggttattccgtcaatggcagctttgcagaatacgggcttgctgatccgaaattcgttggccgacttcccgacaatctggaattcggccccgctgcacccgtgctctgcgccggtgtcaccgtctacaagggtctcaaggaaaccgaagtgaggcccggcgaatgggtggtcatatcgggcattggcgggcttggtcatatggccgtgcaatatgccaaggccatgggcatgcatgtcgttgccgccgatatttatgacgacaagctggagcttgcgaaaaagctgggcgcggatttcaccgtcaacggtcgggcgccggatgcggtggaacaggtgcagaaggcgaccggcggcgtccacggcgcgctcgtgacggcggtttcgccaaaagccatggagcaggcctacggtttcctgcgctccaagggcacgatggcacttgttggcctgccgccgggcttcatctccattccggttttcgaaacggtgctgaagcgcatcacggtgcgtggttccatcgtcggcacaaggcaggatctggaggaggcgctttccttcgctggtgaaggcaaggtagccgctcacttctcctgggacaaactcgaaaacatcaacgacatcttccgtcgcatggaagagggcaagatcgacggccgtatcgttctcgantga

SEQ ID NO: 84875 - protein, 339 aa, Agrobacterium tumefaciens
  misc_feature (339)..(339): Xaa can be Asp or Glu
MAKTMKAAVVRAFGKPLTIEEVAIPDPGPAEILINYKATGICHTDLHAATGDWPVKPNPPFIPGHEGVGYVAKIGAGVTGIKEGDRAGTPWLYTACGCCIPCRTGWETLCPSQKNSGYSVNGSFAEYGLADPKFVGRLPDNLEFGPAAPVLCAGVTVYKGLKETEVRPGEWVVISGIGGLGHMAVQYAKAMGMHVVAADIYDDKLELAKKLGADFTVNGRAPDAVEQVQKATGGVHGALVTAVSPKAMEQAYGFLRSKGTMALVGLPPGFISIPVFETVLKRITVRGSIVGTRQDLEEALSFAGEGKVAAHFSWDKLENINDIFRRMEEGKIDGRIVLX

SEQ ID NO: 84876 - DNA, 1086 bp, Festuca arundinacea
  CDS (1)..(1086)
atgggcagcgtggacgcctccgagaagacgatcaccgggtgggccgccagggacaccaccggtcacctctccccctacacctacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccagaggtgagcaagtacagcgtcggcgacgtggtcggcgttggggtgatcgtcgggtgctgccgcgactgcaggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctagactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcgggaggaagaccatcaccgggagcttcatcgggagcatcgaggagaccgaggaggtgctcaggttctgcgtcgaaaaggggcccacctcgcagatcgaggtcgtcaagatggactacctcaaccacgcgctcgagaggctcgagcgcaacgacgtcaggtaccgcttcgtcgtcgacgtcgctgggagcaacatcaaggacgccgacgcctga

SEQ ID NO: 84877 - protein, 361 aa, Festuca arundinacea
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGPTSQIEVVKMDYLNHALERLERNDVRYRFVVDVAGSNIKDADA

SEQ ID NO: 84878 - DNA, 1086 bp, Festuca arundinacea
  CDS (1)..(1086)
atgggcagcgtggacgcctccgagaagacgatcaccgggtgggccgccagggacaccaccggtcacctctccccctacacctacaccctcaggaggacgggcgctgaagatgtggtgctgaaggttctgtactgcggcatctgccacactgacctccaccagaccaagaaccaccttggtgcctcaaaataccccatggttcccgggcatgaggtggtaggcgaggtggtggaggtcgggccagaggtgagcaagtacagcgtcggcgacgtggtcggcgttggggtgatcgtcgggtgctgccgcgactgcaggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggacgctgccatggactcgctggactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcgggaggaagaccatcaccgggagcttcatcgggagcatcgaggagaccgaggaggtgctcaggttctgcgtcgaaaaggggctcacctcgcagatcgaggtcgtcaagatggactacctcaaccacgcgctcgagaggctcgagcgcaacgatgtcaggtaccgcttcgtcgtcgacgtcgctgggagcaacatcaaggacgccgacgcctga

SEQ ID NO: 84879 - protein, 361 aa, Festuca arundinacea
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMDAAMDSLDYIIDTVPVKHPLEPYLALLKMDGKLVLMGVIAEPLSFVSPMVMLGRKTITGSFIGSIEETEEVLRFCVEKGLTSQIEVVKMDYLNHALERLERNDVRYRFVVDVAGSNIKDADA

SEQ ID NO: 84880 - DNA, 1086 bp, Festuca arundinacea
  CDS (1)..(1086)
atgggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctcctccatggtcgtcgaccagaagttcgtggtgaagatcccagcggggctagcgccggagcaggcggcgccgctgctgtgcgccggcgtgaccgtgtacagcccgctgaagcacttcgggctgatgaccccgggcctccgcggcggcatcctcggcctcggcggcgtcggccacatgggcgtgaaggtggccaagtccatgggccaccacgtcaccgtgatcagctcctccgacaagaagcgcgccgaggccatggacgacctgggcgccgacgcctacctcgtcagctccgacgaggcccagatggccgccgccatggactcgctggactacatcatcgacaccgtgcccgtcaagcacccgctcgagccctacctcgcgctcctcaagatggacggcaagctcgtcctcatgggcgtcatcggcgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgacgtcgcagggagcaacatcgacgacactgccgcgtga

SEQ ID NO: 84881 - protein, 361 aa, Festuca arundinacea
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVEKGLTSQIEVVKMDYLNQALERLERNDVRYRFVVDVAGSNIDDTAA

SEQ ID NO: 84882 - DNA, 1086 bp, Festuca arundinacea
  CDS (1)..(1086)
atgggcagcgtcgacgcctccgagaagacgatcaccgggtgggccgccagggacgccaccggccacctctccccctacacgtacaacctcaggaggacgggcgctgaagatgtggtgctgaaggttctgtactgcggcatctgccacactgacctccaccagaccaagaaccaccttggtgcttcaaaataccccatggtacccgggcatgaggtggtaggcgaggtggtggaggtcgggccggaggtgagcaagtacagcgtcggcgacgtggtcggcgtgggggtgatcgtcgggtgctgccgcgactgccggccgtgcaaggccaacgttgagcagtactgcaacaagaagatctggtcgtacaacgacgtctacaccgacggcaagcccacgcagggcggcttcgcctccgccatggtcgtcgaccagaagttcgtggtgaagatcccggcggggctggcgccggagcaggcggcgccgctgctctgcgcgggggtgacggtgtacagcccgctgaagcacttcgggctgatgaccccaggcctccgtggcggcatcctgggcctgggcggcgtgggccacatgggcgtgaaggtggccaagtccatgggccaccacgtcaccgtgatcagctcctccaacaagaagcgcgccgaggccatggacgacctcggcgccgacgcctacctcgtcagctccgacgaggcccagatggccgccgccatggactcgctagactacatcatcgacaccgtgcccgtcaagcacccgctcgagccctacctggcgctgctcaagatggacggcaagctcgtcctcatgggcgtcatcgccgagccgctcagcttcgtgtcccccatggtcatgctcggaaggaagaccatcaccggcagcttcatcgggagcatcgaggagaccgaggaggtgcttaggttctgcgtcgaaaagggcctcacctcgcagatcgaggtcgtcaagatggactacctcaaccaggcgctcgagaggctcgagcgcaacgacgtcaggtaccgcttcgtcgtcgatgtcgcagggagcaacatcgacgacactgccgcgtga

SEQ ID NO: 84883 - protein, 361 aa, Festuca arundinacea
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGLTSQIEVVKMDYLNQALERLERNDVRYRFVVDVAGSNIDDTAA

SEQ ID NO: 84884 - DNA, 1089 bp, Populus tremuloides
  CDS (1)..(1089)
atgtccaagtcaccagaagaagaacaccctgtgaaggccttcgggtgggctgctagggatcaatctggtcatctttctcccttcaacttctccaggagggctactggtgaagaggatgtgaggttcaaggtgctgtactgcggggtatgccattctgaccttcacagtatcaagaatgactggggcttctccatgtaccctttggttcctgggcatgaaattgtgggagaagtgacagaagttgggagcaaggtgaaaaaggttaatgtgggagacaaagtgggcgtgggatgcttggttggtgcatgtcactcctgtgagagttgtgccaatgatcttgaaaattactgtccaaaaatgatcctgacatacgcctccatctaccatgacggaaccatcacttacggtggctactcagatcacatggtcgctaacgaacgctacatcattcgattccccgataacatgccgcttgacggtggcgctcctctcctttgtgccgggattacagtgtatagtcccttgaaatattttggactagatgaacccggtaagcatatcggtatcgttggcttaggtggacttggtcacgtggctgtcaaatttgccaaggcctttggatctaaagtgacagtaattagtacctccccttccaagaaggaggaggctttgaagaacttcggtgcagactcatttttggttagtcgtgaccaagagcaaatgcaggctgctgcaggaacattagatggcatcatcgatacagtttctgcagttcacccccttttgccattgtttggactgttgaagtctcacgggaagcttatcttggtgggtgcaccggaaaagcctcttgagctacctgccttttctttgattgctggaaggaagatagttgccgggagtggtattggaggcatgaaggagacacaagagatgattgattttgcagcaaaacacaacatcacagcagatatcgaagttatttcaacggactatcttaatacggcgatggaacgtttggctaaaaacgatgtcagataccgattcgtcattgacgttggcaatactttggcagctacgaagccctaa

SEQ ID NO: 84885 - protein, 362 aa, Populus tremuloides
MSKSPEEEHPVKAFGWAARDQSGHLSPFNFSRRATGEEDVRFKVLYCGVCHSDLHSIKNDWGFSMYPLVPGHEIVGEVTEVGSKVKKVNVGDKVGVGCLVGACHSCESCANDLENYCPKMILTYASIYHDGTITYGGYSDHMVANERYIIRFPDNMPLDGGAPLLCAGITVYSPLKYFGLDEPGKHIGIVGLGGLGHVAVKFAKAFGSKVTVISTSPSKKEEALKNFGADSFLVSRDQEQMQAAAGTLDGIIDTVSAVHPLLPLFGLLKSHGKLILVGAPEKPLELPAFSLIAGRKIVAGSGIGGMKETQEMIDFAAKHNITADIEVISTDYLNTAMERLAKNDVRYRFVIDVGNTLAATKP

SEQ ID NO: 84886 - DNA, 1047 bp, Mycobacterium smegmatis
  CDS (1)..(1047): transl_table=11
atgagtaccgtttccgcgtatgccgccacctcggcgaccgaaccactgaccaagaccaccatcacccgtcgcgccgtgggtccgcacgatgttgcgttcgacatccacttcgcaggcatctgtcactccgacatccacaccgtcaaggccgagtggggcgtcccgaactaccccgtggtccccggtcacgagatcgccggcgtggtcaccgaggtgggctcggaggtcaccaagtacaaggtcggcgaccgcgtcggcgtcggctgcttcgtcgactcctgccgagagtgcgacaactgcaaggccggcctggagcagtactgcaccggcaccggcatggtcggcacctacaacgcgatcgaccgcgacggcaccccgacccacggcggttacagcggcgccatcgtggtcgacgagaactacgtgcgcatccccgacagcctttcgctcgacgcggccgctcccctgctgtgtgcgggcatcaccacctattccccgctgcggcactggaatgccggccccggcaagaaggtcgccgtcatcgggctcggcggcctcggccacgtggccgtcaagctcgccaaggcgatgggcgccgatgtcacggtgctcagccagtcgctgaagaagatggaagacggcctgcgcctggggcgctcggcctactacgcgacgtccgatccggagacgttcgacaagctcgccgggtcgttcgacctgatcctcaacaccgtgtcggcgaacctggacctcggtgcctacctgggcctgctcaagctcgacggcgcgctcgtcgaactcggcctgcccgagcaccccatggaggtcccggcgttcccgctgctcgctcagcgacgcaacctcaccggctcgatgatcggcggcatccccgagacccaggagatgctcgacttctgcgccgaacacgacgtccggccggagatcgagatcatcacccccgactacatcaacgaggcctacgagcgcgtcctggccagcgatgtgcgctaccgcttcgtgatcgacaccgcgtcgctgcgtagctga

SEQ ID NO: 84887 - protein, 348 aa, Mycobacterium smegmatis
MSTVSAYAATSATEPLTKTTITRRAVGPHDVAFDIHFAGICHSDIHTVKAEWGVPNYPVVPGHEIAGVVTEVGSEVTKYKVGDRVGVGCFVDSCRECDNCKAGLEQYCTGTGMVGTYNAIDRDGTPTHGGYSGAIVVDENYVRIPDSLSLDAAAPLLCAGITTYSPLRHWNAGPGKKVAVIGLGGLGHVAVKLAKAMGADVTVLSQSLKKMEDGLRLGRSAYYATSDPETFDKLAGSFDLILNTVSANLDLGAYLGLLKLDGALVELGLPEHPMEVPAFPLLAQRRNLTGSMIGGIPETQEMLDFCAEHDVRPEIEIITPDYINEAYERVLASDVRYRFVIDTASLRS

SEQ ID NO: 84888 - DNA, 1080 bp, Fragaria ananassa
  CDS (1)..(1080)
atgtctatcgagcaagaacaccccaataaggcatctggatgggctgcaagagattcatctggtgttctctctcccttcaatttctccagaagggaaaccggagagaaagacgtgatgttcaaagtgttgtactgtggaatttgccattcggaccatcacatggtcaagaatgaatggggtttctctacctatcctctggttccggggcatgagattgttggtgaagttacagaagtagggagcaaagtacaaaaatttaaagttggagacagagtcggtgttggatgcattgtgggatcttgccgatcttgtgaaaattgtaccgaccaccttgagaactactgccccaaacagatactcacttacggtgccaattactacgacggaaccaccacctatggcggttgctctgacattatggtggcccatgaacacttcgtagtacgcatcccagacaacttgcctcttgatggtgctgcgccgctcctatgtgccgggattacaacctacagccccctgagatatttcggacttgacaagcccggcatgcatgtaggtgtggtcggcctaggcggtttaggccacgtcgccgtgaagtttgccaaggctatgggagtgaaggttacagtgatcagtacgtcccctaaaaaagaggaggaagctcttaaacacctaggagcggactcgtttttggttagccgtgaccaagatcatatgcaggctgccattggtacaatggatgggatcattgacacagtttctgcacaacatcctctcctgcctttgattggtttgttgaagtctcatggaaagcttgttatggttggtgcaccagagaagcctcttgaacttccagtttttcctttactcatgggaagaaagatggtagctggtagcggcattgggggtatgatggagacacaagagatgatagattttgcagccaagcacaacataacagcagacatcgaagtcataccaatcgactacttgaacactgctatggagcgtctagtcaaagcagatgtcagataccgttttgtcatcgacattggaaacacactgaaggctagctcttaa

SEQ ID NO: 84889 - protein, 359 aa, Fragaria ananassa
MSIEQEHPNKASGWAARDSSGVLSPFNFSRRETGEKDVMFKVLYCGICHSDHHMVKNEWGFSTYPLVPGHEIVGEVTEVGSKVQKFKVGDRVGVGCIVGSCRSCENCTDHLENYCPKQILTYGANYYDGTTTYGGCSDIMVAHEHFVVRIPDNLPLDGAAPLLCAGITTYSPLRYFGLDKPGMHVGVVGLGGLGHVAVKFAKAMGVKVTVISTSPKKEEEALKHLGADSFLVSRDQDHMQAAIGTMDGIIDTVSAQHPLLPLIGLLKSHGKLVMVGAPEKPLELPVFPLLMGRKMVAGSGIGGMMETQEMIDFAAKHNITADIEVIPIDYLNTAMERLVKADVRYRFVIDIGNTLKASS

SEQ ID NO: 84890 - DNA, 1023 bp, Acinetobacter sp
  CDS (1)..(1023): transl_table=11
atgagcaatcatcaaattcgcgcttatgctgcaatgcaagctggcgagcaagtggtgccgtaccaatttgatgcgggagaattaaaagcccatcaagttgaagtcaaagttgaatattgtggtctgtgccactccgatctatccgtgattaataatgagtggcaatcatcggtttaccctgcggtggctggacatgaaatcattggtactatcattgcattgggatcagaagccaaagggttgaagctcggtcaacgggtaggtattggttggacagctgaaacctgtcaagcctgtgatccatgtattgggggtaatcaggtcctatgtactggtgaaaaaaaagcaaccatcattggccatgcaggcggttttgcagataaagtccgtgcaggttggcaatgggtcattccccttccggacgatttagaccctgaaagtgctggcccgctactgtgtggtggcatcacggtattggatcctttactaaaacacaaaatccaagcgacccatcatgtgggtgtgattggtattggtggtttaggtcatatcgcgattaagttactcaaagcatggggctgtgaaattacggctttcagttctaatccagataaaactgaagaactcaaagccaatggcgccgaccaagtggtaaatagccgtgatgctcaggccatcaagggcacacgttggaagttgattatactaagtacggccaatggcaccctaaacgtgaaagcctatctcaatactttggcaccaaaaggtagtctacatttcctaggtgtgactttagaaccaatccctgtttctgtcggtgccatcatgggaggtgccaaatctgtcacctcatcaccaacgggctcaccgttagccctgcgccaacttttacaattcgctgcgcgcaaaaatatcgcaccacaggttgagttatttccaatgtcacagctaaatgaagcgattgaacgactgcattcaggccaagcacgttatcgcatcgtactcaaagcagacttcgactaa

SEQ ID NO: 84891 - protein, 340 aa, Acinetobacter sp
MSNHQIRAYAAMQAGEQVVPYQFDAGELKAHQVEVKVEYCGLCHSDLSVINNEWQSSVYPAVAGHEIIGTIIALGSEAKGLKLGQRVGIGWTAETCQACDPCIGGNQVLCTGEKKATIIGHAGGFADKVRAGWQWVIPLPDDLDPESAGPLLCGGITVLDPLLKHKIQATHHVGVIGIGGLGHIAIKLLKAWGCEITAFSSNPDKTEELKANGADQVVNSRDAQAIKGTRWKLIILSTANGTLNVKAYLNTLAPKGSLHFLGVTLEPIPVSVGAIMGGAKSVTSSPTGSPLALRQLLQFAARKNIAPQVELFPMSQLNEAIERLHSGQARYRIVLKADFD

SEQ ID NO: 84892 - DNA, 1086 bp, Cryptococcus neoformans var
  CDS (1)..(1086)
atgtctactctctctaacttcaccattcccaagacccagactgccgctgttgtcaagacaaccggcgctgagctcgcgattgaaaaggaacaccctgtcaagcaggcttccgagcttgggcccggtcaatgcttggtcaaaatctcccacactggtgtctgccataccgacttgcacgccaagtctggcgactggcctgttcccccatctcatccccttatcggaggtcatgaaggtgtcggtattatcgtcgctattggtgaccacactgctgcttctcccgtcaagcttggtgaccgagtcggtatcaagtggctcgccgacagctgtctcagctgcgaatactgtcgacgcggctatgagatgaactgtcccaacgtcaagctctctggctataccaccgacggtactttctccgaatacgtcgtttccttcgtcaaccatgtgactcctattcctgaatccctcgactctgccggcgccgcctccatcctgtgtgctggtgtcaccacctacaaggctctcaaggtctccaacaccaaggtcggtgactgggtcgctcttcccggcgctggcggtggtctcggtcatcttgctgtccaatatgcgaaggccatgggcctcaaggtcatcgctatcgatagtggcgctgccaaggagaagctcgttaagtctctcggtgctgacgcttgggtcgactttaagacttccaaggatattgtggccgacatcaaagccgctactggaggggacggtcctgccgccgctgtggtcacggctgccaacaagacgggttacgctcaggctatcgagtacttgaagcctagcggcacccttgtcgctgtcggtatgcctgatgctgagatgggcgcaaacgttttctggacagtgttcaagagcatcaggatccagggtagctatgtcggtaacagacaggatgcgattgaggcgcttgatattgccgcgtccggccaagtcaaggtcgtttttgaagagaagggtcttgactctttaaagggcgtcttcgaggatcttgaggctggtaagattgccggccgtgttgtcctcaaggtttccgacgagtaa

SEQ ID NO: 84893 - protein, 361 aa, Cryptococcus neoformans var
MSTLSNFTIPKTQTAAVVKTTGAELAIEKEHPVKQASELGPGQCLVKISHTGVCHTDLHAKSGDWPVPPSHPLIGGHEGVGIIVAIGDHTAASPVKLGDRVGIKWLADSCLSCEYCRRGYEMNCPNVKLSGYTTDGTFSEYVVSFVNHVTPIPESLDSAGAASILCAGVTTYKALKVSNTKVGDWVALPGAGGGLGHLAVQYAKAMGLKVIAIDSGAAKEKLVKSLGADAWVDFKTSKDIVADIKAATGGDGPAAAVVTAANKTGYAQAIEYLKPSGTLVAVGMPDAEMGANVFWTVFKSIRIQGSYVGNRQDAIEALDIAASGQVKVVFEEKGLDSLKGVFEDLEAGKIAGRVVLKVSDE

SEQ ID NO: 84894 - DNA, 1074 bp, Populus tremuloides
  CDS (1)..(1074)
atgggtagccttgaaacagagagaaaaattgtaggatgggcagcaacagactcaactgggcatctcgctccttacacctatagtctcagagatacggggccagaagatgttcttatcaaggttatcagctgtggaatttgccataccgatatccaccaaatcaaaaatgatcttggcatgtcacactatcctatggtccctggccatgaagtggttggtgaggttgttgaggtgggatcagatgtgacaaagttcaaagctggagatgttgttggtgttggagtcatcgttggaagctgcaagaattgtcatccatgcaaatcagagcttgagcaatactgcaacaagaaaatctggtcttacaatgatgtctacactgatggcaaacccacccaaggaggctttgctgaatccatggttgtcgatcaaaagtttgtggtgagaattcctgatgggatgtcaccagaacaagcagcgccgctgttgtgcgctggattgacagtttacagcccactcaaacactttggactgaaacagagtgggctaagaggagggattttaggacttggaggagtagggcacatgggggtgaagatagcaaaggcaatgggacaccatgtaactgtgattagttcttctgacaagaagcgggaggaggctatggaacatcttggtgctgatgaatacctggtcagctcggatgtggaaagcatgcaaaaagctgctgatcaacttgactatatcatcgatactgtgcctgtggttcaccctctcgagccttacctttctctattgaaacttgatggcaagctgatcttgatgggtgttattaataccccattgcagtttgtttcgccaatggttatgcttgggagaaagtcgatcaccgggagcttcatagggagcatgaaggagacagaggagatgcttgagttctgcaaggaaaagggattggcctccatgattgaagtgatcaaaatggattatatcaacacagcattcgagaggcttgagaaaaatgatgtgagatatagattcgttgtcgatgttgctggtagcaagcttattccctga

SEQ ID NO: 84895 - protein, 357 aa, Populus tremuloides
MGSLETERKIVGWAATDSTGHLAPYTYSLRDTGPEDVLIKVISCGICHTDIHQIKNDLGMSHYPMVPGHEVVGEVVEVGSDVTKFKAGDVVGVGVIVGSCKNCHPCKSELEQYCNKKIWSYNDVYTDGKPTQGGFAESMVVDQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINTPLQFVSPMVMLGRKSITGSFIGSMKETEEMLEFCKEKGLASMIEVIKMDYINTAFERLEKNDVRYRFVVDVAGSKLIP

SEQ ID NO: 84896 - DNA, 1059 bp, Leishmania major
  CDS (1)..(1059)
atgccgactgaagcgcacggatgggctgccctctccgccaagtcgaagctggagcccttcgccttccagcgccgtgacgtcggccctgacgatgtggtgatcgccatagcgtactgcggtgtgtgccacagcgacgtgcatcaggcccgtgatgagtgggacggctccacgttcccgatggtgcccggccacgagattgttggtcacgtgacgaaggtgggctcagaagtgaccaagtacaaggccggcgacagggttggcgtgggctgcatggtggactcgtgcatgaagtgccgccagtgcgagcgcggcctggagcagtattgcgtgaatggcgcatcgttcacctacaacagcacgcagcaggacaagaagacgccgacctttggcggctactctgaccacgtggtggtgcgcgagcattttgttgtgagcatcccggataacctcgacctgtgcgccgcggcgccgcttctctgcgctggtgtcacaacgttctcgccgctgcggtactggggagtgaagaagggcacgcgcgtgggtgtggttgggctgggcggtctgggtcacatggccgtgaagctggcgaacgcgatgggtgcggaagtgacggtgttcactcgctcctcgaacaaagtcgaggaagcggaaaacctcggtgcgcaccacgtcgtcaacacgaacaacgagcaggagatgaattcgattcagggaacactcgacgtgattgtggacacggtgggcatgagccacgacctgcgcccctacatgatgacgctggacatagacggcaagcttgccctggtgggcatgccggagcacgcgcacccgccgctggacccccggcgcattatcgcttcgcgccagtgtgttggcgggtcgaatattgccggcatgcctgagacgcaagagctgctcaacttttgcggtgagcacaacatcaccgcgacggtggagaagatcggcatcgaatatatcaacgaggcctacgagcgcattttggcgagcgacgtgcgctaccgcttcgtgattgacatggcgtctctgaaaaaggagtag

SEQ ID NO: 84897 - protein, 352 aa, Leishmania major
MPTEAHGWAALSAKSKLEPFAFQRRDVGPDDVVIAIAYCGVCHSDVHQARDEWDGSTFPMVPGHEIVGHVTKVGSEVTKYKAGDRVGVGCMVDSCMKCRQCERGLEQYCVNGASFTYNSTQQDKKTPTFGGYSDHVVVREHFVVSIPDNLDLCAAAPLLCAGVTTFSPLRYWGVKKGTRVGVVGLGGLGHMAVKLANAMGAEVTVFTRSSNKVEEAENLGAHHVVNTNNEQEMNSIQGTLDVIVDTVGMSHDLRPYMMTLDIDGKLALVGMPEHAHPPLDPRRIIASRQCVGGSNIAGMPETQELLNFCGEHNITATVEKIGIEYINEAYERILASDVRYRFVIDMASLKKE

SEQ ID NO: 84898 - DNA, 1053 bp, Candida albicans
  CDS (1)..(1053): transl_table=12
atgtctgaacaaatcccaaaaactcaaaaagccgttgtctttgataccaatggtggtcaattagtctacaaggattacccagttccaactccaaagccaaatgaattgttgattcacgtcaaatactctggtgtctgtcacactgatttacatgcaaggaaaggtgactggccattggctactaaattgccattagttggtggtcacgaaggtgccggtgtcgttgtcggtatgggtgaaaacgtcaaaggatggaaaatcggtgactttgccggtatcaaatggttgaatggttcttgtatgagttgtgaattctgtcaacaaggtgctgaaccaaactgtggtgaagctgacttgtctggttacactcacgatggttcattcgaacaatacgctactgctgatgctgttcaagccgctaaaattccagctggtactgatttagccaatgtcgcaccaatcttatgtgctggtgttactgtttacaaagccttaaagactgctgacttagcagctggccaatgggttgctatctccggtgctggtggtggtttaggttctttggccgttcaatacgccagagccatgggtttgagagttgttgctattgacggtggtgacgaaaaaggtgaatttgttaaatcattgggtgctgaagcttacgttgatttcaccaaagataaagatattgttgaagctgtcaagaaagctactgatggtggtccacacggtgctatcaatgtctctgtttctgaaaaagccattgaccaatctgttgaatatgttagaccattaggtaaagttgttttggttggtttaccagctcacgctaaagtcactgctccagttttcgatgctgttgtcaaatccattgaaatcaaaggttcttacgttggtaacagaaaagacactgctgaagctattgacttcttctccagaggtttaatcaaatgtccaatcaagattgtcggtttatctgacttgccagaagtcttcaaattgatggaagaaggtaaaatcttgggtagatacgtcttggacaccagtaaataa

SEQ ID NO: 84899 - protein, 350 aa, Candida albicans
MSEQIPKTQKAVVFDTNGGQLVYKDYPVPTPKPNELLIHVKYSGVCHTDLHARKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 84900 - DNA, 1047 bp, Kluyveromyces marxianus
  CDS (1)..(1047)
atggctattccagaaactcaaaagggtgttatcttctacgaacacggtggtgagttgcaatacaaggacattccagttccaaagccaaagccaaatgaacttttgatcaacgttaagtactctggtgtgtgtcacaccgatttgcacgcatggcaaggtgactggccattggacaccaagttgccattggtcggtggtcacgaaggtgctggtattgttgttgccatgggtgagaacgttactgggtgggaaatcggtgactatgctggtatcaagtggttgaacggttcctgtatgtcttgtgaggagtgtgagttgtcgaacgaaccaaactgtccaaaggccgacttgtctggttacactcacgacggttctttccaacaatacgctaccgctgacgctgtgcaggctgccagaattccaaagaacgtcgacttggccgaggttgccccaatcttgtgtgccggtgttaccgtgtacaaggctttgaagtctgcccacatcaaggctggtgactgggtcgccatctccggtgcatgtggtggtctaggttccttggccatccaatacgccaaggctatgggttacagagtgctaggtatcgatgctggtgacgaaaaggccaaattgttcaaggaattgggcggtgaatacttcatcgacttcaccaagaccaaggacatggtagcagaagtcattgaggccaccaatggtgtggcccacgctgtcattaacgtgtctgtgtccgaagccgccatctctacctctgtcttgtacaccagatcaaacggtaccgtcgtcttggtcggtttgccaagagacgcccaatgtaagtctgatgtcttcaaccaagtcgtcaagtccatctccattgttggttcttacgttggtaacagagcagacaccagagaagccctagacttcttctccagaggtttggtcaaggctccaattaagattctcggcttgtctgaattggcatccgtttacgacaagatggtcaagggccaaatcgttggtagaattgtcgttgacacttccaaataa

SEQ ID NO: 84901 - protein, 348 aa, Kluyveromyces marxianus
MAIPETQKGVIFYEHGGELQYKDIPVPKPKPNELLINVKYSGVCHTDLHAWQGDWPLDTKLPLVGGHEGAGIVVAMGENVTGWEIGDYAGIKWLNGSCMSCEECELSNEPNCPKADLSGYTHDGSFQQYATADAVQAARIPKNVDLAEVAPILCAGVTVYKALKSAHIKAGDWVAISGACGGLGSLAIQYAKAMGYRVLGIDAGDEKAKLFKELGGEYFIDFTKTKDMVAEVIEATNGVAHAVINVSVSEAAISTSVLYTRSNGTVVLVGLPRDAQCKSDVFNQVVKSISIVGSYVGNRADTREALDFFSRGLVKAPIKILGLSELASVYDKMVKGQIVGRIVVDTSK

SEQ ID NO: 84902 - DNA, 1014 bp, Zymomonas mobilis
  CDS (1)..(1014): transl_table=11
atgaaagcagccgtcataactaaagatcatacgatcgaagtgaaagacaccaaattacgccctctgaaatacggggaagcgcttttggaaatggaatattgcggggtatgtcataccgatctccacgtgaaaaacggggattttggcgatgaaaccggcagaattaccggccatgaaggcatcggtatcgtcaagcaggtcggggaaggggttacttctctgaaagtcggtgaccgtgccagtgttgcatggttcttcaaaggctgcggccattgcgaatattgtgtcagtggaaatgaaacgctttgccgcaacgttgaaaatgccggttatacggttgacggcgctatggcagaagaatgcatcgtcgttgccgattactcggtcaaagtgccagatggtcttgatcctgcggttgccagcagcatcacttgcgcgggtgtaaccacctataaagcagtcaaagtttctcagatacagccgggacaatggctggctatctatggcttgggcggtttaggcaatctagcccttcaatatgccaagaatgttttcaacgccaaagtgatcgcgatcgatgtcaatgatgaacagctcgcttttgccaaagagctgggcgcagatatggtcatcaatccgaaaaacgaagatgctgccaaaatcattcaggaaaaagtcggcggcgcacatgcgacggtggtgacagctgttgccaaatccgcctttaactcggctgttgaggctatccgcgcgggtggccgtgttgtcgccgttggtctgcctcctgaaaaaatggatttgagcattcctcgcttggtgcttgacggtatcgaagtcttaggttctttggtcggaacgcgggaagatttgaaagaagccttccagtttgcagccgaaggtaaggtcaaaccgaaagtcaccaagcgtaaagtcgaagaaatcaaccaaatctttgacgaaatggaacatggtaaattcacaggccgtatggttgttgattttacccatcactag

SEQ ID NO: 84903 - protein, 337 aa, Zymomonas mobilis
MKAAVITKDHTIEVKDTKLRPLKYGEALLEMEYCGVCHTDLHVKNGDFGDETGRITGHEGIGIVKQVGEGVTSLKVGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 84904 - DNA, 1020 bp, Bacillus stearothermophilus
  CDS (1)..(1020): transl_table=11
gtgaaagcagcagtagttaacgaatttaaaaaagcacttgaaattaaagaggtggaaagacccaaactagaggaaggtgaagttttagttaagatcgaagcatgcggtgtgtgccatacggatttacatgcagcccatggtgactggccgattaaaccgaaattgccgttaattccggggcatgaaggagtcggaattgttgtagaagtcgcaaagggagttaaatcaataaaagtgggagatcgcgtcggcatcccatggttatattctgcatgtggtgaatgtgaatattgtttaactggtcaagaaacactttgcccgcatcaattgaatggcggatattccgttgatggcggatatgcggaatactgtaaagctcccgcagattatgtggcgaaaattcctgataacttagatccagttgaagtagcgccaattttatgtgcaggcgtaacgacatataaagcgttgaaagtatcaggtgctcggccaggtgaatgggtggccatttacggtattggaggacttggtcatattgcattacaatacgccaaagcgatgggacttaatgtggtagctgttgatatcagtgatgaaaaatcaaaattagccaaagatttaggtgcagatattgcaatcaacggtttaaaagaagatcctgtcaaagcgatacatgatcaagtaggcggagttcatgctgctattagtgtagcggtgaataaaaaagcatttgaacaggcctatcagtcagtgaaacggggaggcacattagttgttgtcggtctgccaaatgctgatctgcctattccgatcttcgatacagtattaaacggcgtttccgttaaaggttccatcgtcggtacaagaaaggacatgcaggaagcattagattttgctgctcgcggaaaagtccgtccaattgttgaaaccgctgaattagaagaaataaatgaagtatttgaaagaatggaaaaaggaaaaatcaacggtcgtatcgtactaaaattgaaggaggattga

SEQ ID NO: 84905 - protein, 339 aa, Bacillus stearothermophilus
MKAAVVNEFKKALEIKEVERPKLEEGEVLVKIEACGVCHTDLHAAHGDWPIKPKLPLIPGHEGVGIVVEVAKGVKSIKVGDRVGIPWLYSACGECEYCLTGQETLCPHQLNGGYSVDGGYAEYCKAPADYVAKIPDNLDPVEVAPILCAGVTTYKALKVSGARPGEWVAIYGIGGLGHIALQYAKAMGLNVVAVDISDEKSKLAKDLGADIAINGLKEDPVKAIHDQVGGVHAAISVAVNKKAFEQAYQSVKRGGTLVVVGLPNADLPIPIFDTVLNGVSVKGSIVGTRKDMQEALDFAARGKVRPIVETAELEEINEVFERMEKGKINGRIVLKLKED

SEQ ID NO: 84906 - DNA, 1047 bp, Candida albicans
  CDS (1)..(1047): transl_table=12
atgtctgtcccaactactcaaaaagctgttattttcgaaaccaacggtggtaagttggaatacaaagatatcccagtcccaaaaccaaaagcaaatgaattgttaatcaacgtcaaatactctggtgtctgtcacactgatttacacgcttggaaaggtgactggccattggctactaaattgccattggttggtggtcacgaaggtgctggtgttgttgtcgccttgggtgaaaacgttaaaggctggaaagttggtgattacgctggtgttaaatggttgaacggttcttgtttgaactgtgaatactgtcaatcaggtgctgaaccaaactgtgctgaagctgatttatccggttacacccacgatggttctttccaacaatatgctactgctgacgctgttcaagctgccagaatcccagctggtaccgacttagccaatgttgcaccaatcttatgtgctggtgtcaccgtctacaaagctttaaagactgctgaattagaagccggtcaatgggttgctatttccggtgccgctggtggtttaggttctttagctgttcaatacgccaaggccatgggttacagagttcttgccatcgatggtggtgaagacaagggtgaattcgtcaaatccttgggtgctgaaacctttattgattttaccaaagaaaaagacgttgtcgaagctgtcaagaaggccaccaatggtggtccacatggtgttatcaatgtctctgtctcagaaagagccattggtcaatccactgaatatgtcagaactttaggtaaagttgttttggttggtttgccagctggtgctaaaattagtaccccagtctttgatgctgttatcaagaccattcaaattaaaggttcttatgtcggtaacagaaaagatactgctgaagccgttgatttcttcacaagaggtttgatcaaatgtccaatcaagattgttggcttatccgaattaccagaagtttacaaattgatggaagaaggtaaaatcttgggtagatacgtcttggacaacgacaaataa

SEQ ID NO: 84907 - protein, 348 aa, Candida albicans
MSVPTTQKAVIFETNGGKLEYKDIPVPKPKANELLINVKYSGVCHTDLHAWKGDWPLATKLPLVGGHEGAGVVVALGENVKGWKVGDYAGVKWLNGSCLNCEYCQSGAEPNCAEADLSGYTHDGSFQQYATADAVQAARIPAGTDLANVAPILCAGVTVYKALKTAELEAGQWVAISGAAGGLGSLAVQYAKAMGYRVLAIDGGEDKGEFVKSLGAETFIDFTKEKDVVEAVKKATNGGPHGVINVSVSERAIGQSTEYVRTLGKVVLVGLPAGAKISTPVFDAVIKTIQIKGSYVGNRKDTAEAVDFFTRGLIKCPIKIVGLSELPEVYKLMEEGKILGRYVLDNDK

SEQ ID NO: 84908 - DNA, 1104 bp, Emericella nidulans
  CDS (1)..(1104)
atggctgctcctgaaatccccaagaagcaaaaggctgtcatctacgacaaccccggtaccgtctctaccaaggtcgtcgagctggatgtacctgagcccggcgacaatgaagtcctgatcaatctcactcattccggcgtttgccactcagattttggtattatgaccaacacgtggaagatactacccttccctactcagcccggacaagtcggtggccatgaaggcgttggcaaagtggtgaagctcggcgcgggcgctgaagcatcaggattgaagatcggggacagagtcggtgttaagtggatttccagcgcctgtgggcagtgccctccatgccaggacggcgccgacggcctctgcttcaaccaaaaggtatcaggttactacacccctggcacattccagcaatacgtgctcggtcctgcgcaatacgttaccccaattcccgatggcctcccatcagccgaagcggcgccccttctctgtgccggtgtcacagtctacgcttctcttaagcgcagtaaagcccaaccaggtcaatggatcgtcatctccggcgctggcggcggccttggccacttagccgtccagatcgcagccaagggcatgggcctgcgtgtgattggcgttgaccacgggagtaaagaagagctcgtcaaggcgtcaggcgccgagcacttcgtggatatcaccaagttcccaacgggcgataaattcgaggccatctcctcgcacgtcaaatcgcttacaacgaagggtcttggtgcgcatgctgtcatagtttgcacggcgtccaatattgcttacgctcagtctttgctcttcctccggtacaacggaacgatggtctgcgtgggtatccccgagaacgagccgcagcgtatcgcaagtgcgtacccaggcctgtttatccagaagcatgtgcatgtcactgggtcggctgtcggaaataggaacgaggcgattgagactatggagtttgcggcgaggggtgtcattaaggcgcacttccgggaggagaagatggaggccttgactgaaattttcaaagagatggaggaggggaagttgcaggggcgggtggtgcttgatctttcttag

SEQ ID NO: 84909 - protein, 367 aa, Emericella nidulans
MAAPEIPKKQKAVIYDNPGTVSTKVVELDVPEPGDNEVLINLTHSGVCHSDFGIMTNTWKILPFPTQPGQVGGHEGVGKVVKLGAGAEASGLKIGDRVGVKWISSACGQCPPCQDGADGLCFNQKVSGYYTPGTFQQYVLGPAQYVTPIPDGLPSAEAAPLLCAGVTVYASLKRSKAQPGQWIVISGAGGGLGHLAVQIAAKGMGLRVIGVDHGSKEELVKASGAEHFVDITKFPTGDKFEAISSHVKSLTTKGLGAHAVIVCTASNIAYAQSLLFLRYNGTMVCVGIPENEPQRIASAYPGLFIQKHVHVTGSAVGNRNEAIETMEFAARGVIKAHFREEKMEALTEIFKEMEEGKLQGRVVLDLS

SEQ ID NO: 84910 - DNA, 1083 bp, Saccharomyces cerevisiae
  CDS (1)..(1083)
atgtcttatcctgagaaatttgaaggtatcgctattcaatcacacgaagattggaaaaacccaaagaagacaaagtatgacccaaaaccattttacgatcatgacattgacattaagatcgaagcatgtggtgtctgcggtagtgatattcattgtgcagctggtcattggggcaatatgaagatgccgctagtcgttggtcatgaaatcgttggtaaagttgtcaagctagggcccaagtcaaacagtgggttgaaagtcggtcaacgtgttggtgtaggtgctcaagtcttttcatgcttggaatgtgaccgttgtaagaatgataatgaaccatactgcaccaagtttgttaccacatacagtcagccttatgaagacggctatgtgtcgcagggtggctatgcaaactacgtcagagttcatgaacattttgtggtgcctatcccagagaatattccatcacatttggctgctccactattatgtggtggtttgactgtgtactctccattggttcgtaacggttgcggtccaggtaaaaaagttggtatagttggtcttggtggtatcggcagtatgggtacattgatttccaaagccatgggggcagagacgtatgttatttctcgttcttcgagaaaaagagaagatgcaatgaagatgggcgccgatcactacattgctacattagaagaaggtgattggggtgaaaagtactttgacaccttcgacctgattgtagtctgtgcttcctcccttaccgacattgacttcaacattatgccaaaggctatgaaggttggtggtagaattgtctcaatctctataccagaacaacacgaaatgttatcgctaaagccatatggcttaaaggctgtctccatttcttacagtgctttaggttccatcaaagaattgaaccaactcttgaaattagtctctgaaaaagatatcaaaatttgggtggaaacattacctgttggtgaagccggcgtccatgaagccttcgaaaggatggaaaagggtgacgttagatatagatttaccttagtcggctacgacaaagaattttcagactag

SEQ ID NO: 84911 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 84912 - DNA, 1086 bp, Saccharomyces cerevisiae
  CDS (1)..(1086)
atgctttacccagaaaaatttcagggcatcggtatttccaacgcaaaggattggaagcatcctaaattagtgagttttgacccaaaaccctttggcgatcatgacgttgatgttgaaattgaagcctgtggtatctgcggatctgattttcatatagccgttggtaattggggtccagtcccagaaaatcaaatccttggacatgaaataattggccgcgtggtgaaggttggatccaagtgccacactggggtaaaaatcggtgaccgtgttggtgttggtgcccaagccttggcgtgttttgagtgtgaacgttgcaaaagtgacaacgagcaatactgtaccaatgaccacgttttgactatgtggactccttacaaggacggctacatttcacaaggaggctttgcctcccacgtgaggcttcatgaacactttgctattcaaataccagaaaatattccaagtccgctagccgctccattattgtgtggtggtattacagttttctctccactactaagaaatggctgtggtccaggtaagagggtaggtattgttggcatcggtggtattgggcatatggggattctgttggctaaagctatgggagccgaggtttatgcgttttcgcgaggccactccaagcgggaggattctatgaaactcggtgctgatcactatattgctatgttggaggataaaggctggacagaacaatactctaacgctttggaccttcttgtcgtttgctcatcatctttgtcgaaagttaattttgacagtatcgttaagattatgaagattggaggctccatcgtttcaattgctgctcctgaagttaatgaaaagcttgttttaaaaccgttgggcctaatgggagtatcaatctcaagcagtgctatcggatctaggaaggaaatcgaacaactattgaaattagtttccgaaaagaatgtcaaaatatgggtggaaaaacttccgatcagcgaagaaggcgtcagccatgcctttacaaggatggaaagcggagacgtcaaatacagatttactttggtcgattatgataagaaattccataaatag

SEQ ID NO: 84913 - protein, 361 aa, Saccharomyces cerevisiae
MLYPEKFQGIGISNAKDWKHPKLVSFDPKPFGDHDVDVEIEACGICGSDFHIAVGNWGPVPENQILGHEIIGRVVKVGSKCHTGVKIGDRVGVGAQALACFECERCKSDNEQYCTNDHVLTMWTPYKDGYISQGGFASHVRLHEHFAIQIPENIPSPLAAPLLCGGITVFSPLLRNGCGPGKRVGIVGIGGIGHMGILLAKAMGAEVYAFSRGHSKREDSMKLGADHYIAMLEDKGWTEQYSNALDLLVVCSSSLSKVNFDSIVKIMKIGGSIVSIAAPEVNEKLVLKPLGLMGVSISSSAIGSRKEIEQLLKLVSEKNVKIWVEKLPISEEGVSHAFTRMESGDVKYRFTLVDYDKKFHK

SEQ ID NO: 84914 - DNA, 1023 bp, Rhizobium meliloti
  CDS (1)..(1023): transl_table=11
atgacgatgacagccgctgtggtccgagagttcggcaagccgcttgtgattgaggaagttccggttccgcagccaggacccggacaggtcctgatcaaatacgaggccacgggcgtgtgtcacaccgacctgcatgccgccaagggcgactggccagtgagacccaatccgcccttcattcccgggcacgagggcgttggctacgttgccaagctcggcgccgaggtcacgcgactgaaggaaggggaccgagtcggcgtgccgtggctgcacaccgcctgcggatgctgcacgccatgccgcaccggctgggagacgctctgcggcagccagcaaaatacgggctactcggttgacggcacttttgcccaatatggcctagctgatcccgatttcgtcgggcggctgcccgccaggctggaattcggaccggccgctccggtgctctgtgccggcgtgacagtctacaaaggcctaaaggagacggaggtcagacccggagaatgggttctcgtctccggcatcggcggcctgggccacatggccgtccaatatgccaaggccatgggcatgcatgtcgccgcagccgacatattccccgacaagctcgcccttgccgagaagctcggcgccgatcttgttgtcgacgcgcgggcgcccgacgccgttgaagaggtgcagaggcgaacaggcggcctgcacggcgcgctggtcacggcagtctcgccgaaggccatggaacaggcctacagcatgctgcgctcgaaaggtacgatggcactggtcggcctgccgcccggccagatctgcctgccggtgttcgacacggtgctcaagcgtatcacggtacgcggttcgatcgtcggcacccgccaggatctcgaggaggcattggaatttgccggagagggcaaggtcgcggcccacttctcatgggacaagatcgagaacatcaacgccatcttcgagcgcatggaagaaggcaagatcgacggccgtatcgttctcgatctgaatggttga

SEQ ID NO: 84915 - protein, 340 aa, Rhizobium meliloti
MTMTAAVVREFGKPLVIEEVPVPQPGPGQVLIKYEATGVCHTDLHAAKGDWPVRPNPPFIPGHEGVGYVAKLGAEVTRLKEGDRVGVPWLHTACGCCTPCRTGWETLCGSQQNTGYSVDGTFAQYGLADPDFVGRLPARLEFGPAAPVLCAGVTVYKGLKETEVRPGEWVLVSGIGGLGHMAVQYAKAMGMHVAAADIFPDKLALAEKLGADLVVDARAPDAVEEVQRRTGGLHGALVTAVSPKAMEQAYSMLRSKGTMALVGLPPGQICLPVFDTVLKRITVRGSIVGTRQDLEEALEFAGEGKVAAHFSWDKIENINAIFERMEEGKIDGRIVLDLNG

SEQ ID NO: 84916 - DNA, 1041 bp, Mycobacterium bovis
  CDS (1)..(1041): transl_table=11
atgagcactgttgccgcctacgccgccatgtcggcgaccgaacccctgaccaagaccacgatcacccgtcgcgacccgggcccgcacgacgtggcgatcgacatcaagttcgccggaatctgtcactcggacatccataccgtcaaagccgagtggggccaaccgaattaccctgtggtccctggccacgagatcgccggcgtggtgaccgccgtgggctcggaggtgaccaagtaccggcagggcgaccgcgttggggttggctgtttcgtggactcgtgccgcgagtgcaacagttgcacgcgcggcatcgaacagtactgcaagccgggcgcaaacttcacctacaactcgatcggcaaagacggccagccaacccagggcggctacagcgaagcgatcgtcgtcgacgaaaactacgtgttgcgcatacccgacgtgctgcccctggatgtggcggcgccgctgttgtgcgcgggcatcacgctgtactcgccactgcgccactggaatgccggggcgaacacgcgggtggcgatcatcggcctaggcggactgggtcacatgggcgtcaagctgggcgccgcgatgggcgccgacgtgacggtgctgtcccaatcgctgaagaaaatggaggacggtctgcgcttgggggccaagagctactacgcgaccgccgacccggacaccttccgcaagctgcgcggcggcttcgacctgatcctgaacaccgtctcggctaacttggacctcggccagtacctgaacctgctggacgtcgacggcacactcgtggaactgggtatccccgagcaccccatggccgtgccggcgttcgcgctagcgctcatgcgacgcagcctggccgggtccaacatcggcgggatcgccgagacccaggagatgctcaatttctgtgccgagcacggcgtgacacccgaaatcgagctgattgaaccggactacatcaacgacgcctacgagcgcgtgctggccagcgacgtgcgctaccgcttcgtcatcgacatctcagccctgtga

SEQ ID NO: 84917 - protein, 346 aa, Mycobacterium bovis
MSTVAAYAAMSATEPLTKTTITRRDPGPHDVAIDIKFAGICHSDIHTVKAEWGQPNYPVVPGHEIAGVVTAVGSEVTKYRQGDRVGVGCFVDSCRECNSCTRGIEQYCKPGANFTYNSIGKDGQPTQGGYSEAIVVDENYVLRIPDVLPLDVAAPLLCAGITLYSPLRHWNAGANTRVAIIGLGGLGHMGVKLGAAMGADVTVLSQSLKKMEDGLRLGAKSYYATADPDTFRKLRGGFDLILNTVSANLDLGQYLNLLDVDGTLVELGIPEHPMAVPAFALALMRRSLAGSNIGGIAETQEMLNFCAEHGVTPEIELIEPDYINDAYERVLASDVRYRFVIDISAL

SEQ ID NO: 84918 - DNA, 1083 bp, Aralia cordata
  CDS (1)..(1083)
atgggtagcttggaagcagagagaaaaacaacaggatgggcagcaagagacccatctggggttctctcaccatacacctacactctcagggaaacaggcccagaagatgtttttatcaagattatttattgtgggatttgccatactgatattcaccagatcaagaatgatcttggagcttccaattaccctatggttccagggcatgaagtggttggtgaggttgtggaggtgggatcagatgtgaccaagttcaaggtaggagattgcgtcggggatggtacaatcgttggatgctgcaaaacttgtcgcccatgcaaagcagatgttgagcagtactgcaacaagaagatctggtcctacaatgatgtctacaccgatggcaagcccacccaaggaggcttctccggtcacatggtcgtcgatcaaaagtttgttgtgaagataccagatggaatggcaccagaacaggcagcacctctactgtgtgccggggtgacagtttacagtccactgacccattttgggttgaaagagatcagtggactgagagggggaatattggggcttggaggggttgggcacatgggcgtgaagttggcaaaagccatggggcatcatgtgactgtcataagctcttctgataagaagaaagaggaggcaatagatcatcttggtgcagatgcttacctggtcagctcagatgccactcagatgcaagaggctgccgactcccttgattatattattgacactgtgcctgtttttcacccacttgagccttacctctctttgttgaaacttgatgggaagttgatcttgatgggtgttatcaatactccattgcaatttatctcccccatggttatgcttgggaggaaggccatcacagggagcttcatcggcagcatgaaagagacggaagaaatgctagatttctgcaacgaaaaaggaataacttccacaattgaagttgtgaagatggattacataaacaccgcttttgagaggttggagaagaacgatgtgaggtaccgttttgttgtagatgttgccggcagcaaacttgatcaagaaacatga

SEQ ID NO: 84919 - protein, 360 aa, Aralia cordata
MGSLEAERKTTGWAARDPSGVLSPYTYTLRETGPEDVFIKIIYCGICHTDIHQIKNDLGASNYPMVPGHEVVGEVVEVGSDVTKFKVGDCVGDGTIVGCCKTCRPCKADVEQYCNKKIWSYNDVYTDGKPTQGGFSGHMVVDQKFVVKIPDGMAPEQAAPLLCAGVTVYSPLTHFGLKEISGLRGGILGLGGVGHMGVKLAKAMGHHVTVISSSDKKKEEAIDHLGADAYLVSSDATQMQEAADSLDYIIDTVPVFHPLEPYLSLLKLDGKLILMGVINTPLQFISPMVMLGRKAITGSFIGSMKETEEMLDFCNEKGITSTIEVVKMDYINTAFERLEKNDVRYRFVVDVAGSKLDQET

SEQ ID NO: 84920 - DNA, 1065 bp, Eucalyptus gunnii
  CDS (1)..(1065)
atgggcagtcttgagaaggagaggaccaccacgggttgggctgcaagggacccgtctggcgttctctctccttacacttatagcctcagaaacacgggaccagaagatctttacatcaaggtgttgagctgcgggatttgccacagtgacattcaccagatcaagaatgatcttggcatgtcccactaccctatggttcctgggcatgaagtggtgggtgaggttctggaggtgggatcagaggtgacaaagtacagagttggtgaccgagtgggaaccggtatagtggttgggtgctgcagaagctgtagcccttgcaattcggaccaggagcaatattgcaacaagaagatttggaattacaatgacgtgtacaccgatggcaagcccactcaaggtgggtttgctggtgagatagtggttggcgaaaggtttgtggtgaaaatccctgatgggttagagtcggaacaggcagcgccgctaatgtgcgctggtgtgaccgtgtacaggcctctggtgcgctttgggctcaagcaaagtgggctgagaggagggatactggggcttggaggggttggccacatgggggtgaagatagccaaggccatgggacaccatgtgactgtgataagctcttctgataagaagagaacggaggcattggagcacctgggtgccgatgcttacctagtgagctccgatgaaaatggaatgaaagaggccactgattcgctcgactacgtttttgacactatccctgtggttcaccctctcgaaccttacctggccttgttgaagctcgatgggaagctgatcttgactggtgtcatcaatgctcctcttcaatttatctctcccatggttatgcttgagtcaatcactgggagtttcatagggagcatgaaggaaacagaggagatgcttgagttctgcaaagaaaagggattgacttcccagatcgaagtgatcaagatggattatgtcaacacggccctagagaggctcgagaagaatgatgtcaggtacaggtttgtcgtggacgtcgtgggaagcaagcttgattag

SEQ ID NO: 84921 - protein, 354 aa, Eucalyptus gunnii
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYRPLVRFGLKQSGLRGGILGLGGVGHMGVKIAKAMGHHVTVISSSDKKRTEALEHLGADAYLVSSDENGMKEATDSLDYVFDTIPVVHPLEPYLALLKLDGKLILTGVINAPLQFISPMVMLESITGSFIGSMKETEEMLEFCKEKGLTSQIEVIKMDYVNTALERLEKNDVRYRFVVDVVGSKLD

SEQ ID NO: 84922 - DNA, 1074 bp, Arabidopsis thaliana
  CDS (1)..(1074)
atgggaataatggaggcagagaggaaaacaacaggctgggctgccagagacccatctgggatcctctctccttacacttacactcttagagagactggaccagaggatgtgaacataagaatcatttgctgtggaatctgccacaccgatcttcatcaaactaaaaatgatcttggcatgtctaattaccccatggttcctgggcatgaagtggtaggggaagtagtggaggtgggatcagatgtgagcaagttcaccgtaggggacatagttggagttggttgcctcgttggatgttgcggaggttgtagcccctgcgagagagatctggaacagtattgtccaaagaagatttggagctacaatgatgtttacatcaatggtcaacctacacaaggcggcttcgctaaagccaccgtcgttcaccaaaagtttgtggtcaagattccagaaggaatggcggttgagcaggctgcgccgctactgtgcgctggtgtgactgtgtacagtccactgagccactttggtctgaaacaaccaggcctaagaggaggtatactagggttaggtggagtcggtcacatgggtgtgaaaatagccaaagcaatgggtcaccatgtgactgtcataagctcatcaaacaagaagagagaagaggcattgcaagatcttggagctgatgattacgtgatcggatccgaccaagcgaagatgagcgaattggctgattcgttggattacgtaattgacacggtgcctgttcatcatgcacttgagccatatttgtctctgcttaagcttgatggtaaactcattctcatgggagttatcaacaatccattacagtttctcactcctctgcttatgcttgggaggaaagtgataacggggagcttcatagggagcatgaaggagacagaggagatgcttgagttctgtaaagaaaagggtttgagttcgattatcgaagttgtgaagatggattatgttaacactgcgtttgagagactcgagaagaacgatgtgcgttataggttcgtcgttgatgtcgaaggaagcaatctcgacgcttga

SEQ ID NO: 84923 - protein, 357 aa, Arabidopsis thaliana
MGIMEAERKTTGWAARDPSGILSPYTYTLRETGPEDVNIRIICCGICHTDLHQTKNDLGMSNYPMVPGHEVVGEVVEVGSDVSKFTVGDIVGVGCLVGCCGGCSPCERDLEQYCPKKIWSYNDVYINGQPTQGGFAKATVVHQKFVVKIPEGMAVEQAAPLLCAGVTVYSPLSHFGLKQPGLRGGILGLGGVGHMGVKIAKAMGHHVTVISSSNKKREEALQDLGADDYVIGSDQAKMSELADSLDYVIDTVPVHHALEPYLSLLKLDGKLILMGVINNPLQFLTPLLMLGRKVITGSFIGSMKETEEMLEFCKEKGLSSIIEVVKMDYVNTAFERLEKNDVRYRFVVDVEGSNLDA

SEQ ID NO: 84924 - DNA, 1071 bp, Eucalyptus gunnii
  CDS (1)..(1071)
atgggcagtcttgagaaggagaggaccaccacgggttgggctgcaagggacccgtctggcgttctctctccttacacttatagcctcagaaacacgggaccagaagatctttacatcaaggtgttgagctgcggagtttgccacagtgacattcaccagatcaagaatgatcttggcatgtcccactaccctatggttcctgggcatgaagtggtgggcgaggttctggaggtgggatcagaggtgacaaagtacagagttggtgaccgagtgggaaccggtatagtggttgggtgctgcagaagctgtagcccttgcaattcggaccaggagcaatattgcaacaagaagatttggaattacaatgacgtgtacaccgatggcaagcccactcaaggtgggtttgctggtgagatagtggttggcgaaaggtttgtggtgaaaatcccagatgggttagagtcggaacaggcagcgccgctgatgtgcgctggtgtgaccgtgtacagccctctggtgcgctttgggctcaagcaaagcgggttgagaggagggatattggggcttggaggggttggccacatgggggtgaagatagccaaggccatgggacaccacgtgactgtgataagctcttctgataagaagagaacggaggcattggagcacctgggtgccgatgcttacctagtgagctccgatgaaaatggaatgaaagaggccactgattctctcgactacatttttgacactatccctgtggttcaccctctcgaaccttacctggccttgttgaagctcgatggaaagctgatcttgactggtgtcatcaatgctcctcttcaatttatctctcccatggttatgcttgggaggaagtcaatcactgggagtttcatagggagcatgaaggaaacagaggagatgcttgagttctgcaaagaaaagggattgacttcccagatcgaagtgatcaagatggattatgtcaacaccgccctagagaggctcgagaagaatgatgtcaggtacaggttcgtcgtggacgtcgtgggaagcaagcttgattag

SEQ ID NO: 84925 - protein, 356 aa, Eucalyptus gunnii
MGSLEKERTTTGWAARDPSGVLSPYTYSLRNTGPEDLYIKVLSCGVCHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 84926 - DNA, 1074 bp, Nicotiana tabacum
  CDS (1)..(1074)
atgggtggcttggaagttgagaaaacaactattggttgggctgctagagacccttctggtgtactttcaccttatacctatactctcagaaacacaggacctgaagatgtggaagtcaaagttttgtattgtgggctctgtcacactgatcttcaccaagttaaaaatgatcttggcatgtccaactaccctctggttcctggacatgaagtggtgggagaagtggtggaggtaggaccagatgtgtcaaaattcaaagttggggacacagttggagttggattactcgttggaagttgcaggaactgtggcccttgcaagagagatatagagcaatattgcaacaagaagatttggaactgcaatgatgtctacactgatggcaaacccacccaaggtggttttgctaaatccatggttgttgatcaaaagtttgtggtgaaaattccagagggtatggcaccagaacaagcagcacctctattatgtgctggtataacagtatacagtccattgaaccattttggtttcaaacagagtggattaagaggaggaattttgggattaggaggagtgggacacatgggagtgaaaatagcaaaggcaatgggacatcatgttactgtcattagttcttcaaataagaagagacaagaggcattggaacatcttggtgcagatgattatcttgtcagttcagacactgataaaatgcaagaggcttctgattcacttgactatattattgatactgtccctgttggccatcctcttgaaccttatctttctttgcttaaaattgatggcaaacttatcttgatgggagttatcaacacccccttgcaatttatctcccccatggttatgctcgggagaaagagcatcacaggaagctttattggtagcatgaaggaaacagaggaaatgctagatttctgcaaagagaaaggtgtgacttcacagattgagatagtgaaaatggattatatcaacactgcaatggagaggttggagaaaaatgatgtgaggtacagatttgtggttgatgttattggaagcaagcttgaccagtaa

SEQ ID NO: 84927 - protein, 357 aa, Nicotiana tabacum
MGGLEVEKTTIGWAARDPSGVLSPYTYTLRNTGPEDVEVKVLYCGLCHTDLHQVKNDLGMSNYPLVPGHEVVGEVVEVGPDVSKFKVGDTVGVGLLVGSCRNCGPCKRDIEQYCNKKIWNCNDVYTDGKPTQGGFAKSMVVDQKFVVKIPEGMAPEQAAPLLCAGITVYSPLNHFGFKQSGLRGGILGLGGVGHMGVKIAKAMGHHVTVISSSNKKRQEALEHLGADDYLVSSDTDKMQEASDSLDYIIDTVPVGHPLEPYLSLLKIDGKLILMGVINTPLQFISPMVMLGRKSITGSFIGSMKETEEMLDFCKEKGVTSQIEIVKMDYINTAMERLEKNDVRYRFVVDVIGSKLDQ

SEQ ID NO: 84928 - DNA, 1074 bp, Nicotiana tabacum
  CDS (1)..(1074)
atgggtagcttggatgttgaaaaatcagctattggttgggctgctagagacccttctggtctactttcaccttatacctatactctcagaaacacaggacctgaagatgtgcaagtcaaagttttgtattgtggactttgccacagtgatcttcaccaagttaaaaatgatcttggcatgtccaactaccctctggttcctggacatgaagtggtgggaaaagtagtggaggtaggagcagatgtgtcaaaattcaaagtgggggacacagttggagttggattactcgttggaagttgtaggaactgtggcccttgcaagagagaaatagagcaatattgcaacaagaagatttggaattgcaatgatgtctacactgatggcaaacccacccaaggtggttttgctaattctatggttgttgatcaaaactttgtggtgaaaattccagagggtatggcaccagaacaagcagcacctctattatgtgctggcataacagtatacagtccattcaaccattttggttttaatcagagtggatttagaggaggaattttgggattaggaggagttggacatatgggagtgaaaatagcaaaggcaatgggacatcatgttactgtcattagttcttcaaataagaagagacaagaggcattggaacatcttggtgcagatgattatcttgttagttcagacactgataaaatgcaagaagctgctgattcacttgactatattattgatactgtccctgttggccatcctcttgaactttatctttctttgcttaaaattgatggcaaacttatcttgatcggagttatcaacacccccttgcaatttatctctcccatggttatgctcgggagaaagagcatcactggaagctttattggtagcatgaaggaaacagaggaaatgctagacttctgcaaagagaaaggtgtgacttcacagattgagatagtgaaaatggattatatcaacactgcaatggagaggttggagaaaaatgatgtgagctacagatttgttgttgatgttgctggaagcaagcttgaccagtaa

SEQ ID NO: 84929 - protein, 357 aa, Nicotiana tabacum
MGSLDVEKSAIGWAARDPSGLLSPYTYTLRNTGPEDVQVKVLYCGLCHSDLHQVKNDLGMSNYPLVPGHEVVGKVVEVGADVSKFKVGDTVGVGLLVGSCRNCGPCKREIEQYCNKKIWNCNDVYTDGKPTQGGFANSMVVDQNFVVKIPEGMAPEQAAPLLCAGITVYSPFNHFGFNQSGFRGGILGLGGVGHMGVKIAKAMGHHVTVISSSNKKRQEALEHLGADDYLVSSDTDKMQEAADSLDYIIDTVPVGHPLELYLSLLKIDGKLILIGVINTPLQFISPMVMLGRKSITGSFIGSMKETEEMLDFCKEKGVTSQIEIVKMDYINTAMERLEKNDVSYRFVVDVAGSKLDQ

SEQ ID NO: 84930 - DNA, 1071 bp, Eucalyptus globulus
  CDS (1)..(1071)
atgggcagtcttgagaaggagaggaccaccacgggttgggctgcaagggacccgtctggcgttctctctccttacacttatagcctcagaaacacgggaccagaagatctttacatcaaggtgttgagctgcgggatttgccacagtgacattcaccagatcaagaatgatcttggcatgtcccactaccctatggttcctgggcatgaagtggtgggtgaggttctggaggtgggatcagaggtgacaaagtacagagttggtgaccgagtgggaaccggtatagtggttgggtgctgcagaagctgtagcccttgcaattcggaccaggagcaatattgcaacaagaagatttggaattacaatgacgtgtacaccgatggcaagcccactcaaggtgggtttgctggtgagatagtggttggcgaaaggtttgtggtgaaaatcccagatgggttagagtcggaacaggcagcgccgctgatgtgcgctggtgtgaccgtgtacagccctctggtgcgctttgggctcaagcaaagtgggctgagaggagggatattggggcttggaggggttggccacatgggcgtgaagatagccaaggccatgggacaccatgtgactgtgataagctcttctgataagaagagaacggaggcattggagcacctgggtgccgatgcttacctagtgagctccgatgaaaatggaatgaaagaggccactgattcgctcgactacatttttgacactatccctgtggttcaccctctcgaaccttacctggccttgttgaagctcgatgggaagctgatcttgactggtgtcatcaatgctcctcttcaatttatctctcccatggttatgcttgggaggaagtcaatcactgggagtttcatagggagcatgaaggaaacagaggagatgcttgagttctgcaaagaaaagggattgacttcccagatcgaagtgatcaagatggattatgtcaacacggccctagagaggctcgagaagaatgatgtcaggtacaggttcgtcgtggacgtcgtgggaagcaagcttgattag

SEQ ID NO: 84931 - protein, 356 aa, Eucalyptus globulus
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 84932 - DNA, 1086 bp, Lolium perenne
  CDS (1)..(1086)
atgggcagcgtcgacgcctccgagaagacgatcaccggctgggccgccagggacgccaccggccacctctccccgtacacgtacaacctcaggaggacgggcgctgaagatgtggtgctgaaggttctgtactgcggcatctgccacactgacctccaccagaccaagaaccaccttggtgcttcaaaataccccatggttcccgggcatgaggtggtaggcgaggtggtggaggtcgggccggaggtgagcaagtacagcgtcggcgatgtggtcggcgtgggggtgatcgttgggtgctgccgcgactgccggccgtgcaaggccaacgttgagcagtactgcaacaagaagatctggtcgtacaacgacgtctacaccgacggaaagcccacgcagggcggcttcgctggctccatggtcgtcgaccagaagttcgtggtgaagatcccagcggggctagcgccggagcaggcggcgccgctgctgtgcgctggcgtcacggtgtacagcccgctgaagcacttcgggctgatgaccccgggcctccgcggcggcatcctcggcctgggcggcgtgggccacatgggcgtgaaggtggccaagtccatgggccaccacgtcaccgtgatcagctcctccgacaagaagcgcgccgaggccatggacgacctgggcgccgacgactacctcgtcagctccgacgaggcccagatggccgccgccatggactcgctggactacatcatcgacaccgtgcccgtcaagcacccgctcgagccctacctcgcgctgctcaagatggacggcaagctcgtcctcatgggcgtcattggcgagccgctcagcttcgtgtcccccatggtcatgctcgggaggaagaccatcacgggcagcttcatcgggagcatcgaggagaccgaggaggtgctcaggttctgcgtcgacaagggcctcacctcgcagatcgaggtcgtcaagatggactacctcaaccaggcgcttgagaggctcgagcgcaacgacgtcaggtaccgcttcgtcgtcgacgtcgcagggagcaacatcgacgacactgccgcatga

SEQ ID NO: 84933 - protein, 361 aa, Lolium perenne
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFAGSMVVDQKFVVKIPAGLAPEQAAPLLCAGVTVYSPLKHFGLMTPGLRGGILGLGGVGHMGVKVAKSMGHHVTVISSSDKKRAEAMDDLGADDYLVSSDEAQMAAAMDSLDYIIDTVPVKHPLEPYLALLKMDGKLVLMGVIGEPLSFVSPMVMLGRKTITGSFIGSIEETEEVLRFCVDKGLTSQIEVVKMDYLNQALERLERNDVRYRFVVDVAGSNIDDTAA

SEQ ID NO: 84934 - DNA, 1104 bp, Zea mays
  CDS (1)..(1104)
atggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacgaggtggtcggcgaggtggtggaggtcgggcccgaagtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaacccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatggcggcggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactga

SEQ ID NO: 84935 - protein, 367 aa, Zea mays
MGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTNPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 84936 - DNA, 1077 bp, Medicago sativa
  CDS (1)..(1077)
atgggtagcattgaagctgcagaaagaacaacagtaggattggctgcaaaagacccttccggaattctcactccatacacatacactctcagaaacacaggaccggatgatgtttacatcaaaattcattactgtggagtttgtcattctgatcttcaccaaatcaaaaatgatcttggcatgtccaattatcctatggttcccgggcatgaagtggttggtgaggtactagaggtgggttcaaatgttacaaggttcaaagtgggagaaattgtgggagttggtcttctcgttggttgctgcaaaagctgcagagcatgtgattctgagattgagcaatactgtaacaagaagatctggtcttacaatgatgtttacactgacggaaagatcactcagggtggctttgctgaatccaccgtcgttgaacaaaagtttgttgtgaaaataccagagggattggcaccagagcaagttgcaccattgttgtgtgcaggtgtgactgtgtacagtccactttcacattttgggctgaaaacacctgggctaagaggtggaatattgggtcttggtggagtaggacacatgggggtgaaagtagcaaaggcattaggtcaccatgtcactgtgataagctcttctgataagaagaagaaagaggcacttgaggatcttggagctgacaattatcttgttagctcagatactgttgggatgcaagaagctgctgattcacttgattatatcattgacactgttcctgttggtcaccctcttgagccttatctttcattgctcaaaattgatgggaaattgatcttgatgggtgttattaacacccctcttcaatttgttacacctatggtcatgctagggaggaagtcaattactggaagctttgttgggagcgtgaaggagacagaggagatgttggagttttggaaagagaagggtctaacttccatgattgaaattgtaactatggattacattaacaaagcttttgaaagattggagaagaatgatgtgaggtataggttcgttgtggatgtcaaaggaagtaaatttgaggagtga

SEQ ID NO: 84937 - protein, 358 aa, Medicago sativa
MGSIEAAERTTVGLAAKDPSGILTPYTYTLRNTGPDDVYIKIHYCGVCHSDLHQIKNDLGMSNYPMVPGHEVVGEVLEVGSNVTRFKVGEIVGVGLLVGCCKSCRACDSEIEQYCNKKIWSYNDVYTDGKITQGGFAESTVVEQKFVVKIPEGLAPEQVAPLLCAGVTVYSPLSHFGLKTPGLRGGILGLGGVGHMGVKVAKALGHHVTVISSSDKKKKEALEDLGADNYLVSSDTVGMQEAADSLDYIIDTVPVGHPLEPYLSLLKIDGKLILMGVINTPLQFVTPMVMLGRKSITGSFVGSVKETEEMLEFWKEKGLTSMIEIVTMDYINKAFERLEKNDVRYRFVVDVKGSKFEE

SEQ ID NO: 84938 - DNA, 1074 bp, Pinus radiata
  CDS (1)..(1074)
atgggaagcttggaaactgaaaaaactgttacaggatatgcagctcgggactccagtggccacttgtccccttacacttacaatctcagaaagaaaggacctgaggatgtaattgtaaaggtcatttactgcggaatctgccactctgatttagttcaaatgcgtaatgaaatgggcatgtctcattacccaatggtccctgggcatgaagtggtggggattgtaacagagattggtagcgaggtgaagaaattcaaagtgggagagcatgtaggggttggttgcattgttgggtcctgtcgcagttgcggtaactgcaatcagagcatggaacaatactgcagcaagaggatttggacctacaatgatgtgaaccatgacggcacccctactcagggaggatttgcaagcagtatggtggttgatcagatgtttgtggttcgaatcccggagaatcttcctctggaacaagcggcccctctgttatgtgcaggggttacagttttcagcccaatgaagcatttcgccatgacagagcccgggaagaaatgtgggattttgggtttaggaggcgtggggcacatgggtgtcaagattgccaaagcctttggactccacgtgacggttatcagttcgtctgataaaaagaaagaagaagccatggaagtcctcggcgccgatgcttatcttgttagcaaggatactgaaaagatgatggaagcagcagagagcctagattacataatggacaccattccagttgctcatcctctggaaccatatcttgcccttctgaagacaaatggaaagctagtgatgctgggcgttgttccagagccgttgcacttcgtgactcctctcttaatacttgggagaaggagcatagctggaagtttcattggcagcatggaggaaacacaggaaactctagatttctgtgcagagaagaaggtatcatcgatgattgaggttgtgggcctggactacatcaacacggccatggaaaggttggagaagaacgatgtccgttacagatttgtggtggatgttgctggaagcaagttggataattag

SEQ ID NO: 84939 - protein, 357 aa, Pinus radiata
MGSLETEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHMGVKIAKAFGLHVTVISSSDKKKEEAMEVLGADAYLVSKDTEKMMEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLEKNDVRYRFVVDVAGSKLDN

SEQ ID NO: 84940 - DNA, 1074 bp, Pinus taeda
  CDS (1)..(1074)
atgggaagcttggaatctgaaaaaactgttacaggatatgcagctcgggactccagtggccacttgtccccttacacttacaatctcagaaagaaaggacctgaggatgtaattgtaaaggtcatttactgcggaatctgccactctgatttagttcaaatgcgtaatgaaatgggcatgtctcattacccaatggtccctgggcatgaagtggtggggattgtaacagagattggtagcgaggtgaagaagttcaaagtgggagagcatgtaggggttggttgcattgttgggtcctgtcgcagttgcggtaactgcaatcagagcatggaacaatactgcagcaagaggatttggacctacaatgatgtgaaccatgacggcacccctactcagggaggatttgcaagcagtatggtggttgatcagatgtttgtggttcgaatcccggagaatcttcctctggaacaagcagcccctctgttatgtgcaggggttacagttttcagcccaatgaagcatttcgccatgacagagcccgggaagaaatgtgggattttgggtttaggaggcgtggggcacttgggtgtcaagattgccaaagcctttggacttcacgtgacggttatcagttcgtctgataaaaagaaagaagaagccatggaagtcctcggcgccgatgcttatcttgttagcaaggatactgaaaagatgatggaagcagcagagagcctagattacataatggacaccattccagttgctcatcctctggaaccatatcttgcccttctgaagacaaatggaaagctagtgatgctgggcgttgttccagagccgttgcacttcgtgactcctcccttaatacttgggagaaggagcatagctggaagtttcattggcggcatggaggaaacacaggaaactctagatttctgtgcagagaagaaggtatcatcgatgattgaggttgtgggcctggactacatcaacacggccatggaaaggttggagaagaacgatgtccgttacagatttgtggtggatgttgctggaagcgagctagataactag

SEQ ID NO: 84941 - protein, 357 aa, Pinus taeda
MGSLESEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHLGVKIAKAFGLHVTVISSSDKKKEEAMEVLGADAYLVSKDTEKMMEAAESLDYIMDTIPVAHPLEPYLALLKTNGKLVMLGVVPEPLHFVTPPLILGRRSIAGSFIGGMEETQETLDFCAEKKVSSMIEVVGLDYINTAMERLEKNDVRYRFVVDVAGSELDN

SEQ ID NO: 84942 - DNA, 1074 bp, Populus deltoides
  CDS (1)..(1074)
atgggtagccttgaaacagagagaaaaattgtaggatgggcagcaacagactcaactgggcatctcgctccttacacctatagtctcagagatacggggccagaagatgtttttatcaaggttatcagttgtggagtttgccataccgatatccaccaaatcaaaaatgatcttggcatgtcacactatcctatggtccctggccatgaagtggttggtgaggttgttgaggtgggatcagatgtgacaaggttcaaagttggagatgttgtcggtgttggagtcatcgttggaagctgcaagaattgtcatccatgcaaatcagagattgagcaatactgcaacaagaaaatctggtcttacaatgatgtctacactgatggcaaacccacccaaggaggctttgctgaatccatggttgtgcatcaaaagtttgtggtgagaattcctgatgggatgtcaccagaacaagcagcgccgctattgtgcgctggattgacagtttacagcccacttaaacactttggactgaaacagagtgggctaagaggagggattttaggacttggaggagtagggcacatgggggtgaagatagcaaaggcaatgggacaccatgtaactgtgattagttcttctgacaagaagcgggaggaggctatggaacatcttggtgctgatgaatacttggtcagctcggatgtggaaagcatgcaaaaagctgctgatcaacttgattatatcatcgatactgtgcctgtggttcaccctctggagccttacctttctctgttgaaacttgatggcaagctgatcttgatgggtgttattaatgccccattgcagtttgttacgcctatggttatgcttgggagaaagtctatcaccgggagcttcatagggagcatgaaggagacagaggagatgcttgagttctgcaaggaaaagggagtggcctccatgattgaagtgatcaaaatggattatatcaacacagcattcgagaggcttgagaaaaatgatgtgagatatagattcgttgtcgatgttgctggtagcaagcttattcactga

SEQ ID NO: 84943 - protein, 357 aa, Populus deltoides
MGSLETERKIVGWAATDSTGHLAPYTYSLRDTGPEDVFIKVISCGVCHTDIHQIKNDLGMSHYPMVPGHEVVGEVVEVGSDVTRFKVGDVVGVGVIVGSCKNCHPCKSEIEQYCNKKIWSYNDVYTDGKPTQGGFAESMVVHQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGVASMIEVIKMDYINTAFERLEKNDVRYRFVVDVAGSKLIH

SEQ ID NO: 84944 - DNA, 1098 bp, Saccharum officinarum
  CDS (1)..(1098)
atggggagcctggcgtccgagaggaaggtggtcgggtgggccgccagggacgccaccggacacctcgccccctacacctacaccctcaggagcacaggccctgaagatgtggtggtgaaggtgctctactgtgggatctgccacacagacatccaccaggccaagaaccacctcggggcttcaaagtaccccatggtccctgggcacgaagtggtcggtgaggtggtggaagtcgggcccgaagtgaccaagtacggcgtcggcgacgtggtaggcgtcggggtgatcgtcgggtgctgccgcgagtgcaaaccctgcaaggccaacgttgagcagtactgcaacaagaagatctggtcctacaacgatgtctacactgacggccggcccacgcagggcggcttcgcctccaccatggtcgtcgaccagaagtttgtgatgaagatcccggcgggtctggcgccggagcaagcggcgccgctgctgtgcgcgggcgttacggtgtacagcccgctgaaagcctttgggctgacgaccccgggcctccgtggcgcgatcctgggcctcggcggcgtgggccacatgggcgtgaaggtggccaaggccatgggccaccacgtgacggtgatcagctcgtcgtccaagaagcgcgcggaggcgatggaccacctgggcgcggacgcgtacctggtgagctcggacgcggcggccatggcggcggccgccgactcgctggactacatcatcgacacggtgcccgtgcaccacccgctggagccctacctggcgctgctgaagctggacggcaagcacgttctgctgggcgtcatcggcgagcccctcagcttcgtgtccccaatggtgatgctggggcggaaggccatcacggggagcttcatcggcagcatcgacgagaccgccgaggtgctccagttctgcgtcgacaaggggctcacctcccagatcgaggtggtcaagatggggtacgtgaacgaggcgctggatcggctggagcgcaacgacgtccgctaccgcttcgtcgtcgacgtcgccggcagcaacgtcgaggaggtggcggccgatgcgccgagcaactga

SEQ ID NO: 84945 - protein, 365 aa, Saccharum officinarum
MGSLASERKVVGWAARDATGHLAPYTYTLRSTGPEDVVVKVLYCGICHTDIHQAKNHLGASKYPMVPGHEVVGEVVEVGPEVTKYGVGDVVGVGVIVGCCRECKPCKANVEQYCNKKIWSYNDVYTDGRPTQGGFASTMVVDQKFVMKIPAGLAPEQAAPLLCAGVTVYSPLKAFGLTTPGLRGAILGLGGVGHMGVKVAKAMGHHVTVISSSSKKRAEAMDHLGADAYLVSSDAAAMAAAADSLDYIIDTVPVHHPLEPYLALLKLDGKHVLLGVIGEPLSFVSPMVMLGRKAITGSFIGSIDETAEVLQFCVDKGLTSQIEVVKMGYVNEALDRLERNDVRYRFVVDVAGSNVEEVAADAPSN

SEQ ID NO: 84946 - DNA, 1074 bp, Arabidopsis thaliana
  CDS (1)..(1074)
atgggaaaggttcttgagaaggaggcgtttggattggctgcgaaagacgaatcgggaattctttcgcctttcagtttctctagaagggcgacgggtgaaaaggatgtgaggttcaaagtcttgttctgtggaatttgccacactgatctgagtatggccaaaaacgaatgggggttaactacttatcctcttgtccctgggcatgagattgtgggcgtggtgactgaagttggagccaaagtgaaaaaattcaacgctggagacaaagtcggagttggctatatggccggctcgtgcaggtcatgtgacagctgcaatgatggcgacgagaactactgtccaaagatgatcttaacgtccggagccaaaaactttgacgataccatgacccatggtggatactccgaccacatggtgtgtgctgaggatttcatcatccgtattcctgacaatctcccattagacggtgccgcaccactactctgcgccggggtcacggtctactcccccatgaagtatcacgggctcgacaagcccggtatgcacatcggtgtggtgggactaggcggtttgggccatgtagcagtgaaatttgctaaggctatgggtactaaagttacggttattagtacttcggagcgtaagagagacgaggccgttactcggcttggtgcggatgccttcttggtgagccgtgacccgaaacaaatgaaggatgcaatggggactatggatggtatcattgataccgtatctgcgacccatccacttcttccgctgcttggtttgcttaaaaataagggaaaacttgttatggttggtgcaccagcagaaccgctcgagcttcctgtttttcctctcatctttgggcggaagatggtggtgggtagtatggtaggaggtataaaggagacgcaagagatggtggatttggctggaaaacacaacatcacggcggatattgagctcatctctgcggattatgtcaacaccgccatggaacggcttgcaaaggctgacgttaagtaccgatttgtgattgatgttgccaacacgatgaagccaactccttaa

SEQ ID NO: 84947 - protein, 357 aa, Arabidopsis thaliana
MGKVLEKEAFGLAAKDESGILSPFSFSRRATGEKDVRFKVLFCGICHTDLSMAKNEWGLTTYPLVPGHEIVGVVTEVGAKVKKFNAGDKVGVGYMAGSCRSCDSCNDGDENYCPKMILTSGAKNFDDTMTHGGYSDHMVCAEDFIIRIPDNLPLDGAAPLLCAGVTVYSPMKYHGLDKPGMHIGVVGLGGLGHVAVKFAKAMGTKVTVISTSERKRDEAVTRLGADAFLVSRDPKQMKDAMGTMDGIIDTVSATHPLLPLLGLLKNKGKLVMVGAPAEPLELPVFPLIFGRKMVVGSMVGGIKETQEMVDLAGKHNITADIELISADYVNTAMERLAKADVKYRFVIDVANTMKPTP

SEQ ID NO: 84948 - DNA, 1065 bp, Stylosanthes humilis
  CDS (1)..(1065)
atggcatcatcgaaagcctttggctgggctgcaaaagatgcctccggccatctctctcccttccatttcacaagaaggcaaaacgaagctgatgacgtcacgctgaaaatcctctactgcggggtttgccattccgatctccacacagtcaagaacgactggggtttcactacttaccctgttgtccctgggcatgaaattgctggtattgtgacaaaagttggaagtaatgtgacaaaatttaaggagggtgatagagttggagttggtgtaatagtggactcatgtcaggaatgtgagtgttgccagcaggatctggagagttactgtcctaaacctgtgtttacctataactctccttataaagggacacgaacccagggtggctactctgattttgtggttgtacatcagcgctttgtgcttcaatttcctgacaacctaccccttgatgccggtgccccgcttctgtgtgctgggatcactgtgtatagtcctatgaagtattatggcatgacagagccgggcaagcatttgggagtcgccgggcttggtggcttaggccatgttgccatcaaatttggcaaagcatttggtctcaaagttactgtcattagtagctctcccaacaaggaatctgaagctattgacgttctaggggctgattctttccttctttcctctgaccctgaaaagatgaaggctgctaccggaacgatggattatatcattgacacgatttctgctgttcattcgctggtttccctgcttggtctgctgaagctgaacggaaagttggtcaccgtggggctgcctagcaagccgcttcagctgcctatctttcccttggttgcaggaaggaagcttatagggggaagcaactttggagggctgaaggagactcaggagatgcttgatttctgtggaaagcataacatagctgcaaatattgagctgattaagatggatgagatcaacactgctatagaaaggctcagcaaagctgatgttaagtatcgctttgtcattgatgttgcaaactccttatcatccagtaacatgtag

SEQ ID NO: 84949 - protein, 354 aa, Stylosanthes humilis
MASSKAFGWAAKDASGHLSPFHFTRRQNEADDVTLKILYCGVCHSDLHTVKNDWGFTTYPVVPGHEIAGIVTKVGSNVTKFKEGDRVGVGVIVDSCQECECCQQDLESYCPKPVFTYNSPYKGTRTQGGYSDFVVVHQRFVLQFPDNLPLDAGAPLLCAGITVYSPMKYYGMTEPGKHLGVAGLGGLGHVAIKFGKAFGLKVTVISSSPNKESEAIDVLGADSFLLSSDPEKMKAATGTMDYIIDTISAVHSLVSLLGLLKLNGKLVTVGLPSKPLQLPIFPLVAGRKLIGGSNFGGLKETQEMLDFCGKHNIAANIELIKMDEINTAIERLSKADVKYRFVIDVANSLSSSNM

SEQ ID NO: 84950 - DNA, 1080 bp, Arabidopsis thaliana
  CDS (1)..(1080)
atgggaaaggttcttcagaaagaggcgttcggattagccgcgaaagacaattccggagttctctcgcctttcagtttcactagaagggaaacaggagaaaaggatgtgaggttcaaagtgttattttgtggaatttgtcactctgatttgcatatggtcaagaacgagtggggaatgtctacttatcctcttgtcccagggcatgagatcgtgggcgtggtgactgaagtcggagccaaagtgactaaattcaaaaccggagaaaaagtcggagttgggtgtttggtcagctcgtgcgggtcatgtgacagctgcaccgaaggtatggaaaactattgtccaaaatcaatccaaacgtacggattcccgtactacgacaacaccataacatacggtggttactccgaccacatggtttgcgaggaaggtttcgtcatccgtattccagacaatctccccttggacgccgccgcaccgctcctctgtgccggtatcacggtctattcccctatgaagtatcacgggctcgacaaacccggtatgcacatcggtgtggtaggattaggcggtttaggtcatgtaggagtgaaatttgccaaggctatgggtactaaggttacggttattagtacttcggagaaaaagagagatgaggcgattaatcggcttggtgcggatgctttcttggtgagccgtgacccaaaacagattaaggatgcaatgggtactatggatggtataattgataccgtctctgcgactcattcacttcttccgttgctcggtttgctgaagcataagggaaaacttgttatggttggtgcacccgagaagccactcgagctacctgtcatgcctctcatctttgagaggaagatggtaatgggaagtatgataggagggataaaagagacccaggaaatgatagatatggccgggaaacacaacatcactgcggatattgagcttatctctgccgattatgtcaacaccgccatggaacggctagagaaagccgacgttaggtaccgctttgtgattgatgttgccaacacattgaagcctaatcctaatttataa

SEQ ID NO: 84951 - protein, 359 aa, Arabidopsis thaliana
MGKVLQKEAFGLAAKDNSGVLSPFSFTRRETGEKDVRFKVLFCGICHSDLHMVKNEWGMSTYPLVPGHEIVGVVTEVGAKVTKFKTGEKVGVGCLVSSCGSCDSCTEGMENYCPKSIQTYGFPYYDNTITYGGYSDHMVCEEGFVIRIPDNLPLDAAAPLLCAGITVYSPMKYHGLDKPGMHIGVVGLGGLGHVGVKFAKAMGTKVTVISTSEKKRDEAINRLGADAFLVSRDPKQIKDAMGTMDGIIDTVSATHSLLPLLGLLKHKGKLVMVGAPEKPLELPVMPLIFERKMVMGSMIGGIKETQEMIDMAGKHNITADIELISADYVNTAMERLEKADVRYRFVIDVANTLKPNPNL

SEQ ID NO: 84952 - DNA, 1092 bp, Stylosanthes humilis
  CDS (1)..(1092)
atggaagcatcacaagttgaatttgagcatcctaggaaggcatttggatgggcagcaagagattcttctggattgctctcccctttcaatttctctagaagggacattggagaggaagatgttgcattggaagtgttgtactgtggtatatgccacacggacctgcacatggcaaagaacgactttggcaattccatctatccatatgtccctgggcatgaagtgattggcatagttgcagaggtgggaagcaaggtagaaaagtacaaggttggagacaaagtgggcgtgggatactttgtagaatcttgtcgctcctgccaaaattgtattgataatcttgaaaattattgtccaaaacacatattaacacaaggtgacaaacacattgatggaaccacaacctatggaggctactctgattcaatggttgttgatgaacactttgtgacccgaattcctgaaggactacctcttgatggctgcggctcctcttctttgtgctggggttacagtcacagccctctaaaatattatgggcttgataagcctggtttgcatgtgggtgtagttggccttggtgggcttggccatatggtagccaagtttgctaaaacccatgggcttaagatcactgtcattagtacttcacccccaaccaaaaaagaggaagcaataaagaatttgggagctgattcatttttggttagtcgtgatccagaccaaatggaggctccaaaagaaactctggatggcatcattgacacagtttctgctgatcattccattgtacctctaattggattattgaagtctcatggaaaacttgtattgattggggcaattgagaagcctctggaattgcctccctttcctttgattttgggaagaaaacttgttggtggtactctggtcggagggctgaaagagacacaagaaatgattgatttttccccaaaacataatgtgaagcctgagattgaagttgttccaatggattatgttaacattgcaatgcaacgtcttgctaaagctgatgtcaagtatcgcttcgtaattgatgttgcaaacacactcaaaccaacctcttga

SEQ ID NO: 84953 - protein, 363 aa, Stylosanthes humilis
MEASQVEFEHPRKAFGWAARDSSGLLSPFNFSRRDIGEEDVALEVLYCGICHTDLHMAKNDFGNSIYPYVPGHEVIGIVAEVGSKVEKYKVGDKVGVGYFVESCRSCQNCIDNLENYCPKHILTQGDKHIDGTTTYGGYSDSMVVDEHFVTRIPEGLPLDGCGSSSLCWGYSHSPLKYYGLDKPGLHVGVVGLGGLGHMVAKFAKTHGLKITVISTSPPTKKEEAIKNLGADSFLVSRDPDQMEAPKETLDGIIDTVSADHSIVPLIGLLKSHGKLVLIGAIEKPLELPPFPLILGRKLVGGTLVGGLKETQEMIDFSPKHNVKPEIEVVPMDYVNIAMQRLAKADVKYRFVIDVANTLKPTS

SEQ ID NO: 84954 - DNA, 1083 bp, Arabidopsis thaliana
  CDS (1)..(1083)
atggcgaaatctccagaaacagagcatccgaacaaagtctttggttggggtgctagagacaaatccggtgttctctctccttttcacttctctagaagagacaatggtgaaaatgatgtgacagtgaagatcttgttctgtggagtttgccacactgatttacacaccatcaaaaacgactggggatactcgtattacccagtagttccagggcatgaaatcgttgggatcgctacaaaagttggtaagaacgtgactaaattcaaagaaggagatcgtgtcggagtaggagtgatcagtggctcgtgccaatcttgcgaatcttgtgaccaagatcttgaaaactactgtcctcaaatgtctttcacatacaatgcgattggatccgatggaaccaagaattacggtggctattcggagaacattgtggttgatcaacggtttgttttgcggtttccggagaatttaccgagcgattcgggtgcgccgttgctgtgtgctggaatcactgtgtatagtccaatgaagtattatggtatgactgaggcagggaagcatttaggggttgctggacttggtgggcttggtcatgttgctgttaagagtggtaaagcttttggtttgaaagttactgtcattagttcttcttctacgaaagcagaggaagccattaatcatcttggtgctgattcgtttcttgtcacaactgatcctcagaaaatgaaggctgcaattggaacaatggactacattatcgatacgatatcagcagtacatgctctgtatccgttgctcggtttactcaaagtcaacggaaagctcattgctttaggcttacctgagaagcctctcgagctaccaatgttccctcttgttctcggaaggaaaatggttggaggaagtgacgtgggagggatgaaggagacacaagagatgcttgatttctgcgctaagcacaacattacagctgatattgaattgattaagatggatgagattaacactgcgatggagaggcttgctaagtctgatgttaggtacaggttcgtgatcgacgtggctaactccttgagccctccatga

SEQ ID NO: 84955 - protein, 360 aa, Arabidopsis thaliana
MAKSPETEHPNKVFGWGARDKSGVLSPFHFSRRDNGENDVTVKILFCGVCHTDLHTIKNDWGYSYYPVVPGHEIVGIATKVGKNVTKFKEGDRVGVGVISGSCQSCESCDQDLENYCPQMSFTYNAIGSDGTKNYGGYSENIVVDQRFVLRFPENLPSDSGAPLLCAGITVYSPMKYYGMTEAGKHLGVAGLGGLGHVAVKSGKAFGLKVTVISSSSTKAEEAINHLGADSFLVTTDPQKMKAAIGTMDYIIDTISAVHALYPLLGLLKVNGKLIALGLPEKPLELPMFPLVLGRKMVGGSDVGGMKETQEMLDFCAKHNITADIELIKMDEINTAMERLAKSDVRYRFVIDVANSLSPP

SEQ ID NO: 84956 - DNA, 1080 bp, Fragaria ananassa
  CDS (1)..(1080)
atggctatcgagcaagaacaccgcaagaaggcatctggatgggctgcaagagattcatctggtgttctctctcccttcaatttctacagaagggaaaccggagagaaagacgtgacgttcaaagtgttgtactgtgggatttgccattcggaccttcacatggtcaagaatgaatggggcttctctacctatcctctggttccagggcatgagattgttggtgaagttacggaagtagggagcaaagtacaaaaatttaaagttggagacagagtcggtgttggatgcattgtgggatcttgccgatcttgtgaaaattgtaccgaccaccttgagaactactgccccaaacagatactcacttacggtgccaagtattacgacggaagcaccacctatggcggttactctgacattatggtggccgatgaacacttcatagtacgcatcccagacaacttgcctcttgatggtgctgcgccgctcctatgtgccgggattacaacctacagccccctgagatatttcggacttgacaagcccggcatgcatgtaggtgtggtcggcctaggcggtttaggccacgtcgccgtgaagtttgccaaggctatgggagtgaaggttacagtgatcagtacgtcccctaagaaagaggaggaagctcttaaacacctaggagctgactcgtttttggttagccgtgaccaagatcaaatgcaggctgccattggtaccatggatgggatcattgacacagtttctgcacaacatcctctcctgcctttgattggtttgttgaactctcatggaaagcttgttatggttggtgcaccagagaagcctcttgaacttccagtttttcctttactcatgggaagaaagatggtagctggtagcggcattgggggtatgaaggagacacaagagatgatagattttgcagccaggcacaacataacagcagacatcgaagtcataccaatcgactacttgaacactgctatggagcgtctagtcaaagcagatgtcagataccgttttgtcatcgacattggaaacacactgaaggttaggtcttaa

SEQ ID NO: 84957 - protein, 359 aa, Fragaria ananassa
MAIEQEHRKKASGWAARDSSGVLSPFNFYRRETGEKDVTFKVLYCGICHSDLHMVKNEWGFSTYPLVPGHEIVGEVTEVGSKVQKFKVGDRVGVGCIVGSCRSCENCTDHLENYCPKQILTYGAKYYDGSTTYGGYSDIMVADEHFIVRIPDNLPLDGAAPLLCAGITTYSPLRYFGLDKPGMHVGVVGLGGLGHVAVKFAKAMGVKVTVISTSPKKEEEALKHLGADSFLVSRDQDQMQAAIGTMDGIIDTVSAQHPLLPLIGLLNSHGKLVMVGAPEKPLELPVFPLLMGRKMVAGSGIGGMKETQEMIDFAARHNITADIEVIPIDYLNTAMERLVKADVRYRFVIDIGNTLKVRS

SEQ ID NO: 84958 - DNA, 1080 bp, Medicago sativa
  CDS (1)..(1080)
atggcgaaatcaccagaaaccgaactcccactcaaagcctttggttgggctgctagagacacttctggcaccctctctccctttcatttctctcgaagggaaaatggtgatgatgatgtgagtgtgaaaattctatattgtggagtttgtcattctgatctacacactctcaagaacgattggggtttcactacttaccctgttgttcctgggcatgaaattgttggcgttgtgacaaaagttggaatcaatgtgaaaaaattcagagtgggtgataacgttggtgttggtgtaattgtcgagtcttgtcagacttgtgagaattgcaatcaagatttggagcagtactgtcctaaacctgtatttacctataactctccttataaagggacacgaacctatggtggctattctgattttgtggttgttcaccagcggtatgtagttcagtttcctgacaacttaccccttgacgctggtgctccacttctgtgtgccgggatcaccgtgtatagcccgatgaagtattatggtatgactgaaccaggcaaacatttgggagtggcagggcttggtgggttaggccatgttgcaatcaaattcggtaaagcatttgggctgaaggttactgttattagtacctctccaaacaaggaaactgaggccattgacaaacttggtgctgattctttccttgtttccaaagaccctgagaaaatgaaggctgctatgggaaccatggactacatcatagacacaatatctgctgctcattccctgatgccactgcttggtctactgaagttgaatgggaaactggtcactgtagggttgcctagcaagccccttgagctctctgtctttccattagttgcaggacggaagcttatcggagggagtaacattggagggatgaaagagactcaggagatgctcgatttctgcggcaagcacaacataactgcagatattgagttgattaagatgcatgaaatcaacacggccatggaaaggcttcacaaagctgatgtgaaatatcggtttgtgattgatgtggccaactccttctcaagtttgtag

SEQ ID NO: 84959 - protein, 359 aa, Medicago sativa
MAKSPETELPLKAFGWAARDTSGTLSPFHFSRRENGDDDVSVKILYCGVCHSDLHTLKNDWGFTTYPVVPGHEIVGVVTKVGINVKKFRVGDNVGVGVIVESCQTCENCNQDLEQYCPKPVFTYNSPYKGTRTYGGYSDFVVVHQRYVVQFPDNLPLDAGAPLLCAGITVYSPMKYYGMTEPGKHLGVAGLGGLGHVAIKFGKAFGLKVTVISTSPNKETEAIDKLGADSFLVSKDPEKMKAAMGTMDYIIDTISAAHSLMPLLGLLKLNGKLVTVGLPSKPLELSVFPLVAGRKLIGGSNIGGMKETQEMLDFCGKHNITADIELIKMHEINTAMERLHKADVKYRFVIDVANSFSSL

SEQ ID NO: 84960 - DNA, 1086 bp, Mesembryanthemum crystallinum
  CDS (1)..(1086)
atggcaaattcagcacctgaaaatgtccacccacaaaaggctttcggatgggctgccagagacacctctggcactctctctcctctcaaattctctaggagggcaacaggagagcaggatgtaacgtttaaagtgttgtattgtgggatttgtcactctgatcttcactatatcaagaatgaatggggcaatgctgtttaccctgctattcctgggcatgagattgtaggagttgtcacagaagtaggaaacaaagtccaaaacttcaaagttggagacaaagtcggggtaggatgcatggttggatcctgccgttcatgtgaaagctgcgagaaccatctcgaaaactactgccccaagatgattctcacctacggatcaacctactatgacggcaccctaacatatggaggctactccgacatcatggttgtcgaggagcactttgctgttcgcattcctgacaacatggcacttgatgccactgcccctcttctctgtgctggtgtcactgtctacagcccgttgaagcactttgagctcgacaaaccaggactccatatcggtgttgttggtcttggtgggttgggtcatatggctgtgaagtttggcaaggcttttggtgccaaggtcacggttataagtacctcgccgaacaagaaggatgaagctgttaatcgtcttggtgctgattcttttgtggtcagccgcgaacctgagcagatgcagtctgctatggggactttggatggtataatagataccgtctctgcagctcatcctctgttaccattgcttggtctgctgaaatctcaagggaagatgatcatggttggtgtccctgacaaacctctcgagttgccggtttttcctttgcttcaggggaggaaaatattggctggaagctgcataggaggcatgaaggagacgcaggaaatgatcgattttgctgccaagcacgacattaaatcagatattgaggtggtaccgatggattatgtgaacacggccatggaacgtctacttaagggagatgttagataccgttttgtcatcgatgtcgcaaacaccttgaaagctgaatga

SEQ ID NO: 84961 - protein, 361 aa, Mesembryanthemum crystallinum
MANSAPENVHPQKAFGWAARDTSGTLSPLKFSRRATGEQDVTFKVLYCGICHSDLHYIKNEWGNAVYPAIPGHEIVGVVTEVGNKVQNFKVGDKVGVGCMVGSCRSCESCENHLENYCPKMILTYGSTYYDGTLTYGGYSDIMVVEEHFAVRIPDNMALDATAPLLCAGVTVYSPLKHFELDKPGLHIGVVGLGGLGHMAVKFGKAFGAKVTVISTSPNKKDEAVNRLGADSFVVSREPEQMQSAMGTLDGIIDTVSAAHPLLPLLGLLKSQGKMIMVGVPDKPLELPVFPLLQGRKILAGSCIGGMKETQEMIDFAAKHDIKSDIEVVPMDYVNTAMERLLKGDVRYRFVIDVANTLKAE

SEQ ID NO: 84962 - DNA, 1050 bp, Escherichia coli
  CDS (1)..(1050): transl_table=11
atgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactga

SEQ ID NO: 84963 - protein, 349 aa, Escherichia coli
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 84964 - DNA, 1020 bp, Escherichia coli
  CDS (1)..(1020)
atgtcgatgataaaaagctatgccgcaaaagaagcgggcggcgaactggaagtttatgagtacgatcccggtgagctgaggccacaagatgttgaagtgcaggtggattactgcgggatctgccattccgatctgtcgatgatcgataacgaatggggattttcacaatatccgctggttgccgggcatgaggtgattgggcgcgtggtggcactcgggagcgccgcgcaggataaaggtttgcaggtcggtcagcgtgtcgggattggctggacggcgcgtagctgtggtcactgcgacgcctgtattagcggtaatcagatcaactgcgagcaaggtgcggtgccgacgattatgaatcgcggtggctttgccgagaagttgcgtgcggactggcaatgggtgattccactgccagaaaatattgatatcgagtccgccgggccgctgttgtgcggcggtatcacggtctttaaaccactgttgatgcaccatatcactgctaccagccgcgttggggtaattggtattggcgggctggggcatatcgctataaaacttctgcacgcaatgggatgcgaggtgacagcctttagttctaatccggcgaaagagcaggaagtgctggcgatgggtgccgataaagtggtgaatagccgcgatccgcaggcactgaaagcactggcggggcagtttgatctcattatcaacaccgtcaacgtcagcctcgactggcagccctattttgaggcgctgacctatggcggtaatttccatacggtcggtgcggttctcacgccgctgtctgttccggcctttacgttaattgcgggcgatcgcagcgtctctggttctgctaccggcacgccttatgagctgcgtaagctgatgcgttttgccgcccgcagcaaggttgcgccgaccaccgaactgttcccgatgtcgaaaattaacgacgccatccagcatgtgcgcgacggtaaggcgcgttaccgcgtggtgttgaaagccgatttttga

SEQ ID NO: 84965 - protein, 339 aa, Escherichia coli
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 84966 - DNA, 21 bp, Primer
atgctctacacttcccaaaca

SEQ ID NO: 84967 - DNA, 26 bp, Primer
ttaaaaatcggctttcaacaccacgc

SEQ ID NO: 84968 - protein, 457 aa, consensus
  MISC_FEATURE (1)..(457): consensus for the disclosure of xaa see table XV
GXCHXDXHXXXXXXXXXXXXXXXXXXXXXXXGHEXXGXVXXXGXXXXXVXXXXXGDXVGXXXXXXXCXXXXXXXCXXCXXXXEXXCXXXXXXXXXXXXXXXXXXXXXXXXXXXXXGXXXXXXXXXXXXXXXPXXXXXXXXXXXXXXXXAPXLCAGXTXYXXXXXXXXXXXXXXGXXXXXXGXGGLGHXXXXXAXXXGXXXXXXXXXXXXXXXXXXXXXXXXXGAXXXXXXXXXXXXXXXXXXXXXXXXXXXXXXXXXXXXXXXXXXXXXXXXXXXXXXXXXXXXXXXXXXXXXXXXXXXXXGXXXXXGXXXXXXXXXXXXXXXXXXXXXXXXXXXXXXXXXXXXXXXXXXXXXXXXXXGSXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXV

SEQ ID NO: 84969 - protein, 93 aa, consensus
  MISC_FEATURE (1)..(93): consensus for the disclosure of xaa see table XV
XXXXXXXXCXXXXXXXXXXXXXXXXXXXXXXXXXXXXGHXXXGXXXXXXXXXXXXXXXXXGXXXXXXXXXXXXXXXXXXXXCXXCXXXXXXXC

SEQ ID NO: 84970 - protein, 76 aa, consensus
  MISC_FEATURE (1)..(76): consensus for the disclosure of xaa see table XV
XXXXCXGXTXXXXXXXXXXXXXXXXXXXXXXXXXGXXXXXXXXXXXXXXXXXXXXXXXXXXXXXXXXXXXXXXXXX

SEQ ID NO: 84971 - DNA, 1398 bp, Escherichia coli; identical to SEQ ID NO: 68146
  CDS (1)..(1398)

SEQ ID NO: 84972 - protein, 465 aa, Escherichia coli; identical to SEQ ID NO: 68147

SEQ ID NO: 84973 - DNA, 2103 bp, Thermococcus kodakaraensis; identical to SEQ ID NO: 68148
  CDS (1)..(2103)

SEQ ID NO: 84974 - protein, 700 aa, Thermococcus kodakaraensis; identical to SEQ ID NO: 68149

SEQ ID NO: 84975 - DNA, 2487 bp, Thermococcus kodakaraensis; identical to SEQ ID NO: 68150
  CDS (1)..(2487)

SEQ ID NO: 84976 - protein, 828 aa, Thermococcus kodakaraensis; identical to SEQ ID NO: 68151

SEQ ID NO: 84977 - DNA, 2910 bp, Deinococcus radiodurans R1; identical to SEQ ID NO: 68152
  CDS (1)..(2910): transl_table=11

SEQ ID NO: 84978 - protein, 969 aa, Deinococcus radiodurans R1; identical to SEQ ID NO: 68153

SEQ ID NO: 84979 - DNA, 1347 bp, Helicobacter pylori J99; identical to SEQ ID NO: 68154
  CDS (1)..(1347): transl_table=11

SEQ ID NO: 84980 - protein, 448 aa, Helicobacter pylori J99; identical to SEQ ID NO: 68155

SEQ ID NO: 84981 - DNA, 1641 bp, Methanothermobacter thermautotrophicus str. Delta H; identical to SEQ ID NO: 68156
  CDS (1)..(1641): transl_table=11

SEQ ID NO: 84982 - protein, 546 aa, Methanothermobacter thermautotrophicus str. Delta H; identical to SEQ ID NO: 68157

SEQ ID NO: 84983 - DNA, 2352 bp, Campylobacter jejuni subsp. jejuni NCTC 11168; identical to SEQ ID NO: 68158
  CDS (1)..(2352): transl_table=11

SEQ ID NO: 84984 - protein, 783 aa, Campylobacter jejuni subsp. jejuni NCTC 11168; identical to SEQ ID NO: 68159

SEQ ID NO: 84985 - DNA, 1680 bp, Sulfolobus solfataricus P2; identical to SEQ ID NO: 68160
  CDS (1)..(1680): transl_table=11

SEQ ID NO: 84986 - protein, 559 aa, Sulfolobus solfataricus P2; identical to SEQ ID NO: 68161

SEQ ID NO: 84987 - DNA, 1935 bp, Streptococcus pneumoniae R6; identical to SEQ ID NO: 68162
  CDS (1)..(1935): transl_table=11

SEQ ID NO: 84988 - protein, 644 aa, Streptococcus pneumoniae R6; identical to SEQ ID NO: 68163

SEQ ID NO: 84989 - DNA, 1656 bp, Sulfolobus tokodaii str. 7; identical to SEQ ID NO: 68164
  CDS (1)..(1656): transl_table=11

SEQ ID NO: 84990 - protein, 551 aa, Sulfolobus tokodaii str. 7; identical to SEQ ID NO: 68165

SEQ ID NO: 84991 - DNA, 2052 bp, Sulfolobus tokodaii str. 7; identical to SEQ ID NO: 68166
  CDS (1)..(2052): transl_table=11

SEQ ID NO: 84992 - protein, 683 aa, Sulfolobus tokodaii str. 7; identical to SEQ ID NO: 68167

SEQ ID NO: 84993 - DNA, 1032 bp, Bacillus subtilis subsp. subtilis str. 168; identical to SEQ ID NO: 68168
  CDS (1)..(1032): transl_table=11

SEQ ID NO: 84994 - protein, 343 aa, Bacillus subtilis subsp. subtilis str. 168; identical to SEQ ID NO: 68169

SEQ ID NO: 84995 - DNA, 2064 bp, Yersinia pestis CO92; identical to SEQ ID NO: 68170
  CDS (1)..(2064)

SEQ ID NO: 84996 - protein, 687 aa, Yersinia pestis CO92; identical to SEQ ID NO: 68171

SEQ ID NO: 84997 - DNA, 2103 bp, Methanosarcina acetivorans C2A; identical to SEQ ID NO: 68172
  CDS (1)..(2103): transl_table=11

SEQ ID NO: 84998 - protein, 700 aa, Methanosarcina acetivorans C2A; identical to SEQ ID NO: 68173

SEQ ID NO: 84999 - DNA, 2529 bp, Xanthomonas campestris pv. campestris str. ATCC 33913; identical to SEQ ID NO: 68174
  CDS (1)..(2529): transl_table=11

SEQ ID NO: 85000 - protein, 842 aa, Xanthomonas campestris pv. campestris str. ATCC 33913; identical to SEQ ID NO: 68175

SEQ ID NO: 85001 - DNA, 1704 bp, Streptococcus mutans UA159; identical to SEQ ID NO: 68176
  CDS (1)..(1704): transl_table=11

SEQ ID NO: 85002 - protein, 567 aa, Streptococcus mutans UA159; identical to SEQ ID NO: 68177

SEQ ID NO: 85003 - DNA, 1554 bp, Pseudomonas syringae pv. tomato str. DC3000; identical to SEQ ID NO: 68178
  CDS (1)..(1554): transl_table=11

SEQ ID NO: 85004 - protein, 517 aa, Pseudomonas syringae pv. tomato str. DC3000; identical to SEQ ID NO: 68179

SEQ ID NO: 85005 - DNA, 1737 bp, Bacillus cereus ATCC 14579; identical to SEQ ID NO: 68180
  CDS (1)..(1737): transl_table=11

SEQ ID NO: 85006 - protein, 578 aa, Bacillus cereus ATCC 14579; identical to SEQ ID NO: 68181

SEQ ID NO: 85007 - DNA, 2223 bp, Nitrosomonas europaea ATCC 19718; identical to SEQ ID NO: 68182
  CDS (1)..(2223): transl_table=11

SEQ ID NO: 85008 - protein, 740 aa, Nitrosomonas europaea ATCC 19718; identical to SEQ ID NO: 68183

SEQ ID NO: 85009 - DNA, 2013 bp, Helicobacter hepaticus ATCC 51449; identical to SEQ ID NO: 68184
  CDS (1)..(2013): transl_table=11

SEQ ID NO: 85010 - protein, 670 aa, Helicobacter hepaticus ATCC 51449; identical to SEQ ID NO: 68185

SEQ ID NO: 85011 - DNA, 1716 bp, Porphyromonas gingivalis W83; identical to SEQ ID NO: 68186
  CDS (1)..(1716): transl_table=11

SEQ ID NO: 85012 - protein, 571 aa, Porphyromonas gingivalis W83; identical to SEQ ID NO: 68187

SEQ ID NO: 85013 - DNA, 1815 bp, Methanococcus maripaludis S2; identical to SEQ ID NO: 68188
  CDS (1)..(1815): transl_table=11

SEQ ID NO: 85014 - protein, 604 aa, Methanococcus maripaludis S2; identical to SEQ ID NO: 68189

SEQ ID NO: 85015 - DNA, 1572 bp, Picrophilus torridus DSM 9790; identical to SEQ ID NO: 68190
  CDS (1)..(1572): transl_table=11

SEQ ID NO: 85016 - protein, 523 aa, Picrophilus torridus DSM 9790; identical to SEQ ID NO: 68191

SEQ ID NO: 85017 - DNA, 2544 bp, Bacillus anthracis str. Sterne; identical to SEQ ID NO: 68192
  CDS (1)..(2544): transl_table=11

SEQ ID NO: 85018 - protein, 847 aa, Bacillus anthracis str. Sterne; identical to SEQ ID NO: 68193

SEQ ID NO: 85019 - DNA, 1704 bp, Staphylococcus aureus subsp. aureus MRSA252; identical to SEQ ID NO: 68194
  CDS (1)..(1704): transl_table=11

SEQ ID NO: 85020 - protein, 567 aa, Staphylococcus aureus subsp. aureus MRSA252; identical to SEQ ID NO: 68195

SEQ ID NO: 85021 - DNA, 1668 bp, Streptococcus pyogenes MGAS10394; identical to SEQ ID NO: 68196
  CDS (1)..(1668): transl_table=11

SEQ ID NO: 85022 - protein, 555 aa, Streptococcus pyogenes MGAS10394; identical to SEQ ID NO: 68197

SEQ ID NO: 85023 - DNA, 1635 bp, Haloarcula marismortui ATCC 43049; identical to SEQ ID NO: 68198
  CDS (1)..(1635): transl_table=11

SEQ ID NO: 85024 - protein, 544 aa, Haloarcula marismortui ATCC 43049; identical to SEQ ID NO: 68199

SEQ ID NO: 85025 - DNA, 1680 bp, Geobacillus kaustophilus HTA426; identical to SEQ ID NO: 68200
  CDS (1)..(1680): transl_table=11

SEQ ID NO: 85026 - protein, 559 aa, Geobacillus kaustophilus HTA426; identical to SEQ ID NO: 68201

SEQ ID NO: 85027 - DNA, 1065 bp, Azoarcus sp. EbN1; identical to SEQ ID NO: 68202
  CDS (1)..(1065): transl_table=11

SEQ ID NO: 85028 - protein, 354 aa, Azoarcus sp. EbN1; identical to SEQ ID NO: 68203

SEQ ID NO: 85029 - DNA, 1989 bp, Campylobacter jejuni RM1221; identical to SEQ ID NO: 68204
  CDS (1)..(1989): transl_table=11

SEQ ID NO: 85030 - protein, 662 aa, Campylobacter jejuni RM1221; identical to SEQ ID NO: 68205

SEQ ID NO: 85031 - DNA, 1590 bp, Nostoc punctiforme PCC 73102; identical to SEQ ID NO: 68206
  CDS (1)..(1590)

SEQ ID NO: 85032 - protein, 529 aa, Nostoc punctiforme PCC 73102; identical to SEQ ID NO: 68207

SEQ ID NO: 85033 - DNA, 1458 bp, Psychrobacter sp. 273-4; identical to SEQ ID NO: 68208
  CDS (1)..(1458)

SEQ ID NO: 85034 - protein, 485 aa, Psychrobacter sp. 273-4; identical to SEQ ID NO: 68209

SEQ ID NO: 85035 - DNA, 1521 bp, Crocosphaera watsonii WH 8501; identical to SEQ ID NO: 68210
  CDS (1)..(1521)

SEQ ID NO: 85036 - protein, 506 aa, Crocosphaera watsonii WH 8501; identical to SEQ ID NO: 68211

SEQ ID NO: 85037 - DNA, 963 bp, Pseudomonas syringae pv. syringae B728a; identical to SEQ ID NO: 68212
  CDS (1)..(963)

SEQ ID NO: 85038 - protein, 320 aa, Pseudomonas syringae pv. syringae B728a; identical to SEQ ID NO: 68213

SEQ ID NO: 85039 - DNA, 2535 bp, Bacillus cereus G9241; identical to SEQ ID NO: 68214
  CDS (1)..(2535): transl_table=11

SEQ ID NO: 85040 - protein, 844 aa, Bacillus cereus G9241; identical to SEQ ID NO: 68215

SEQ ID NO: 85041 - DNA, 1272 bp, Pseudomonas fluorescens PfO-1; identical to SEQ ID NO: 68216
  CDS (1)..(1272)

SEQ ID NO: 85042 - protein, 423 aa, Pseudomonas fluorescens PfO-1; identical to SEQ ID NO: 68217

SEQ ID NO: 85043 - DNA, 2118 bp, Methanosarcina barkeri str. fusaro; identical to SEQ ID NO: 68218
  CDS (1)..(2118)

SEQ ID NO: 85044 - protein, 705 aa, Methanosarcina barkeri str. fusaro; identical to SEQ ID NO: 68219

SEQ ID NO: 85045 - DNA, 1620 bp, Trichodesmium erythraeum IMS101; identical to SEQ ID NO: 68220
  CDS (1)..(1620)

SEQ ID NO: 85046 - protein, 539 aa, Trichodesmium erythraeum IMS101; identical to SEQ ID NO: 68221

SEQ ID NO: 85047 - DNA, 1698 bp, Streptococcus suis 89/1591; identical to SEQ ID NO: 68222
  CDS (1)..(1698)

SEQ ID NO: 85048 - protein, 565 aa, Streptococcus suis 89/1591; identical to SEQ ID NO: 68223

SEQ ID NO: 85049 - DNA, 1917 bp, Campylobacter lari RM2100; identical to SEQ ID NO: 68224
  CDS (1)..(1917): transl_table=11

SEQ ID NO: 85050 - protein, 638 aa, Campylobacter lari RM2100; identical to SEQ ID NO: 68225

SEQ ID NO: 85051 - DNA, 1398 bp, Escherichia coli; identical to SEQ ID NO: 68226
  CDS (1)..(1398): transl_table=11

SEQ ID NO: 85052 - protein, 465 aa, Escherichia coli; identical to SEQ ID NO: 68227

SEQ ID NO: 85053 - DNA, 885 bp, Escherichia coli; identical to SEQ ID NO: 68228
  CDS (1)..(885): transl_table=11

SEQ ID NO: 85054 - protein, 294 aa, Escherichia coli; identical to SEQ ID NO: 68229

SEQ ID NO: 85055 - DNA, 1758 bp, Lactococcus lactis; identical to SEQ ID NO: 68230
  CDS (1)..(1758): transl_table=11

SEQ ID NO: 85056 - protein, 585 aa, Lactococcus lactis; identical to SEQ ID NO: 68231

SEQ ID NO: 85057 - DNA, 25 bp, Primer
atgaggaaggcatatcttatggaat

SEQ ID NO: 85058 - DNA, 26 bp, Primer
ttatgagtcccctaataatttgttgg

SEQ ID NO: 85059 - protein, 421 aa, consensus; identical to SEQ ID NO: 68234
  MISC_FEATURE (1)..(421): consensus for the disclosure of xaa see table XV

SEQ ID NO: 85060 - protein, 88 aa, consensus; identical to SEQ ID NO: 68235
  MISC_FEATURE (1)..(88): consensus for the disclosure of xaa see table XV

SEQ ID NO: 85061 - DNA, 159 bp, Escherichia coli; identical to SEQ ID NO: 57058
  CDS (1)..(159)

SEQ ID NO: 85062 - protein, 52 aa, Escherichia coli; identical to SEQ ID NO: 57059

SEQ ID NO: 85063 - DNA, 25 bp, Primer
atgaacggtgctacctccttatatg

SEQ ID NO: 85064 - DNA, 26 bp, Primer
ttattctggctcattcaataattgcg

SEQ ID NO: 85065 - DNA, 1425 bp, Escherichia coli K12; identical to SEQ ID NO: 28717
  CDS (1)..(1425)

SEQ ID NO: 85066 - protein, 474 aa, Escherichia coli K12; identical to SEQ ID NO: 28718

SEQ ID NO: 85067 - DNA, 1401 bp, Haemophilus influenzae; identical to SEQ ID NO: 28719
  CDS (1)..(1401)

SEQ ID NO: 85068 - protein, 466 aa, Haemophilus influenzae; identical to SEQ ID NO: 28720

SEQ ID NO: 85069 - DNA, 1350 bp, Bacillus subtilis; identical to SEQ ID NO: 28721
  CDS (1)..(1350)

SEQ ID NO: 85070 - protein, 449 aa, Bacillus subtilis; identical to SEQ ID NO: 28722

SEQ ID NO: 85071 - DNA, 1545 bp, Xylella fastidiosa; identical to SEQ ID NO: 28723
  CDS (1)..(1545)

SEQ ID NO: 85072 - protein, 514 aa, Xylella fastidiosa; identical to SEQ ID NO: 28724

SEQ ID NO: 85073 - DNA, 1251 bp, Nostoc sp. PCC 7120; identical to SEQ ID NO: 28725
  CDS (1)..(1251)

SEQ ID NO: 85074 - protein, 416 aa, Nostoc sp. PCC 7120; identical to SEQ ID NO: 28726

SEQ ID NO: 85075 - DNA, 1428 bp, Salmonella enterica subsp. enterica serovar Typhi; identical to SEQ ID NO: 28727
  CDS (1)..(1428)

SEQ ID NO: 85076 - protein, 475 aa, Salmonella enterica subsp. enterica serovar Typhi; identical to SEQ ID NO: 28728

SEQ ID NO: 85077 - DNA, 1290 bp, Nostoc sp. PCC 7120; identical to SEQ ID NO: 28729
  CDS (1)..(1290)

SEQ ID NO: 85078 - protein, 429 aa, Nostoc sp. PCC 7120; identical to SEQ ID NO: 28730

SEQ ID NO: 85079 - DNA, 1206 bp, Nostoc sp. PCC 7120; identical to SEQ ID NO: 28731
  CDS (1)..(1206)

SEQ ID NO: 85080 - protein, 401 aa, Nostoc sp. PCC 7120; identical to SEQ ID NO: 28732

SEQ ID NO: 85081 - DNA, 1545 bp, Agrobacterium tumefaciens; identical to SEQ ID NO: 28733
  CDS (1)..(1545)

SEQ ID NO: 85082 - protein, 514 aa, Agrobacterium tumefaciens; identical to SEQ ID NO: 28734

SEQ ID NO: 85083 - DNA, 1446 bp, Yersinia pestis; identical to SEQ ID NO: 28735
  CDS (1)..(1446)

SEQ ID NO: 85084 - protein, 481 aa, Yersinia pestis; identical to SEQ ID NO: 28736

SEQ ID NO: 85085 - DNA, 1572 bp, Agrobacterium tumefaciens; identical to SEQ ID NO: 28737
  CDS (1)..(1572)

SEQ ID NO: 85086 - protein, 523 aa, Agrobacterium tumefaciens; identical to SEQ ID NO: 28738

SEQ ID NO: 85087 - DNA, 1407 bp, Agrobacterium tumefaciens; identical to SEQ ID NO: 28739
  CDS (1)..(1407)

SEQ ID NO: 85088 - protein, 468 aa, Agrobacterium tumefaciens; identical to SEQ ID NO: 28740

SEQ ID NO: 85089 - DNA, 1425 bp, Brucella melitensis; identical to SEQ ID NO: 28741
  CDS (1)..(1425)

SEQ ID NO: 85090 - protein, 474 aa, Brucella melitensis; identical to SEQ ID NO: 28742

SEQ ID NO: 85091 - DNA, 1362 bp, Aquifex aeolicus; identical to SEQ ID NO: 28743
  CDS (1)..(1362)

SEQ ID NO: 85092 - protein, 453 aa, Aquifex aeolicus; identical to SEQ ID NO: 28744

SEQ ID NO: 85093 - DNA, 1500 bp, Neisseria meningitidis; identical to SEQ ID NO: 28745
  CDS (1)..(1500)

SEQ ID NO: 85094 - protein, 499 aa, Neisseria meningitidis; identical to SEQ ID NO: 28746

SEQ ID NO: 85095 - DNA, 1170 bp, Pseudomonas aeruginosa; identical to SEQ ID NO: 28747
  CDS (1)..(1170)

SEQ ID NO: 85096 - protein, 389 aa, Pseudomonas aeruginosa; identical to SEQ ID NO: 28748

SEQ ID NO: 85097 - DNA, 1407 bp, Sinorhizobium meliloti; identical to SEQ ID NO: 28749
  CDS (1)..(1407)

SEQ ID NO: 85098 - protein, 468 aa, Sinorhizobium meliloti; identical to SEQ ID NO: 28750

SEQ ID NO: 85099 - DNA, 1332 bp, Helicobacter pylori; identical to SEQ ID NO: 28751
  CDS (1)..(1332)

SEQ ID NO: 85100 - protein, 443 aa, Helicobacter pylori; identical to SEQ ID NO: 28752

SEQ ID NO: 85101 - DNA, 1419 bp, Caulobacter crescentus; identical to SEQ ID NO: 28753
  CDS (1)..(1419)

SEQ ID NO: 85102 - protein, 472 aa, Caulobacter crescentus; identical to SEQ ID NO: 28754

SEQ ID NO: 85103 - DNA, 1446 bp, Xylella fastidiosa; identical to SEQ ID NO: 28755
  CDS (1)..(1446)

SEQ ID NO: 85104 - protein, 481 aa, Xylella fastidiosa; identical to SEQ ID NO: 28756

SEQ ID NO: 85105 - DNA, 1458 bp, Treponema pallidum subsp. pallidum (syphilis spirochete); identical to SEQ ID NO: 28757
  CDS (1)..(1458)

SEQ ID NO: 85106 - protein, 485 aa, Treponema pallidum subsp. pallidum (syphilis spirochete); identical to SEQ ID NO: 28758

SEQ ID NO: 85107 - DNA, 1380 bp, Thermotoga maritima; identical to SEQ ID NO: 28759
  CDS (1)..(1380)

SEQ ID NO: 85108 - protein, 459 aa, Thermotoga maritima; identical to SEQ ID NO: 28760

SEQ ID NO: 85109 - DNA, 1371 bp, Vibrio cholerae; identical to SEQ ID NO: 28761
  CDS (1)..(1371)

SEQ ID NO: 85110 - protein, 456 aa, Vibrio cholerae; identical to SEQ ID NO: 28762

SEQ ID NO: 85111 - DNA, 1961 bp, Pseudomonas aeruginosa; identical to SEQ ID NO: 28763
  CDS (496)..(1920)

SEQ ID NO: 85112 - protein, 474 aa, Pseudomonas aeruginosa; identical to SEQ ID NO: 28764

SEQ ID NO: 85113 - DNA, 1593 bp, Caulobacter crescentus; identical to SEQ ID NO: 28765
  CDS (1)..(1593)

SEQ ID NO: 85114 - protein, 530 aa, Caulobacter crescentus; identical to SEQ ID NO: 28766

SEQ ID NO: 85115 - DNA, 1536 bp, Rickettsia conorii; identical to SEQ ID NO: 28767
  CDS (1)..(1536)

SEQ ID NO: 85116 - protein, 511 aa, Rickettsia conorii; identical to SEQ ID NO: 28768

SEQ ID NO: 85117 - DNA, 1452 bp, Borrelia burgdorferi (Lyme disease spirochete); identical to SEQ ID NO: 28769
  CDS (1)..(1452)

SEQ ID NO: 85118 - protein, 483 aa, Borrelia burgdorferi (Lyme disease spirochete); identical to SEQ ID NO: 28770

SEQ ID NO: 85119 - DNA, 1494 bp, Chlamydia trachomatis; identical to SEQ ID NO: 28771
  CDS (1)..(1494)

SEQ ID NO: 85120 - protein, 497 aa, Chlamydia trachomatis; identical to SEQ ID NO: 28772

SEQ ID NO: 85121 - DNA, 1431 bp, Helicobacter pylori; identical to SEQ ID NO: 28773
  CDS (1)..(1431)

SEQ ID NO: 85122 - protein, 476 aa, Helicobacter pylori; identical to SEQ ID NO: 28774

SEQ ID NO: 85123 - DNA, 1302 bp, Clostridium acetobutylicum; identical to SEQ ID NO: 28775
  CDS (1)..(1302)

SEQ ID NO: 85124 - protein, 433 aa, Clostridium acetobutylicum; identical to SEQ ID NO: 28776

SEQ ID NO: 85125 - DNA, 2009 bp, Brucella abortus; identical to SEQ ID NO: 28777
  CDS (275)..(1816)

SEQ ID NO: 85126 - protein, 513 aa, Brucella abortus; identical to SEQ ID NO: 28778

SEQ ID NO: 85127 - DNA, 1185 bp, Synechocystis sp; identical to SEQ ID NO: 28779
  CDS (1)..(1185)

SEQ ID NO: 85128 - protein, 394 aa, Synechocystis sp; identical to SEQ ID NO: 28780

SEQ ID NO: 85129 - DNA, 1251 bp, Synechocystis sp; identical to SEQ ID NO: 28781
  CDS (1)..(1251)

SEQ ID NO: 85130 - protein, 416 aa, Synechocystis sp; identical to SEQ ID NO: 28782

SEQ ID NO: 85131 - DNA, 1359 bp, Synechocystis sp; identical to SEQ ID NO: 28783
  CDS (1)..(1359)

SEQ ID NO: 85132 - protein, 452 aa, Synechocystis sp; identical to SEQ ID NO: 28784

SEQ ID NO: 85133 - DNA, 1740 bp, Lactococcus lactis; identical to SEQ ID NO: 28785
  CDS (230)..(1456)

SEQ ID NO: 85134 - protein, 408 aa, Lactococcus lactis; identical to SEQ ID NO: 28786

SEQ ID NO: 85135 - DNA, 1383 bp, Rhodobacter capsulatus; identical to SEQ ID NO: 28787
  CDS (1)..(1383)

SEQ ID NO: 85136 - protein, 460 aa, Rhodobacter capsulatus; identical to SEQ ID NO: 28788

SEQ ID NO: 85137 - DNA, 1392 bp, Haemophilus influenzae; identical to SEQ ID NO: 28789
  CDS (1)..(1392)

SEQ ID NO: 85138 - protein, 463 aa, Haemophilus influenzae; identical to SEQ ID NO: 28790

SEQ ID NO: 85139 - DNA, 1800 bp, Yersinia enterocolitica; identical to SEQ ID NO: 28791
  CDS (244)..(1680)

SEQ ID NO: 85140 - protein, 478 aa, Yersinia enterocolitica; identical to SEQ ID NO: 28792

SEQ ID NO: 85141 - DNA, 2027 bp, Azotobacter vinelandii; identical to SEQ ID NO: 28793
  CDS (483)..(1904)

SEQ ID NO: 85142 - protein, 473 aa, Azotobacter vinelandii; identical to SEQ ID NO: 28794

SEQ ID NO: 85143 - DNA, 1905 bp, Brucella abortus; identical to SEQ ID NO: 28795
  CDS (333)..(1835)

SEQ ID NO: 85144 - protein, 500 aa, Brucella abortus; identical to SEQ ID NO: 28796

SEQ ID NO: 85145 - DNA, 1466 bp, Campylobacter jejuni; identical to SEQ ID NO: 28797
  CDS (48)..(1466)

SEQ ID NO: 85146 - protein, 472 aa, Campylobacter jejuni; identical to SEQ ID NO: 28798

SEQ ID NO: 85147 - DNA, 1191 bp, Pseudomonas aeruginosa; identical to SEQ ID NO: 28799
  CDS (14)..(1183)

SEQ ID NO: 85148 - protein, 389 aa, Pseudomonas aeruginosa; identical to SEQ ID NO: 28800

SEQ ID NO: 85149 - DNA, 1488 bp, Burkholderia mallei ATCC 23344; identical to SEQ ID NO: 28801
  CDS (1)..(1488)

SEQ ID NO: 85150 - protein, 495 aa, Burkholderia mallei ATCC 23344; identical to SEQ ID NO: 28802

SEQ ID NO: 85151 - DNA, 1209 bp, Burkholderia pseudomallei K96243; identical to SEQ ID NO: 28803
  CDS (1)..(1209)

SEQ ID NO: 85152 - protein, 402 aa, Burkholderia pseudomallei K96243; identical to SEQ ID NO: 28804

SEQ ID NO: 85153 - DNA, 1458 bp, Burkholderia pseudomallei K96243; identical to SEQ ID NO: 28805
  CDS (1)..(1458)

SEQ ID NO: 85154 - protein, 485 aa, Burkholderia pseudomallei K96243; identical to SEQ ID NO: 28806

SEQ ID NO: 85155 - DNA, 1557 bp, Burkholderia pseudomallei K96243; identical to SEQ ID NO: 28807
  CDS (1)..(1557)

SEQ ID NO: 85156 - protein, 518 aa, Burkholderia pseudomallei K96243; identical to SEQ ID NO: 28808

SEQ ID NO: 85157 - DNA, 1419 bp, Burkholderia pseudomallei K96243; identical to SEQ ID NO: 28809
  CDS (1)..(1419)

SEQ ID NO: 85158 - protein, 472 aa, Burkholderia pseudomallei K96243; identical to SEQ ID NO: 28810

SEQ ID NO: 85159 - DNA, 1566 bp, Bacteroides fragilis; identical to SEQ ID NO: 28811
  CDS (19)..(1566)

SEQ ID NO: 85160 - protein, 515 aa, Bacteroides fragilis; identical to SEQ ID NO: 28812

SEQ ID NO: 85161 - DNA, 2358 bp, Bacillus licheniformis DSM 13; identical to SEQ ID NO: 28813
  CDS (501)..(1871)

SEQ ID NO: 85162 - protein, 456 aa, Bacillus licheniformis DSM 13; identical to SEQ ID NO: 28814

SEQ ID NO: 85163 - DNA, 1470 bp, Mannheimia succiniciproducens MBEL55E; identical to SEQ ID NO: 28815
  CDS (1)..(1470)

SEQ ID NO: 85164 - protein, 489 aa, Mannheimia succiniciproducens MBEL55E; identical to SEQ ID NO: 28816

SEQ ID NO: 85165 - DNA, 1425 bp, Borrelia garinii PBi; identical to SEQ ID NO: 28817
  CDS (1)..(1425)

SEQ ID NO: 85166 - protein, 474 aa, Borrelia garinii PBi; identical to SEQ ID NO: 28818

SEQ ID NO: 85167 - DNA, 1224 bp, Lactococcus lactis; identical to SEQ ID NO: 28819
  CDS (1)..(1224)

SEQ ID NO: 85168 - protein, 407 aa, Lactococcus lactis; identical to SEQ ID NO: 28820

SEQ ID NO: 85169 - DNA, 1557 bp, Rickettsia typhi; identical to SEQ ID NO: 28821
  CDS (1)..(1557)

SEQ ID NO: 85170 - protein, 518 aa, Rickettsia typhi; identical to SEQ ID NO: 28822

SEQ ID NO: 85171 - DNA, 1485 bp, Onchocerca volvulus endobacterium; identical to SEQ ID NO: 28823
  CDS (1)..(1485)

SEQ ID NO: 85172 - protein, 494 aa, Onchocerca volvulus endobacterium; identical to SEQ ID NO: 28824

SEQ ID NO: 85173 - DNA, 1455 bp, Desulfotalea psychrophila; identical to SEQ ID NO: 28825
  CDS (1)..(1455)

SEQ ID NO: 85174 - protein, 484 aa, Desulfotalea psychrophila; identical to SEQ ID NO: 28826

SEQ ID NO: 85175 - DNA, 1467 bp, Erwinia carotovora; identical to SEQ ID NO: 28827
  CDS (1)..(1467)

SEQ ID NO: 85176 - protein, 488 aa, Erwinia carotovora; identical to SEQ ID NO: 28828

SEQ ID NO: 85177 - DNA, 1371 bp, Erwinia carotovora; identical to SEQ ID NO: 28829
  CDS (1)..(1371)

SEQ ID NO: 85178 - protein, 456 aa, Erwinia carotovora; identical to SEQ ID NO: 28830

SEQ ID NO: 85179 - DNA, 1404 bp, Acinetobacter sp; identical to SEQ ID NO: 28831
  CDS (1)..(1404)

SEQ ID NO: 85180 - protein, 467 aa, Acinetobacter sp; identical to SEQ ID NO: 28832

SEQ ID NO: 85181 - DNA, 1518 bp, Bartonella quintana; identical to SEQ ID NO: 28833
  CDS (1)..(1518)

SEQ ID NO: 85182 - protein, 505 aa, Bartonella quintana; identical to SEQ ID NO: 28834

SEQ ID NO: 85183 - DNA, 1395 bp, Bartonella quintana; identical to SEQ ID NO: 28835
  CDS (1)..(1395)

SEQ ID NO: 85184 - protein, 464 aa, Bartonella quintana; identical to SEQ ID NO: 28836

SEQ ID NO: 85185 - DNA, 1512 bp, Bartonella quintana; identical to SEQ ID NO: 28837
  CDS (1)..(1512)

SEQ ID NO: 85186 - protein, 503 aa, Bartonella quintana; identical to SEQ ID NO: 28838

SEQ ID NO: 85187 - DNA, 1518 bp, Bartonella henselae; identical to SEQ ID NO: 28839
  CDS (1)..(1518)

SEQ ID NO: 85188 - protein, 505 aa, Bartonella henselae; identical to SEQ ID NO: 28840

SEQ ID NO: 85189 - DNA, 1392 bp, Bartonella henselae; identical to SEQ ID NO: 28841
  CDS (1)..(1392)

SEQ ID NO: 85190 - protein, 463 aa, Bartonella henselae; identical to SEQ ID NO: 28842

SEQ ID NO: 85191 - DNA, 1368 bp, Photobacterium profundum; identical to SEQ ID NO: 28843
  CDS (1)..(1368)

SEQ ID NO: 85192 - protein, 455 aa, Photobacterium profundum; identical to SEQ ID NO: 28844

SEQ ID NO: 85193 - DNA, 1455 bp, Parachlamydia sp; identical to SEQ ID NO: 28845
  CDS (1)..(1455)

SEQ ID NO: 85194 - protein, 484 aa, Parachlamydia sp; identical to SEQ ID NO: 28846

SEQ ID NO: 85195 - DNA, 1563 bp, Rhodopseudomonas palustris; identical to SEQ ID NO: 28847
  CDS (1)..(1563)

SEQ ID NO: 85196 - protein, 520 aa, Rhodopseudomonas palustris; identical to SEQ ID NO: 28848

SEQ ID NO: 85197 - DNA, 1506 bp, Rhodopseudomonas palustris; identical to SEQ ID NO: 28849
  CDS (1)..(1506)

SEQ ID NO: 85198 - protein, 501 aa, Rhodopseudomonas palustris; identical to SEQ ID NO: 28850

SEQ ID NO: 85199 - DNA, 1200 bp, Rhodopseudomonas palustris; identical to SEQ ID NO: 28851
  CDS (1)..(1200)

SEQ ID NO: 85200 - protein, 399 aa, Rhodopseudomonas palustris; identical to SEQ ID NO: 28852

SEQ ID NO: 85201 - DNA, 1392 bp, Rhodopseudomonas palustris; identical to SEQ ID NO: 28853
  CDS (1)..(1392)

SEQ ID NO: 85202 - protein, 463 aa, Rhodopseudomonas palustris; identical to SEQ ID NO: 28854

SEQ ID NO: 85203 - DNA, 1572 bp, Rhodopseudomonas palustris; identical to SEQ ID NO: 28855
  CDS (1)..(1572)

SEQ ID NO: 85204 - protein, 523 aa, Rhodopseudomonas palustris; identical to SEQ ID NO: 28856

SEQ ID NO: 85205 - DNA, 1401 bp, uncultured bacterium 580; identical to SEQ ID NO: 28857
  CDS (1)..(1401)

SEQ ID NO: 85206 - protein, 466 aa, uncultured bacterium 580; identical to SEQ ID NO: 28858

SEQ ID NO: 85207 - DNA, 1476 bp, uncultured bacterium 106; identical to SEQ ID NO: 28859
  CDS (1)..(1476)

SEQ ID NO: 85208 - protein, 491 aa, uncultured bacterium 106; identical to SEQ ID NO: 28860

SEQ ID NO: 85209 - DNA, 1143 bp, uncultured bacterium 105; identical to SEQ ID NO: 28861
  CDS (1)..(1143)

SEQ ID NO: 85210 - protein, 380 aa, uncultured bacterium 105; identical to SEQ ID NO: 28862

SEQ ID NO: 85211 - DNA, 1395 bp, Rhizobium sp; identical to SEQ ID NO: 28863
  CDS (1)..(1395)

SEQ ID NO: 85212 - protein, 464 aa, Rhizobium sp; identical to SEQ ID NO: 28864

SEQ ID NO: 85213 - DNA, 1449 bp, Desulfovibrio vulgaris; identical to SEQ ID NO: 28865
  CDS (1)..(1449)

SEQ ID NO: 85214 - protein, 482 aa, Desulfovibrio vulgaris; identical to SEQ ID NO: 28866

SEQ ID NO: 85215 - DNA, 1167 bp, Leptospira interrogans; identical to SEQ ID NO: 28867
  CDS (1)..(1167)

SEQ ID NO: 85216 - protein, 388 aa, Leptospira interrogans; identical to SEQ ID NO: 28868

SEQ ID NO: 85217 - DNA, 1494 bp, Wolbachia pipientis wMel; identical to SEQ ID NO: 28869
  CDS (1)..(1494)

SEQ ID NO: 85218 - protein, 497 aa, Wolbachia pipientis wMel; identical to SEQ ID NO: 28870

SEQ ID NO: 85219 - DNA, 1482 bp, Treponema denticola; identical to SEQ ID NO: 28871
  CDS (1)..(1482)

SEQ ID NO: 85220 - protein, 493 aa, Treponema denticola; identical to SEQ ID NO: 28872

SEQ ID NO: 85221 - DNA, 1395 bp, Geobacter sulfurreducens; identical to SEQ ID NO: 28873
  CDS (1)..(1395)

SEQ ID NO: 85222 - protein, 464 aa, Geobacter sulfurreducens; identical to SEQ ID NO: 28874

SEQ ID NO: 85223 - DNA, 1416 bp, Geobacter sulfurreducens; identical to SEQ ID NO: 28875
  CDS (1)..(1416)

SEQ ID NO: 85224 - protein, 471 aa, Geobacter sulfurreducens; identical to SEQ ID NO: 28876

SEQ ID NO: 85225 - DNA, 1221 bp, Lactobacillus johnsonii; identical to SEQ ID NO: 28877
  CDS (1)..(1221)

SEQ ID NO: 85226 - protein, 406 aa, Lactobacillus johnsonii; identical to SEQ ID NO: 28878

SEQ ID NO: 85227 - DNA, 1425 bp, Wolinella succinogenes; identical to SEQ ID NO: 28879
  CDS (1)..(1425)

SEQ ID NO: 85228 - protein, 474 aa, Wolinella succinogenes; identical to SEQ ID NO: 28880

SEQ ID NO: 85229 - DNA, 1368 bp, Vibrio vulnificus; identical to SEQ ID NO: 28881
  CDS (1)..(1368)

SEQ ID NO: 85230 - protein, 455 aa, Vibrio vulnificus; identical to SEQ ID NO: 28882

SEQ ID NO: 85231 - DNA, 1497 bp, Porphyromonas gingivalis; identical to SEQ ID NO: 28883
  CDS (1)..(1497)

SEQ ID NO: 85232 - protein, 498 aa, Porphyromonas gingivalis; identical to SEQ ID NO: 28884

SEQ ID NO: 85233 - DNA, 1320 bp, Gloeobacter violaceus; identical to SEQ ID NO: 28885
  CDS (1)..(1320)

SEQ ID NO: 85234 - protein, 439 aa, Gloeobacter violaceus; identical to SEQ ID NO: 28886

SEQ ID NO: 85235 - DNA, 1467 bp, Chromobacterium violaceum; identical to SEQ ID NO: 28887
  CDS (1)..(1467)

SEQ ID NO: 85236 - protein, 488 aa, Chromobacterium violaceum; identical to SEQ ID NO: 28888

SEQ ID NO: 85237 - DNA, 1413 bp, Chromobacterium violaceum; identical to SEQ ID NO: 28889
  CDS (1)..(1413)

SEQ ID NO: 85238 - protein, 470 aa, Chromobacterium violaceum; identical to SEQ ID NO: 28890

SEQ ID NO: 85239 - DNA, 1158 bp, Prochlorococcus marinus; identical to SEQ ID NO: 28891
  CDS (1)..(1158)

SEQ ID NO: 85240 - protein, 385 aa, Prochlorococcus marinus; identical to SEQ ID NO: 28892

SEQ ID NO: 85241 - DNA, 1125 bp, Synechococcus sp; identical to SEQ ID NO: 28893
  CDS (1)..(1125)

SEQ ID NO: 85242 - protein, 374 aa, Synechococcus sp; identical to SEQ ID NO: 28894

SEQ ID NO: 85243 - DNA, 1299 bp, Synechococcus sp; identical to SEQ ID NO: 28895
  CDS (1)..(1299)

SEQ ID NO: 85244 - protein, 432 aa, Synechococcus sp; identical to SEQ ID NO: 28896

SEQ ID NO: 85245 - DNA, 1527 bp, Rhodopirellula baltica; identical to SEQ ID NO: 28897
  CDS (1)..(1527)

SEQ ID NO: 85246 - protein, 508 aa, Rhodopirellula baltica; identical to SEQ ID NO: 28898

SEQ ID NO: 85247 - DNA, 1530 bp, Rhodopirellula baltica; identical to SEQ ID NO: 28899
  CDS (1)..(1530)

SEQ ID NO: 85248 - protein, 509 aa, Rhodopirellula baltica; identical to SEQ ID NO: 28900

SEQ ID NO: 85249 - DNA, 1890 bp, Rhodopirellula baltica; identical to SEQ ID NO: 28901
  CDS (1)..(1890)

SEQ ID NO: 85250 - protein, 629 aa, Rhodopirellula baltica; identical to SEQ ID NO: 28902

SEQ ID NO: 85251 - DNA, 1188 bp, Prochlorococcus marinus; identical to SEQ ID NO: 28903
  CDS (1)..(1188)

SEQ ID NO: 85252 - protein, 395 aa, Prochlorococcus marinus; identical to SEQ ID NO: 28904

SEQ ID NO: 85253 - DNA, 1176 bp, Prochlorococcus marinus; identical to SEQ ID NO: 28905
  CDS (1)..(1176)

SEQ ID NO: 85254 - protein, 391 aa, Prochlorococcus marinus; identical to SEQ ID NO: 28906

SEQ ID NO: 85255 - DNA, 1434 bp, Helicobacter hepaticus; identical to SEQ ID NO: 28907
  CDS (1)..(1434)

SEQ ID NO: 85256 - protein, 477 aa, Helicobacter hepaticus; identical to SEQ ID NO: 28908

SEQ ID NO: 85257 - DNA, 1419 bp, Haemophilus ducreyi; identical to SEQ ID NO: 28909
  CDS (1)..(1419)

SEQ ID NO: 85258 - protein, 472 aa, Haemophilus ducreyi; identical to SEQ ID NO: 28910

SEQ ID NO: 85259 - DNA, 1386 bp, Candidatus Blochmannia floridanus; identical to SEQ ID NO: 28911
  CDS (1)..(1386)

SEQ ID NO: 85260 - protein, 461 aa, Candidatus Blochmannia floridanus; identical to SEQ ID NO: 28912

SEQ ID NO: 85261 - DNA, 1137 bp, Bordetella pertussis; identical to SEQ ID NO: 28913
  CDS (1)..(1137)

SEQ ID NO: 85262 - protein, 378 aa, Bordetella pertussis; identical to SEQ ID NO: 28914

SEQ ID NO: 85263 - DNA, 1116 bp, Bordetella parapertussis; identical to SEQ ID NO: 28915
  CDS (1)..(1116)

SEQ ID NO: 85264 - protein, 371 aa, Bordetella parapertussis; identical to SEQ ID NO: 28916

SEQ ID NO: 85265 - DNA, 1488 bp, Bordetella parapertussis; identical to SEQ ID NO: 28917
  CDS (1)..(1488)

SEQ ID NO: 85266 - protein, 495 aa, Bordetella parapertussis; identical to SEQ ID NO: 28918

SEQ ID NO: 85267 - DNA, 1467 bp, Chlamydophila caviae; identical to SEQ ID NO: 28919
  CDS (1)..(1467)

SEQ ID NO: 85268 - protein, 488 aa, Chlamydophila caviae; identical to SEQ ID NO: 28920

SEQ ID NO: 85269 - DNA, 1419 bp, Streptomyces avermitilis; identical to SEQ ID NO: 28921
  CDS (1)..(1419)

SEQ ID NO: 85270 - protein, 472 aa, Streptomyces avermitilis; identical to SEQ ID NO: 28922

SEQ ID NO: 85271 - DNA, 1491 bp, Nitrosomonas europaea; identical to SEQ ID NO: 28923
  CDS (1)..(1491)

SEQ ID NO: 85272 - protein, 496 aa, Nitrosomonas europaea; identical to SEQ ID NO: 28924

SEQ ID NO: 85273 - DNA, 1323 bp, Enterococcus faecalis; identical to SEQ ID NO: 28925
  CDS (25)..(1323)

SEQ ID NO: 85274 - protein, 432 aa, Enterococcus faecalis; identical to SEQ ID NO: 28926

SEQ ID NO: 85275 - DNA, 1356 bp, Coxiella burnetii; identical to SEQ ID NO: 28927
  CDS (1)..(1356)

SEQ ID NO: 85276 - protein, 451 aa, Coxiella burnetii; identical to SEQ ID NO: 28928

SEQ ID NO: 85277 - DNA, 1368 bp, Enterobacter cloacae; identical to SEQ ID NO: 28929
  CDS (1)..(1368)

SEQ ID NO: 85278 - protein, 455 aa, Enterobacter cloacae; identical to SEQ ID NO: 28930

SEQ ID NO: 85279 - DNA, 1545 bp, Xylella fastidiosa; identical to SEQ ID NO: 28931
  CDS (1)..(1545)

SEQ ID NO: 85280 - protein, 514 aa, Xylella fastidiosa; identical to SEQ ID NO: 28932

SEQ ID NO: 85281 - DNA, 1377 bp, Xylella fastidiosa; identical to SEQ ID NO: 28933
  CDS (1)..(1377)

SEQ ID NO: 85282 - protein, 458 aa, Xylella fastidiosa; identical to SEQ ID NO: 28934

SEQ ID NO: 85283 - DNA, 1368 bp, Vibrio parahaemolyticus; identical to SEQ ID NO: 28935
  CDS (1)..(1368)

SEQ ID NO: 85284 - protein, 455 aa, Vibrio parahaemolyticus; identical to SEQ ID NO: 28936

SEQ ID NO: 85285 - DNA, 1161 bp, Pseudomonas syringae; identical to SEQ ID NO: 28937
  CDS (1)..(1161)

SEQ ID NO: 85286 - protein, 386 aa, Pseudomonas syringae; identical to SEQ ID NO: 28938

SEQ ID NO: 85287 - DNA, 1440 bp, Pseudomonas syringae; identical to SEQ ID NO: 28939
  CDS (1)..(1440)

SEQ ID NO: 85288 - protein, 479 aa, Pseudomonas syringae; identical to SEQ ID NO: 28940

SEQ ID NO: 85289 - DNA, 1479 bp, Pseudomonas putida; identical to SEQ ID NO: 28941
  CDS (1)..(1479)

SEQ ID NO: 85290 - protein, 492 aa, Pseudomonas putida; identical to SEQ ID NO: 28942

SEQ ID NO: 85291 - DNA, 1524 bp, Bradyrhizobium japonicum; identical to SEQ ID NO: 28943
  CDS (1)..(1524)

SEQ ID NO: 85292 - protein, 507 aa, Bradyrhizobium japonicum; identical to SEQ ID NO: 28944

SEQ ID NO: 85293 - DNA, 1272 bp, Bradyrhizobium japonicum; identical to SEQ ID NO: 28945
  CDS (1)..(1272)

SEQ ID NO: 85294 - protein, 423 aa, Bradyrhizobium japonicum; identical to SEQ ID NO: 28946

SEQ ID NO: 85295 - DNA, 1578 bp, Bradyrhizobium japonicum; identical to SEQ ID NO: 28947
  CDS (1)..(1578)

SEQ ID NO: 85296 - protein, 525 aa, Bradyrhizobium japonicum; identical to SEQ ID NO: 28948

SEQ ID NO: 85297 - DNA, 1587 bp, Bradyrhizobium japonicum; identical to SEQ ID NO: 28949
  CDS (1)..(1587)

SEQ ID NO: 85298 - protein, 528 aa, Bradyrhizobium japonicum; identical to SEQ ID NO: 28950

SEQ ID NO: 85299 - DNA, 1536 bp, Bacteroides thetaiotaomicron; identical to SEQ ID NO: 28951
  CDS (1)..(1536)

SEQ ID NO: 85300 - protein, 511 aa, Bacteroides thetaiotaomicron; identical to SEQ ID NO: 28952

SEQ ID NO: 85301 - DNA, 1410 bp, Escherichia coli O6; identical to SEQ ID NO: 28953
  CDS (1)..(1410)

SEQ ID NO: 85302 - protein, 469 aa, Escherichia coli O6; identical to SEQ ID NO: 28954

SEQ ID NO: 85303 - DNA, 1392 bp, Yersinia pestis; identical to SEQ ID NO: 28955
  CDS (1)..(1392)

SEQ ID NO: 85304 - protein, 463 aa, Yersinia pestis; identical to SEQ ID NO: 28956

SEQ ID NO: 85305 - DNA, 1374 bp, Wigglesworthia glossinidia brevipalpis; identical to SEQ ID NO: 28957
  CDS (1)..(1374)

SEQ ID NO: 85306 - protein, 457 aa, Wigglesworthia glossinidia brevipalpis; identical to SEQ ID NO: 28958

SEQ ID NO: 85307 - DNA, 1128 bp, Synechococcus elongatus; identical to SEQ ID NO: 28959
  CDS (1)..(1128)

SEQ ID NO: 85308 - protein, 375 aa, Synechococcus elongatus; identical to SEQ ID NO: 28960

SEQ ID NO: 85309 - DNA, 1170 bp, Synechococcus elongatus; identical to SEQ ID NO: 28961
  CDS (1)..(1170)

SEQ ID NO: 85310 - protein, 389 aa, Synechococcus elongatus; identical to SEQ ID NO: 28962

SEQ ID NO: 85311 - DNA, 1353 bp, Shewanella oneidensis; identical to SEQ ID NO: 28963
  CDS (1)..(1353)

SEQ ID NO: 85312 - protein, 450 aa, Shewanella oneidensis; identical to SEQ ID NO: 28964

SEQ ID NO: 85313 - DNA, 1518 bp, Chlorobium tepidum; identical to SEQ ID NO: 28965
  CDS (1)..(1518)

SEQ ID NO: 85314 - protein, 505 aa, Chlorobium tepidum; identical to SEQ ID NO: 28966

SEQ ID NO: 85315 - DNA, 1461 bp, Rhizobium etli; identical to SEQ ID NO: 28967
  CDS (1)..(1461)

SEQ ID NO: 85316 - protein, 486 aa, Rhizobium etli; identical to SEQ ID NO: 28968

SEQ ID NO: 85317 - DNA, 1368 bp, Pasteurella piscicida; identical to SEQ ID NO: 28969
  CDS (1)..(1368)

SEQ ID NO: 85318 - protein, 455 aa, Pasteurella piscicida; identical to SEQ ID NO: 28970

SEQ ID NO: 85319 - DNA, 1437 bp, Xanthomonas campestris; identical to SEQ ID NO: 28971
  CDS (1)..(1437)

SEQ ID NO: 85320 - protein, 478 aa, Xanthomonas campestris; identical to SEQ ID NO: 28972

SEQ ID NO: 85321 - DNA, 1437 bp, Xanthomonas axonopodis; identical to SEQ ID NO: 28973
  CDS (1)..(1437)

SEQ ID NO: 85322 - protein, 478 aa, Xanthomonas axonopodis; identical to SEQ ID NO: 28974

SEQ ID NO: 85323 - DNA, 1578 bp, Xanthomonas axonopodis; identical to SEQ ID NO: 28975
  CDS (1)..(1578)

SEQ ID NO: 85324 - protein, 525 aa, Xanthomonas axonopodis; identical to SEQ ID NO: 28976

SEQ ID NO: 85325 - DNA, 2077 bp, Klebsiella pneumoniae; identical to SEQ ID NO: 28977
  CDS (374)..(1807)

SEQ ID NO: 85326 - protein, 477 aa, Klebsiella pneumoniae; identical to SEQ ID NO: 28978

SEQ ID NO: 85327 - DNA, 1536 bp, Xanthomonas campestris; identical to SEQ ID NO: 28979
  CDS (1)..(1536)

SEQ ID NO: 85328 - protein, 511 aa, Xanthomonas campestris; identical to SEQ ID NO: 28980

SEQ ID NO: 85329 - DNA, 1473 bp, Ralstonia solanacearum; identical to SEQ ID NO: 28981
  CDS (1)..(1473)

SEQ ID NO: 85330 - protein, 490 aa, Ralstonia solanacearum; identical to SEQ ID NO: 28982

SEQ ID NO: 85331 - DNA, 1518 bp, Ralstonia solanacearum; identical to SEQ ID NO: 28983
  CDS (1)..(1518)

SEQ ID NO: 85332 - protein, 505 aa, Ralstonia solanacearum; identical to SEQ ID NO: 28984

SEQ ID NO: 85333 - DNA, 1368 bp, Salmonella typhimurium; identical to SEQ ID NO: 28985
  CDS (1)..(1368)

SEQ ID NO: 85334 - protein, 455 aa, Salmonella typhimurium; identical to SEQ ID NO: 28986

SEQ ID NO: 85335 - DNA, 1512 bp, Rhizobium meliloti; identical to SEQ ID NO: 28987
  CDS (1)..(1512)

SEQ ID NO: 85336 - protein, 503 aa, Rhizobium meliloti; identical to SEQ ID NO: 28988

SEQ ID NO: 85337 - DNA, 1398 bp, Rhizobium meliloti; identical to SEQ ID NO: 28989
  CDS (1)..(1398)

SEQ ID NO: 85338 - protein, 465 aa, Rhizobium meliloti; identical to SEQ ID NO: 28990

SEQ ID NO: 85339 - DNA, 1551 bp, Rhizobium loti; identical to SEQ ID NO: 28991
  CDS (1)..(1551)

SEQ ID NO: 85340 - protein, 516 aa, Rhizobium loti; identical to SEQ ID NO: 28992

SEQ ID NO: 85341 - DNA, 1542 bp, Rhizobium loti; identical to SEQ ID NO: 28993
  CDS (1)..(1542)

SEQ ID NO: 85342 - protein, 513 aa, Rhizobium loti; identical to SEQ ID NO: 28994

SEQ ID NO: 85343 - DNA, 1515 bp, Rhizobium loti; identical to SEQ ID NO: 28995
  CDS (1)..(1515)

SEQ ID NO: 85344 - protein, 504 aa, Rhizobium loti; identical to SEQ ID NO: 28996

SEQ ID NO: 85345 - DNA, 1287 bp, Rhizobium loti; identical to SEQ ID NO: 28997
  CDS (1)..(1287)

SEQ ID NO: 85346 - protein, 428 aa, Rhizobium loti; identical to SEQ ID NO: 28998

SEQ ID NO: 85347 - DNA, 1446 bp, Pseudomonas syringae; identical to SEQ ID NO: 28999
  CDS (1)..(1446)

SEQ ID NO: 85348 - protein, 481 aa, Pseudomonas syringae; identical to SEQ ID NO: 29000

SEQ ID NO: 85349 - DNA, 1380 bp, Pasteurella multocida; identical to SEQ ID NO: 29001
  CDS (1)..(1380)

SEQ ID NO: 85350 - protein, 459 aa, Pasteurella multocida; identical to SEQ ID NO: 29002

SEQ ID NO: 85351 - DNA, 1362 bp, Aeromonas hydrophila; identical to SEQ ID NO: 29003
  CDS (1)..(1362)

SEQ ID NO: 85352 - protein, 453 aa, Aeromonas hydrophila; identical to SEQ ID NO: 29004

SEQ ID NO: 85353 - DNA, 1503 bp, Myxococcus xanthus; identical to SEQ ID NO: 29005
  CDS (1)..(1503)

SEQ ID NO: 85354 - protein, 500 aa, Myxococcus xanthus; identical to SEQ ID NO: 29006

SEQ ID NO: 85355 - DNA, 1476 bp, Shigella sonnei; identical to SEQ ID NO: 29007
  CDS (1)..(1476)

SEQ ID NO: 85356 - protein, 491 aa, Shigella sonnei; identical to SEQ ID NO: 29008

SEQ ID NO: 85357 - DNA, 1512 bp, Bartonella henselae; identical to SEQ ID NO: 29009
  CDS (1)..(1512)

SEQ ID NO: 85358 - protein, 503 aa, Bartonella henselae; identical to SEQ ID NO: 29010

SEQ ID NO: 85359 - DNA, 1437 bp, Buchnera aphidicola; identical to SEQ ID NO: 29011
  CDS (1)..(1437)

SEQ ID NO: 85360 - protein, 478 aa, Buchnera aphidicola; identical to SEQ ID NO: 29012

SEQ ID NO: 85361 - DNA, 1515 bp, Rhizobium meliloti; identical to SEQ ID NO: 29013
  CDS (1)..(1515)

SEQ ID NO: 85362 - protein, 504 aa, Rhizobium meliloti; identical to SEQ ID NO: 29014

SEQ ID NO: 85363 - DNA, 1377 bp, Bacillus subtilis; identical to SEQ ID NO: 29015
  CDS (1)..(1377)

SEQ ID NO: 85364 - protein, 458 aa, Bacillus subtilis; identical to SEQ ID NO: 29016

SEQ ID NO: 85365 - DNA, 24 bp, Primer
atgaaaaaaaccacattagcactg

SEQ ID NO: 85366 - DNA, 25 bp, Primer
ttactgcattaacaggtagatggtg

SEQ ID NO: 85367 - protein, 406 aa, consensus; identical to SEQ ID NO: 29019
  MISC_FEATURE (1)..(406): consensus for the disclosure of xaa see table XV

SEQ ID NO: 85368 - protein, 66 aa, consensus; identical to SEQ ID NO: 29020
  MISC_FEATURE (1)..(66): consensus for the disclosure of xaa see table XV

SEQ ID NO: 85369 - protein, 37 aa, consensus; identical to SEQ ID NO: 29021
  MISC_FEATURE (1)..(37): consensus for the disclosure of xaa see table XV

SEQ ID NO: 85370 - protein, 30 aa, consensus; identical to SEQ ID NO: 29022
  MISC_FEATURE (1)..(30): consensus for the disclosure of xaa see table XV

SEQ ID NO: 85371 - protein, 34 aa, consensus; identical to SEQ ID NO: 29023
  MISC_FEATURE (1)..(34): consensus for the disclosure of xaa see table XV

SEQ ID NO: 85372 - protein, 68 aa, consensus; identical to SEQ ID NO: 29024
  MISC_FEATURE (1)..(68): consensus for the disclosure of xaa see table XV

SEQ ID NO: 85373 - DNA, 1047 bp, Escherichia coli
  CDS (1)..(1047)
atgacgcaatttaatcccgttgatcatccacatcgccgctacaacccgctcaccgggcaatggattctggtttcaccgcaccgcgctaagcgcccctggcagggggcgcaggaaacgccagccaaacaggtgttacctgcgcacgatccagattgcttcctctgcgcaggtaatgtgcgggtgacaggcgataaaaaccccgattacaccgggacttacgttttcactaatgactttgcggctttgatgtctgacacgccagatgcgccagaaagtcacgatccgctgatgcgttgccagagcgcgcgcggcaccagccgggtgatctgcttttcaccggatcacagtaaaacgctgccagagctcagcgttgcagcattgacggaaatcgtcaaaacctggcaggagcaaaccgcagaactggggaaaacgtacccatgggtgcaggtttttgaaaacaaaggcgcggcgatgggctgctctaacccgcatccgcacggtcagatttgggcaaatagcttcctgcctaacgaagctgagcgcgaagaccgcctgcaaaaagaatattttgccgaacagaaatcaccaatgctggtggattatgttcagcgcgagctggcagacggtagccgtaccgttgtcgaaaccgaacactggttagccgtcgtgccttactgggctgcctggccgttcgaaacgctactgctgcccaaagcccacgttttacggatcaccgatttgaccgacgcccagcgcagcgatctggcgctggcgttgaaaaagctgaccagtcgttatgacaacctcttccagtgctccttcccctactctatgggctggcacggcgcgccatttaatggcgaagagaatcaacactggcagctgcacgcgcacttttatccgcctctgctgcgctccgccaccgtacgtaaatttatggttggttatgaaatgctggcagagacccagcgagacctgaccgcagaacaggcagcagagcgtttgcgcgcagtcagcgatatccattttcgcgaatccggagtgtaa

SEQ ID NO: 85374 - protein, 348 aa, Escherichia coli
MTQFNPVDHPHRRYNPLTGQWILVSPHRAKRPWQGAQETPAKQVLPAHDPDCFLCAGNVRVTGDKNPDYTGTYVFTNDFAALMSDTPDAPESHDPLMRCQSARGTSRVICFSPDHSKTLPELSVAALTEIVKTWQEQTAELGKTYPWVQVFENKGAAMGCSNPHPHGQIWANSFLPNEAEREDRLQKEYFAEQKSPMLVDYVQRELADGSRTVVETEHWLAVVPYWAAWPFETLLLPKAHVLRITDLTDAQRSDLALALKKLTSRYDNLFQCSFPYSMGWHGAPFNGEENQHWQLHAHFYPPLLRSATVRKFMVGYEMLAETQRDLTAEQAAERLRAVSDIHFRESGV

SEQ ID NO: 85375 - DNA, 1101 bp, Saccharomyces cerevisiae
  CDS (1)..(1101)
atgactgctgaagaatttgatttttctagccattcccatagacgttacaatccactaaccgattcatggatcttagtttctccacacagagctaaaagaccttggttaggtcaacaggaggctgcttacaagcccacagctccattgtatgatccaaaatgctatctatgtcctggtaacaaaagagctactggtaacctaaacccaagatatgaatcaacgtatattttccccaatgattatgctgccgttaggctcgatcaacctattttaccacagaatgattccaatgaggataatcttaaaaataggctgcttaaagtgcaatctgtgagaggcaattgtttcgtcatatgttttagccccaatcataatctaaccattccacaaatgaaacaatcagatctggttcatattgttaattcttggcaagcattgactgacgatctctccagagaagcaagagaaaatcataagcctttcaaatatgtccaaatatttgaaaacaaaggtacagccatgggttgttccaacttacatccacatggccaagcttggtgcttagaatccatccctagtgaagtttcgcaagaattgaaatcttttgataaatataaacgtgaacacaatactgatttgtttgccgattacgtcaaattagaatcaagagagaagtcaagagtcgtagtggagaatgaatcctttattgttgttgttccatactgggccatctggccatttgagaccttggtcatttcaaagaagaagcttgcctcaattagccaatttaaccaaatggtgaaggaggacctcgcctcgattttaaagcaactaactattaagtatgataatttatttgaaacgagtttcccatactcaatgggtatccatcaggctcctttgaatgcgactggtgatgaattgagtaatagttggtttcacatgcatttctacccacctttactgagatcagctactgttcggaaattcttggttggttttgaattgttaggtgagcctcaaagagatttaacttcggaacaagctgctgaaaaactaagaaatttagatggtcagattcattatctacaaagactgtaa

SEQ ID NO: 85376 - protein, 366 aa, Saccharomyces cerevisiae
MTAEEFDFSSHSHRRYNPLTDSWILVSPHRAKRPWLGQQEAAYKPTAPLYDPKCYLCPGNKRATGNLNPRYESTYIFPNDYAAVRLDQPILPQNDSNEDNLKNRLLKVQSVRGNCFVICFSPNHNLTIPQMKQSDLVHIVNSWQALTDDLSREARENHKPFKYVQIFENKGTAMGCSNLHPHGQAWCLESIPSEVSQELKSFDKYKREHNTDLFADYVKLESREKSRVVVENESFIVVVPYWAIWPFETLVISKKKLASISQFNQMVKEDLASILKQLTIKYDNLFETSFPYSMGIHQAPLNATGDELSNSWFHMHFYPPLLRSATVRKFLVGFELLGEPQRDLTSEQAAEKLRNLDGQIHYLQRL

SEQ ID NO: 85377 - DNA, 1182 bp, Mus musculus
  CDS (1)..(1182)
atggcagcgaccttccgggcgagcgaacaccagcatattcgctacaacccgctccaggacgagtgggtgttagtgtcggctcatcgcatgaagcggccctggcaaggacaagtggagccccagcttctgaagacagtgccccgccacgacccactcaaccctctgtgtcccggggccacacgagctaatggggaggtgaatccccactatgatggtacctttctgtttgacaatgacttcccggctctgcagcccgatgctccggatccaggacccagtgaccaccctctcttccgagcagaggccgccagaggagtttgtaaggtcatgtgcttccacccctggtcggatgtgacgctgccactcatgtctgtccctgagatccgagctgtcatcgatgcatgggcctcagtcacagaggagctgggtgcccagtacccttgggtgcagatctttgaaaataaaggagccatgatgggctgttctaacccccatccccactgccaggtttgggctagcagcttcctgccagatatcgcccagcgtgaagagcgatcccagcagacctatcacagccagcatggaaaacctttgttattggaatatggtcaccaagagctcctcaggaaggaacgtctggtcctaaccagtgagcactggatagttctggtccccttctgggcagtgtggcctttccagacacttctgctgccccggcggcacgtgcggcggctacctgagctgaaccccgctgagcgtgatctcgcctccatcatgaagaagctcttgaccaagtacgacaatctatttgagacatcctttccctactccatgggctggcatggggctcccacgggattaaagactggagccacctgtgaccactggcagctccacgcccactactaccccccacttctgcgatccgcaactgtccggaagttcatggttggaccgtgtacactggcagctcacgcccactacctacccccacttctcggatccgcaactgtctatgaaatgcttgcccaggcccagcgtgacctcactcccgaacaggccccagaaagattaagggcgcttcccgaggtacactattgcctggcgcagaaagacaaggaaacggcaggatcaccattgcttgactgtgaccacatcagggccttgaatctttgtacctga

SEQ ID NO: 85378 - protein, 393 aa, Mus musculus
MAATFRASEHQHIRYNPLQDEWVLVSAHRMKRPWQGQVEPQLLKTVPRHDPLNPLCPGATRANGEVNPHYDGTFLFDNDFPALQPDAPDPGPSDHPLFRAEAARGVCKVMCFHPWSDVTLPLMSVPEIRAVIDAWASVTEELGAQYPWVQIFENKGAMMGCSNPHPHCQVWASSFLPDIAQREERSQQTYHSQHGKPLLLEYGHQELLRKERLVLTSEHWIVLVPFWAVWPFQTLLLPRRHVRRLPELNPAERDLASIMKKLLTKYDNLFETSFPYSMGWHGAPTGLKTGATCDHWQLHAHYYPPLLRSATVRKFMVGPCTLAAHAHYLPPLLGSATVYEMLAQAQRDLTPEQAPERLRALPEVHYCLAQKDKETAGSPLLDCDHIRALNLCT

SEQ ID NO: 85379 - DNA, 984 bp, Pyrococcus horikoshii OT3
  CDS (1)..(984): transl_table=11
atgagagaacttcgatataaccctctcacagggcagtggatcatggtatctgcagtcaggaaaaatagaccatggagacctagaaatttttgtccattttgtccaggaagcgaagagacaggatatggatgggaagtccttttacttccgaacagattcccaatgctatcattcgacgcaccaaaacctaaaaatgaggatttctataaaaaggccagggctatgggtcaatgtagtgttattgtcgagactcccaagcatgagctcagagatttggatgagcttcccagggaacaaatggtaaagatagtgaggatgtggataaaaattacggaaacgttaaaggaaaatcgcaacgttgcataccttgctatttttagaaataagggagaggaaattggggtaagcttaaagcatcctcacggccaactttacgcccttccatatattcctctcaaggttagacttaaaatagagaactctagaaggtactataagagaactggggaatgcatattctgcaggataattaaagaagaggaaaagaacggggagaggactatctatgaaaatgataacttcatagtttttatgccattctttgcaagctggccctttgaagttcatatataccctaaaaggcacattcagtacctaaccgaccttaaggtgaatgaaattgaagacctagcggaagttatccaagtaactaccgcaacgctaaacgccgttctagataggcaaatgccatatgctatgatgatattccaagccccttttaaggggaattatcccttctatcacctccacatagagttctacccaattctaagagataatgggaaggttaagtatacagcgggaattgaactcgggacttgggaattcacatacgatggaattccagaagaaaacgccagaaaacttaaagaagcatgcaaaaaagtttcacagagaatgagtcttaagggaaaatgtatttaa

SEQ ID NO: 85380 - protein, 327 aa, Pyrococcus horikoshii OT3
MRELRYNPLTGQWIMVSAVRKNRPWRPRNFCPFCPGSEETGYGWEVLLLPNRFPMLSFDAPKPKNEDFYKKARAMGQCSVIVETPKHELRDLDELPREQMVKIVRMWIKITETLKENRNVAYLAIFRNKGEEIGVSLKHPHGQLYALPYIPLKVRLKIENSRRYYKRTGECIFCRIIKEEEKNGERTIYENDNFIVFMPFFASWPFEVHIYPKRHIQYLTDLKVNEIEDLAEVIQVTTATLNAVLDRQMPYAMMIFQAPFKGNYPFYHLHIEFYPILRDNGKVKYTAGIELGTWEFTYDGIPEENARKLKEACKKVSQRMSLKGKCI

SEQ ID NO: 85381 - DNA, 1056 bp, Arabidopsis thaliana
  CDS (1)..(1056)
atgacgtcaccgagccatgcctctgatcgcggcggcggcgacggtgactcagtcgagaatcagtcccctgagctcaggaaagatccggtaactaaccgctgggtcatattctctcccgccagagccaagagaccgactgatttcaaatccaaatctccccagaaccctaatcccaaaccttcctcatgcccattttgcatcggtcgtgagcaagagtgtgccccggagttatttcgtgtgccagatcatgacccgaattggaaactccgggtcatcgagaatctgtacccggctcttagtaggaatctcgagacccaatcgacccaacctgagacgggaacaagtcggacaatagtcggattcggattccacgacgtagtgatcgaatcccctgttcattcgattcagctctccgatatcgatccggtgggtatcggcgatatcttgatcgcttataagaagaggatcaatcagattgcgcaacatgattccatcaattacatccaggttttcaagaaccaaggtgcgtcggctggagcatcaatgagtcactcccacagtcaaatgatggctctaccagttgttcctccaacggtttcttcacgccttgatggtactaaagattatttcgaggagactgggaaatgttgtctctgtgaagctaaatcaaaacattttgtgatcgatgagtcgtctcattttgtttctgttgctccttttgctgctacgtatccctttgagatttggattattccgaaagatcattcttcccacttccatcatctcgatgacgttaaggctgttgaccttggaggacttctgaaactcatgcttcagaagatagcaaagcaacttaacgatccaccgtataactatatgatccatacttctccactcaaggttacagaatcacaattaccttatacgcactggttcttacagattgtacctcagctttctggggtaggtgggtttgagattggcacaggttgttacataaaccctgttttcccagaggatgtagcaaaggttatgcgggaagttagccttacttga

SEQ ID NO: 85382 - protein, 351 aa, Arabidopsis thaliana
MTSPSHASDRGGGDGDSVENQSPELRKDPVTNRWVIFSPARAKRPTDFKSKSPQNPNPKPSSCPFCIGREQECAPELFRVPDHDPNWKLRVIENLYPALSRNLETQSTQPETGTSRTIVGFGFHDVVIESPVHSIQLSDIDPVGIGDILIAYKKRINQIAQHDSINYIQVFKNQGASAGASMSHSHSQMMALPVVPPTVSSRLDGTKDYFEETGKCCLCEAKSKHFVIDESSHFVSVAPFAATYPFEIWIIPKDHSSHFHHLDDVKAVDLGGLLKLMLQKIAKQLNDPPYNYMIHTSPLKVTESQLPYTHWFLQIVPQLSGVGGFEIGTGCYINPVFPEDVAKVMREVSLT

SEQ ID NO: 85383 - DNA, 1011 bp, Thermotoga maritima MSB8
  CDS (1)..(1011): transl_table=11
atgcccgaattcagaaaagatcccattataaaaagatgggttatcatagccaccgagagagcgaaaaggcctcatgattttgcaagaacgaaagtagaagaagtgcgggaaggtttctgtcccttcgattacggtaatgaacacaccacaccaccggagattttcgccttcaggcctgcagacacggaacccaacacaccgggctggtgggtgcgtgttgttccaaacaagtttccagcggttgatcccaacgcacctttgagaaaatacggaagaggtatgtacgatgcagctatggggtttggttaccacgatgtggtcgttgaaactcccgatcacaattctcaccttgccgttatggattacaagaacgtggaagaagtcatctgggcttacaagatcagatacgaacagctcatgaaggatgagagaataaaatacatactgattttcaaaaaccacggaagggacgcaggagcttctctcagccatcctcacagccagataatcgcgctccctatcatgccaaagagggttcaagaagaactcgacggttctaaggaatattacgagtacaaggaaagatgtcctttctgcgatatcatagacgaggagaaaagagaaagggagagaatcgttgaggagaacgatcacttcattgctctggagcccttcgccgccagatttccgttcgaaacatggattcttccaaagaggcacatgaacagctttcacctgatatccgaggatgaagttgggtcccttgcaaaaatcctaaagaacgttctctacaggatatacgccgctttagataatccgccctacaaccttttgatccacaccgcccccacgagtctcgaaggcaaggattattaccactggcacatagagatattcccaagattgacaaaagtagcgggcttcgaatggggaacgggattctacataaacacagtacccccggaagatgccgctagatatctgagagaagtcagtttagagcaagtttga

SEQ ID NO: 85384 - protein, 336 aa, Thermotoga maritima MSB8
MPEFRKDPIIKRWVIIATERAKRPHDFARTKVEEVREGFCPFDYGNEHTTPPEIFAFRPADTEPNTPGWWVRVVPNKFPAVDPNAPLRKYGRGMYDAAMGFGYHDVVVETPDHNSHLAVMDYKNVEEVIWAYKIRYEQLMKDERIKYILIFKNHGRDAGASLSHPHSQIIALPIMPKRVQEELDGSKEYYEYKERCPFCDIIDEEKRERERIVEENDHFIALEPFAARFPFETWILPKRHMNSFHLISEDEVGSLAKILKNVLYRIYAALDNPPYNLLIHTAPTSLEGKDYYHWHIEIFPRLTKVAGFEWGTGFYINTVPPEDAARYLREVSLEQV

SEQ ID NO: 85385 - DNA, 1047 bp, Pasteurella multocida subsp. multocida str. Pm70
  CDS (1)..(1047): transl_table=11
atgcgtcattcacgatttgaaccaaccgaacacccacatcgccgttataatccgttaaccgatcagtgggtacttgtatcaccacatagagcaaaacgtccatggcaagggcaacaagaaaaagtggctgaggatgaaaagccaagttatgatccaacctgttatttatgcccatccaataagcgtattacgggtgaacaaaaccctgattatcaaaagcctttcgtgttcaaaaatgatttttctgcgttattagaagaaacacctaatccagaaaagtcaactgatcctttattccaaatatcaaaagcacaaggcgaaagtcgcgtgatttgcttttcgcctgatcatagcaaaaccttacctttattaacagtcgaagaaattcatgatgtgataaaagtgtggcaagagcagttgctagaattggggcaaaaatatcaatgggttcaaatctttgaaaataaaggtgccgctatgggctgttctaatccgcatccacatgggcaaatttgggcgaatagctttttgccaaatgaggtagcgcgtgcggatcagactcagcgcgcttatcttgctaaacaaggatcggtgatgttaatggactatgccaaacgtgaaattgaactgaaagaacgcgtggtggttgaaactgaacattggttagcggtggtgccttattgggcggtttggccatttgaaacgttattgatgccgaaggcgcatgtgaaacgtttgacggacttaactgaagaacaaagcaaagacttagcgctggcattaaaaaaactgacgacaaaatacgataatttatttgaaacctctttcccttattccatggggtttcatgcggcgccttttaatgaagagagcaatgaacattggcaacttcatgcccatttttatccaccattattacgttctgctactgtacgtaaatttatggtaggttatgaaatgttaggggaatctcaacgtgatttaactgcagagcaagccgcagaacgtttacgtgtgctcagtgaagtgcattataagcaaagataa

SEQ ID NO: 85386 - protein, 348 aa, Pasteurella multocida subsp. multocida str. Pm70
MRHSRFEPTEHPHRRYNPLTDQWVLVSPHRAKRPWQGQQEKVAEDEKPSYDPTCYLCPSNKRITGEQNPDYQKPFVFKNDFSALLEETPNPEKSTDPLFQISKAQGESRVICFSPDHSKTLPLLTVEEIHDVIKVWQEQLLELGQKYQWVQIFENKGAAMGCSNPHPHGQIWANSFLPNEVARADQTQRAYLAKQGSVMLMDYAKREIELKERVVVETEHWLAVVPYWAVWPFETLLMPKAHVKRLTDLTEEQSKDLALALKKLTTKYDNLFETSFPYSMGFHAAPFNEESNEHWQLHAHFYPPLLRSATVRKFMVGYEMLGESQRDLTAEQAAERLRVLSEVHYKQR

SEQ ID NO: 85387 - DNA, 945 bp, Clostridium acetobutylicum ATCC 824
  CDS (1)..(945): transl_table=11
ttgagtataagaagaaatagcataaataatacaactgtaataataaacaaaaaaagagcagaaagacctgttgaactaaagagtaaaaagaagaaggaagaaaaggtacaatatgagaaggaatgtccattttgtattggtaatgaatatagaacaccagcagtaatctatgacacaaaagaaccataccatgtaagagtttctgaaaacaaatatcctattgttaaagaaaaaagcatggataataatgaagtatttgggaatcattatgtggtaatagaaggtaaaaatcatagtgataatatgtatgagtttaccaaagaacaaatgcgagaaattataaaagcatataaaaatacagtatataaactttatgaaaatgaagatataaagtatgttcagatattcaagaattgtggtaaagactctggtgcatcacttaaacacccacactctcaaattgttggaataaatatagttcctgatgaaatatctagggaaataaaaggtactaaaaagtactacgaagagaataaggaatgcttttattgcagcagactaaaaaaagaagttcaatataaaaagagaattattcatatgggtaaatatttcactgctttttgtccgtatgattcaacttatcagtacaaagttaccataatgaaaaataagcaccaaagcaattttggtcttgatgaattagaaatgatggaattaggggaaataataacattaatattaaagaaattaaataatataagttataattgcagttataatatgtgtttccattttttaaaggaagaaaatgagttctatcatttttatgtggacattatacctagattaaatccaatgggaggatttgagattggtactggaataatgataaacacagttgaccctgaggttgcagctgaaatttttagaaatatccagttataa

SEQ ID NO: 85388 - protein, 314 aa, Clostridium acetobutylicum ATCC 824
MSIRRNSINNTTVIINKKRAERPVELKSKKKKEEKVQYEKECPFCIGNEYRTPAVIYDTKEPYHVRVSENKYPIVKEKSMDNNEVFGNHYVVIEGKNHSDNMYEFTKEQMREIIKAYKNTVYKLYENEDIKYVQIFKNCGKDSGASLKHPHSQIVGINIVPDEISREIKGTKKYYEENKECFYCSRLKKEVQYKKRIIHMGKYFTAFCPYDSTYQYKVTIMKNKHQSNFGLDELEMMELGEIITLILKKLNNISYNCSYNMCFHFLKEENEFYHFYVDIIPRLNPMGGFEIGTGIMINTVDPEVAAEIFRNIQL

SEQ ID NO: 85389 - DNA, 957 bp, Pyrobaculum aerophilum str. IM2
  CDS (1)..(957): transl_table=11
atggagattaggaaagaccccttcacgggggagtatatcttagtctcgccccacaggcttaaacgcccctggcaaccagagggcgcatgccccttctgccccggcgcccccgagaccggccgcgggtgggacgtgctaatactcccaaatagataccccgtggttacggaaaaccccccagagccgacagccgaagatttatatgaggtaatccccgcgcgcggctcctcgctagtagtggtggaaacccctcaacacgatgttgacgacctcagcgacttgcccctaggccaaataaaaaagattttgacggcggtggctgaggctcagagaaaagccgagaaagagggcaacgccgcatacttcctcttttttagaaacaagggtaaggagattggagtctccctcacccacccacactctcaaatatacatacttccggtggttcccccaagagtccgcgcagagcttcaagcctcctacgagtggtatgtaaaacacggctcgtgcctccactgccgcattgtagaaaaagaggaaaaacgccttgtcttccaaaaccgcaattggaaggcgtttgtgccgttttatgcgaaatggccccacgaagtccacatataccccaagaggcacagaagcctgctcactgagttaacagacgaggaggtggcggatttagccgaggcgttgaaaataacgctatgcgccttaaaacaagtggcggggataccaatgccctatataatggtgctccaccaagcgccgcttccacggccaacgcagtactaccacttacactttgaaatatacggcatgtataggccagacgggaagcttaaacatgcagccggcgccgagttgggagcgtcgctatttacactggacactactcccgaggagactgcggctagaattaaggcggctctacagaaatgtttaaagcattcggcggattaa

SEQ ID NO: 85390 - protein, 318 aa, Pyrobaculum aerophilum str. IM2
MEIRKDPFTGEYILVSPHRLKRPWQPEGACPFCPGAPETGRGWDVLILPNRYPVVTENPPEPTAEDLYEVIPARGSSLVVVETPQHDVDDLSDLPLGQIKKILTAVAEAQRKAEKEGNAAYFLFFRNKGKEIGVSLTHPHSQIYILPVVPPRVRAELQASYEWYVKHGSCLHCRIVEKEEKRLVFQNRNWKAFVPFYAKWPHEVHIYPKRHRSLLTELTDEEVADLAEALKITLCALKQVAGIPMPYIMVLHQAPLPRPTQYYHLHFEIYGMYRPDGKLKHAAGAELGASLFTLDTTPEETAARIKAALQKCLKHSAD

SEQ ID NO: 85391 - DNA, 984 bp, Pyrococcus furiosus DSM 3638
  CDS (1)..(984): transl_table=11
atgagggagctgagatataaccccctcacaggtcagtggatcatggtgtctgcagttaggaaaaaaagaccatggagacccacaaatttctgtccattttgcccaggaagcgaagagacaggttatggatggaaagttcttttgcttccaaatagattcccaatgttatcttttgatgccccaaaacctgagagtgaggaattttacaagaaagctagggcaattggccagtgtagtgttatcgtcgagacaccagatcatgatcttaaagatctagacgagcttcccagggagcaaatggttaaggttgttgaactgtgggtagaggctacgaaaacactaaaggaaaatccccacgttgcttatctcgcgatatttagaaataaaggggaggaaattggagtaagcttaactcatccccacggccagctttatgcccttccgtatattcctctcaaagctagactcaaaatagaaaactctagaaagtactacaagagcaaaaatgaatgtttgttctgtaggatacttaaagaagaaaaagaaagtgaagagagaattatctacgaaaatgacaactttatagttttcatgcccttctttgcaagttggcctttcgaaatgcacatttatccaaaaagacacgttcagtatttaacagacctcaacaaggaagaaatagaaagcttggcggatgcaattcaagctaccactggaaccttaaacaccattttagaaaggcaaatgccctacacaatgatgatattccaggctccatttaaaggaaactacaagttttatcacctacacatagagttctaccctattttaagagacaatggaaagatcaaatacgcagcaggaattgaaatgggtacatgggaatttacatacgatgcaatcccagaagaaaacgccagaaagcttaaagaggcatgcaaaaaagtttcacaaagacttaaccttaaagggaaatgtatttaa

SEQ ID NO: 85392 - protein, 327 aa, Pyrococcus furiosus DSM 3638
MRELRYNPLTGQWIMVSAVRKKRPWRPTNFCPFCPGSEETGYGWKVLLLPNRFPMLSFDAPKPESEEFYKKARAIGQCSVIVETPDHDLKDLDELPREQMVKVVELWVEATKTLKENPHVAYLAIFRNKGEEIGVSLTHPHGQLYALPYIPLKARLKIENSRKYYKSKNECLFCRILKEEKESEERIIYENDNFIVFMPFFASWPFEMHIYPKRHVQYLTDLNKEEIESLADAIQATTGTLNTILERQMPYTMMIFQAPFKGNYKFYHLHIEFYPILRDNGKIKYAAGIEMGTWEFTYDAIPEENARKLKEACKKVSQRLNLKGKCI

SEQ ID NO: 85393 - DNA, 1029 bp, Methanosarcina acetivorans C2A
  CDS (1)..(1029): transl_table=11
atgtcagaaatcagaaagcactattttctccccgaatactgcataattgccgaagggagagctaaaagaccttcggattttgcaggggcagccaaagattccgaaaaaaatcattctgaaagctgcgtgttctgcggagggaatgaagaaaaaacacctcctgcaactgcggcatataagaagggggagatctttgccgataccgaaaaaaaacgagtccgcaactgggattttcgctgttttccaaacctctatcccgcactttctcctgctccgccctctcccggatttcgcggaaaagggcttgaagcttttcctggattcggtttccatgaggtaatagtggagtcccccgtacacgggaaaaaacttgaggaattctccgatgctgagatatccgggcttatgggagtctataaggacagagtatgccattacgcagcccgtgaaaaaatccgttatgtttccctgttcaaaaactccggaaaagctgcaggcgcttcacagaaccactcacatagccagctcctcgccctgccggtttgccctcaggttctggaaagggaactgaaggctatcagggaaggagaaaaatgcccttactgtgtgctccttgaaaaagaaaaaacttcgacacgccttatccgtgaaaatagcaaatttgtggcttttgccccttactattcaacaggaccctttgaagtatggatccttccaaaagaacatattagtttcctgggagatttcagtccggaactcctttttgctctcggggaaattttgagagcggtcctcaggagttatggaaaagtactggggaacctgccttataaccacatgttctaccagctttttgagacaccagagtaccacctgaacctgaggctgatgcccaggatctccacggctgcggggtttgaattgaataccggaatttacatcaatacggtttcccctgaaaaggcagcttcatatctgaggggggatattaatgagccgactcgggagaaagtcgggagagaaaaataa

SEQ ID NO: 85394 - protein, 342 aa, Methanosarcina acetivorans C2A
MSEIRKHYFLPEYCIIAEGRAKRPSDFAGAAKDSEKNHSESCVFCGGNEEKTPPATAAYKKGEIFADTEKKRVRNWDFRCFPNLYPALSPAPPSPGFRGKGLEAFPGFGFHEVIVESPVHGKKLEEFSDAEISGLMGVYKDRVCHYAAREKIRYVSLFKNSGKAAGASQNHSHSQLLALPVCPQVLERELKAIREGEKCPYCVLLEKEKTSTRLIRENSKFVAFAPYYSTGPFEVWILPKEHISFLGDFSPELLFALGEILRAVLRSYGKVLGNLPYNHMFYQLFETPEYHLNLRLMPRISTAAGFELNTGIYINTVSPEKAASYLRGDINEPTREKVGREK

SEQ ID NO: 85395 - DNA, 978 bp, Thermoanaerobacter tengcongensis MB4
  CDS (1)..(978): transl_table=11
atgtctgagataagatttgatttagttacagggaaaatggtgattatagcggttgagagggcgaaaaggcctcatgactttgcaattgctcatcaggaaaagaagggaagcaaagattgtcctttttgtccgagaaatgaaaatatgacgcctccttctcttgtggagataaaagatggacaagggaagtggcttgtgagggggttcacaaataaattcgcagcgttaaatacggaggtaaaagagattgatgtgccttctctttacagaggagagtacggctatggtgtggcagaagtgattgtggaatctccttaccacgatgttacttttgggaatttgactttggaacagatgaaaagggtgtttcacgccataattgaaagatacagatcaattgtgaaagatgaaaagataaagtacgttcaggtttttaagaattttgggccaagaggaggggcttctcttgagcacggccattggcaggtcatagcaattccttttatccccgagctggtgaacagggaagttgagggcactcaggagtatataaaaaaggaaagaaaatgcccttactgcgaaattattgagtacgaaagagaagcaggtgtgagattgataggggagaatgaaaagtttgtggcaatagctccatatgcttctcagtatccttatgagtcgtggataattccaaaagagcatcaggaaaagtttgaggagatagatgaggattctctctcaaaatttgtggagattttaaagcctttgattgagaaatacgagaaagagtttgagatgcctccttacaacattgtccttcacactctgcctcctcgggatataagaaattaccactggcatatagaaattgctcctaggcttacgatagcggcagggttcgagctgggcacaggtgtgcatataaaccctgtctctccagagcttgctgcttcgattttaaaattacaaaatttatga

SEQ ID NO: 85396 - protein, 325 aa, Thermoanaerobacter tengcongensis MB4
MSEIRFDLVTGKMVIIAVERAKRPHDFAIAHQEKKGSKDCPFCPRNENMTPPSLVEIKDGQGKWLVRGFTNKFAALNTEVKEIDVPSLYRGEYGYGVAEVIVESPYHDVTFGNLTLEQMKRVFHAIIERYRSIVKDEKIKYVQVFKNFGPRGGASLEHGHWQVIAIPFIPELVNREVEGTQEYIKKERKCPYCEIIEYEREAGVRLIGENEKFVAIAPYASQYPYESWIIPKEHQEKFEEIDEDSLSKFVEILKPLIEKYEKEFEMPPYNIVLHTLPPRDIRNYHWHIEIAPRLTIAAGFELGTGVHINPVSPELAASILKLQNL

SEQ ID NO: 85397 - DNA, 1062 bp, Streptomyces coelicolor A3(2)
  CDS (1)..(1062)
atgaagaagacctcgacccggctggccgacggccgtgagctggtctactacgacctgcgcgacgacaccgtgcgcgacgccgtggaccgccgtccgctggagcggaccgtcaccacgtccgaggtgcgacgcgacccgctgctcggcgactccgtcgccgtcgcctcgcaccggcaggggcgcacctaccatccgccggccgaccagtgcccgctgtgcccgtcggacggggaacggctgagcgagatcccggactcggcctatgacgtggtggtcttcgagaatcgctttccctcgctggccggtgactccgggcgctgcgaggtcgtctgcttcacctccgaccacgacgcctccttcgccgacctgagcgaggagcaggcccggctggtgctcgacgcctggacggaccgcacctccgagctgtcccatctgccctccgttgaacaggtgttctgcttcgagaaccggggcgccgagatcggggtgacgctgggtcacccgcacgggcagatctacgcctacccgttcaccaccccccgcaccgccctgatgctccgttcactcgccgcccacaaggacgcgacgggcggggggaacctgttcgactccgtgctggaggaggagctggccggtgagcgggtcgtcctggagggtgagcactgggccgccttcgtgccgtacgcggcgcactggccgtacgaggtgcacctctacccgaagcggcgggtgcccgatctgctcggactcgacgaggcggctcgcacagaattccccaaggtctacctggagctgctgaggcgcttcgaccggatcttcggcgagggcgagcccccgaccccctacatcgcggcctggcaccaggcgccgttcgggcagctggaggagttcgagggtgtgacgcgcgacgacttcgcgctccacctggaacttttcactatccgccgtacgtccggcaagctgaagttcctcgcgggctccgaatccggcatgaacgtgttcatcaacgacgtacccccggagcgcgcggccgagcgactgcgagaggtagcgagttcatga

SEQ ID NO: 85398 - protein, 353 aa, Streptomyces coelicolor A3(2)
MKKTSTRLADGRELVYYDLRDDTVRDAVDRRPLERTVTTSEVRRDPLLGDSVAVASHRQGRTYHPPADQCPLCPSDGERLSEIPDSAYDVVVFENRFPSLAGDSGRCEVVCFTSDHDASFADLSEEQARLVLDAWTDRTSELSHLPSVEQVFCFENRGAEIGVTLGHPHGQIYAYPFTTPRTALMLRSLAAHKDATGGGNLFDSVLEEELAGERVVLEGEHWAAFVPYAAHWPYEVHLYPKRRVPDLLGLDEAARTEFPKVYLELLRRFDRIFGEGEPPTPYIAAWHQAPFGQLEEFEGVTRDDFALHLELFTIRRTSGKLKFLAGSESGMNVFINDVPPERAAERLREVASS

SEQ ID NO: 85399 - DNA, 1053 bp, Yersinia pestis KIM
  CDS (1)..(1053): transl_table=11
atgacgcattttaaccctgtggatcatccacatcgtcgctataacccgttgaaagaccagtgggtattggtctcgcctcatcgggctaaacgcccatggcaaggccaacaagaagcacccgcaaccgagaatttaccggctcatgatcccgattgcttcttgtgccccggcaatacccgagttaccggtgatgtgaatcctgattactcatcgacttatgtctttaccaatgactttgccgcactgatgcctgataccccagatgcgccgccaagtcatgatccgctgatgcgtagtcaaagcgcacgcggcaccagtagagtcatttgcttctctcctgatcacagcaaaaccctgccgcaactgacactgcccgcgctggaacaggtcgttcagacttggcagcagcagagcgccgagttgggcaaaatatacccatgggtgcaagtgtttgaaaataaaggggcagcgatgggctgctctaatccccatccgcatgggcaaatttgggccaacagtttcctgccgaatgaagcagaacaggaagaccgtttacagcaacagtattttcagcaacatcaatcgcccatgctgctggattatgtcgagcgggaacgccgcgatggtcaacggaccgtggttgaaacagaacattggctagcggtagtgccttactgggcagcctggccatttgaaaccctgttactgcccaaagccgcagtattgcgcctggaagacctttcggcagagcaacgcagtgatttggccattgccttgaaaaaactgaccagccgttatgacaatttattctcatgctctttcccttactctatgggatggcatggcgcgccttataacgcgaatgacaatacgcattggcaattacatgcgcatttttatccccctctgctgcgttcagcgtcagtacgtaagtttatggtgggctatgaactgctggccgaaacccagcgagaccttacagcagaacaggcggcagcactcctgcgggcagtaagtgatgttcactataaagaggccggagccaaatcatga

SEQ ID NO: 85400 - protein, 350 aa, Yersinia pestis KIM
MTHFNPVDHPHRRYNPLKDQWVLVSPHRAKRPWQGQQEAPATENLPAHDPDCFLCPGNTRVTGDVNPDYSSTYVFTNDFAALMPDTPDAPPSHDPLMRSQSARGTSRVICFSPDHSKTLPQLTLPALEQVVQTWQQQSAELGKIYPWVQVFENKGAAMGCSNPHPHGQIWANSFLPNEAEQEDRLQQQYFQQHQSPMLLDYVERERRDGQRTVVETEHWLAVVPYWAAWPFETLLLPKAAVLRLEDLSAEQRSDLAIALKKLTSRYDNLFSCSFPYSMGWHGAPYNANDNTHWQLHAHFYPPLLRSASVRKFMVGYELLAETQRDLTAEQAAALLRAVSDVHYKEAGAKS

SEQ ID NO: 85401 - DNA, 1251 bp, Bifidobacterium longum NCC2705
  CDS (1)..(1251): transl_table=11
atggctgatttcgccaactacacccccggggagtatgcgaaggagcatatccgcatcacgccggcgacgcttgccgacggtcgtgacttcttctacctggacgacgaccccgagttcgtctccggtgccaagacccgcgagctcaaggacccgcgcccgctggactaccgtttcgccccgcatctggacgccgacggtaacgaagtgccgtacgccgccccgcagatgcgccgcgacccgctgaccggcgactggatcccgatggccaccgcccgtatgaaccgcccgatcaccgccggccccggcgccaccgccaagggcaacccgctggccgcccgcaagcccggtgacccgtaccaggacggcgaagtgccggacaccgactacaacgtcgtggtgttcgagaaccgcttcccctcgatggtgcgcgtgcccggtgtctccgaggacgtgacctacgttgacggcaacccgctgtgggagaagaagctcgccgccggccgctgcgaagtcatctgcttcgacccgaacgaggacggcctgccggccgatttgccggtctcccgcctgcgcaccgtggttgaggcttgggccttccgtaccgccgaaatctccaagatggaaggcatcgagcagatcttcccgttcgagaaccacggccaggaaatcggcgtctccctcgcccacccgcacggccaggtctactgctacccgttcatcgccccgaagatggagaaggaactccagcacaccgaggcctaccacgagaagaccggtggcaacctgcttaaggacatcatgaacgccgagctcgaagccggcgaacgcatcgtgatgcgcaaccacagctgggtcgcctacgtgccggccgccgcccgttggccccttgaagtccacgtggccccggtgcgcgacgtgctcaccctcgaccagctcaacgacgaagagcgctgggaccttgcctccatgtactcgcacctcctgaagcgcggcaacgccttcttcgacaagggcgacggcaagggcatggacctgccgtacatcgctgcctggcaccaggccccgatccacgacaagcgccgcgagaactaccgcctgaacctgcagttcttctccttccgccgtgccgccaacaagatcaagtacctcgccggctccgaatccggcatggccgcctggatctccgacaccacgccggaactcatcgccaagcgcttccacgagctcggctccatcgacatcgccgactga

SEQ ID NO: 85402 - protein, 416 aa, Bifidobacterium longum NCC2705
MADFANYTPGEYAKEHIRITPATLADGRDFFYLDDDPEFVSGAKTRELKDPRPLDYRFAPHLDADGNEVPYAAPQMRRDPLTGDWIPMATARMNRPITAGPGATAKGNPLAARKPGDPYQDGEVPDTDYNVVVFENRFPSMVRVPGVSEDVTYVDGNPLWEKKLAAGRCEVICFDPNEDGLPADLPVSRLRTVVEAWAFRTAEISKMEGIEQIFPFENHGQEIGVSLAHPHGQVYCYPFIAPKMEKELQHTEAYHEKTGGNLLKDIMNAELEAGERIVMRNHSWVAYVPAAARWPLEVHVAPVRDVLTLDQLNDEERWDLASMYSHLLKRGNAFFDKGDGKGMDLPYIAAWHQAPIHDKRRENYRLNLQFFSFRRAANKIKYLAGSESGMAAWISDTTPELIAKRFHELGSIDIAD

SEQ ID NO: 85403 - DNA, 1086 bp, Streptomyces avermitilis MA-4680
  CDS (1)..(1086)
atgaagaagacctcgaccccgctggccgacggtcgcgagctcatctactacgacctgcgcgacgacgccgtgcgcgacgccgtggaccggcgcccgctcgaccggaccgtcaccagctcggagatccgccgcgacccgctgctcggcgactcggtcgcgatcgcctcgcaccgccagggccgcacctaccaccccccggcgaacgaatgtccgctctgcccctccgagggcgagcggctgagcgagatcccggactcctcgtacgacgtggtcgtcttcgagaaccgcttcccctcgctggccggagactccggccgctgcgaggtggtctgcttcacctccgaccacgactcctccttcgccgacctgaccgaggagcaggcgggcctggtcctggacgcctggaccgaccggacggcggagctgtcgcatcttccctccgtccagcaggtgttctgcttcgagaaccgcggcgccgagatcggcgtgacactcggccacccgcacggacagatctacggctaccccttcaccacgccccgtactgcgctgatgctgcgttcggcggccgcgcacaaggaggcgacggggggcggcaacctcttcgacgacgtactcgccggcgaactggccggggagcggatcgtccttcagggagagcactgggtcgccttcgttccgtacgcggcgcactggccctacgaggtccacctctacccgcgccgccgggtccccgacctgctggccctcgacgaggacgcacgcacagagttccccaaggtgtatctggaactcttgaggcgcttcgaccggatcttcgatgggacgggtggagggaaagaaggggtgggcgagcctccgacgccgtacatcgccgcctggcaccaggcgccgttcggcccgttggaggagttcgaaggcgtcaaccgtgacgacttcgcactccacctcgagcttttcaccattcgccgcacttccggcaagctgaagtttctcgcgggttccgagtccggcatgagcgtgttcatcaacgacgtgccgccggagaccgcggcccagcgactgcgagaggtagcgagttcatga

SEQ ID NO: 85404 - protein, 361 aa, Streptomyces avermitilis MA-4680
MKKTSTPLADGRELIYYDLRDDAVRDAVDRRPLDRTVTSSEIRRDPLLGDSVAIASHRQGRTYHPPANECPLCPSEGERLSEIPDSSYDVVVFENRFPSLAGDSGRCEVVCFTSDHDSSFADLTEEQAGLVLDAWTDRTAELSHLPSVQQVFCFENRGAEIGVTLGHPHGQIYGYPFTTPRTALMLRSAAAHKEATGGGNLFDDVLAGELAGERIVLQGEHWVAFVPYAAHWPYEVHLYPRRRVPDLLALDEDARTEFPKVYLELLRRFDRIFDGTGGGKEGVGEPPTPYIAAWHQAPFGPLEEFEGVNRDDFALHLELFTIRRTSGKLKFLAGSESGMSVFINDVPPETAAQRLREVASS

SEQ ID NO: 85405 - DNA, 1185 bp, Mycobacterium bovis AF2122/97
  CDS (1)..(1185): transl_table=11
atgagcgccacgccaccgcccggaggactcgacgcgtcggtgttcatcgcgaacgaacgcggtcggcaactcgacgaggcgctcccagtagggttctgcgttgtgacggcgccgacgcggtggaccctggccgatggccgtgacctgctgttcttttcgctgcccggacacgtcccggcgccggtgtcggatcgtcggccgctgcccgaacgtgacccggctccctcgcggctgcggttcgaccgggccaccggccagtgggtgatcgtcgccgcacagcgccaggatcgcacctacaagccgccggccgcgcgctgcccgctgtgtccggggccgaccggtctgagtagcgaggtgcccgcccccgactacgacgttgtcgtcttcgagaaccggtttcccagcctggccggggccggcatcgccccaatcggcgcgcccgacggtgacgggttcgtatccgctccggggcacggacgctgcgaggtgatctgcttttcggccgatcacaccggttcgttcgcgggcctggacccggcgcatgccgggctggtcgtgcacgcgtggcggcaccgcaccgccgaattgacggccctgcccggggtagcgcaggtgttctgcttcgagaaccgtggtgaggagatcggggtgaccctgacccacccgcacggccagatttacgcctatccgtatctgacgccgcgcaccgcggcgatgctgcgccaggctcgtcggcaccgaaagcgtcacggtgacaacctgtttgccagcctgctggcacgcgaggtcgccgacggcagccgcatcgtggtacgcggcgagctgttcaccgcattcgtaccgttcgccgcacgctggccggtggaggtgcacatttacccaaaccggttggtgcgcaacctcaccgagctcaatgacggggagttggatgagttcgcccggatctatctggacgtgctgcagaggtttgatcggatgtattcttcaccgctgccgtacatgtcggcgctgcaccagttcagcgaggtccagcgcgatggctactttcacgtcgagctcatgtcgatccggcgcagcgccaccaaactgaaatatctggcggccgccgagtcggcgatggacgcgttcatcgccgacgttatcccggagagcgtggccgcccggctgcgcgagctgggcccatga

SEQ ID NO: 85406 - protein, 394 aa, Mycobacterium bovis AF2122/97
MSATPPPGGLDASVFIANERGRQLDEALPVGFCVVTAPTRWTLADGRDLLFFSLPGHVPAPVSDRRPLPERDPAPSRLRFDRATGQWVIVAAQRQDRTYKPPAARCPLCPGPTGLSSEVPAPDYDVVVFENRFPSLAGAGIAPIGAPDGDGFVSAPGHGRCEVICFSADHTGSFAGLDPAHAGLVVHAWRHRTAELTALPGVAQVFCFENRGEEIGVTLTHPHGQIYAYPYLTPRTAAMLRQARRHRKRHGDNLFASLLAREVADGSRIVVRGELFTAFVPFAARWPVEVHIYPNRLVRNLTELNDGELDEFARIYLDVLQRFDRMYSSPLPYMSALHQFSEVQRDGYFHVELMSIRRSATKLKYLAAAESAMDAFIADVIPESVAARLRELGP

SEQ ID NO: 85407 - DNA, 1392 bp, Rhodopirellula baltica SH 1
  CDS (1)..(1392): transl_table=11
atgaagacacaacagtcaggagtcaacatcgatccgcgtcaaatatcgctgagtgagacctcccggactgctgaacattcgcttcccgcggaacaaagcggattggacacgcaaagcgtgaccgacctgcaaaccgagcgtgacaatcccgtccctacgcgcaccggggcaaaaccaaacttcgattattccgccacgtcgcaacgtgcggaggatttggtggatcgcttggtcgacgccgagatcctcgatcagccctgcaaagacggccgatacgttgactttcccaatgagtcacacgttcaaaccggtcgctcgcgaaaagacccgatttcgggcagttggacgatctttgcacccggccgtgcccgccggcctgatcaattcaaatctcatcggccaaaacctgacgcgtcgatggattgcccgttctgccacggcaacgaaaacctgacaccagcttcggtgtggtcggcaaaactatcggaagacgaagaagccgttccacagtcttctgattggacagttcgagtcgttccgaacttgtttccggccatcaaacccgaaagcaacgctgagctcaaacccaccgccgccgacgacgaagcagaatcgcgtttgtcgccattcgctcaatcgttgtttgtcgaagagatcgcatcgggtggccacgaggtcatcattgaagccgctcgccacactcggtcgcttagcgaactgaacttggcagagatcgccctcgcgttttccgcttatgcggcccggatgcgtcattggcgtcaacaacctggcatccaattcatcagtctgttcaagaacgtcggccgtgatgccggtgcgtcgttgcagcacagccacagccaactcatcgcttcgaaccacttgccgcactcggttcgcgaagtcaacaaacgcatgcgatcgcactttgatcgttacggacgctgtttgcaatgcgatgtgttgcaagctgaactggaacgcaaagaacgaatcgttcatcaatccgattcgctggtcgcctactgtcctcacgccagccggttcccttacctgattcgaatcacgtccaaaatgcatgtgggctgtttcgaagacctttcggtttcaatgaacgaagaagtcgcgcgtttggtgctgcgaagcgttcgttggctcgaagcgatcattcccggcgtcgcgtacaacatgatgttgcacacgggtcccgccggtgaccagcacgacaacgaaacgcaccactggagccttgaattggcaccacgaatcggtcgtttggccggttatgaactcagttccggcgggatgatcaacacggtgtatcccgaggctgccgcggacgaatttcgtcatcaagcccgacgcagcgacccgcgtcacgccctgcgttaa

SEQ ID NO: 85408 - protein, 463 aa, Rhodopirellula baltica SH 1
MKTQQSGVNIDPRQISLSETSRTAEHSLPAEQSGLDTQSVTDLQTERDNPVPTRTGAKPNFDYSATSQRAEDLVDRLVDAEILDQPCKDGRYVDFPNESHVQTGRSRKDPISGSWTIFAPGRARRPDQFKSHRPKPDASMDCPFCHGNENLTPASVWSAKLSEDEEAVPQSSDWTVRVVPNLFPAIKPESNAELKPTAADDEAESRLSPFAQSLFVEEIASGGHEVIIEAARHTRSLSELNLAEIALAFSAYAARMRHWRQQPGIQFISLFKNVGRDAGASLQHSHSQLIASNHLPHSVREVNKRMRSHFDRYGRCLQCDVLQAELERKERIVHQSDSLVAYCPHASRFPYLIRITSKMHVGCFEDLSVSMNEEVARLVLRSVRWLEAIIPGVAYNMMLHTGPAGDQHDNETHHWSLELAPRIGRLAGYELSSGGMINTVYPEAAADEFRHQARRSDPRHALR

SEQ ID NO: 85409 - DNA, 1074 bp, Photorhabdus luminescens subsp. laumondii TTO1
  CDS (1)..(1074): transl_table=11
atgccccaaattgcattcaatcctattgaacatccccatcgtcgttataatccgttaaccgggcaatgggttttggtctctcctcatcgggtgaaacggccgtggcatgggcaggatgagcagccattgatagacaatattccgaactatgatgagcaatgttttctttgcccatcaaatacacgtatttccggtgataaaaatcctgcttatcaaggagcctttgtttttaataatgatttttcggctttaatgctcgattcacctgatttaccaccatcatgtcatccactatttaaagcgcagggggttagaggattaagtcgcgtgatctgtttttctcccgatcacagtaagacattgccggaattgccggttaaacacattcgtcaattgattgatacctggaatgagcacattgaaatactgggtaaggaatatctttgggttcaagtttttgaaaataagggtgaagcaatgggatgttctcagcctcatccacatgggcaaatctgggcgaatagttttctgccaaacgaaattgaacgtaaagataaacaactgcgtgcttattaccaagaacagagttctaatttattgatggattatattcaggctgaattagctgatggtgagcgggttgtggtcgatacaacccattggttggcggttgtgccttattgggcagcatggccctatgaaaccatgttgttacctaaagttcatgtgcgtcgaatgaatgaattaacggatcagcaacgcgatgatttggcggtcgcgcttaaaaagcttaccagccgttatgataatttatttcatagcgcttttccctattcgatgggttggcattttgcaccgttttttgaacaaggcgctgatattgaacattggcaactacatgcacttttctatccgccattattgcgatcggctactgtgcgaaaatttatggtgggttatgaaatgtttgctgaaaaacaacgtgatttaacggcagagcaagccgctcagcttttgcgtgctgtgagcgatatacattataaagagcaacaatgttcattatcgagtggctga

SEQ ID NO: 85410 - protein, 357 aa, Photorhabdus luminescens subsp. laumondii TTO1
MPQIAFNPIEHPHRRYNPLTGQWVLVSPHRVKRPWHGQDEQPLIDNIPNYDEQCFLCPSNTRISGDKNPAYQGAFVFNNDFSALMLDSPDLPPSCHPLFKAQGVRGLSRVICFSPDHSKTLPELPVKHIRQLIDTWNEHIEILGKEYLWVQVFENKGEAMGCSQPHPHGQIWANSFLPNEIERKDKQLRAYYQEQSSNLLMDYIQAELADGERVVVDTTHWLAVVPYWAAWPYETMLLPKVHVRRMNELTDQQRDDLAVALKKLTSRYDNLFHSAFPYSMGWHFAPFFEQGADIEHWQLHALFYPPLLRSATVRKFMVGYEMFAEKQRDLTAEQAAQLLRAVSDIHYKEQQCSLSSG

SEQ ID NO: 85411 - DNA, 1068 bp, Vibrio vulnificus YJ016
  CDS (1)..(1068): transl_table=11
atgtcgaatgttgagtttaaccctgtggatcacccacaccgtcgttttaatccactcacgggccagtgggttttggtttcccctcatcgtgcaaaacgcccttggagcggtgccgatgagaagccagccattgatgaactgccaagttacgatgagaaatgtttcttgtgtccgaccaacgaacgcgtctctggcgatgtcaatccagattaccaaggtacttacgtgtttaagaacgattttgctgccttgatggtggactcaccggatgcgccagagtcagagaatccgctcttcaaaacccaaggcgtgcgcggtttaagccgagtgatttgcttctcgccagatcacagcaaaaccttacctgagctaccagtggaaaaaatccgcggcgtgattgagacctggaacgaacaaattgaagagctcggcaaagagtacgtttgggttcaagcgttcgagaacaaaggtgaaaccatgggctgttctcagccacacccacatggtcaaatctgggcgaacagcttcttaccaaacgaaattgagcgtaaagagcacaacctaaaagcgtattaccaagaacacggcagcaacttgctggtggattacgtgcaagcagaactcaaagacggttcacgtactgtggtggaaaccgagcactggttggccgtcgtgccttactgggcagcgtggccatttgaaaccatgcttctgccgaaaacgcacattcgccgcatgagcgaactcagcgatgggcaacgagatgatttagcactagcgattaagaagctgaccagccgttacgacaacttattccagtgctcattcccatactcaatgggctggcactacgcgccgttttttgaccaaggcaccgacatcgaccattggcaacttcatgcacttttctatccgccactcctgcgcagtgcgacgattcgcaagtttatggtcggttacgaaatgctggcagaaagccaacgcgatctcaccgcagagcaagccgcgcagcgtctgcgtgatgtgagtgatgtccattacaaagaatgctatccccttcctacttga

SEQ ID NO: 85412 - protein, 355 aa, Vibrio vulnificus YJ016
MSNVEFNPVDHPHRRFNPLTGQWVLVSPHRAKRPWSGADEKPAIDELPSYDEKCFLCPTNERVSGDVNPDYQGTYVFKNDFAALMVDSPDAPESENPLFKTQGVRGLSRVICFSPDHSKTLPELPVEKIRGVIETWNEQIEELGKEYVWVQAFENKGETMGCSQPHPHGQIWANSFLPNEIERKEHNLKAYYQEHGSNLLVDYVQAELKDGSRTVVETEHWLAVVPYWAAWPFETMLLPKTHIRRMSELSDGQRDDLALAIKKLTSRYDNLFQCSFPYSMGWHYAPFFDQGTDIDHWQLHALFYPPLLRSATIRKFMVGYEMLAESQRDLTAEQAAQRLRDVSDVHYKECYPLPT

SEQ ID NO: 85413 - DNA, 1131 bp, Corynebacterium diphtheriae NCTC 13129
  CDS (1)..(1131): transl_table=11
atgaacgtgactacttccacgcttgccgacggtcgcgagatcatctacttcgatgaccacgagctgcgcgagggagaacgagttcttcacgattccagggacctgccccacacgcagccactgtcggagatccgccacgatcccctcacaaacacgtgggtggcttacgcagcccaccgcatgaaccgcacgtttatgccaccagcgaatgaaaacccgcttgcaccgacaacgcctggcaaccttcctacagagataccgtcgcctacgtatgacgtcgttgtttttgaaaaccgattcccgtcgttttctatgaacatcgcagtaggagaggattgggaaagttatgttgatgggatagacctctatccacgtcgacctgcccttgcccgttgcgaggtagtctgttttaccccagatgtagacaagtcctttaaggatctgccggtttcacgtattcgcactgtcatcaatgcttgggcacatcgaaccgaggcgctgtcagccttgtctggggtccaacaggtgttcccctttgaaaacaggggagaagaaatcggcgtaacactccaacacccgcacggtcagatctactcctacccgttcctttccccacggctacaagcaattgttcaaagtgcacaatactatgcggaaacacacgacggccatgatctcttcgatgcgatcatccgcgaagaatctgctgtacaaacacgagttattgaacgcacagagcacttcattgttttcgtcccagcagccgcaaaatggccagtagaagcaatggtcatgccgcttcgtgccgtagctgacttcaccgaactcactgacgtggaacgcgacgacctagcagctctactcaagcgcctctacacggcggtggacagcttcttcgaaggagtaactaaaacaccatacatcgcaggctggacccaagcaccagtagacccagcactgcgcccatttggccgcctccacctgcagctgttttccttgatgaggtcgccaaaccgaatgaagttcctcgccggttcagaatcaagccaaggggtctggatcaacgacacaaccccagaacgcattgcacaacgattcaaggaggtatggccacatgccacgctggattaa

SEQ ID NO: 85414 - protein, 376 aa, Corynebacterium diphtheriae NCTC 13129
MNVTTSTLADGREIIYFDDHELREGERVLHDSRDLPHTQPLSEIRHDPLTNTWVAYAAHRMNRTFMPPANENPLAPTTPGNLPTEIPSPTYDVVVFENRFPSFSMNIAVGEDWESYVDGIDLYPRRPALARCEVVCFTPDVDKSFKDLPVSRIRTVINAWAHRTEALSALSGVQQVFPFENRGEEIGVTLQHPHGQIYSYPFLSPRLQAIVQSAQYYAETHDGHDLFDAIIREESAVQTRVIERTEHFIVFVPAAAKWPVEAMVMPLRAVADFTELTDVERDDLAALLKRLYTAVDSFFEGVTKTPYIAGWTQAPVDPALRPFGRLHLQLFSLMRSPNRMKFLAGSESSQGVWINDTTPERIAQRFKEVWPHATLD

SEQ ID NO: 85415 - DNA, 1026 bp, Geobacter sulfurreducens PCA
  CDS (1)..(1026): transl_table=11
atgtccgaactgagatgggaccccctgaagcagcactgggtaatcatagccaccgaacgggggcgcagaccccgggacttcatggtggagcacgaaaccacggatgcggcctgctgccctttctgctacgggctggaaggaaagactccgccggaaatttacgccgtacgcgacacgggcgtcgctaattcccccgggtggaaagtacgggtgatccccaacaaatacccggccctgcgtatcgagggcaacctcaacagccgggggttcggcccctatgacgtcctgaacggcatcggcgcccatgaagtgatcatcgaaacccccgatcacgaccgggatatggccgagctctcaccggcagagatcaccgaggtcctcagggcttggcgagcccggtttctggatctgcgccgcgacacccgcttccgctacatggtcctcttcaaaaaccacggcaccaaggccggcgccaccctgtcccactctcacagccagctcatcgccgtccccctcatccccccggtggcggcaaccgaactgcgggtatgcaaagagtacttctccgccaaggagcgttgcctcatctgcgacctgatcgacttcgaactgaagagcggcgagcgcatcgtccgggagttcgccaactacgtcatcatgaccccctatgcggcctgcttccccttcgaggtgcggctctatcccaagcgacacgcctttgatttcgctctgctgcccgatgcggaactggcggagctggctgtggcgctcaaggacatgctcacccgcttgcgaagcgtcctgcgcgatccaccctacaatttcatcctccataccgccccgccgcgccatccgcgcctcggcaagcccggctactggagttccatcgaatatgattaccactggcacatcgaattggtgccgaggctgacccagatcgccgggttcgagtggggaaccggcttccacatcaatccgacgtcgccggaagacgccgcggcattcctcagggaagcgggggcatga

SEQ ID NO: 85416 - protein, 341 aa, Geobacter sulfurreducens PCA
MSELRWDPLKQHWVIIATERGRRPRDFMVEHETTDAACCPFCYGLEGKTPPEIYAVRDTGVANSPGWKVRVIPNKYPALRIEGNLNSRGFGPYDVLNGIGAHEVIIETPDHDRDMAELSPAEITEVLRAWRARFLDLRRDTRFRYMVLFKNHGTKAGATLSHSHSQLIAVPLIPPVAATELRVCKEYFSAKERCLICDLIDFELKSGERIVREFANYVIMTPYAACFPFEVRLYPKRHAFDFALLPDAELAELAVALKDMLTRLRSVLRDPPYNFILHTAPPRHPRLGKPGYWSSIEYDYHWHIELVPRLTQIAGFEWGTGFHINPTSPEDAAAFLREAGA

SEQ ID NO: 85417 - DNA, 1098 bp, Mycobacterium avium subsp. paratuberculosis str. k10
  CDS (1)..(1098): transl_table=11
atggggccgacgcgggcgaagctggctgacggtcgcgacctgctgttcttctcgctgcccgggcaccgcgcttcgccggtcgaagaccgccgccccctgccgccccgaaccgccgaaaccgttgcgccgggcggacagtcgcagctgcggttcgaccggtccaccgggcagtgggtgatcatcgccgcgctgcgccaggaccgcacctacaagccgccgcccgacgcgtgcccgctctgccccgggccgaccgggctgaccagcgaggtacccgccgccgactacgacgtcgtggtgttcgagaaccgctttcccagcctgtccggtgcggcaccggggctgctggccgccggcgccgacgggttcgtgtccgcgcccgcgcacggccgctgcgaggtggtctgcttctcggccgaccacaccgggtcgttcgcggggctgccacccgcgcacgcccggctggtggtgcaggcctggcggcatcgcaccgccgagctgatggacaccccgggcatcgagcaggtgttctgcttcgagaaccgcggggaggagatcggggtgaccctgacccatccgcacggccagatctacggctacccctacctgaccccgcgcaccgccgccatgctgggccaggcggacgagcatcgaaaacgccacggcggcaacctcttcggtgacctgctggcccgcgaggtcgccgacggcagccggatcatcgcgcgcgacgacctgttcaccgcgttcgtgccgttcgcggcgcggtggccggtggaggtgcacatctacccgaacaggttcgtgcccaacctgaccgcactgcgcgacgacgaggtggacgggttcgtggccgtctatctggacgtgctgcgccgcttcgaccggatgtatgacgcaccgctgccctacatttcggcgctgcaccaatacaccggcaccggtgctcaggcccagggctacttccacgtcgaactgatgtccatccggcgcagcgcgaccaagctcaaattcctcgccgcctccgaatcggcgatggacgccttcatcagcgacgtcaccccggaaagcgtggcccagcggctgcgggagctgcgatga

SEQ ID NO: 85418 - protein, 365 aa, Mycobacterium avium subsp. paratuberculosis str. k10
MGPTRAKLADGRDLLFFSLPGHRASPVEDRRPLPPRTAETVAPGGQSQLRFDRSTGQWVIIAALRQDRTYKPPPDACPLCPGPTGLTSEVPAADYDVVVFENRFPSLSGAAPGLLAAGADGFVSAPAHGRCEVVCFSADHTGSFAGLPPAHARLVVQAWRHRTAELMDTPGIEQVFCFENRGEEIGVTLTHPHGQIYGYPYLTPRTAAMLGQADEHRKRHGGNLFGDLLAREVADGSRIIARDDLFTAFVPFAARWPVEVHIYPNRFVPNLTALRDDEVDGFVAVYLDVLRRFDRMYDAPLPYISALHQYTGTGAQAQGYFHVELMSIRRSATKLKFLAASESAMDAFISDVTPESVAQRLRELR

SEQ ID NO: 85419 - DNA, 1221 bp, Rattus norvegicus
  CDS (1)..(1221)
atgctctccagagaagtgcctccaatccggtgtggaggagaatcatcaaaacatcctggggaggttaattcgtgtgacctcatgtcgcaaagcggagccgatcctgagcagcgccagcaggcttcagaggcggacgccatggcagcgaccttccgggcgagcgaacaccagcatattcgctacaacccgctccaggatgagtgggtgttagtgtcagcccatcgcatgaagcggccctggcaaggacaagtggagccccagcttctgaagacggtcccccgccatgacccactcaaccctctgtgtcccggggccacacgagctaatggggaggtgaatcccccctatgatggcaccttcttatttgacaatgacttcccggctctgcagcccgatgctccggatccaggacccagtgaccaccctctcttccgagtggaggccgccagaggagtttgtaaggtcatgtgcttccacccctggtcggatgtgacgctgccactcatgtctgtccctgagatccgagctgtcatcgatgcatgggcctcagtcacagaggaactgggcgcccagtacccttgggtgcagatctttgaaaacaaaggagccatgatgggttgctctaacccccatccccactgccaggtttgggctagcaatttcctgccagatattgcccagcgtgaagagcgatcccagcagacttatcacaaccagcatggaaagcctttattattggaatatggccaccaagagctcctcaggaaggaacgtctggtcctaaccagtgagtactggatagttctggtccccttctgggcagtgtggcctttccagacattactgctgccccgacggcacgtgcagcggctacctgagctgacccctgctgagcgtgatgatctagcctccaccatgaagaagctcttgaccaagtatgacaacctgtttgagacgtcctttccttactccatgggctggcacggggctcccatgggattaaagactggagccacctgtgaccactggcagctccatgctcactattaccccccactcctgcgatcggctactgttcggaaattcatggttggctatgaaatgcttgcccaggcccagcgtgacctcactcccgaacaggctgcagaaagattaagggtgctccctgaggtacactattgcctgacgcagaaagacaaggaaacagcagccaccgcttga

SEQ ID NO: 85420 - protein, 406 aa, Rattus norvegicus
MLSREVPPIRCGGESSKHPGEVNSCDLMSQSGADPEQRQQASEADAMAATFRASEHQHIRYNPLQDEWVLVSAHRMKRPWQGQVEPQLLKTVPRHDPLNPLCPGATRANGEVNPPYDGTFLFDNDFPALQPDAPDPGPSDHPLFRVEAARGVCKVMCFHPWSDVTLPLMSVPEIRAVIDAWASVTEELGAQYPWVQIFENKGAMMGCSNPHPHCQVWASNFLPDIAQREERSQQTYHNQHGKPLLLEYGHQELLRKERLVLTSEYWIVLVPFWAVWPFQTLLLPRRHVQRLPELTPAERDDLASTMKKLLTKYDNLFETSFPYSMGWHGAPMGLKTGATCDHWQLHAHYYPPLLRSATVRKFMVGYEMLAQAQRDLTPEQAAERLRVLPEVHYCLTQKDKETAATA

SEQ ID NO: 85421 - DNA, 1065 bp, Anopheles gambiae str. PEST
  CDS (1)..(1065)
atgagtgaaatgttcgacccgacagatcatcaacaccgccgttacaatccactgaacgggcagtgggtgctggtgagtccgcatcgcatgaagcggccctggtcgggccaggaagaaaatccccagccagagaatcttccctcgtttgatccaacgaacccgctgtgtccgggagtgacccgcccgaatggaaccaaaaatcccatctacgagtcaacgttcgtgtttacgaacgactttccggccctgctggagcaggtaccggagcccccgtccagcgatgatccgctgttccagatagcaccggcgcagggcacctgccgggtgatgtgcttccatccgaagtctaacaaaacgctaccactgatgacgcccaaggagatacgcaatgttattgatgcgtggatcgcggaattccgcacgctggcgcagcggtaccaatgggtgcagattttcgaaaacaagggtgcaacgatgggctgctcgaacccgcatccacactgccagatctgggcctgctcgtttctgccgaatgagccgaagattaaggatgatatgttgcggcagtactacgcagctcatggaacggctctactggatgattacgtgaaccgcgaattgattaagagggagcgaattgtcatcgagaatccggactggctggtggtggttccgttctgggcagtgtggccgttcgaaacgatgctgatttcgcgaaatcggaacaagcgcatcaccgacctaactttgccgcagatcaacagtctagcgatcgtgatcaaggagctgaccaccaagtacgacaatctcttcaagtgctcgtttccgtacagcatgggctggcacggtgcaccgacggcggagctggcgaatggtgccgcggctgaacagcactggaccctgcatgcaatctactacccgcccctgcttcgttccgccacggtgcgcaagttcatggtgggcttcgagttgctatgccaggcgcagcgtgatctgacggctgaacaggccgccgacaggcttcgtggactctccggcaaacgacactacagtgagcagctgtga

SEQ ID NO: 85422 - protein, 354 aa, Anopheles gambiae str. PEST
MSEMFDPTDHQHRRYNPLNGQWVLVSPHRMKRPWSGQEENPQPENLPSFDPTNPLCPGVTRPNGTKNPIYESTFVFTNDFPALLEQVPEPPSSDDPLFQIAPAQGTCRVMCFHPKSNKTLPLMTPKEIRNVIDAWIAEFRTLAQRYQWVQIFENKGATMGCSNPHPHCQIWACSFLPNEPKIKDDMLRQYYAAHGTALLDDYVNRELIKRERIVIENPDWLVVVPFWAVWPFETMLISRNRNKRITDLTLPQINSLAIVIKELTTKYDNLFKCSFPYSMGWHGAPTAELANGAAAEQHWTLHAIYYPPLLRSATVRKFMVGFELLCQAQRDLTAEQAADRLRGLSGKRHYSEQL

SEQ ID NO: 85423 - DNA, 1155 bp, Magnaporthe grisea 70-15
  CDS (1)..(1155)
atgcctgacaagattcttgacgacatctcccatcggaggtacaatcctttgactggcacatggctcctcgtctcgccgcatcgcacaaaacgaccctggcaaggtcagcaggaagcgccttccaagagcgagcttccacagtatgacccgtcttgctatctctgcccagggaatacacgcgcccagggcgacagcaacccgaaatacgagaagacatttgtctttgtcaacgactacagcgccgtcaaggagacacaggcacactatgcgccagaggaaaagaccgatgatgttgcctcgctcctcctcaaggcggacgctgccactggccgttgctatgtgttgacattctcggccgtgcacaatgtcaccctggccgacatgaagccccaagaaatcgtccccgtaattgatctctggacggatctctacgcctcgcacgtttgtccgactagccccttgggtacggctgccgctaccgtgcgtcagaaactctcgatagtccccgagtgccaaatgtcgcagccatcgcaacaactacgatacatgacgatatttgagaacaagggagctgcgatgggttgctcgaacccccacccccattgtcaaatatggacgacgtcgagcttgccagaggaaccaggcaaggaattggatcaaatgtccaagtaccgtcgggaacatggacgtcatatgcttggtgactacgtcaagttggagatcgagaagggcgagcgtgtcgtttggcagaacgacagcttcttgattgtttgtccgtggtgggcagtttggcctttcgaggttctggtccttgcgaagcgacatgttcgggccttggtggatctgtcgaccgacgagaggcttcattttgctgaggccatccaggaagtcactcggcgatatgacaacttgttcgagacaaacttcccatacagctctggaatacaccaggcgcccattgactgcagtgaagaagaggccgagagcagctggttccacatgcatttctacccgccgctgcttcgctcagctaccgtgaagaagttccttgttggatatgagcttttggccgagcctcaacgcgacattacccctgaacaagccgcggctcgtttgagggcctgcggcggagagctgtaccgcaactctctataa

SEQ ID NO: 85424 - protein, 384 aa, Magnaporthe grisea 70-15
MPDKILDDISHRRYNPLTGTWLLVSPHRTKRPWQGQQEAPSKSELPQYDPSCYLCPGNTRAQGDSNPKYEKTFVFVNDYSAVKETQAHYAPEEKTDDVASLLLKADAATGRCYVLTFSAVHNVTLADMKPQEIVPVIDLWTDLYASHVCPTSPLGTAAATVRQKLSIVPECQMSQPSQQLRYMTIFENKGAAMGCSNPHPHCQIWTTSSLPEEPGKELDQMSKYRREHGRHMLGDYVKLEIEKGERVVWQNDSFLIVCPWWAVWPFEVLVLAKRHVRALVDLSTDERLHFAEAIQEVTRRYDNLFETNFPYSSGIHQAPIDCSEEEAESSWFHMHFYPPLLRSATVKKFLVGYELLAEPQRDITPEQAAARLRACGGELYRNSL

SEQ ID NO: 85425 - DNA, 1149 bp, Gibberella zeae PH-1
  CDS (1)..(1149)
atgcctgatcaaattcttgacgatatctctcatcggagatacaatcccctcacggattcctggctgcttgtatcccctcatcgcacgaagcgaccttggcaaggtcagcaagaggctgctgtcgcgacagaactccccgaatatgaccccaaatgttacctatgtcccggcaatccacgagcagctggtgactctaacccgaaatacgaaaggacgtttgcctttgtgaacgactacagcgcagtcaagcaagagcagcctgaatatgacgccaaggcctcatccaacgacttggaatctcttctcctccaagcccagggtgtcaagggtgtgtgttatgtcctcaccttctctcccaagcatcatgtcacccttgccgatatgactgccaacgagattgttcccgttattgaacactggacacgcatctatgccaaccatctgacgccgtcaaacccccgcgcggctgaagctgaccagcttaatatctccatgtccaaagacactacccctagccccgaggaacagtaccgatatatgcaaatctttgagaacaagggcgctgcaatgggttgctccaaccctcaccctcattgccaggtctggaccacatctactatgcccgaggagccaggcaaggagcttgtccaaatgaccaagtatcgagaacagcatgaaggccgacacctcttaggtgactacgtcaaattggaattggagaagaaagagcgagttgtttgggagaacgatgcattcgttattgtgtgcccttggtgggctgtgtggccgtttgaggttcttgttctgcctaagcgacacatccgatcccttctcgactttaagcccgaagagcgactccaatttgccgaagccattcaagaagtcacccgaaggtacgacaacttgtttgagtgcaacttcccctatagctctggccttcaccaggcaccgcttgacggtacccctgaggagttggagagtgcttatttccacatgcatttttatccccctctgctgcgctcggccacagtcaagaagttcctcgttggttacgagctcttggctgagccgcagcgtgatatcacacccgagcaggctacagtccgcttgaggaactgcggaggagagctctaccgaaagagcctatag

SEQ ID NO: 85426 - protein, 382 aa, Gibberella zeae PH-1
MPDQILDDISHRRYNPLTDSWLLVSPHRTKRPWQGQQEAAVATELPEYDPKCYLCPGNPRAAGDSNPKYERTFAFVNDYSAVKQEQPEYDAKASSNDLESLLLQAQGVKGVCYVLTFSPKHHVTLADMTANEIVPVIEHWTRIYANHLTPSNPRAAEADQLNISMSKDTTPSPEEQYRYMQIFENKGAAMGCSNPHPHCQVWTTSTMPEEPGKELVQMTKYREQHEGRHLLGDYVKLELEKKERVVWENDAFVIVCPWWAVWPFEVLVLPKRHIRSLLDFKPEERLQFAEAIQEVTRRYDNLFECNFPYSSGLHQAPLDGTPEELESAYFHMHFYPPLLRSATVKKFLVGYELLAEPQRDITPEQATVRLRNCGGELYRKSL

SEQ ID NO: 85427 - DNA, 1230 bp, Ustilago maydis 521
  CDS (1)..(1230)
atgaacggctacaatcatgccaacggcgactctgacggccacgctagcacgcaagccaatatggtcgctgacagctcacagcaagagcccgtcgagttcgatgcaaccgagcatcctcaccgaagatacaacccgttgacacgcagctgggtgctctgctcaccccaccgcactaagcgtccgtggcaaggtcaagaggaaaagccacagggcacgtctctccccgcatatgatgagaaatgctacctctgccctggcaacacacgtgccacgggtgagaaaaacgacgattatacctctacctttttcttcgaaaacgactatgccgcgctcaaaccacaatcggtaatggaagagaagaaccaacatcctttgctccaatcacagccagctcgaggtcgttgctacgtgatttgcttcaatccgcagcacaacttgacgctggcgcagcttagtactccacccttttcgccagatcagcacattgtgccaatcattcggagctggcagaagatttacaaacagatccccgctgagaacccattcgtcaagtacattcagatcttcgagaacaagggctcggcgatgggttgttcgaatccacaccctcacggacaggtgtggtcgctggattacattccggaagagccgagcaaggagcttgcttctctccgcgactggtccaaggacccggctaaccaggatgccaaggttaacctaggcgcattggacgaccacggacgcccatccatgctgctcacgctcgctaagcttgaattgtcgacccctggtcgtccccgcgtcatcacctccaacagccactttgtggccatcgtaccttactgggcggtatggccgtttgaagtgctcctgcttcctgcgcaacgtcagatccgcaacatcctgcagatgaccgaagtcgaggtcgtctcgctggctcgcatcttggccgagaccacttgtaaattggacaacgtcttcaagtgctcgtttccctactcgatgggcgtccatcagcaaccaacgcagatcaacacgcaggagcaggatgaatttgctcagttccacatccacttttatccgccgttgttgcggtccgcttcggtgcgcaagttcttggtcggcttcgagatgatggcggaaccgcagagggatttgactgcggaacaggcggcgaaacgcatccgcgagtgcgatgatatacactaccttgcgacgttggagaagtag

SEQ ID NO: 85428 - protein, 409 aa, Ustilago maydis 521
MNGYNHANGDSDGHASTQANMVADSSQQEPVEFDATEHPHRRYNPLTRSWVLCSPHRTKRPWQGQEEKPQGTSLPAYDEKCYLCPGNTRATGEKNDDYTSTFFFENDYAALKPQSVMEEKNQHPLLQSQPARGRCYVICFNPQHNLTLAQLSTPPFSPDQHIVPIIRSWQKIYKQIPAENPFVKYIQIFENKGSAMGCSNPHPHGQVWSLDYIPEEPSKELASLRDWSKDPANQDAKVNLGALDDHGRPSMLLTLAKLELSTPGRPRVITSNSHFVAIVPYWAVWPFEVLLLPAQRQIRNILQMTEVEVVSLARILAETTCKLDNVFKCSFPYSMGVHQQPTQINTQEQDEFAQFHIHFYPPLLRSASVRKFLVGFEMMAEPQRDLTAEQAAKRIRECDDIHYLATLEK

SEQ ID NO: 85429 - DNA, 1149 bp, Aspergillus nidulans FGSC A4
  CDS (1)..(1149)
atggttgaaagcgtcctcgacgatatctcccaccggagatataatcctcttcgtggagcctatgttctggtctctccccaccgtactaaacgtccctggcaaggcgcccaagaaacaccctccaagacaaccctgcctgactatgacgctacctgctacctttgccctggtaacaagcgcgcacagggagaccacaaccccaaatacgaaaagacttttatcttcgtcaatgactacagcgcggtcaaggaggaacaagcgccctaccacccagaagccggaaccgagaccgaatcattctttctgcgcgccgacccggtcaccggaaaatgctacgtgctcaccttctccgccgcccacaacctaaccctagcggacctctcaccggtcgagatcgtccccgtcatcaacgcctggacagacgtctacatcgcgcatttgtccccaagcagcccccttgccgccgccgcctccaaactcaccatttcctctggctctcctgcagcaagcctcgccaaaccaaatgaacagtaccgatacatgcagatcttcgagaacaagggcgcggcaatgggctgctcgaacccgcacccgcacggccagatctggacaaccagttctctccctgaagagctcgctgccgaactggaacagatgaagaagtatcgccgcgaacataatgggggacacatgctggccgactatgccgcgctcgagagcaagaagcaggaacgcgtagtctttgagaacgatgcattcctggtcgtttgtccctggtgggctatctggccgtttgagactatgatcattagcaagacgcacaagcgtgctcttgttgatctcgatgacaatgaaaaggcgcagcttgcggaggcgattgctgaagttactaggcggtacgataacctctttgagacacatttcccgtacagtatggggattcaccaagctcccttggaggggtctgaggaggagattgaggcgtcatatctgcatctgcatttctatccgccattattgaggagtgcaacggtgagaaagttcttggttggttatgagttgatggctgagcctcagcgcgatatcacccccgagcaggcggccgcaaggttacggggttgtggggaggtggatgacgcgcatgagtag

SEQ ID NO: 85430 - protein, 382 aa, Aspergillus nidulans FGSC A4
MVESVLDDISHRRYNPLRGAYVLVSPHRTKRPWQGAQETPSKTTLPDYDATCYLCPGNKRAQGDHNPKYEKTFIFVNDYSAVKEEQAPYHPEAGTETESFFLRADPVTGKCYVLTFSAAHNLTLADLSPVEIVPVINAWTDVYIAHLSPSSPLAAAASKLTISSGSPAASLAKPNEQYRYMQIFENKGAAMGCSNPHPHGQIWTTSSLPEELAAELEQMKKYRREHNGGHMLADYAALESKKQERVVFENDAFLVVCPWWAIWPFETMIISKTHKRALVDLDDNEKAQLAEAIAEVTRRYDNLFETHFPYSMGIHQAPLEGSEEEIEASYLHLHFYPPLLRSATVRKFLVGYELMAEPQRDITPEQAAARLRGCGEVDDAHE

SEQ ID NO: 85431 - DNA, 1110 bp, Debaryomyces hansenii CBS767
  CDS (1)..(1110)
atggccgaactattcgattttacaaatcattcacatcgtcgtttcaatcctttgtcaaatacatacgtcttatgctcaccacatagagctaaaagaccatggcaaggtgctaaagaagagcttaaaaagtcggacttaccaagtttcgatcctaagtgttatttatgtcctggaaacataagggctacaggagattctaacccaaaatacgaaaatacttacatctttccaaatgactacccagctgtcagggtagatcagcctgattatattgaagatacggaggaaattgaaaaatcctctccattaaaagccaaattattcaagactcaaggggtaaaaggtaagtgttttgtgatttgttttagtccaaaccataatttaactttaccattgatgtcagttgaagatattacttctgttattcaatcctggagatctttatataaagatttacaaaaggaggcacaagacggacctgtcaaatacaaatatttacaaatattcgaaaacagaggttttgcaatgggttgctccaatccacatcctcatggtcaagcttggtgcttagacacaattccaacagaagtcgatcatgaaataaaaaatatgaccaattatcacaatgaatctcattcgcacatgcttggggattatgttcaattagaattaaaagaaagagagagattggttttagaaaacgattcgtttattgtcgttgttccatactgggcattgtggccgtttgaaacgctcttaatttccaaagaacacttacgttctattaaagactttactgaaaagcataataaagatttagcttcgatcttgaagaaattaactaccaagtacgataacctttttaatactagtttcccatattcaatgggtatacatcaggctcctttggatggtactgatgaggaaaagaataattcttggttccatatgcacttctatcctccattattaagatctgctactgttaagaaattctgtgttggatttgaaatgttaggcgaatcacaaagagacttaacaagtgaacaagctgcatctagattgcaagatttagacggcgacaaacattatttgagtaaaataaactag

SEQ ID NO: 85432 - protein, 369 aa, Debaryomyces hansenii CBS767
MAELFDFTNHSHRRFNPLSNTYVLCSPHRAKRPWQGAKEELKKSDLPSFDPKCYLCPGNIRATGDSNPKYENTYIFPNDYPAVRVDQPDYIEDTEEIEKSSPLKAKLFKTQGVKGKCFVICFSPNHNLTLPLMSVEDITSVIQSWRSLYKDLQKEAQDGPVKYKYLQIFENRGFAMGCSNPHPHGQAWCLDTIPTEVDHEIKNMTNYHNESHSHMLGDYVQLELKERERLVLENDSFIVVVPYWALWPFETLLISKEHLRSIKDFTEKHNKDLASILKKLTTKYDNLFNTSFPYSMGIHQAPLDGTDEEKNNSWFHMHFYPPLLRSATVKKFCVGFEMLGESQRDLTSEQAASRLQDLDGDKHYLSKIN

SEQ ID NO: 85433 - DNA, 1059 bp, Yarrowia lipolytica CLIB99
  CDS (1)..(1059)
atgactcttgtggcatccgacattcctcacagacgatacaacccgctgcgacaatcatgggtgctggtgtcacctcatcgagctaagcgaccttggcagggacagcaagaagagcccaccaaggacacgaagcccgagtacgacgacaagtgctatctgtgtcctcgaaatgctcgaatcaacggggagatgaacccggactacaaggacactttcgtgtttgagaacgacttcagtgctgtttttgagaaaactgcggaagtggagaaggtcgttgaggaggcccaaaaggagcacacagagtctactgctctcgacctggaccttctgcgaaaagaagatgtgttcggatactgtcaggttatttgcttttcgcccaaacacaatgtgactcttgctacaatgactgttgagcagatcgaaaaggtgattgagacctggcagaaaatgtacacagaggctcagagtcgaggaatcaagtactcgctgatttttgaaaacaagggagctaccatgggctgctccaaccctcatgcccatggccaggtctggaacaccagtattgttcctgaagagccccagatggagtttgattcattgaagaaatacaaggacgaaaagaaccgtgatcttctggtcgattacgtcaacttggaaatgtccaaaaacgaacgaatcgtctaccagaatgcctcgtttctcgtggtggttccttactgggccgtctggccttttgagaccatgattgtgtccaaggaacgggtttcttccatcaaaaagctgaccaaggaacaagtccagcatcttgccgacgccatctcggtgatcacaaaaaagtacgacaagctcttcaacacctctttcccctactcaatgggtattcatcaatcatttgtggacgttgagaactgtccctacgagcatcttcggctcctgttctaccctcctcttctgcgatctgcctccgtcaagaagttccaggtcggattcgagatgctgggaatgccgcagcgagacattactgccgaaggggctgccaagcggttgtatgatttgtaa

SEQ ID NO: 85434 - protein, 352 aa, Yarrowia lipolytica CLIB99
MTLVASDIPHRRYNPLRQSWVLVSPHRAKRPWQGQQEEPTKDTKPEYDDKCYLCPRNARINGEMNPDYKDTFVFENDFSAVFEKTAEVEKVVEEAQKEHTESTALDLDLLRKEDVFGYCQVICFSPKHNVTLATMTVEQIEKVIETWQKMYTEAQSRGIKYSLIFENKGATMGCSNPHAHGQVWNTSIVPEEPQMEFDSLKKYKDEKNRDLLVDYVNLEMSKNERIVYQNASFLVVVPYWAVWPFETMIVSKERVSSIKKLTKEQVQHLADAISVITKKYDKLFNTSFPYSMGIHQSFVDVENCPYEHLRLLFYPPLLRSASVKKFQVGFEMLGMPQRDITAEGAAKRLYDL

SEQ ID NO: 85435 - DNA, 1155 bp, Cryptococcus neoformans var. neoformans JEC21
  CDS (1)..(1155)
atgtcggctgcacatttagaggttccgtatttcgagccgactgaacacccccataggcgatataatcctctgataggcaagcatgtactggtgtcccctcataggaccaaacgcccatggaaggggcagacggaggagccggtcctgaccactcttccagaatatgaggcaacttgtaatctttgtccgggtaacgaaagaagtaatggcaacaagaacccaaagtatatagacacttttactttcgaaaacgacttccccgctctccttcctggtcctctaccaacccttcagcaaccttccaaagtcaattcatcagattcgcttttcgcatctgaaccgatcaggggacgatgtaaagtcatctgcttccaccccaagcatgatcttacaattgctaggatgaacgtagacgacgtggttagggtgatcggggagtggaagaacgtctacgtggaggaaggacggatgctacaggaaagcagtggtcaaggatacgtgcaaatatttgagaatcggggggctatgatgggggccagcgcacctcaccctcatggacaagtttggtcattgtcctatgtacctgatgaaccccaaacggagctgaacaacctggctgcctcaactttggtatcttcgggtaacactccagtgcggggcgacggatgtccgtgtttgctatgcacttacgcagcagaagaagtgaggcgaaaggaacgggtggttgagattgacgtggagagcggatgggtcgcagtagtccctttttgggctgtgtggccttttgaaacccttttgcttccttacaagagacacattccttcccttattcagctaaacgataatgaaataatcggactggctcgtatacttcagaggcttttggtaaggtatgacaatcttttctcatgcccattcccttattccatggggctgcatcaatctcctcttccaccttcaaaccctgacggcgatgtggctcacatccacttccacttctatccgcctcttttaaggagcgccagcgtacgcaagtttttggttggctttgaaatgatggctgaagtacaaagggatttaactcctgaacaagctgcatcaagattaagagctttgccagggacccattatttggatcagaaaatagcagtttag

SEQ ID NO: 85436 - protein, 384 aa, Cryptococcus neoformans var. neoformans JEC21
MSAAHLEVPYFEPTEHPHRRYNPLIGKHVLVSPHRTKRPWKGQTEEPVLTTLPEYEATCNLCPGNERSNGNKNPKYIDTFTFENDFPALLPGPLPTLQQPSKVNSSDSLFASEPIRGRCKVICFHPKHDLTIARMNVDDVVRVIGEWKNVYVEEGRMLQESSGQGYVQIFENRGAMMGASAPHPHGQVWSLSYVPDEPQTELNNLAASTLVSSGNTPVRGDGCPCLLCTYAAEEVRRKERVVEIDVESGWVAVVPFWAVWPFETLLLPYKRHIPSLIQLNDNEIIGLARILQRLLVRYDNLFSCPFPYSMGLHQSPLPPSNPDGDVAHIHFHFYPPLLRSASVRKFLVGFEMMAEVQRDLTPEQAASRLRALPGTHYLDQKIAV

SEQ ID NO: 85437 - DNA, 1050 bp, Thermus thermophilus HB27
  CDS (1)..(1050): transl_table=11
atgccccccttctataagcgcctccaccggaagaaggacggccgggagctcttcctctacggcctaatgcccctcgagggcccccctctccccgaagacgccgagcccttccgccccgccccccacctccgctaccaccccttgcggggggagtgggtggtctacgccgcccaccgccaggggcgcaccttcctcccccccaaggagcactgccccttgtgcccgagccgggaagggggcttccccacggagatccccttcccctcctttcaggtggccgtctttgaaaaccgcttcccctccttcgtggaggaagcccctccccctcccgaggggcttcccgtgcccgcggggaaggccttggggcggtgcgaggtggtggtctacacccccgcccacacgggaagcctcgccaccctcacggaggaggaaaggctccttttggcctgggcgtggcgggaccggtacgaggccctctacgcccttcccggggtgcgcttcgtcatgccctttgagaaccggggggaggcggtgggggtcaccctccaccacccccacggccagatctacgcctaccccttcgtgccccccgtcctggagcgggaaagccaggccttccgggaaaggcccgtgctccttgagcttttcccgaaccttgggccctacgtggtggacgaggaggagggcttcctcgccttcgtcccccccttcgcccggtacccctttgaggtctgggtggcccccgtggaaaggcaccccggtccctggaccttctccgagggggagatggcggccttcgccaggctcttgggccgggtggtggcccggtacgacgccctctttggggagcccttcccttacgtcatggtcttccacgccgcgcccttgggggaggaggccacctttcacttccacgtggagttctaccccccgaggcgcacccgggacaagctcaaattcctggcggggacggagctcggggcggggacgttcgtggtggacgccctgcccgaggagaccgcgaaggcccttagggcggcgttgccgtga

SEQ ID NO: 85438 - protein, 349 aa, Thermus thermophilus HB27
MPPFYKRLHRKKDGRELFLYGLMPLEGPPLPEDAEPFRPAPHLRYHPLRGEWVVYAAHRQGRTFLPPKEHCPLCPSREGGFPTEIPFPSFQVAVFENRFPSFVEEAPPPPEGLPVPAGKALGRCEVVVYTPAHTGSLATLTEEERLLLAWAWRDRYEALYALPGVRFVMPFENRGEAVGVTLHHPHGQIYAYPFVPPVLERESQAFRERPVLLELFPNLGPYVVDEEEGFLAFVPPFARYPFEVWVAPVERHPGPWTFSEGEMAAFARLLGRVVARYDALFGEPFPYVMVFHAAPLGEEATFHFHVEFYPPRRTRDKLKFLAGTELGAGTFVVDALPEETAKALRAALP

SEQ ID NO: 85439 - DNA, 1041 bp, Erwinia carotovora subsp. atroseptica SCRI1043
  CDS (1)..(1041)
atgcagtttgagccaactgaacatccgcatcgccgttttaacccgctgaaaggcgagtggattctggtttctccacatcgggccaagcgcccctggcaaggccagcaggatgaacccgatcgtgccacaccaccgccttacgatccgacttgttatctatgcgcgggcaacaaacgtattactggcgatatcaacccgcagtatcagagtacgtttgtttttacgaatgatttttcggcactgatggaagacacgccggatgccccgtcgggtgatgatgaactgttccgcgtgcagcaagcccgtggtgtcagtcgtgtgatctgtttttctcccgatcacagtaaaagcctgccacagctttcgctgtcagcgctgaaagctgtgatcgatacatggagcgagcaaaccgcggagctgggcaagcgctatccatgggtgcaggtatttgagaataaagggacgatgatggggtgttctaatccccatccacacgggcaagtttgggcaaatgattttctgccgaacgaagtgctgcgtgaagatgaacagcagcgggactattttactcgccatggctcgccgttattgctggactacgtgcagcgagagcaggctgacggtgcgcgcatcgtagtggaaaccgagcactggttagcggttgttccttactgggcctcgtggccgtttgaaacgctggtactgcccaaattcgcggtgcagcgattaccacagctaaatgacgttcagcgtgacgatctggctctgattctgaaaaagctgaccagccgttacgacaacctgttccagtgttcattcccttattcgatgggatggcatggtgcaccgtttaaggacggggacatcgcgcactggcagttgcatgcccatttttatcccccgttattacgttccgccagcgtgcgcaaatttatggtcggctatgaaatgttggccgaagcacagcgtgacctgacggcagagcaagccgctgaacgcttacgcagcgtgagtgatatccatttccgtgagcaaatttga

SEQ ID NO: 85440 - protein, 346 aa, Erwinia carotovora subsp. atroseptica SCRI1043
MQFEPTEHPHRRFNPLKGEWILVSPHRAKRPWQGQQDEPDRATPPPYDPTCYLCAGNKRITGDINPQYQSTFVFTNDFSALMEDTPDAPSGDDELFRVQQARGVSRVICFSPDHSKSLPQLSLSALKAVIDTWSEQTAELGKRYPWVQVFENKGTMMGCSNPHPHGQVWANDFLPNEVLREDEQQRDYFTRHGSPLLLDYVQREQADGARIVVETEHWLAVVPYWASWPFETLVLPKFAVQRLPQLNDVQRDDLALILKKLTSRYDNLFQCSFPYSMGWHGAPFKDGDIAHWQLHAHFYPPLLRSASVRKFMVGYEMLAEAQRDLTAEQAAERLRSVSDIHFREQI

SEQ ID NO: 85441 - DNA, 1086 bp, Nocardia farcinica IFM 10152
  CDS (1)..(1086): transl_table=11
atgcacaggacccggcgcagcctggccgacggccgggagatctactactacgacgccgagccggtcccgcggaccgccgtggacagccgcgagctgcccacgacgtcgacccattcccaggcgcgattcgatccgttgctgggcgaatgggtcgtgatcgcctcacaccgccagacccggaccttcctgccgcccgccgatctgtgcccgctgtgcccctccacgccggaccgggcaaccgagatccccgaggcggactaccaggtggcggtgttcgagaaccgcttcccctcgctgtccaccgaccgcatcgagctgccggagacggtcaccggggcgccgctgtcggccctgcgcaacggattcggccgctgcgaggtggtctgtttcaccagcgatcacgacgcgtcgttcgccgatctggatccggcccgggcgcgcctggtggtcgacgtgtgggccgaccggaccgcggagctggccgcgatggagggcatcgagcaggtgttctgtttcgagaaccacggcgccgagatcggcgtgacgctgacccatccgcacggccagatctacgcctacccgttcgtcaccccccgggcggcgaagatcgccggtaacgtccggcgttaccgggaagcccacgcgcgcaatctcttcggcgacatcctcgacgccgagcggcgcgcggagctgcgtgtcgtgggcgccaacgacgagtggacggcgttcgtgccgccgttcgcgcgctggccctacgaggtgcagctctacccgcaccggcaggtcgccgacctgcccgacctcgacgacgcccagcgcgacggcttcgccgccctctacctcgacgtcctcggccgcttcgcccgccggttcgacgcgccgatgccctatgtcgccgcctggaaccaggcgccgagcgcggatgccggtgtgccgcgcgaggattggtggctgcacctgcaactgttctcgatccggcgggccccgggcaagctgaagtatctggccgggtcggagtcgggcatgcacgtgttcgtcaacgacaccacccccgagaccgtcgccgccgaactccgcgacgtctga

SEQ ID NO: 85442 - protein, 361 aa, Nocardia farcinica IFM 10152
MHRTRRSLADGREIYYYDAEPVPRTAVDSRELPTTSTHSQARFDPLLGEWVVIASHRQTRTFLPPADLCPLCPSTPDRATEIPEADYQVAVFENRFPSLSTDRIELPETVTGAPLSALRNGFGRCEVVCFTSDHDASFADLDPARARLVVDVWADRTAELAAMEGIEQVFCFENHGAEIGVTLTHPHGQIYAYPFVTPRAAKIAGNVRRYREAHARNLFGDILDAERRAELRVVGANDEWTAFVPPFARWPYEVQLYPHRQVADLPDLDDAQRDGFAALYLDVLGRFARRFDAPMPYVAAWNQAPSADAGVPREDWWLHLQLFSIRRAPGKLKYLAGSESGMHVFVNDTTPETVAAELRDV

SEQ ID NO: 85443 - DNA, 1098 bp, Photobacterium profundum SS9
  CDS (1)..(1098): transl_table=11
ttgattatgtcgaatatggattcgagcacaaatttgaacagcgatgcttttgacgcaaccgatcatccgcaccgtcgttataaccctttaacgggtcaatgggttttggtttcgccacaccgtgcaaaacgtccttggcagggggctgatgaaacaccagaacaagctgtagatacacaatatgatagcggatgttttttatgtccaaccaatacacgcgtgtctggtgataaaaatccagattatactggcacttatgtatttaataatgatcacgctgcgttaacggttgatacacctgacgcgccgcaatctgataatccattatttcgtagcgagagtgctcgagggcttagccgcgtagtgtgtttctctcccgatcatagcaagacattaccagaattgtctgtacccgctattcgcagtgttgttgatacatggaacgaacagattgaagagctggggcaggattatgtttgggttcaagcttttgaaaataaaggttcagcgatggggtgctctcagcctcatccgcatggacaaatttgggcgaacagttttttaccgaatgaaattgcccgtaaagacgacaatttaagagcgtactatcaagaaaacggcactaacttactggttgattacgttaacagtgaaatgaaagacggctctcgcactgtcgttgaaactgaatattggattgctgttgtaccttattgggctgcatggccatttgaaacaatgttaatgcccaaaacacatgtacgccgtatgactgatttaacggatgaacagcgtgatgatcttgcgttagccatgaaaaaactgactagccgttacgacaatctgtttaagtgctcgttcccgtattcgatgggttggcattacgcacccttctttaaagaagatcaagatgacgacacaaacatcgagcattggcagctgcacgcattgttttatccacctcttttacgctctgcgaccgtgcgtaaatttatggtggggtatgaaatgctagctgaaagccaacgtgatttaaccgcagagcaagcagctgacaaattacgtgcactgagcgatattcattttcgcgaacaatag

SEQ ID NO: 85444 - protein, 365 aa, Photobacterium profundum SS9
MIMSNMDSSTNLNSDAFDATDHPHRRYNPLTGQWVLVSPHRAKRPWQGADETPEQAVDTQYDSGCFLCPTNTRVSGDKNPDYTGTYVFNNDHAALTVDTPDAPQSDNPLFRSESARGLSRVVCFSPDHSKTLPELSVPAIRSVVDTWNEQIEELGQDYVWVQAFENKGSAMGCSQPHPHGQIWANSFLPNEIARKDDNLRAYYQENGTNLLVDYVNSEMKDGSRTVVETEYWIAVVPYWAAWPFETMLMPKTHVRRMTDLTDEQRDDLALAMKKLTSRYDNLFKCSFPYSMGWHYAPFFKEDQDDDTNIEHWQLHALFYPPLLRSATVRKFMVGYEMLAESQRDLTAEQAADKLRALSDIHFREQ

SEQ ID NO: 85445 - DNA, 1026 bp, Francisella tularensis subsp. tularensis Schu 4
  CDS (1)..(1026): transl_table=11
atgaatatttcagctacaatatcacagctcaaatcctcgcatcgtcgtaagaatatcttaactaatgaatgggttttagtatctccccataggcttaatagaccatggcaaggtcaatcagaagaaactcaaaaaaatactctgccagaatatgatgataaatgctatctgtgtccaactaatattcgagctaatggagaagttaatcctgatttcaaagaaacttttgtatttgaaaacgatttttctgctttatctaaagaaaaaatagacaaaaaacttgagataaatgatgatctatttcaactaagtggtgctactggtattgctaaagttatatgcttctctgcaaaacacaatctaacaatggcatcaatgcaacaaaaagatatagttaaagttgttgatctatgggcatctgaagttacagaattaagtaaaaaatatcaatgggtacaggtttttgaaaataaaggctcaattatgggctgctctaactctcatccacatggacaaatctgggcttgtgatttcttaccaacagaagctcaaaaagaatataagtcgcaacaacaatattttgagaaaaacaaatctagtatgctgatcgattatgcgaatagagaaataaaggaagaagaccgaatcgtttaccaaaatgatgattggttaattgttgtaccgttttgggcaacatggccttatgaaactctattactaccaaaatttaaatgctctcatctaaatcatttaagtaattcacaaagaaaaactttagcaaatgctctaaaaatactattagtaaaatatgataaactatttgatacttctttcccgtattcaatgggttggcacggctcgataaatgctacagagtctgattattggcagcttcatgcacatttttatccgccattattacgttcagcaacagtcaaaaagtttatggttggatttgaaatgcttggagaatcgcaaagagatattactccagaattagcggcacaagttttaagagatttataa

SEQ ID NO: 85446 - protein, 341 aa, Francisella tularensis subsp. tularensis Schu 4
MNISATISQLKSSHRRKNILTNEWVLVSPHRLNRPWQGQSEETQKNTLPEYDDKCYLCPTNIRANGEVNPDFKETFVFENDFSALSKEKIDKKLEINDDLFQLSGATGIAKVICFSAKHNLTMASMQQKDIVKVVDLWASEVTELSKKYQWVQVFENKGSIMGCSNSHPHGQIWACDFLPTEAQKEYKSQQQYFEKNKSSMLIDYANREIKEEDRIVYQNDDWLIVVPFWATWPYETLLLPKFKCSHLNHLSNSQRKTLANALKILLVKYDKLFDTSFPYSMGWHGSINATESDYWQLHAHFYPPLLRSATVKKFMVGFEMLGESQRDITPELAAQVLRDL

SEQ ID NO: 85447 - DNA, 981 bp, Thermococcus kodakaraensis KOD1
  CDS (1)..(981): transl_table=11
atgagggaactgaggttcaatcccctaaccgggcagtggataatggtctcagcggagaggaaaaagcgcccctggcgacccaagaacttctgccccttctgtcctggcactgaggagaccggctacggctgggaagttctcctccttccaaatcgcttcccgatgctctccttcgaggcccctaagccggagaaagttgagttctacaaaaaggcgagggccattggccagtgcagcgtaatagtcgagacgccggagcacgggctgaaagacctcgacgagctttccagggaggggatggtaaaggtcgtggagctgtggaaggaagcaaccagaaccctcagagaaaacaggcacatagcctacgtcgccatattcagaaacaagggcgaggagattggagtgagcctccaccacccccacggccagctctacgcactccccttcattccgctcaaggtgaggcttaagatcgagaactcccggaggcactttaagaaacacggcgagtgcctcttctgcaggatccttgaggaggagcggaaaggaggaagggtgatctacgagaacgatagcttcgcggtcttcctcccattcttcgcgagctggccgttcgaactccacgtctatccgaagaggcacgtccagtacctgacccagctcgacgggaaggagagcgaggacctggcagatgcagtaagggcaaccaccgcaacgctcaatgcccttttcgacagggggatgccctacacgatgatgatattccaggcgccgttcaaggggaggtatccattctaccacctccacatcgagttctacccgatccttagggacgcaaacaaggtgaagttcgcggccggaatagagatgggcacctgggagttcacgtacgattcagttccagaggagaacgccgagaggctgaaggaagcctgcggaaagataaaggaagaaaaggggctaattggcaggtgcctttga

SEQ ID NO: 85448 - protein, 326 aa, Thermococcus kodakaraensis KOD1
MRELRFNPLTGQWIMVSAERKKRPWRPKNFCPFCPGTEETGYGWEVLLLPNRFPMLSFEAPKPEKVEFYKKARAIGQCSVIVETPEHGLKDLDELSREGMVKVVELWKEATRTLRENRHIAYVAIFRNKGEEIGVSLHHPHGQLYALPFIPLKVRLKIENSRRHFKKHGECLFCRILEEERKGGRVIYENDSFAVFLPFFASWPFELHVYPKRHVQYLTQLDGKESEDLADAVRATTATLNALFDRGMPYTMMIFQAPFKGRYPFYHLHIEFYPILRDANKVKFAAGIEMGTWEFTYDSVPEENAERLKEACGKIKEEKGLIGRCL

SEQ ID NO: 85449 - DNA, 1101 bp, Nostoc punctiforme PCC 73102
  CDS (1)..(1101)
atgtactcccacaagctgttaaagcccgacggacgcaaactaaagttatacagtcgctacccaattactagtcagttagaagccactagccctagtaatgagccagtgcaagctaatccccacttgcgctggcaccccttgcggggtgaatgggtagcttatgcgagtcaccgtcaagggcggacattcatgccgcccccagaatataatcccctcgcacctaccaccaaccctgagttcccaacagaactaccccaaggtaagtatgacgtggcagtgtttgataaccgctttccctcaatgactcccacagccaacaatccacctgataccatcgtggaaacgttaccagctaatggagcctgtgaggtagtggtttttacgcaagatgcccgcgcctccttgagttccttagagttggatcatctagatttgttgttggaagtctggggcgatcgcacccgcgaactaggactaaatccgcaaattcagtatgtgctgccctttgaaaataaaggggtagaggtgggtgtaacattgcaccatccccacgggcaaatttacgcctatccttttataccgcctgttccggcgcggatgctgtcaatgcagcaggagtattatgaaaaacatcggcggggtttactgcaagacttgattcagaaggaaattgcagacaatcgacggattatttatcaagatgagtatgcgatcgcatttgtccccgtatgcgctcgttacccctatgaagtctggattgcaccgaaagagccagttagcactttcatggatcttaccccagaacaacgttggggacttgccaaagcgttaaaaactgtcactctcaagtatgacggtttgtggaatcgcccgtttccttacttgatggcttggttccaagcacccacggatggtttagcccatccagaagcgcatttacacgccgagttttttccaccatatcggacaagcgaaaggctgaagtatctggcgggaaccgaacttgcagccgggatgtttgccaatgatgctttaccagaagaaaaagcaaaggaactacaagctgtggtggtaaatattgaagaaccgatttcggtgtga

SEQ ID NO: 85450 - protein, 366 aa, Nostoc punctiforme PCC 73102
MYSHKLLKPDGRKLKLYSRYPITSQLEATSPSNEPVQANPHLRWHPLRGEWVAYASHRQGRTFMPPPEYNPLAPTTNPEFPTELPQGKYDVAVFDNRFPSMTPTANNPPDTIVETLPANGACEVVVFTQDARASLSSLELDHLDLLLEVWGDRTRELGLNPQIQYVLPFENKGVEVGVTLHHPHGQIYAYPFIPPVPARMLSMQQEYYEKHRRGLLQDLIQKEIADNRRIIYQDEYAIAFVPVCARYPYEVWIAPKEPVSTFMDLTPEQRWGLAKALKTVTLKYDGLWNRPFPYLMAWFQAPTDGLAHPEAHLHAEFFPPYRTSERLKYLAGTELAAGMFANDALPEEKAKELQAVVVNIEEPISV

SEQ ID NO: 85451 - DNA, 1077 bp, Desulfovibrio desulfuricans G20
  CDS (1)..(1077)
atgggcctgcaaccgtacaaggacattccgcacacacggcgcaacgcgctgacaggcgaatgggtgctggtgtcgccccacagggcaatgcgcccctggcaggggcagcaggacgcacccgacaccaccgtcatgcccgcctatgacccgcagtgttatctgtgtccgggcaacctgcgcacaggcggtgcccgcaacccgcactacagcggcgtattcgtcttcgacaacgactttcaggcactgaaaacgcccggcagccgcaccgcgcaaagccccccccgcaaaaacgacgacctgtttgccgccagacccgagacaggcatctgccgtgtcgtatgttactctccccgccacgacctgaccatggcccgcatgcagcccgcacaggcagaggccgtcatcaccgcgtggcagcaggagtatgccgcactgtgctcacgacaggatatcgggtatgtccagatttttgaaaacagaggcgccatgatgggctgctccaacccgcatccccacgggcagatatgggccagcagctccgtgccgcacatcgccgcgcaggaagacaccatgcagcgccgccacctgcagcaacacggcggctgcctgctctgcagatacaccgctctggaagaagaatacaaagagcgtgtggtcttcagcaatgactcgttctgcgcggtggtaccctactgggcggtgtggccctttgaaaccatgcttctgccgcgcaggcatgccgccgacatcacagacatgaccccggcggaaaaaaccgatctcgcgcatgcgctcatacggctgaccaccagatacgacaacctgttccgcacgccttttccctattccatgggcatacaccagcagccctgcaagggcgcttctccgcaggcatggcattaccattttcacttctatccgccgctgctgcgttccgcatcggtacgcaaattcatggtgggctatgaaatgctgggcagcccgcagcgcgacctgactgcagagagcgcggcggacaagctgcgcgccctttccgacgtgcattacacggacctgcggcaggggtctgcaacatga

SEQ ID NO: 85452 - protein, 358 aa, Desulfovibrio desulfuricans G20
MGLQPYKDIPHTRRNALTGEWVLVSPHRAMRPWQGQQDAPDTTVMPAYDPQCYLCPGNLRTGGARNPHYSGVFVFDNDFQALKTPGSRTAQSPPRKNDDLFAARPETGICRVVCYSPRHDLTMARMQPAQAEAVITAWQQEYAALCSRQDIGYVQIFENRGAMMGCSNPHPHGQIWASSSVPHIAAQEDTMQRRHLQQHGGCLLCRYTALEEEYKERVVFSNDSFCAVVPYWAVWPFETMLLPRRHAADITDMTPAEKTDLAHALIRLTTRYDNLFRTPFPYSMGIHQQPCKGASPQAWHYHFHFYPPLLRSASVRKFMVGYEMLGSPQRDLTAESAADKLRALSDVHYTDLRQGSAT

SEQ ID NO: 85453 - DNA, 888 bp, Desulfovibrio desulfuricans G20
  CDS (1)..(888)
atgggcctgcaaccgtacaaggacattccgcacacacggcgcaacgcgctgacaggcgaatgggtgctggtgtcgccccacagggcaatgcgcccctggcaggggcagcaggacgcacccgacaccaccgtcatgcccgcctatgacccgcagtgttatctgtgtccgggcaacctgcgcacaggcggtgcccgcaacccgcactacagcggcgtattcgtcttcgacaacgactttcaggcactgaaaacgcccggcagccgcaccgcgcaaagccccccccgcaaaaacgacgacctgtttgccgccagacccgagacaggcatctgccgtgtcgtatgttactctccccgccacgacctgaccatggcccgcatgcagcccgcacaggcagaggccgtcatcaccgcgtggcagcaggagtatgccgcactgtgctcacgacaggatatcgggtatgtccagatttttgaaaacagaggcgccatgatgggctgctccaacccgcatccccacgggcagatatgggccagcagctccgtgccgcacatcgccgcgcaggaagacaccatgcagcgccgccacctgcagcaacacggcggctgcctgctctgcagatacaccgctctggaagaagaatacaaagagcgtgtggtcttcagcaatgactcgttctgcgcggtggtaccctactgggcggtgtggccctttgaaaccatgcttctgccgcgcaggcatgccgccgacatcacagacatgaccccggcggaaaaaaccgatctcgcgcatgcgctcatacggctgaccaccagatacgacaacctgttccgcacgccttttccctattccatgggcatacaccagcagccctgcaagggcgcttcttag

SEQ ID NO: 85454 - protein, 295 aa, Desulfovibrio desulfuricans G20
MGLQPYKDIPHTRRNALTGEWVLVSPHRAMRPWQGQQDAPDTTVMPAYDPQCYLCPGNLRTGGARNPHYSGVFVFDNDFQALKTPGSRTAQSPPRKNDDLFAARPETGICRVVCYSPRHDLTMARMQPAQAEAVITAWQQEYAALCSRQDIGYVQIFENRGAMMGCSNPHPHGQIWASSSVPHIAAQEDTMQRRHLQQHGGCLLCRYTALEEEYKERVVFSNDSFCAVVPYWAVWPFETMLLPRRHAADITDMTPAEKTDLAHALIRLTTRYDNLFRTPFPYSMGIHQQPCKGAS

SEQ ID NO: 85455 - DNA, 1050 bp, Actinobacillus pleuropneumoniae serovar 1 str. 4074
  CDS (1)..(1050)
atgagccaacaatttatcctaaacgatcaccctcatcgtcgttttaatccgttaaaaaatcaatggattttagtttctccgcatcgtgcgaaacgtccgtggcaaggtcagcaggaagaaacggttgcggataataaaccgagctatgatccgacttgttatctctgtccgggaaataaacgcattaccggcgaacaaaatcccgtttatagcaaacctttcgtctttaaaaacgatttctccgcactactgccggatacaccggcgccggaagccggttccgatccgcttttccaaatttcacatactcaaggcgaaagccgtgtaatttgcttctcgcctgatcacagtaaaaccttaccgcaactttcggtggctgaaattgagcaagtggtacaagtctggcaagagcaagcgaatgagttaaaaacacgttatcagtgggtacaaatttttgaaaacaaaggctcgatgatgggctgctctaatccgcacccgcacggtcaaatttgggcaagcaatttcttaccgaacgaaattgcgattgaagacgaatgtcaggcaaattactttgctcaatacggtcgtccattgcttcttgattatgccgagcgtgaattaactaaaaaagaacgtatcgtcgtcgaaaccgaagactggattgcagtggtgccttactgggctggctggccgtttgaaactttactgttgccgaaacacaagcactttaaacgcattaccgatttaaacgaagcggaacgagcggatttagctctcgcacttaaaaagctaaccactcgctacgataacttatttaatatcagtttcccatattcgatgggcttccatttcgctccgtttaatgaaagtgataatccgcattggcaacttcacgcccatttctatccgccgttgttacgttcggcaaccgtgcgtaaatttatggtcggctacgagatgatggcggaaagtcagcgagatctgacaccggaacaagcggcggaaagattaaatgctgtgagcgacagcgttcactataaaaatcaatag

SEQ ID NO: 85456 - protein, 349 aa, Actinobacillus pleuropneumoniae serovar 1 str. 4074
MSQQFILNDHPHRRFNPLKNQWILVSPHRAKRPWQGQQEETVADNKPSYDPTCYLCPGNKRITGEQNPVYSKPFVFKNDFSALLPDTPAPEAGSDPLFQISHTQGESRVICFSPDHSKTLPQLSVAEIEQVVQVWQEQANELKTRYQWVQIFENKGSMMGCSNPHPHGQIWASNFLPNEIAIEDECQANYFAQYGRPLLLDYAERELTKKERIVVETEDWIAVVPYWAGWPFETLLLPKHKHFKRITDLNEAERADLALALKKLTTRYDNLFNISFPYSMGFHFAPFNESDNPHWQLHAHFYPPLLRSATVRKFMVGYEMMAESQRDLTPEQAAERLNAVSDSVHYKNQ

SEQ ID NO: 85457 - DNA, 990 bp, Methanococcoides burtonii DSM 6242
  CDS (1)..(990)
atgtcagagatacgcaagcactattttctggatgaatattgcataatagcaccaggaagaagtaaaagaccttcagtgttcaaagcagaaaagaaagaaaaggactccaataaatgtgttttttgtgcaggggaagaagataaaacacctcttgcaactgctgtttataaaaatggaagtattctgaaagattccgaaagttcaagagtaacaggatgggatgtgcggtgtatgccaaatctttatcctgcacttgctccggatgcaggtgaagtcaattcagatcatgaggtattcccaggttatggttttcatgaagttatagttgaaacacctacgcatgagaacatgctccctgatctttcagatgaagagatgtcattacttatgaaagtctatcgggatcgtgtaattcactacgaaacctttgataagatcgaatacgtttcattgtttaagaactggggagaaaaggctggtgcgtctttggaacatacccattcccagctaatagcgatgcccattaaacctccactattaatggaagagatgaagatcataggatcattttcaatatgtccttattgtgacatcgtggaaaaagaaagcaaaggtgagaggctcttatatgaaaatgagcattttatggttatagcaccttattgttcaaaggtcccatatgagttgtggatcctacctaaggaacatataaatcatatctcaggctttgatcaggaccatttggactcgctgggaatagcaatacgttctgctctctcatgtctccgggacaatatgggtgagataccttataattacatgttctatcagctaagagatgaacctgaatatcactttaacttgaaacttcaaccggttacaacgaagaccgcgggttttgagaaaaataccgaagtatacattaatacaatgcctccggaaactgcggtcaaatatcttcagggtaattttcaggacggtcctgaatga

SEQ ID NO: 85458 - protein, 329 aa, Methanococcoides burtonii DSM 6242
MSEIRKHYFLDEYCIIAPGRSKRPSVFKAEKKEKDSNKCVFCAGEEDKTPLATAVYKNGSILKDSESSRVTGWDVRCMPNLYPALAPDAGEVNSDHEVFPGYGFHEVIVETPTHENMLPDLSDEEMSLLMKVYRDRVIHYETFDKIEYVSLFKNWGEKAGASLEHTHSQLIAMPIKPPLLMEEMKIIGSFSICPYCDIVEKESKGERLLYENEHFMVIAPYCSKVPYELWILPKEHINHISGFDQDHLDSLGIAIRSALSCLRDNMGEIPYNYMFYQLRDEPEYHFNLKLQPVTTKTAGFEKNTEVYINTMPPETAVKYLQGNFQDGPE

SEQ ID NO: 85459 - DNA, 1251 bp, Bifidobacterium longum DJO10A
  CDS (1)..(1251)
atggctgatttcgccaactacacccccggggagtatgcgaaggagcacatccgcatcacgccgacgacgcttgccgacggtcgtgacttcttctacctggacgacgaccccgagttcgtctccggtgccaagacccgcgagctcaaggacccgcgcccgctggactaccgtttcgccccgcacctggacgccgacggcaacgaagtgccgtacgccgccccgcagatgcgccgcgacccgctgaccggcgactggattccgatggccaccgcccgtatgaaccgcccgatcaccgccggccccggcgctaccgccaagggcaacccgctggccgcccgcaagcccggtgacccgtaccaggacggcgaagtgccggacaccgactacaacgtcgtggtgttcgagaaccgcttcccctcgatggtgcgcgtgcccggcgtctccgaggacgtgacctacgttgacggcaacccgctgtgggagaagaagctcgccgccggccgctgcgaagtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggtcaggaaatcggcgtctccctcgctcacccgcacggccaggtctactgctacccgttcatcgccccgaagatggagaaggaactccagcacaccgaggcctaccacgagaagaccggtggcaacctcttgaaggacatcatgaacgccgagctcgaagccggcgaacgcatcgtgatgcgcaaccacagctgggtcgcctacgtgccggccgccgcccgttggcccctcgaggtccacgtggctccggtgcgcgacgtgctcaccctcgaccagctcaacgacgaagagcgctgggacctcgcctccatgtactcgcacctcctgaagcgcggcaacgccttcttcgacaagggcgacggcaagggcatggacctgccatacatcgccgcctggcaccaggccccgatccacgacgcccgccgcgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactga

SEQ ID NO: 85460 - protein, 416 aa, Bifidobacterium longum DJO10A
MADFANYTPGEYAKEHIRITPTTLADGRDFFYLDDDPEFVSGAKTRELKDPRPLDYRFAPHLDADGNEVPYAAPQMRRDPLTGDWIPMATARMNRPITAGPGATAKGNPLAARKPGDPYQDGEVPDTDYNVVVFENRFPSMVRVPGVSEDVTYVDGNPLWEKKLAAGRCEVICFDPNEDGLPADLPVSRLRTVVEAWAFRTAEISKMEGIEQIFPFENHGQEIGVSLAHPHGQVYCYPFIAPKMEKELQHTEAYHEKTGGNLLKDIMNAELEAGERIVMRNHSWVAYVPAAARWPLEVHVAPVRDVLTLDQLNDEERWDLASMYSHLLKRGNAFFDKGDGKGMDLPYIAAWHQAPIHDARRENYRLNLQFFSFRRAANKIKYLAGSESGMAAWISDTTPELIAKRFHELGSIDIAD

SEQ ID NO: 85461 - DNA, 1005 bp, Methanosarcina barkeri str. fusaro
  CDS (1)..(1005)
atgtcagaaatcagaaagcattactttctttccgagtactgtataattgccgaagaaagagctaaaaggccttcggattttgcagtcgcagacgaaggcagcgggaaacacagctctaaaaactgctttttctgtggaggagccgaggaaaatactcctcttgccactgctgtttataaaaaggggaaaatctattccgatacccctgaaaaaagagtacgtaactgggatttccgctgctttccgaacctttatcctgctctttcacctgtgcctgactccccaggccagaaggaaaaagggctgcaagctgaacccgggtatggttttcacgaagttatcgtagagacacctttgcatgggagaaggcttgaagatttttctaattctgaaatttcagcactcatgcaggtctatagagaccgtacatgcagttatgcaacccgtgaaaatatacgctacgtttccctgtttaaaaattccggggaaaaagcaggggcttcgattaatcactctcacagccagcttcttgccctgcctttttgtccttctcctctgtcaagggaattaaaggttatcaggaatatcgaggaatgcccttactgtgccatttatgacctggaaaaggcttctccacgtttaatatctaaaaacagcgaatggatagcctttactccttattcctcaatgggaccatttgaagtgtggttcctcccccaaaagcatgtcagttttcttggtgattgtagtgacaaacttctttttgctctgggggatattctgaaagccattctcaaaagttatggacgaattcttggaaatccaccctttaattatatgttttaccagctttccgaatctcctgaatatcacctgaaccttcgtttgctccccaggatttctattcatgcgggttttgaactcggtacaggaacttatattaatacggttcctccggaaagagcagcctcttatttgaaggaaggccttacgcatggagaatga

SEQ ID NO: 85462 - protein, 334 aa, Methanosarcina barkeri str. fusaro
MSEIRKHYFLSEYCIIAEERAKRPSDFAVADEGSGKHSSKNCFFCGGAEENTPLATAVYKKGKIYSDTPEKRVRNWDFRCFPNLYPALSPVPDSPGQKEKGLQAEPGYGFHEVIVETPLHGRRLEDFSNSEISALMQVYRDRTCSYATRENIRYVSLFKNSGEKAGASINHSHSQLLALPFCPSPLSRELKVIRNIEECPYCAIYDLEKASPRLISKNSEWIAFTPYSSMGPFEVWFLPQKHVSFLGDCSDKLLFALGDILKAILKSYGRILGNPPFNYMFYQLSESPEYHLNLRLLPRISIHAGFELGTGTYINTVPPERAASYLKEGLTHGE

SEQ ID NO: 85463 - DNA, 1026 bp, Geobacter metallireducens GS-15
  CDS (1)..(1026)
atgtccgaactgagatgggaccccctcaagcagcactgggtgattatcgccaccgaccgggggcgccggccgcgggatttcctcgtggagcccgagcccacggagatgaccagctgtcccttctgctacggcaacgaggacaagacccccggcgaggtgtacgtggttcgtcctgtcggcggagcgaatgccaccgggtggaaggtgcgggtgatcccgaaccgctttccggtgctccggatcgaaggggaactcaacagccgcgcctacggcatctatgatgtcatgaacggcatcggcgcccacgagatcatcatcgagacaccggaccacaaccgggggctggcagagctctcccccgcagagatcaccgaggttctcaaggcgtaccgcgcccgtttcctggacctgcgccgggacacgcggttccgctacatggtccttttcaagaaccacggccggcgggccggggccaccctttcccactcccacagccagctcatcgcggtccccctcattcccccggctgcggccaccgagctgcgcgtctgccgggagcactatgccaacaaggagcgctgcctcttctgcgacctgctcgatttcgagctccagagcggcgaccggattgttcgggaattcggcaactacgtgatcatgacaccctacgcctcctgttttcccttcgagctgcggctctacccgaagcgccattcccacgatttcgccctgtccaccgacggcgaactggccgaactggccgtggccctcaaggatatgctcggccggctcaagagcgtcctcaaggatcccccctacaacttcatcctccataccgcgcccccaccgcagccgcggctcggcaagccggaattctggagttccatcgaatacgactaccactggcacatcgagttggtgccacggcttacccccatcgccggcttcgagtgggggaccggcttctacatcaatccaacctcgccggaagacgcagccacattccttcggggggctgagctgtag

SEQ ID NO: 85464 - protein, 341 aa, Geobacter metallireducens GS-15
MSELRWDPLKQHWVIIATDRGRRPRDFLVEPEPTEMTSCPFCYGNEDKTPGEVYVVRPVGGANATGWKVRVIPNRFPVLRIEGELNSRAYGIYDVMNGIGAHEIIIETPDHNRGLAELSPAEITEVLKAYRARFLDLRRDTRFRYMVLFKNHGRRAGATLSHSHSQLIAVPLIPPAAATELRVCREHYANKERCLFCDLLDFELQSGDRIVREFGNYVIMTPYASCFPFELRLYPKRHSHDFALSTDGELAELAVALKDMLGRLKSVLKDPPYNFILHTAPPPQPRLGKPEFWSSIEYDYHWHIELVPRLTPIAGFEWGTGFYINPTSPEDAATFLRGAEL

SEQ ID NO: 85465 - DNA, 1026 bp, Novosphingobium aromaticivorans DSM 12444
  CDS (1)..(1026)
atgacccgtttttcaacagacgatcacccgcatcgtcgccagaacctgcttacgggaaagtgggtccttgtctcgccgcaccgcgccaagcggccgtggcagggcgagactggcgatcccgcgccaacgggaggaccgtctcacgatcccggctgctatctctgccccggaaacgcccggacaagcggtgagcgcaacccggactatcccggcgccttcgccttcgacaacgatttccccgccctcatgcccgacaatcccgcgcccgaaggcggcgatcctgtcttccgcgtggccgaagcgcgcgggaccgctcgggtcatctgctattctcccgatcactcgaagacgatgcccgacatggatgtcgcggccatccgcagtctggtcaattgctgggcacaggaaagcgagacgctcggtgcgcattttgccaatgtccagatcttcgagaacaagggcgcgatgatgggctgttccagcccgcacccgcatggccagatctgggccagcgacttcatcccgaccgaagtggcggacgaggaccgggaacaggcagcgtggcacgcctcgcgcgggcgcgtgctgcttgacgaagtcgccgaacgcgaactcgcctcgggcgaacgcgtggtcgaggcgaacgagcactggctcgcggtcgtgccctggtgggcgacatggcccttcgagatattgctggtcgcgcgcgacggcgttggccggatcgaggagctttcggatgcctcgcgtgatgccctcgcgtccatcctgcgtgctgtcacgcgccgctacgacgcgttgttcaacgccagttttccctattccatgggctggcaccagcgcccggcgggcagctccgatcccgctgcctggcggcttcatgcccatttcaacccgccgctgctgcgctcggccacggtgcgcaagttcatggtcggcttcgagatgttcggcgaaagccagcgcgacatcaccccggagaccgccgccgcgcgtctgcgcgcgctggagatcgacgcgtga

SEQ ID NO: 85466 - protein, 341 aa, Novosphingobium aromaticivorans DSM 12444
MTRFSTDDHPHRRQNLLTGKWVLVSPHRAKRPWQGETGDPAPTGGPSHDPGCYLCPGNARTSGERNPDYPGAFAFDNDFPALMPDNPAPEGGDPVFRVAEARGTARVICYSPDHSKTMPDMDVAAIRSLVNCWAQESETLGAHFANVQIFENKGAMMGCSSPHPHGQIWASDFIPTEVADEDREQAAWHASRGRVLLDEVAERELASGERVVEANEHWLAVVPWWATWPFEILLVARDGVGRIEELSDASRDALASILRAVTRRYDALFNASFPYSMGWHQRPAGSSDPAAWRLHAHFNPPLLRSATVRKFMVGFEMFGESQRDITPETAAARLRALEIDA

SEQ ID NO: 85467 - DNA, 1053 bp, Microbulbifer degradans 2-40
  CDS (1)..(1053)
atgagcagtaatttagcttttgacccaaacgatcatagccatagacgtaaaaacccgctaacaggcgagtgggtgctcgtatctccgcatagaagtaagcgcccctggcaaggccagcaagagccaccatcaacagatacgcccccctcccatgacccagactgctacctgtgcgctggcaataagcgcatcaccggtgaagttaaccctcaatatagctcaacctttgtgtttaccaatgactttgcagcagtacaaaaagaatcgcataaggcccccgagtcgaccaataaagggctttttgttacccaacctgtaagcggtaccgccagagttatatgcttttcaccagaccacagcagaagtctaccgcttctttctatagaggagctcaatgctgtcgtatcttgctggcaagagcagttaaccgaattgaaggaaagctgtagctgggtgcaaatttttgaaaacaagggggcggccatggggtgctccaacccccacccgcatgggcaaatctgggccacagatcaaatacctactaaagctgagaaagctgacaaaaaccttaaggcttatttcgatgagcatggctcaaacttacttctggactatgtagaagaagaactagccagcggagaacgcattgtcgacgccaacgaagactgggtcgcacttgtcccctactgggcatgctggccgttcgaaacactactgcttccaagaaaacacattaagcatttagatgtattaaccgagcagcaaaaagaaaacctatcaaaaattttaaaagcaacgcttagccgctatgacaatcttttcaactgcagcttcccctactccatgggatggcacggccaacctttcgacggaaaagataatacccactggcaggtgcacgcacacttttacccgcctttattacgcagcgcctcagttaagaaatttatggttggctacgaaatgctagcagaagcccaaagagatataacaccagaacaagccgcggcgcgcttgcgcgaatgctccaccacccactatttagcgaagtaa

SEQ ID NO: 85468 - protein, 350 aa, Microbulbifer degradans 2-40
MSSNLAFDPNDHSHRRKNPLTGEWVLVSPHRSKRPWQGQQEPPSTDTPPSHDPDCYLCAGNKRITGEVNPQYSSTFVFTNDFAAVQKESHKAPESTNKGLFVTQPVSGTARVICFSPDHSRSLPLLSIEELNAVVSCWQEQLTELKESCSWVQIFENKGAAMGCSNPHPHGQIWATDQIPTKAEKADKNLKAYFDEHGSNLLLDYVEEELASGERIVDANEDWVALVPYWACWPFETLLLPRKHIKHLDVLTEQQKENLSKILKATLSRYDNLFNCSFPYSMGWHGQPFDGKDNTHWQVHAHFYPPLLRSASVKKFMVGYEMLAEAQRDITPEQAAARLRECSTTHYLAK

SEQ ID NO: 85469 - DNA, 1017 bp, Moorella thermoacetica ATCC 39073
  CDS (1)..(1017)
atgcccgaattacgccaggacccggtgagccagcgctgggtaatcattgccaccgaaagggccaaaaggccttcggacttcaagcctccgcatcaagaaaagaatggcagcaccggctgtcctttctgccccggccatgaaagagaaaccccgccggaggtgctggccttccgggtcgccggcaccgcccccgacacccccggctggcgggtacgggttgtccccaataaattcgccgccctggcccccggcgacgatgtaaccatagaaaataggggtttataccggaccatgagcggcaccggtgcccacgaagtcataatcgagggtcccgatcacaacacctttttccccgatatggccccggatcatgccgtccaggtctttaaggcctggcgccagcgttatctgcaattgagccgggataagaaactacaatatatccagctctttaaaaaccatggccgcacggccggagcctccctggaacacccccacagccagttaatcgccactcccctggtaccagttaccgtcagccaggaaatggatagatttaagtcctactggcaggaacaagagagctgcctcctctgcgatgtcgtagaggccgaactggaagccggggccagggtcaccggcttcaatagtgagttcctggccttttgtccctttgcctcccggtttcccatggagacctggatcgtaccccgcaggcaccagacaggcttcggcgactgcgacgacgtgcagcttaagcaactgggcgccatcgtacaggaaaccctgggccggctgaaaaaggcggctggtgacccgccctttaacctggtcctccatacggcccccctacatcaggacgacgttatctatcactggcatttggaactattgccccggctggccatcgtcgccgggtttgagtggggaacaggtatctatatcaaccccaccccgccggaaattgcggcccagtctctcaatgaaattaaactggatcaggaggcactggcttaa

SEQ ID NO: 85470 - protein, 338 aa, Moorella thermoacetica ATCC 39073
MPELRQDPVSQRWVIIATERAKRPSDFKPPHQEKNGSTGCPFCPGHERETPPEVLAFRVAGTAPDTPGWRVRVVPNKFAALAPGDDVTIENRGLYRTMSGTGAHEVIIEGPDHNTFFPDMAPDHAVQVFKAWRQRYLQLSRDKKLQYIQLFKNHGRTAGASLEHPHSQLIATPLVPVTVSQEMDRFKSYWQEQESCLLCDVVEAELEAGARVTGFNSEFLAFCPFASRFPMETWIVPRRHQTGFGDCDDVQLKQLGAIVQETLGRLKKAAGDPPFNLVLHTAPLHQDDVIYHWHLELLPRLAIVAGFEWGTGIYINPTPPEIAAQSLNEIKLDQEALA

SEQ ID NO: 85471 - DNA, 1101 bp, Thiobacillus denitrificans ATCC 25259
  CDS (1)..(1101)
atgtcagatgcatcaaaacccgacagcaacgaagtccgcgagatccgcatcaaccccgtcgtgccgggcgaatcggtcctcgttgccacggcgcgcagcatgcggccgaaaaaggccgaagagctcgcgccgcgcgacacccgcaagcacgtcgagacctgcccgttctgccgcggcaacgagcacaagacgccacctgcgatcctgacctggcccgacaccggggactggcagatccgcatggtcgagaacctctaccccgtcctcggcgacgaccgcgcgcaggcgggattcacgtttggcctgcagcagacgatcgacggctacggccggcacgaggtcatcatcgatcactccgagcatggcatcgcggtccaggacatggccgagacgcatctcgccgcgctgttcggcgtctaccagacgcgcatgcgccagctcttcgactccgacgagcgcctgaaatacgtgctcgtgttcaagaatttcggcccggcggccggggcgtcgatcccgcatacgcacagccaggtcatcgcgatgcccgtggtccccgaaaacgtcgacgccgaggtcaggaacagcgccacccactacgccaagcaccaccactgcatcttctgcgcgctcatcgatgaggcgctgaccttcgaagcgacgatctacgaccgcaattccggtgcggtgcggcgcaagatcaacgtcggccagtacgtcgtcgagcgcggcgagaagttcatcgccatcaagccgttcgcgagccgctacgaatgggaggtgcacatcctgccgctcgcgcatcaggccgatttcctcgacgtccgcggcgaggacctcgccgacctcgcgcgcgtcatgaaacgcacgatggcacggctcgacgcggtcatcggcggcgcccagtacaacttcttcctgcactcggtgccgcacgatgcccagcaggcgacgcacgcgccgagctatcactggcacctcgagatttgcccgcggacctcgatcccgaccggcttcgagttagggtcgggccttttcgtcaatacgatcaatcccgaggaggccgcggagcggctgcgcagcgtcgagctgccggcgcgctga

SEQ ID NO: 85472 - protein, 366 aa, Thiobacillus denitrificans ATCC 25259
MSDASKPDSNEVREIRINPVVPGESVLVATARSMRPKKAEELAPRDTRKHVETCPFCRGNEHKTPPAILTWPDTGDWQIRMVENLYPVLGDDRAQAGFTFGLQQTIDGYGRHEVIIDHSEHGIAVQDMAETHLAALFGVYQTRMRQLFDSDERLKYVLVFKNFGPAAGASIPHTHSQVIAMPVVPENVDAEVRNSATHYAKHHHCIFCALIDEALTFEATIYDRNSGAVRRKINVGQYVVERGEKFIAIKPFASRYEWEVHILPLAHQADFLDVRGEDLADLARVMKRTMARLDAVIGGAQYNFFLHSVPHDAQQATHAPSYHWHLEICPRTSIPTGFELGSGLFVNTINPEEAAERLRSVELPAR

SEQ ID NO: 85473 - DNA, 1101 bp, Kineococcus radiotolerans SRS30216
  CDS (1)..(1101)
atggccgacggccgcgagctcatctacttcgacgacaccgaaccgtggctgtcgggcgaacgggcccgcgacgccgtcgaccaccgcccgctgcggcccgccgacgagacgctgcgcggcggctcccaggtgcgcttcgacccgctgaccggcgactggatcgcgatggcctcgcaccgcaacgaccgcaccctcatgccgccgccggaccaggacccgctggcccccaccgtgcccggcggcttccccaccgagatcgccgactccagctacgacgtcgtcgccttcgagaaccgcttcccctccttctccaaccgcatcggcggcgaggacgggttcctcgacggcgagcggctgtggccgacgcgccccgcggcggggcggtgcgaggtcgtctgcttctcctccgacacccgcggctcgttcggcaccctcgacccccgccgggcccgcaccgtgctcgaggcgtggatcgaccgcaccgagaccctcaacgccaccgacggggtcgagcaggtcttcgtcttcgagaaccgcggggaggagatcggcgtcacgctgccgcacccgcacgggcagatctacgggtacccgttcctcaccccgaagacggagaccatgctgcgccgcgcccgcgagcaccgcgccgcgaccggcggcaacctcttccgcgacgtcctcgacgccgagcgccgcgccggttcccgcgtcgtcctcgagaccgagcacttcaccgcctacgtcccggccgccgcgcgctggcccgtcgaggtccacctcgccccgaaccgcgacgtccccgacctgcccgccctcaccgaggaggagcgcgccgacctcgtcggggcctacctggacctgctggggcgcctggaccgctactaccccgacgaccacccgctgccctacatcgcgggctggcaccaggccccggccaccgaggggcgcgaggagttccgcctgcacctgcaggtgttcagcgtgctgcgcggcccgtcgaaggtgaagttcctcgccgggtcggagtccgccatggccgcctgggtcaacgacacgacgcccgagaaggtggcggcccgactgcgcgaggtggccccgtga

SEQ ID NO: 85474 - protein, 366 aa, Kineococcus radiotolerans SRS30216
MADGRELIYFDDTEPWLSGERARDAVDHRPLRPADETLRGGSQVRFDPLTGDWIAMASHRNDRTLMPPPDQDPLAPTVPGGFPTEIADSSYDVVAFENRFPSFSNRIGGEDGFLDGERLWPTRPAAGRCEVVCFSSDTRGSFGTLDPRRARTVLEAWIDRTETLNATDGVEQVFVFENRGEEIGVTLPHPHGQIYGYPFLTPKTETMLRRAREHRAATGGNLFRDVLDAERRAGSRVVLETEHFTAYVPAAARWPVEVHLAPNRDVPDLPALTEEERADLVGAYLDLLGRLDRYYPDDHPLPYIAGWHQAPATEGREEFRLHLQVFSVLRGPSKVKFLAGSESAMAAWVNDTTPEKVAARLREVAP

SEQ ID NO: 85475 - DNA, 1056 bp, Chloroflexus aurantiacus
  CDS (1)..(1056)
atggaacagcaagaactctttctgcgaccgcaccgccgcctgaatcggctgaccggcgaatgggtgctggtgtcgccgcatcgtacccaacgcccgtggctggggcaggtggagacgttgccgccagccgaattaccgtcttacgatccggcctgctatctgtgtccgggaaatacgcgggcgaatggcgtccagaacccaccgtataccgagacgtttgtcttcgagaacgattttgccgctcttttacctgatattccgttggatcgggtcagtgtgcggctgcccctcgccgatcagcacgacgcagggccggtgctgctccacgccgaggccgaacgtggtatttgtcgcgtggtgtgcttttcaccccgtcatgatctgacgctggcccaaatgtctcaggcagaggttagacgggtcgttgatgtgtgggttgaccagtacaacgagttgggggccatcgattgggtgcagtcagtgttgatcttcgagaatcgtggcgcgatgatgggtgcatccaatccacatccccacggtcaaatctgggccaacgagcagttgccaaacgagatgcgtaaggagctggccacgcaaacggcgtactggcacgagcatcaacgttgcctgctctgcgactatctggcgctggaattgcagcttggtgagcggatcgtgtgtgccaacgacgcctgggtggcgctggtgccgttttgggctgtgtggcccttcgagacgttggtgttaccgcgggtgcacgccggtgccattggtgatcttgatgagagtggtcgtgatggcctggcggcgatattgcgcgagttaaccggtcgctatgaccgtctcttcaatgtgtcgtttccctacagtatgggatttcatcagcgccctaccgatggccttgctcacgaaggctggcatctgcacgcacatttctacccgccattactccgctcggcaactgtccgtaagtttatggtagggtacgaaatgctgggtcagccgcagcgtgatctgacgccggagcaggcagccgcccgcctgcgcgatctgtaa

SEQ ID NO: 85476 - protein, 351 aa, Chloroflexus aurantiacus
MEQQELFLRPHRRLNRLTGEWVLVSPHRTQRPWLGQVETLPPAELPSYDPACYLCPGNTRANGVQNPPYTETFVFENDFAALLPDIPLDRVSVRLPLADQHDAGPVLLHAEAERGICRVVCFSPRHDLTLAQMSQAEVRRVVDVWVDQYNELGAIDWVQSVLIFENRGAMMGASNPHPHGQIWANEQLPNEMRKELATQTAYWHEHQRCLLCDYLALELQLGERIVCANDAWVALVPFWAVWPFETLVLPRVHAGAIGDLDESGRDGLAAILRELTGRYDRLFNVSFPYSMGFHQRPTDGLAHEGWHLHAHFYPPLLRSATVRKFMVGYEMLGQPQRDLTPEQAAARLRDL

SEQ ID NO: 85477 - DNA, 885 bp, Chloroflexus aurantiacus
  CDS (1)..(885)
ttgaccgccgagcgacctcagcacgatcctcaatgccccttctgtgtaggcaatgaagaactcgacctcgaagttgatcgctatccgatcaccgggccttggcaggtgcggattgttcgcaacaagtatccggcgctgcacggtgataggccgcttgtacgtcacttcgagggtgtacggcgtaacataagtggttatggttaccacgaggtattggtcgagcatccacaccacaataccacgcttggtctgatgacccatgctgaggtgcggctggtgctggcaacctatcttagccggggactggcgatgagcagtgatccccggattgagcaggtggtgatcttcaaaaaccacggtgaacgggctggggcctcgttgccacatccgcacagccagctcatggccgttccggttgtgcctgctgatgtgcgccaccggatcgaagaggcacgtcgtttcttcgacgataccggacagtgtgtcttctgtacaatgctggccgacgaactggcgcagcgggaacggatcgtctacgccaatgatgattttgtggcttttgttctctacgctgcttcgtcaccatttcatatctgggtcttgccgcgaaaacatcgtgccagcttttttcacattgccgaggcggagcttgatggtctggctgatgttgtccgtgaggtgtttcatcgcctctactatcggctcaacgatcccgattttaatctggtattgcgctcaactccggccagagaagcagagaacggctactttcactggtacctggcaattgttccccgcctttcgtatatggccggctttgagctgggcagcgggcatctttatcaaccccagcattcccgaagcctgtgctgcatttctgcgtga

SEQ ID NO: 85478 - protein, 294 aa, Chloroflexus aurantiacus
MTAERPQHDPQCPFCVGNEELDLEVDRYPITGPWQVRIVRNKYPALHGDRPLVRHFEGVRRNISGYGYHEVLVEHPHHNTTLGLMTHAEVRLVLATYLSRGLAMSSDPRIEQVVIFKNHGERAGASLPHPHSQLMAVPVVPADVRHRIEEARRFFDDTGQCVFCTMLADELAQRERIVYANDDFVAFVLYAASSPFHIWVLPRKHRASFFHIAEAELDGLADVVREVFHRLYYRLNDPDFNLVLRSTPAREAENGYFHWYLAIVPRLSYMAGFELGSGHLYQPQHSRSLCCISA

SEQ ID NO: 85479 - DNA, 1110 bp, Gracilaria verrucosa
  CDS (1)..(1110)
atgtctgccagcttcgactacaccgagcacccccatcgtcgctacaacccgctctcagcgcgctggattctgtgctcaccccatcgcgcgaagcgtccgtggcagggcagcgttgaagatctgccgcctgatgagcgtcctgagtacgatcccaaggactacttggggccgggaaactttcgtgtgaacggctccgtgcagaaccccaagtacgataccactttcgtgtttgacaatgacttccaggctttgctggataacacgccgcacggcgaagttggcagcgtagaagacaatgatctgctcgtcgcaaaagctgtgcgtggaaagtgtcgcgtcgtctgcttctctccgaagctcaatctcacagtcgccgagatgacagtcgaagaaatcaaacatgtcgtcgatgcctggcttgaggaatatgacaccctctccaagttggactatatcggccatgtgcagatcttcgagaacaaggggcagatgatgggatgctcaaacccacatcctcacggccaaatctgggcttcggagtttgtaccggaggaacctcgcattgtattggagaacctcaaggcgtatcatgaaaagaagggtacccatatgttagaagactatgtcaagatcgagatggaagctaaggaacgaatcgtctgtgaaaatgacaccttccttgccgtcgtgcccttctgggcaacctggccatttgaggtgttggttatgaccaagaaacgcgtaccatgcctcaagaacttcaacgaagccatgaagagcgatctcgccgatatctatcgtcgtgtttgtgcacgatatgacaacctgttcaccacccttttcccttactctatgggtattcatcagtcacctactaccaatggtactgatcccgcgaagcatgattatgcgcactttcacatgcacttctatccgcctctgctccgaagtgcgacagttaggaaattcatggttggcttcgagatgcttggcgaatcacaaagagatttgaccgcagagcaagccgcggcgagactgcgtgcctgctctgaagtgcattataaccatgcccgaaagaaggttgaaggcaatggtgacgcttctaagtga

SEQ ID NO: 85480 - protein, 369 aa, Gracilaria verrucosa
MSASFDYTEHPHRRYNPLSARWILCSPHRAKRPWQGSVEDLPPDERPEYDPKDYLGPGNFRVNGSVQNPKYDTTFVFDNDFQALLDNTPHGEVGSVEDNDLLVAKAVRGKCRVVCFSPKLNLTVAEMTVEEIKHVVDAWLEEYDTLSKLDYIGHVQIFENKGQMMGCSNPHPHGQIWASEFVPEEPRIVLENLKAYHEKKGTHMLEDYVKIEMEAKERIVCENDTFLAVVPFWATWPFEVLVMTKKRVPCLKNFNEAMKSDLADIYRRVCARYDNLFTTLFPYSMGIHQSPTTNGTDPAKHDYAHFHMHFYPPLLRSATVRKFMVGFEMLGESQRDLTAEQAAARLRACSEVHYNHARKKVEGNGDASK

SEQ ID NO: 85481 - DNA, 957 bp, Thermotoga neapolitana
  CDS (1)..(957): transl_table=11
atgatggaactcaggtacaacccgctcacagacgaatgggtgatcatctccgctgcaacacagaaaagaccggttcagccttcgaaaacggagtgtcccatatgtgtgggaggactggaacttcccgaagagtacgatctggttaccttcgaaaacagatatccttctctcaaaaaggaccctcctcctgtggactggaaggagaagggacctttcagaaaagaagagtcccgcggtgtatgcgaggtggtggtctacacctccgatcacaacaccgcactccccggtatgcctctgaaacagatagaaaaactcgttgagatgtgggtggaccgaaccagggacctttcccggcacgattttgtgaagtacgtcttcatcttcgaaaaccgtggaaaagaagttggtgcctctcttccccatccacacggtcagatctacgcctttcctttccttccaaaaagaatagaggtgaagatagatgcgatgagaaagtggtacgaggaaaaaagaagatgtcccatctgcgagatcctcgagaacgaagaagaggaaaggaaggtgtacgaaacagaaaacttcgtagcggttgttcccttctacgcgcgctttccgtacgaggtgcacatatatccaaaaaggcacgtgagcacgctccttgagttttctaaggaagagaagaaagaattcgcaaaagtattgaaagtggtgaccgccaagtacgacaaactcttcgatcaggagtttccgtacatgatgatgttctttcaggcaccattcaacggcgaggacgtttctcactttttccacttccatgtggagttcaatccaccaaaaagagacagggacaagttaaagtggatggcaagcgttgagacgggtacatgggctttcataaatcccgttgttccggaggaggcagcaagacagctcagggagacggaggtggagatatga

SEQ ID NO: 85482 - protein, 318 aa, Thermotoga neapolitana
MMELRYNPLTDEWVIISAATQKRPVQPSKTECPICVGGLELPEEYDLVTFENRYPSLKKDPPPVDWKEKGPFRKEESRGVCEVVVYTSDHNTALPGMPLKQIEKLVEMWVDRTRDLSRHDFVKYVFIFENRGKEVGASLPHPHGQIYAFPFLPKRIEVKIDAMRKWYEEKRRCPICEILENEEEERKVYETENFVAVVPFYARFPYEVHIYPKRHVSTLLEFSKEEKKEFAKVLKVVTAKYDKLFDQEFPYMMMFFQAPFNGEDVSHFFHFHVEFNPPKRDRDKLKWMASVETGTWAFINPVVPEEAARQLRETEVEI

SEQ ID NO: 85483 - DNA, 1050 bp, Thermus sp
  CDS (1)..(1050): transl_table=11
atgccccccttctataagcgcctccaccggaagaaggacggccgggagctcttcctctacggcctaatgcccctcgagggcccccctctccccgaagacgccgagcccttccgccccgccccccacctccgctaccaccccttgcggggggagtgggtggtctacgccgcccaccgccaggggcgcaccttcctcccccccaaggagcactgccccttgtgcccgagccgggaagggggcttccccacggagatccccttcccctccttccaggtggccgtctttgagaaccgcttcccctccttcgtggaggaagcccctccccctcccgaggggcttcccgtgcccgcgggggaggctttggggcggtgcgaggtggtggtttacacccccgcccacacgggaagcctcgccacccttggggaggaggaaaggctcctcctcgcctgggtgtggcgggaccggtacgaggccctctacgcccttcccggggtgcgcttcgtcatgccctttgagaataggggagaggcggtgggggtcaccctccaccacccccacggccagatctacgcctaccccttcgtcccccccgtcctggagcgggaaagccaggccttccgggagaggcccgtactccttgagcttttcccgagccttgggccctacgtggtggacgaggaggagggcttcctcgccttcgtcccccccttcgcccgctacccctacgaggtctggattgctccttgggaacgccatccaggtccttggaccttttccgatgcggagatggcggccttcgccaggctcttgggccgggtggtggcccggtacgacgctctctttggggagcccttcccttacgtcatggtcttccacgccgcgcccttgggggaggagcgcaccttccacttccacgtggagttctaccccccgaggcgcacccgggacaagctcaagttcctggcggggacggagctcggggcggggacgttcgtggtggatgccctgcccgaggagaccgcgaaggcccttagggcggcgctgccgtga

SEQ ID NO: 85484 - protein, 349 aa, Thermus sp
MPPFYKRLHRKKDGRELFLYGLMPLEGPPLPEDAEPFRPAPHLRYHPLRGEWVVYAAHRQGRTFLPPKEHCPLCPSREGGFPTEIPFPSFQVAVFENRFPSFVEEAPPPPEGLPVPAGEALGRCEVVVYTPAHTGSLATLGEEERLLLAWVWRDRYEALYALPGVRFVMPFENRGEAVGVTLHHPHGQIYAYPFVPPVLERESQAFRERPVLLELFPSLGPYVVDEEEGFLAFVPPFARYPYEVWIAPWERHPGPWTFSDAEMAAFARLLGRVVARYDALFGEPFPYVMVFHAAPLGEERTFHFHVEFYPPRRTRDKLKFLAGTELGAGTFVVDALPEETAKALRAALP

SEQ ID NO: 85485 - DNA, 1116 bp, Thiobacillus denitrificans
  CDS (1)..(1116): transl_table=11
atgtcagataatcaatccgcaccgaacgaaatccgagaaatccgcatcaaccccatcgtgcccgccgaatccgtgctggtcgcgacggcgcgcagcatgcgtccgaaaaaggccgaggaactggcgccgcgcgacacgcgcaagcatgtcgagacctgtccgttctgccgcggcaacgaggacaagacgccgccggcgatcctggcctggccggagagcgccgactggcagatccgcatggtcgagaacctctatccggttctgggcgacgaccgcgaacaggccagcttcaatttcggcctgcagcagacgatcgacggctacggccgccacgaggtcatcatcgaccaccacgagcatggcatcgcggtccaggaaatggccgagtcgcacctggcggcgctgttcggcgtctaccagacgcgcatgcggcaactcttcgaatcggatccgcggctgaaatacgtgctcgtgttcaagaacttcggtcccgccgcgggggcctcgatcccgcacacgcacagccaggtgatcgcgatgcccgtggtgccggagaacgtcgaggccgaggtgcggaacagcgcggcgcattacgccaagcatcatcactgcatcttctgcgcgctgatcgacgaggcgctgaccttcgaggcgaccatctacgaccgcaattcgggcgctgtgcggcgcaagatcaacgtcggccagtacgtggtcgagcgcggcgagaagttcatcgccatcaagcccttcgccagccgctacgagtgggaggtacacatcctgccgctgacgcatcaggccgactttctggacgtgcgcggcgaggacatggccgacctggcgcgcgtcatgaagcgcaccatggcgcggctcgacgccgtcatcggcggtgcccagtacaacttcttcctgcattcggtaccgcatggcggcaaggacgcggggcagggcgcgtcgtccgaggcaggcgtgcacgccgccagctaccactggcacctcgaaatctgtccgcgcacgtccatcccgacgggattcgagctgggctcggggctgttcgtcaacaccgtcaatcccgaacaggccgcggaacgcctgcgcaccgtggaactgtga

SEQ ID NO: 85486 - protein, 371 aa, Thiobacillus denitrificans
MSDNQSAPNEIREIRINPIVPAESVLVATARSMRPKKAEELAPRDTRKHVETCPFCRGNEDKTPPAILAWPESADWQIRMVENLYPVLGDDREQASFNFGLQQTIDGYGRHEVIIDHHEHGIAVQEMAESHLAALFGVYQTRMRQLFESDPRLKYVLVFKNFGPAAGASIPHTHSQVIAMPVVPENVEAEVRNSAAHYAKHHHCIFCALIDEALTFEATIYDRNSGAVRRKINVGQYVVERGEKFIAIKPFASRYEWEVHILPLTHQADFLDVRGEDMADLARVMKRTMARLDAVIGGAQYNFFLHSVPHGGKDAGQGASSEAGVHAASYHWHLEICPRTSIPTGFELGSGLFVNTVNPEQAAERLRTVEL

SEQ ID NO: 85487 - DNA, 1047 bp, Thermus brockianus
  CDS (1)..(1047): transl_table=11
atgccccccttctttaaacgccaccaccgcaaaggggacggaagggagctcatcctctacggcctaagccccttggaggaggcgcccttgccggagggggaggaggccttccacgccgccccccacctccgctaccaccccttgcggggggagtgggtggtctacgccgcccaccgccaggagcgcaccttccttcccccgaaggagcactgccccctttgcccaagccgggaaggggccttccccacggagatcccctttacccgcttccaggtggcggtctttgagaaccgcttccccgccctggttgccagcccaccccctccccccgctggcctccccgtgcccgcggaggccgcccggggccggtgcgaggtggtggtctacacgcccctccacacgggaagcctcgccaccctttccgaagaggagaggcttcttttggcctgggtgtggcgggagcggtaccaggccctctatagcctcccgggggtgcgcttcgtcatgccctttgagaaccggggggaggcggtaggggtgaccctgcaccacccccacgggcagatctacgcctatccctttgtgccccccatcttggagcgggaaagcgccgccttccgcgagcggcccgtgcttcaggagctttttccccgcctcgaggcctactggatagaccaggaggaaggcttcctggccttcgttccccccttcgcccgctacccctatgaagtttggcttgctccctgggagcgccacccggggccctggaccttttccgacgaggagatggcggccttcgcccggcttctgggccgggtggtggcccggtacgatgccctttttggcgaaccctttccctacgtgatggccttccacgccgcccctttgggggaggaggccaccttccacttccacgtggagttctacccccccaagcgcacgcaggacaagctcaagttcctggcggggacggaacttggggcgggcaccttcgtggtggacgccctgcccgaggaaacggcgaagcggcttagggaggttttatga

SEQ ID NO: 85488 - protein, 348 aa, Thermus brockianus
MPPFFKRHHRKGDGRELILYGLSPLEEAPLPEGEEAFHAAPHLRYHPLRGEWVVYAAHRQERTFLPPKEHCPLCPSREGAFPTEIPFTRFQVAVFENRFPALVASPPPPPAGLPVPAEAARGRCEVVVYTPLHTGSLATLSEEERLLLAWVWRERYQALYSLPGVRFVMPFENRGEAVGVTLHHPHGQIYAYPFVPPILERESAAFRERPVLQELFPRLEAYWIDQEEGFLAFVPPFARYPYEVWLAPWERHPGPWTFSDEEMAAFARLLGRVVARYDALFGEPFPYVMAFHAAPLGEEATFHFHVEFYPPKRTQDKLKFLAGTELGAGTFVVDALPEETAKRLREVL

SEQ ID NO: 85489 - DNA, 1050 bp, Thermus thermophilus
  CDS (1)..(1050): transl_table=11
atgccccccttctataagcgcctccaccggaagaaggacggccgggagctcttcctctacggcctaatgcccctcgagggcccccctctccccgaagacgccgagcccttccgccccgccccccacctccgctaccaccccttgcggggggagtgggtggtctacgccgcccaccgccaggggcgcaccttcctcccccccaaggagcactgccccttgtgcccgagccgggaagggggcttccccacggagatccccttcccctcctttcaggtggccgtctttgaaaaccgcttcccctccttcgtggaggaagcccctccccctcccgaggggcttcccgtggcggcggggaaggccttggggcggtgcgaggtggtggtctacacccccgcccacacgggaagcctcgccaccctcacggaggaggaaaggctccttttggcctgggcgtggcgggaccggtacgaggccctctacgcccttcccggggtgcgcttcgtcatgccctttgagaacgggggggaggcggtgggggtcaccctccaccacccccacggccagatctacgcctaccccttcgtgccccccgtcctggagcgggaaagccaggccttccgggaaaggcccgtgctccttgagcttttcccgaaccttgggccctacgtggtggacgaggaggagggcttcctcgccttcgtcccccccttcgcccggtacccctttgaggtctgggtggcccccgtggaaaggcaccccggtccctggaccttctccgagggggagatggcggccttcgccaggctcttgggccgggtggtggcccggtacgacgccctctttggggagcccttcccttacgtcatggtcttccacgccgcgcccttgggggaggaggccacctttcacttccacgtggagttctaccccccgaggcgcacccgggacaagctcaaattcctggcggggacggagctcggggcggggacgttcgtggtggacgccctgcccgaggagaccgcgaaggcccttagggcggcgttgccgtga

SEQ ID NO: 85490 - protein, 349 aa, Thermus thermophilus
MPPFYKRLHRKKDGRELFLYGLMPLEGPPLPEDAEPFRPAPHLRYHPLRGEWVVYAAHRQGRTFLPPKEHCPLCPSREGGFPTEIPFPSFQVAVFENRFPSFVEEAPPPPEGLPVAAGKALGRCEVVVYTPAHTGSLATLTEEERLLLAWAWRDRYEALYALPGVRFVMPFENGGEAVGVTLHHPHGQIYAYPFVPPVLERESQAFRERPVLLELFPNLGPYVVDEEEGFLAFVPPFARYPFEVWVAPVERHPGPWTFSEGEMAAFARLLGRVVARYDALFGEPFPYVMVFHAAPLGEEATFHFHVEFYPPRRTRDKLKFLAGTELGAGTFVVDALPEETAKALRAALP

SEQ ID NO: 85491 - DNA, 1146 bp, Cryptococcus neoformans
  CDS (1)..(1146)
atgacggcgactcatacccatagcaatggttccaacgatttcacacctgtgtccataaatgatcacgttcatcggcgcttcaaccctctccttggcaagcatgttctagtctccccacatagatcgctgagaccatggaacggccagaaggaaacccctgctatccccgttgaaacccctcacgactctaaatgctacttgtgtcctggtaataaacgcacgaccgggcaacacaatcctgattataagggtatttatgtcttcgagaacgactttccagcgttgcttcccgaccctctggctgttgggaccaacaagatctccgatgatccattattccagtctgaaccagtcagaggacggtgcaaggtgatttgtttccatccccggcatgacctgaccatggcagctatgaggatttcagagatcaatcatgttttggacgggtggaaagacgtttatgcggaggaagggaagatcatgcaagaggagagttcagacggctgtgtgcaaatctttgagaaccgaggcgcaatgatgggttgttccgcaccgcatcctcatggtcaagtgtggaccacttcatttgttcccgatgaacccgctaccgaaatcgagaactttgttcgctatgcctcaggtcgttccgggtctcatatgctgttggactatgctcttcgcgaagtaaaggctagagagagagtcgtaacgttgcacgaaagcggctgggtcgcagtagtgccatactgggctgcgtggccatttgaaatcctgctcatgccttacaaacgccatatcccatcgatcttacaactgacagcggaggaacaaactggattagcgacgatcttgaaagatgtactgagtcgctatgacaatctgttctcatgtcctttcccttattccatgggtttgcaccagtctcctctgcctccgacagacccgacatcaaactccgcccaagttcatttccatttctacccacctctcctccgaagcgcaacagtgagaaagttcatggtcggattcgagctcttaggggaggcgcagcgagatattgtaccggaacaagcggctgttcgtctgcgagagtcccttcctcataaacgtgcaacactttcaaacgacaagccatacaatccctaa

SEQ ID NO: 85492 - protein, 381 aa, Cryptococcus neoformans
MTATHTHSNGSNDFTPVSINDHVHRRFNPLLGKHVLVSPHRSLRPWNGQKETPAIPVETPHDSKCYLCPGNKRTTGQHNPDYKGIYVFENDFPALLPDPLAVGTNKISDDPLFQSEPVRGRCKVICFHPRHDLTMAAMRISEINHVLDGWKDVYAEEGKIMQEESSDGCVQIFENRGAMMGCSAPHPHGQVWTTSFVPDEPATEIENFVRYASGRSGSHMLLDYALREVKARERVVTLHESGWVAVVPYWAAWPFEILLMPYKRHIPSILQLTAEEQTGLATILKDVLSRYDNLFSCPFPYSMGLHQSPLPPTDPTSNSAQVHFHFYPPLLRSATVRKFMVGFELLGEAQRDIVPEQAAVRLRESLPHKRATLSNDKPYNP

SEQ ID NO: 85493 - DNA, 1050 bp, Haemophilus influenzae
  CDS (1)..(1050): transl_table=11
atgaccgcactttttgaacctacagaacatccacatcgtcgctacaatccgttaattgatcaatgggttttggtatcaccacatcgtgccaaacgcccgtggcaagggcaacaggaaaaagtcaatgaagaacaaaaaccaagttatgatccaacttgttatctttgcccgagtaataagcgtattacaggggaattaaatccagattatcgtaaaccttatgtgtttaaaaatgatttttccgcgcttttagaagatacgccagcccctgaaaaatcctccgatcctcttttccaaagttctcaagctcgtggggaaagtcgagtcatttgtttctctcccgatcatagtaaaacattgccattattgaccgcacttgagattgaagaagtgattaaagtatggcaggaacaacttcgtgagcttggtgcgaaataccaatgggtgcaaatttttgaaaacaaaggggcagcaatggggtgttcgaacccacatccacatggtcaaatttgggcgaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattggatcgctttagtgccttattgggctatttggccatttgaaacattgcttttaccaaaaactcatgtaaaacgtttaactgaattaagtgacgaacaatcaaaagatcttgcggttattttgaaaaaattgacgactaaatacgacaatctctttgaaacctctttcccatattcaatgggatttcatgcggcaccgtttaatggagaagataacgaacattggcagctacatgctcatttttaccctcctcttttgcgttcagcaaccgtgcgtaaatttatggtgggatatgaaatgttaggcgaaaaccaacgtgatttaacggcagaacaggcagcagagcgattacgtgctttgagtgaagttcattataaagaaagaactaaataa

SEQ ID NO: 85494 - protein, 349 aa, Haemophilus influenzae
MTALFEPTEHPHRRYNPLIDQWVLVSPHRAKRPWQGQQEKVNEEQKPSYDPTCYLCPSNKRITGELNPDYRKPYVFKNDFSALLEDTPAPEKSSDPLFQSSQARGESRVICFSPDHSKTLPLLTALEIEEVIKVWQEQLRELGAKYQWVQIFENKGAAMGCSNPHPHGQIWANSFLPNEVAREDRTQRDYLLKHGSVMLVDYVKRELALKERIVVETEHWIALVPYWAIWPFETLLLPKTHVKRLTELSDEQSKDLAVILKKLTTKYDNLFETSFPYSMGFHAAPFNGEDNEHWQLHAHFYPPLLRSATVRKFMVGYEMLGENQRDLTAEQAAERLRALSEVHYKERTK

SEQ ID NO: 85495 - DNA, 1113 bp, Kluyveromyces lactis
  CDS (1)..(1113)
atgtcttttgacttaacagatcactcacatgcacgttacaatccattgactgattcttggattttggtatctccacatagagccaagagaccatggttaggtcaacaggagaaacctggtagaaacgatgctccagaccacgacgataaatgctacttatgtcccggtactaccagggctacaggtgagcagaacccagattacgaatctacatatgtcttcactaacggctatccagctgtgaaattagaacaaccagatccagaactgacggtgtcgaattgcgacgcattgaaggagagattgttcaagttgaaaggtgtgaaaggtaactgttatgtgatctgcttctctccaaaacataacctaagtttcccacaaatggctcaaagtgagatcatgaatgttgtcaaaacgtggactaacttattccagactttggagaaagaagccttggaagagaacaagccttataaatatctacaaattttcgaaaataagggtactgctatgggttgctctaatttacatcctcatggtcaggcttggtgtttagattccattccaagcgaacctgcaaaagagtttgaccacttcgagaaatatgaacatcaacatggtgctcacttgttggaagattatgtcaatttagaacttcgcgaaaaggaaagaattgtgtgcgaaaatgattctttcttggttgttgttccatattgggccgtttggccattcgaaaccatggtcctctcaaaacgtcgcatcccatccttgaatcaatttactgataaagaaagggaagatttagcatctatcatcagaaacttgaccatcagatatgacaatctcttcgaaacgagtttcccatactccatgggtcttcaccaagcctctctcaacgctaccgaaggagaattgaaagccgcttggttccatatgcatttctatccaccattgctaagatcggccactgtgagaaagttcttagtagggttcgagttattaggacaaccacaaagagatttgactgctgaacaagcagcagatagactcaaagccctaagtggtgaagtacattatttagcaaaacttgagcaggaagaaagcaaaacttga

SEQ ID NO: 85496 - protein, 370 aa, Kluyveromyces lactis
MSFDLTDHSHARYNPLTDSWILVSPHRAKRPWLGQQEKPGRNDAPDHDDKCYLCPGTTRATGEQNPDYESTYVFTNGYPAVKLEQPDPELTVSNCDALKERLFKLKGVKGNCYVICFSPKHNLSFPQMAQSEIMNVVKTWTNLFQTLEKEALEENKPYKYLQIFENKGTAMGCSNLHPHGQAWCLDSIPSEPAKEFDHFEKYEHQHGAHLLEDYVNLELREKERIVCENDSFLVVVPYWAVWPFETMVLSKRRIPSLNQFTDKEREDLASIIRNLTIRYDNLFETSFPYSMGLHQASLNATEGELKAAWFHMHFYPPLLRSATVRKFLVGFELLGQPQRDLTAEQAADRLKALSGEVHYLAKLEQEESKT

SEQ ID NO: 85497 - DNA, 1179 bp, Neurospora crassa
  CDS (1)..(1179)
atgaccgacaaagtgcttgacgacatctcgcatcgtcgctacaacccgctcaacggctcttggctgcttgtatcgcctcacagaacaaagaggccatggcaaggacagcaagaggctccagccctcaacaagcttcctgagtatgatccccagtgctacctttgccccggcaacaagcgcgcccaaggcgactccaacccgcactacaaaaacacattcgccttcgtcaacgactacagcgccgtcaaagaggaacagcaagagtaccaccctcggaaggacgccgctggtgacggcgacgatgacattgcctctctcctcctgcaagcgcagcccgccaccggccggtgctacgtgctcaccttctccgccaagcacgacaccactttggcggacatgagcgcgaccgagatcgtacccgtgatcgagacctggacgcgcatctacgccagccacctgtctgcctcgcatccgctcagggacgccgccgcgcgttcactcagcgagattccacctaacccggacggcgaagtcgagcccgcgaaaaagcagcagctgcggtacatgcagatctttgagaacaagggcgcggccatgggctgctcgaacccgcatccgcactgccagatctggacgacgagcacgctgcccgaggagccgggcaaggagctggcgcagatgaccaagtaccaccgtgagcacaaggggaggcatctgctggaggactacgtcaaggtggagatggccaagggcgagcgtgtggtttggcagaacgacgggttcttggtcgtctgcccttggtgggctgtctggccgtttgaggtgctcgtcattgcgaagagacatgtgcgcgcgctggtggagcttacgagcgaggagaggctgcagtttgccgaggcggtgcaggaggttacgagaagatatgataacttgttcgagacaaactttccgtatagctcgggtattcatcaggcgccgttggattgcacagaggaagaggctgagacgagctggttccatatgcatttctaccctccacttcttcggtctgctaccgtgcgcaagttcttggtcggatacgagttaatggctgagccgcagagggatatcactccggagcaagcggctgcgcgactcagagactgcggtggtgagctctatcgcaagtcgttgcagtag

SEQ ID NO: 85498 - protein, 392 aa, Neurospora crassa
MTDKVLDDISHRRYNPLNGSWLLVSPHRTKRPWQGQQEAPALNKLPEYDPQCYLCPGNKRAQGDSNPHYKNTFAFVNDYSAVKEEQQEYHPRKDAAGDGDDDIASLLLQAQPATGRCYVLTFSAKHDTTLADMSATEIVPVIETWTRIYASHLSASHPLRDAAARSLSEIPPNPDGEVEPAKKQQLRYMQIFENKGAAMGCSNPHPHCQIWTTSTLPEEPGKELAQMTKYHREHKGRHLLEDYVKVEMAKGERVVWQNDGFLVVCPWWAVWPFEVLVIAKRHVRALVELTSEERLQFAEAVQEVTRRYDNLFETNFPYSSGIHQAPLDCTEEEAETSWFHMHFYPPLLRSATVRKFLVGYELMAEPQRDITPEQAAARLRDCGGELYRKSLQ

SEQ ID NO: 85499 - DNA, 1047 bp, Salmonella typhimurium
  CDS (1)..(1047): transl_table=11
atgaccccatttaatcccatcgatcatccgcatcgccgttataacccgcttaccggccagtgggttctggtttcgccgcatcgcgcaaaacgcccctggcagggggcgcaggaaacgccgtctcagcaaatgctgccggcccacgatccggactgcttcttgtgtgcgggcaatacgcgtgtcaccggcgataaaaatcccgattacaaagggacttacgtctttactaacgatttcgcggcgctgatggccgacacgccggatgcgccggacagccacgatccgctgatgcgctgtcagagcgcgcgcggcaccagccgcgtgatctgcttttctcccgatcacagtaaaacgctgccggagttgagcctgcccgcgctgacggaaatcgtcagaacctggcagacgcagaccgccgagttaggcaaaacctatccgtgggtgcaggtctttgaaaataaaggcgcggcgatgggctgttcgaacccgcatccgcatggacaggtctgggccaacagcttcctgccgaatgaggccgaacgcgaagatcgtttacaaaaagcctacttcgccgagcagcgctcgccaatgctggtggattatgtccagcgagaactggcggacggcagccgcaccgtggtcgaaaccgaacactggctggcggtggtgccttactgggcggcgtggccgttcgaaacgctactgttacccaaaacgcatgtcctgcgcattaccgatttaagcgacgagcagcgcgactctctggcgctggcgttgaaaaagctgaccagtcgttatgacaacctgtttcagtgttccttcccctactcaatgggctggcacggcgcgccgtttaacggtgaagaaaacgcacactggcagttgcacgcacacttttacccgccgctgctgcgctctgcgaccgtccgtaaatttatggtcggctatgaaatgctggcggaaacccagcgtgatttaaccgcagaacaagcggctgaacgcctgcgcgcggtcagcgacatccattttcgcgaatccggagtataa

SEQ ID NO: 85500 - protein, 348 aa, Salmonella typhimurium
MTPFNPIDHPHRRYNPLTGQWVLVSPHRAKRPWQGAQETPSQQMLPAHDPDCFLCAGNTRVTGDKNPDYKGTYVFTNDFAALMADTPDAPDSHDPLMRCQSARGTSRVICFSPDHSKTLPELSLPALTEIVRTWQTQTAELGKTYPWVQVFENKGAAMGCSNPHPHGQVWANSFLPNEAEREDRLQKAYFAEQRSPMLVDYVQRELADGSRTVVETEHWLAVVPYWAAWPFETLLLPKTHVLRITDLSDEQRDSLALALKKLTSRYDNLFQCSFPYSMGWHGAPFNGEENAHWQLHAHFYPPLLRSATVRKFMVGYEMLAETQRDLTAEQAAERLRAVSDIHFRESGV

SEQ ID NO: 85501 - DNA, 1110 bp, Schizosaccharomyces pombe
  CDS (1)..(1110)
atgactagcaaaaaatttgattttaccgagtattcacatcgtcgttataatccattaacggattcgtacgttttgtgttcacctcatagagcaaagagaccatggcagggagctaaagaagagatcaagaaagatgacactgtaaagtacgatccaacatgttacctatgccctggtaatattagggctacaggttttgaaaatccgaagtatgagacaacatatgtttttcccaatgactatcctgcggtgagagttgatcaaccagattatatgcaagatgaatctgaaataacgaaggggaatacgttaaaaacaaggatgtttaagacagaaggagtgaagggaaaatgttttgttatttgcttttgtcctaaccataatttaactttgccattaatgagcgcggaagcgatttgcaatgttgtagagacttggaaacacttgtatgtgacattaaagaaagaatctttggaagggccgattcgttataaatatttgcagatttttgagaataaagggtcagcaatgggatgttcaaatcctcacccacacggacaagcttggtgtctggatgttattccttcggttgttgctcaagaaatgtgtaacatgaccaaatattttgaacttaataatagtcatttactcggtgattatgtaaaattggagatgttggaaaaggaaagaatagtcgttgaaaatgactcatttattgtggttgtgccttattgggctttgtggccattcgagacattactgatagctaaagagcacctgaaatctttagaagaattcgaagaaaaacaaaaagttgatttggcttccgcattaaaaatgttgactaccaaatacgacaatctattcaacactagtttcccctactcaatgggtcttcaccaagctccattatatggaagtaatgaagaggttgaaaactcttggtttcatatgcatttttatccaccgttgttgagatcagctacagtgaaaaaattctgtgtgggctttgaaatgttgggtgaaccacaaagagatttgaccagtgaacaagcagctgctcgattacaagagctagatggacagaagcactacaaaaatctattataa

SEQ ID NO: 85502 - protein, 369 aa, Schizosaccharomyces pombe
MTSKKFDFTEYSHRRYNPLTDSYVLCSPHRAKRPWQGAKEEIKKDDTVKYDPTCYLCPGNIRATGFENPKYETTYVFPNDYPAVRVDQPDYMQDESEITKGNTLKTRMFKTEGVKGKCFVICFCPNHNLTLPLMSAEAICNVVETWKHLYVTLKKESLEGPIRYKYLQIFENKGSAMGCSNPHPHGQAWCLDVIPSVVAQEMCNMTKYFELNNSHLLGDYVKLEMLEKERIVVENDSFIVVVPYWALWPFETLLIAKEHLKSLEEFEEKQKVDLASALKMLTTKYDNLFNTSFPYSMGLHQAPLYGSNEEVENSWFHMHFYPPLLRSATVKKFCVGFEMLGEPQRDLTSEQAAARLQELDGQKHYKNLL

SEQ ID NO: 85503 - DNA, 957 bp, Thermotoga maritima
  CDS (1)..(957): transl_table=11
atgatggaactcaggtacaatccgctcacagatgaatgggtgatcgtttctgcagccacacagaaaagaccggtacaaccatcgaagacggagtgtcctatctgtgttggaggcctcgaacttcccgaggagtacgatcttgtcaccttcgagaacaggtatccttctctgaaaaaagatccacctcctgtgaactggaaagagaagggacctttcaggaaagaagagtcccgcggtgtctgcgaggtggtcgtctacacctcggatcacaacacagcacttcctggaatgcctttgaagcagatagaaaagctcgttgagatgtgggtggacagaacaagggacctttctcagcacgactttgtgaaatatatcttcattttcgaaaaccgcggaaaggaagtcggtgcttcccttccacacccgcacggtcagatatacgcgttccccttccttccaaagagaatagaagtgaagataggcgcgatgagaaaatggtacgaagagaaaaggaagtgccccatctgcgaggtcctggagagcgaaggagaggagagaaaagtttacgagacggaacatttcctcgctctcgttcctttctacgcacgctttccgtacgaagtgcacatctatccgaagagacacgtgagtactcttctggagttttcgaaagaagaaaagaaagagttcgccaaagttctcaaggtggtgactgcaaaatacgacaaactcttcgatcaggagtttccctacatgatgatgttctttcaggcaccgttcaacgaagaggacgtgtctcacttcttccacttccacgtggagttcaacccaccgaagcgagacagagataaactgaagtggatggcgagtgtcgagacgggtacatgggcgttcataaaccccgtcgttcccgaagaagcagcgagacaactcagagagacggaggtggaaatatga

SEQ ID NO: 85504 - protein, 318 aa, Thermotoga maritima
MMELRYNPLTDEWVIVSAATQKRPVQPSKTECPICVGGLELPEEYDLVTFENRYPSLKKDPPPVNWKEKGPFRKEESRGVCEVVVYTSDHNTALPGMPLKQIEKLVEMWVDRTRDLSQHDFVKYIFIFENRGKEVGASLPHPHGQIYAFPFLPKRIEVKIGAMRKWYEEKRKCPICEVLESEGEERKVYETEHFLALVPFYARFPYEVHIYPKRHVSTLLEFSKEEKKEFAKVLKVVTAKYDKLFDQEFPYMMMFFQAPFNEEDVSHFFHFHVEFNPPKRDRDKLKWMASVETGTWAFINPVVPEEAARQLRETEVEI

SEQ ID NO: 85505 - DNA, 1149 bp, Trichoderma reesei
  CDS (1)..(1149)
atgcctgacaagatcctcgatgacatctcccaccggaggtacaacccactcacagacagctggctgctcgtctcgcctcaccgaacgaagcggccctggcagggccagcaagagggtgctgctgtgacgacgctgcccgagtacgaccccaagtgctacctctgccccggcaactctcgcgctgccggcgaccagaaccccaactatgagcagacgtttgcctttgtaaacgactacagcgccgtcaaggagcagcagcccgactacgaggtcgaccagtcgtcggatgacctggagtcgcttttgctgcgcgctcagggcgtcaagggagtgtgctacgtcctgaccttctcgcccaagcacaacgtcaccctcgccgacatgtcggccaaggacattctccccaccatcaaccattggacccggctctacgccaaccatctgtcgccgtcaaacccgctctcggcagtggccgctcagctccagctgcccatctccaaggaagaggcccccgttcccaaggacaactaccgctacatgcaaatatttgagaacaagggcgcggcgatgggctgctctaacccgcatcctcactgccaggcctggacgacgtcgacgatgcccgaggagccgggcaaggagctggtgcagatggccaagtaccgccagcagcacgggcgtcatttgcttgcagactacatcaagttggagctcgccaaggaagagcgcgtggtctggcagaacgactcctttgtcgtggtgtgcccgtggtgggccatctggccattcgaggtcctcgtcctccccaagcgacacgtccgggccctcgtcgacctcaccgccgatgagcggctgcagcttgcagaggccatccaggaggtcactcggcgatacgacaacctgtttgagtgccacttcccatacagctcgggcatccaccaggctcccctggacggaacgccggaggaaatcgagaatgcctacttccacatgcacttttaccccccgctgctgcggtccgcgacagtcaagaagttcctcgtggggttcgagctcatggcggaggcacagcgagacattacacccgagcaagcaacgattcgcctgcgagcgtgcgatggggagctctaccggaacaagttgagctag

SEQ ID NO: 85506 - protein, 382 aa, Trichoderma reesei
MPDKILDDISHRRYNPLTDSWLLVSPHRTKRPWQGQQEGAAVTTLPEYDPKCYLCPGNSRAAGDQNPNYEQTFAFVNDYSAVKEQQPDYEVDQSSDDLESLLLRAQGVKGVCYVLTFSPKHNVTLADMSAKDILPTINHWTRLYANHLSPSNPLSAVAAQLQLPISKEEAPVPKDNYRYMQIFENKGAAMGCSNPHPHCQAWTTSTMPEEPGKELVQMAKYRQQHGRHLLADYIKLELAKEERVVWQNDSFVVVCPWWAIWPFEVLVLPKRHVRALVDLTADERLQLAEAIQEVTRRYDNLFECHFPYSSGIHQAPLDGTPEEIENAYFHMHFYPPLLRSATVKKFLVGFELMAEAQRDITPEQATIRLRACDGELYRNKLS

SEQ ID NO: 85507 - DNA, 1059 bp, Caenorhabditis elegans
  CDS (1)..(1059)
atgtccaagcaaaataactttcgccgctacaacccgcttatcgatgaatgggttattgtagccgtaaatcggataaatagaccttggcaaggtgccaagacggagaaatcaactacaatttcaacttcttctaacactgaacaatcaatcttaaatccgcttgctcccggcggaactcgatcttcgggaattgctaatgagaattatgtcagcacttatgtgtttgataatgattttccttctttcacggagtttgaagaatgcgctgggaaggatgaaaatgatgatttattcaaacaacacgaagtgaaaggagtttgtaaagtgatttgttatcacccaaatagtcaactcactttagcaacaatggatgttaaagaggtccgcgttgtcattgacatttggaaccaacaatatctggagctcggcccgaaatacgaatgggttcaaatcttcgaaaatcgtggagcagttgtcggatgttcgaatatgcatccacatgggcaactgtgggcgtcaaattatcttccgacgctgccaatgaagaagcatgagagtcaaaagaaacatttcgaaaagcacgggaaggttatgctgatggactatctggagcaggaaactctaaaaaaggaacgaataatcatgagaaatgagcactggacttggctcgtaccgtactgggcattctggccgtatgagacaatgcttctaccaaatcgacacgtggaacgattcactgatttgggagaggttgaaaagcaatcactctctgaaattcttcgttctctactcatcaagtacgacaatgtctttgaatgctcatttccctacatgatgggatggtctggagccccaactggctcttttctgactgaaaattgctcattttggcagctccacttgtcattcttcccgccacttcttcgttcggcgactgttccgaaattccttgctggatatgaagtttttgctgaaaaacaacgggatctttcgccggagattgctgcaaaaacgctgagcgagatcgatgaagagcattattcaaagaaattgcaataa

SEQ ID NO: 85508 - protein, 352 aa, Caenorhabditis elegans
MSKQNNFRRYNPLIDEWVIVAVNRINRPWQGAKTEKSTTISTSSNTEQSILNPLAPGGTRSSGIANENYVSTYVFDNDFPSFTEFEECAGKDENDDLFKQHEVKGVCKVICYHPNSQLTLATMDVKEVRVVIDIWNQQYLELGPKYEWVQIFENRGAVVGCSNMHPHGQLWASNYLPTLPMKKHESQKKHFEKHGKVMLMDYLEQETLKKERIIMRNEHWTWLVPYWAFWPYETMLLPNRHVERFTDLGEVEKQSLSEILRSLLIKYDNVFECSFPYMMGWSGAPTGSFLTENCSFWQLHLSFFPPLLRSATVPKFLAGYEVFAEKQRDLSPEIAAKTLSEIDEEHYSKKLQ

SEQ ID NO: 85509 - DNA, 1053 bp, Drosophila melanogaster
  CDS (1)..(1053)
atgcagtttgtggccagtgagcacccgcaccgacgtctaaatccgttgaacggccaatgggtcctagtgtgcccacatcgcacccaacgcccttggtcgggtcagcaggagaaggcgcagaagaacgagctgcccgaattcgatcccaccaatcctctgtgccctggcgtcaccagacccaatggaatccaaactccggaatatgagagcacctatgtgtttgagaacgacttcccggccctggtggaggtggtgcccgttccgcccaacaacgatgatccactgttccagatagctcccgcccgtggcaactgccgagtgatgtgcttccatcccaaatcgaatctgactttgcccacgatgagtgcagcggaaatcgtcgttgttatcgacgagtggatcagccagttcaacgagcttagcgccaagtacgcgtgggtgcagatattcgagaacaagggagccgccatggggtgttccaatccccatccgcactgccagatctggtcatgctcgtttctgccgacggaaccgcaactgaagcaggagcgtctgcgtgcctactacgccaccaacgagcggcccatgctggccgactatgtggagcgtgagctgcagcgccaggagcggattgtcattgagaatcgcgactggttggtggtggtgcccttctgggccacttggcccttcgaaaccatgctcatctcacgcaacaacaataagcggatcaatgatcttaccgcagaacagcgatacaacttggcgctgaccataaaggagctgaccaccaagtatgacaatctgttccagtgttcattcccctactcgatgggttggcatggagcaccgactgggccggagcatgcccacgcatccagtgctcattggaccctgcacgccatctactatccgccgctgcttcgttctgcctccgtgcgcaagttcatggtgggatttgagctgctggccatggcccagcgggatctgactcccgaacaggcagcccaaaggttgcgggaggtcgatggaaagtgtcattatctagagaagtga

SEQ ID NO: 85510 - protein, 350 aa, Drosophila melanogaster
MQFVASEHPHRRLNPLNGQWVLVCPHRTQRPWSGQQEKAQKNELPEFDPTNPLCPGVTRPNGIQTPEYESTYVFENDFPALVEVVPVPPNNDDPLFQIAPARGNCRVMCFHPKSNLTLPTMSAAEIVVVIDEWISQFNELSAKYAWVQIFENKGAAMGCSNPHPHCQIWSCSFLPTEPQLKQERLRAYYATNERPMLADYVERELQRQERIVIENRDWLVVVPFWATWPFETMLISRNNNKRINDLTAEQRYNLALTIKELTTKYDNLFQCSFPYSMGWHGAPTGPEHAHASSAHWTLHAIYYPPLLRSASVRKFMVGFELLAMAQRDLTPEQAAQRLREVDGKCHYLEK

SEQ ID NO: 85511 - DNA, 1140 bp, Homo sapiens
  CDS (1)..(1140)
atgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctga

SEQ ID NO: 85512 - protein, 379 aa, Homo sapiens
MSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 85513 - DNA, 22 bp, Primer
atgacgcaatttaatcccgttg

SEQ ID NO: 85514 - DNA, 24 bp, Primer
ttacactccggattcgcgaaaatg

SEQ ID NO: 85515 - protein, 452 aa, consensus
  MISC_FEATURE (1)..(452): consensus for the disclosure of xaa see table XV
RXXPXXXXXXXXXXXXRXXRPXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXGXXXVXXXXXXHXXXXXXXXXXXXXXXXXXXXXXXXWXXXXXXXXXXXXXXXXXXXXXXXXXXXXXXXXXXXXXXXXXXXXXXFXNXGXXXGXSXXHPHXQXXXXXXXPXXXXXXXXXXXXXXXXXXXXXXXXXXXXXXXXXXXXXXXXXXXXXXEXXXXXRXXXXXXXXXXXXXXPXXAXXPXEXXXXPXXXXXXXXXXXXXXXXXXXAXXXXXXXXXXXXXXXXXXXXXXXXXXXXXPYXXXXHXXPXXXXXXXXXXXXXXXXXXXXXXXHXXXXPXXXRXXXXXXFXXGXXXXXXXXXXXXXXXXXXXXXXXXXXXXXXXXXEXXAXXL

SEQ ID NO: 85516 - protein, 20 aa, consensus
  MISC_FEATURE (1)..(20): consensus for the disclosure of xaa see table XV
RXXXXXXXXXXXXXXXXXXR

SEQ ID NO: 85517 - protein, 28 aa, consensus
  MISC_FEATURE (1)..(28): consensus for the disclosure of xaa see table XV
XXXFXNXGXXXGXXXXHXHXQXXXXXXX

SEQ ID NO: 85518 - protein, 33 aa, consensus
  MISC_FEATURE (1)..(33): consensus for the disclosure of xaa see table XV
XXXXXXXXXXXXXXXXXXXXXPXXXXXPXXXXX

SEQ ID NO: 85519 - DNA, 1023 bp, Escherichia coli; identical to SEQ ID NO: 44874
  CDS (1)..(1023)

SEQ ID NO: 85520 - protein, 340 aa, Escherichia coli; identical to SEQ ID NO: 44875

SEQ ID NO: 85521 - DNA, 1128 bp, Mesorhizobium loti MAFF303099; identical to SEQ ID NO: 44876
  CDS (1)..(1128): transl_table=11

SEQ ID NO: 85522 - protein, 375 aa, Mesorhizobium loti MAFF303099; identical to SEQ ID NO: 44877

SEQ ID NO: 85523 - DNA, 990 bp, Helicobacter pylori 26695; identical to SEQ ID NO: 44878
  CDS (1)..(990): transl_table=11

SEQ ID NO: 85524 - protein, 329 aa, Helicobacter pylori 26695; identical to SEQ ID NO: 44879

SEQ ID NO: 85525 - DNA, 1032 bp, Borrelia burgdorferi B31; identical to SEQ ID NO: 44880
  CDS (1)..(1032): transl_table=11

SEQ ID NO: 85526 - protein, 343 aa, Borrelia burgdorferi B31; identical to SEQ ID NO: 44881

SEQ ID NO: 85527 - DNA, 981 bp, Aquifex aeolicus VF5; identical to SEQ ID NO: 44882
  CDS (1)..(981): transl_table=11

SEQ ID NO: 85528 - protein, 326 aa, Aquifex aeolicus VF5; identical to SEQ ID NO: 44883

SEQ ID NO: 85529 - DNA, 1035 bp, Treponema pallidum subsp. pallidum str. Nichols; identical to SEQ ID NO: 44884
  CDS (1)..(1035): transl_table=11

SEQ ID NO: 85530 - protein, 344 aa, Treponema pallidum subsp. pallidum str. Nichols; identical to SEQ ID NO: 44885

SEQ ID NO: 85531 - DNA, 1149 bp, Bacillus halodurans C-125; identical to SEQ ID NO: 44886
  CDS (1)..(1149): transl_table=11

SEQ ID NO: 85532 - protein, 382 aa, Bacillus halodurans C-125; identical to SEQ ID NO: 44887

SEQ ID NO: 85533 - DNA, 1047 bp, Pasteurella multocida subsp. multocida str. Pm70; identical to SEQ ID NO: 44888
  CDS (1)..(1047): transl_table=11

SEQ ID NO: 85534 - protein, 348 aa, Pasteurella multocida subsp. multocida str. Pm70; identical to SEQ ID NO: 44889

SEQ ID NO: 85535 - DNA, 1653 bp, Lactococcus lactis subsp. lactis Il1403; identical to SEQ ID NO: 44890
  CDS (1)..(1653): transl_table=11

SEQ ID NO: 85536 - protein, 550 aa, Lactococcus lactis subsp. lactis Il1403; identical to SEQ ID NO: 44891

SEQ ID NO: 85537 - DNA, 996 bp, Neisseria meningitidis MC58; identical to SEQ ID NO: 44892
  CDS (1)..(996): transl_table=11

SEQ ID NO: 85538 - protein, 331 aa, Neisseria meningitidis MC58; identical to SEQ ID NO: 44893

SEQ ID NO: 85539 - DNA, 996 bp, Neisseria meningitidis Z2491; identical to SEQ ID NO: 44894
  CDS (1)..(996): transl_table=11

SEQ ID NO: 85540 - protein, 331 aa, Neisseria meningitidis Z2491; identical to SEQ ID NO: 44895

SEQ ID NO: 85541 - DNA, 1032 bp, Deinococcus radiodurans R1; identical to SEQ ID NO: 44896
  CDS (1)..(1032): transl_table=11

SEQ ID NO: 85542 - protein, 343 aa, Deinococcus radiodurans R1; identical to SEQ ID NO: 44897

SEQ ID NO: 85543 - DNA, 1254 bp, Mycobacterium tuberculosis CDC1551; identical to SEQ ID NO: 44898
  CDS (1)..(1254): transl_table=11

SEQ ID NO: 85544 - protein, 417 aa, Mycobacterium tuberculosis CDC1551; identical to SEQ ID NO: 44899

SEQ ID NO: 85545 - DNA, 1656 bp, Streptococcus pneumoniae TIGR4; identical to SEQ ID NO: 44900
  CDS (1)..(1656): transl_table=11

SEQ ID NO: 85546 - protein, 551 aa, Streptococcus pneumoniae TIGR4; identical to SEQ ID NO: 44901

SEQ ID NO: 85547 - DNA, 1020 bp, Clostridium acetobutylicum ATCC 824; identical to SEQ ID NO: 44902
  CDS (1)..(1020): transl_table=11

SEQ ID NO: 85548 - protein, 339 aa, Clostridium acetobutylicum ATCC 824; identical to SEQ ID NO: 44903

SEQ ID NO: 85549 - DNA, 1221 bp, Agrobacterium tumefaciens str. C58; identical to SEQ ID NO: 44904
  CDS (1)..(1221): transl_table=11

SEQ ID NO: 85550 - protein, 406 aa, Agrobacterium tumefaciens str. C58; identical to SEQ ID NO: 44905

SEQ ID NO: 85551 - DNA, 1020 bp, Rickettsia conorii str. Malish 7; identical to SEQ ID NO: 44906
  CDS (1)..(1020): transl_table=11

SEQ ID NO: 85552 - protein, 339 aa, Rickettsia conorii str. Malish 7; identical to SEQ ID NO: 44907

SEQ ID NO: 85553 - DNA, 1083 bp, Bacillus subtilis subsp. subtilis str. 168; identical to SEQ ID NO: 44908
  CDS (1)..(1083): transl_table=11

SEQ ID NO: 85554 - protein, 360 aa, Bacillus subtilis subsp. subtilis str. 168; identical to SEQ ID NO: 44909

SEQ ID NO: 85555 - DNA, 1101 bp, Caulobacter crescentus CB15; identical to SEQ ID NO: 44910
  CDS (1)..(1101): transl_table=11

SEQ ID NO: 85556 - protein, 366 aa, Caulobacter crescentus CB15; identical to SEQ ID NO: 44911

SEQ ID NO: 85557 - DNA, 1023 bp, Salmonella typhimurium LT2; identical to SEQ ID NO: 44912
  CDS (1)..(1023): transl_table=11

SEQ ID NO: 85558 - protein, 340 aa, Salmonella typhimurium LT2; identical to SEQ ID NO: 44913

SEQ ID NO: 85559 - DNA, 1071 bp, Listeria innocua Clip11262; identical to SEQ ID NO: 44914
  CDS (1)..(1071): transl_table=11

SEQ ID NO: 85560 - protein, 356 aa, Listeria innocua Clip11262; identical to SEQ ID NO: 44915

SEQ ID NO: 85561 - DNA, 1134 bp, Ralstonia solanacearum GMI1000; identical to SEQ ID NO: 44916
  CDS (1)..(1134): transl_table=11

SEQ ID NO: 85562 - protein, 377 aa, Ralstonia solanacearum GMI1000; identical to SEQ ID NO: 44917

SEQ ID NO: 85563 - DNA, 1029 bp, Clostridium perfringens str. 13; identical to SEQ ID NO: 44918
  CDS (1)..(1029): transl_table=11

SEQ ID NO: 85564 - protein, 342 aa, Clostridium perfringens str. 13; identical to SEQ ID NO: 44919

SEQ ID NO: 85565 - DNA, 933 bp, Fusobacterium nucleatum subsp. nucleatum ATCC 25586; identical to SEQ ID NO: 44920
  CDS (1)..(933): transl_table=11

SEQ ID NO: 85566 - protein, 310 aa, Fusobacterium nucleatum subsp. nucleatum ATCC 25586; identical to SEQ ID NO: 44921

SEQ ID NO: 85567 - DNA, 1569 bp, Streptococcus pyogenes MGAS8232; identical to SEQ ID NO: 44922
  CDS (1)..(1569): transl_table=11

SEQ ID NO: 85568 - protein, 522 aa, Streptococcus pyogenes MGAS8232; identical to SEQ ID NO: 44923

SEQ ID NO: 85569 - DNA, 1047 bp, Thermoanaerobacter tengcongensis MB4; identical to SEQ ID NO: 44924
  CDS (1)..(1047): transl_table=11

SEQ ID NO: 85570 - protein, 348 aa, Thermoanaerobacter tengcongensis MB4; identical to SEQ ID NO: 44925

SEQ ID NO: 85571 - DNA, 1749 bp, Streptomyces coelicolor A3(2); identical to SEQ ID NO: 44926
  CDS (1)..(1749)

SEQ ID NO: 85572 - protein, 582 aa, Streptomyces coelicolor A3(2); identical to SEQ ID NO: 44927

SEQ ID NO: 85573 - DNA, 1074 bp, Xanthomonas axonopodis pv. citri str. 306; identical to SEQ ID NO: 44928
  CDS (1)..(1074): transl_table=11

SEQ ID NO: 85574 - protein, 357 aa, Xanthomonas axonopodis pv. citri str. 306; identical to SEQ ID NO: 44929

SEQ ID NO: 85575 - DNA, 1047 bp, Chlorobium tepidum TLS; identical to SEQ ID NO: 44930
  CDS (1)..(1047): transl_table=11

SEQ ID NO: 85576 - protein, 348 aa, Chlorobium tepidum TLS; identical to SEQ ID NO: 44931

SEQ ID NO: 85577 - DNA, 1119 bp, Oceanobacillus iheyensis HTE831; identical to SEQ ID NO: 44932
  CDS (1)..(1119): transl_table=11

SEQ ID NO: 85578 - protein, 372 aa, Oceanobacillus iheyensis HTE831; identical to SEQ ID NO: 44933

SEQ ID NO: 85579 - DNA, 1182 bp, Bifidobacterium longum NCC2705; identical to SEQ ID NO: 44934
  CDS (1)..(1182): transl_table=11

SEQ ID NO: 85580 - protein, 393 aa, Bifidobacterium longum NCC2705; identical to SEQ ID NO: 44935

SEQ ID NO: 85581 - DNA, 1239 bp, Brucella suis 1330; identical to SEQ ID NO: 44936
  CDS (1)..(1239): transl_table=11

SEQ ID NO: 85582 - protein, 412 aa, Brucella suis 1330; identical to SEQ ID NO: 44937

SEQ ID NO: 85583 - DNA, 1017 bp, Leptospira interrogans serovar Lai str. 56601; identical to SEQ ID NO: 44938
  CDS (1)..(1017): transl_table=11

SEQ ID NO: 85584 - protein, 338 aa, Leptospira interrogans serovar Lai str. 56601; identical to SEQ ID NO: 44939

SEQ ID NO: 85585 - DNA, 1011 bp, Shewanella oneidensis MR-1; identical to SEQ ID NO: 44940
  CDS (1)..(1011): transl_table=11

SEQ ID NO: 85586 - protein, 336 aa, Shewanella oneidensis MR-1; identical to SEQ ID NO: 44941

SEQ ID NO: 85587 - DNA, 1191 bp, Corynebacterium efficiens YS-314; identical to SEQ ID NO: 44942
  CDS (1)..(1191): transl_table=11

SEQ ID NO: 85588 - protein, 396 aa, Corynebacterium efficiens YS-314; identical to SEQ ID NO: 44943

SEQ ID NO: 85589 - DNA, 1266 bp, Pseudomonas putida KT2440; identical to SEQ ID NO: 44944
  CDS (1)..(1266): transl_table=11

SEQ ID NO: 85590 - protein, 421 aa, Pseudomonas putida KT2440; identical to SEQ ID NO: 44945

SEQ ID NO: 85591 - DNA, 1278 bp, Bradyrhizobium japonicum USDA 110; identical to SEQ ID NO: 44946
  CDS (1)..(1278)

SEQ ID NO: 85592 - protein, 425 aa, Bradyrhizobium japonicum USDA 110; identical to SEQ ID NO: 44947

SEQ ID NO: 85593 - DNA, 1068 bp, Xylella fastidiosa Temecula1; identical to SEQ ID NO: 44948
  CDS (1)..(1068): transl_table=11

SEQ ID NO: 85594 - protein, 355 aa, Xylella fastidiosa Temecula1; identical to SEQ ID NO: 44949

SEQ ID NO: 85595 - DNA, 1020 bp, Clostridium tetani E88; identical to SEQ ID NO: 44950
  CDS (1)..(1020): transl_table=11

SEQ ID NO: 85596 - protein, 339 aa, Clostridium tetani E88; identical to SEQ ID NO: 44951

SEQ ID NO: 85597 - DNA, 1206 bp, Lactobacillus plantarum WCFS1; identical to SEQ ID NO: 44952
  CDS (1)..(1206): transl_table=11

SEQ ID NO: 85598 - protein, 401 aa, Lactobacillus plantarum WCFS1; identical to SEQ ID NO: 44953

SEQ ID NO: 85599 - DNA, 1002 bp, Tropheryma whipplei TW08/27; identical to SEQ ID NO: 44954
  CDS (1)..(1002): transl_table=11

SEQ ID NO: 85600 - protein, 333 aa, Tropheryma whipplei TW08/27; identical to SEQ ID NO: 44955

SEQ ID NO: 85601 - DNA, 1140 bp, Pseudomonas syringae pv. tomato str. DC3000; identical to SEQ ID NO: 44956
  CDS (1)..(1140): transl_table=11

SEQ ID NO: 85602 - protein, 379 aa, Pseudomonas syringae pv. tomato str. DC3000; identical to SEQ ID NO: 44957

SEQ ID NO: 85603 - DNA, 1017 bp, Vibrio parahaemolyticus RIMD 2210633; identical to SEQ ID NO: 44958
  CDS (1)..(1017): transl_table=11

SEQ ID NO: 85604 - protein, 338 aa, Vibrio parahaemolyticus RIMD 2210633; identical to SEQ ID NO: 44959

SEQ ID NO: 85605 - DNA, 1038 bp, Bacteroides thetaiotaomicron VPI-5482; identical to SEQ ID NO: 44960
  CDS (1)..(1038): transl_table=11

SEQ ID NO: 85606 - protein, 345 aa, Bacteroides thetaiotaomicron VPI-5482; identical to SEQ ID NO: 44961

SEQ ID NO: 85607 - DNA, 1386 bp, Enterococcus faecalis V583; identical to SEQ ID NO: 44962
  CDS (1)..(1386): transl_table=11

SEQ ID NO: 85608 - protein, 461 aa, Enterococcus faecalis V583; identical to SEQ ID NO: 44963

SEQ ID NO: 85609 - DNA, 1113 bp, Coxiella burnetii RSA 493; identical to SEQ ID NO: 44964
  CDS (1)..(1113): transl_table=11

SEQ ID NO: 85610 - protein, 370 aa, Coxiella burnetii RSA 493; identical to SEQ ID NO: 44965

SEQ ID NO: 85611 - DNA, 1818 bp, Streptomyces avermitilis MA-4680; identical to SEQ ID NO: 44966
  CDS (1)..(1818)

SEQ ID NO: 85612 - protein, 605 aa, Streptomyces avermitilis MA-4680; identical to SEQ ID NO: 44967

SEQ ID NO: 85613 - DNA, 1122 bp, Bacillus cereus ATCC 14579; identical to SEQ ID NO: 44968
  CDS (1)..(1122): transl_table=11

SEQ ID NO: 85614 - protein, 373 aa, Bacillus cereus ATCC 14579; identical to SEQ ID NO: 44969

SEQ ID NO: 85615 - DNA, 1032 bp, Nitrosomonas europaea ATCC 19718; identical to SEQ ID NO: 44970
  CDS (1)..(1032): transl_table=11

SEQ ID NO: 85616 - protein, 343 aa, Nitrosomonas europaea ATCC 19718; identical to SEQ ID NO: 44971

SEQ ID NO: 85617 - DNA, 903 bp, Helicobacter hepaticus ATCC 51449; identical to SEQ ID NO: 44972
  CDS (1)..(903): transl_table=11

SEQ ID NO: 85618 - protein, 300 aa, Helicobacter hepaticus ATCC 51449; identical to SEQ ID NO: 44973

SEQ ID NO: 85619 - DNA, 1047 bp, Wigglesworthia glossinidia endosymbiont of Glossina brevipalpis; identical to SEQ ID NO: 44974
  CDS (1)..(1047): transl_table=11

SEQ ID NO: 85620 - protein, 348 aa, Wigglesworthia glossinidia endosymbiont of Glossina brevipalpis; identical to SEQ ID NO: 44975

SEQ ID NO: 85621 - DNA, 1035 bp, Bordetella pertussis Tohama I; identical to SEQ ID NO: 44976
  CDS (1)..(1035): transl_table=11

SEQ ID NO: 85622 - protein, 344 aa, Bordetella pertussis Tohama I; identical to SEQ ID NO: 44977

SEQ ID NO: 85623 - DNA, 1047 bp, Bordetella bronchiseptica RB50; identical to SEQ ID NO: 44978
  CDS (1)..(1047)

SEQ ID NO: 85624 - protein, 348 aa, Bordetella bronchiseptica RB50; identical to SEQ ID NO: 44979

SEQ ID NO: 85625 - DNA, 993 bp, Chromobacterium violaceum ATCC 12472; identical to SEQ ID NO: 44980
  CDS (1)..(993): transl_table=11

SEQ ID NO: 85626 - protein, 330 aa, Chromobacterium violaceum ATCC 12472; identical to SEQ ID NO: 44981

SEQ ID NO: 85627 - DNA, 1095 bp, Porphyromonas gingivalis W83; identical to SEQ ID NO: 44982
  CDS (1)..(1095): transl_table=11

SEQ ID NO: 85628 - protein, 364 aa, Porphyromonas gingivalis W83; identical to SEQ ID NO: 44983

SEQ ID NO: 85629 - DNA, 1038 bp, Gloeobacter violaceus PCC 7421; identical to SEQ ID NO: 44984
  CDS (1)..(1038): transl_table=11

SEQ ID NO: 85630 - protein, 345 aa, Gloeobacter violaceus PCC 7421; identical to SEQ ID NO: 44985

SEQ ID NO: 85631 - DNA, 1017 bp, Photorhabdus luminescens subsp. laumondii TTO1; identical to SEQ ID NO: 44986
  CDS (1)..(1017): transl_table=11

SEQ ID NO: 85632 - protein, 338 aa, Photorhabdus luminescens subsp. laumondii TTO1; identical to SEQ ID NO: 44987

SEQ ID NO: 85633 - DNA, 1017 bp, Vibrio vulnificus YJ016; identical to SEQ ID NO: 44988
  CDS (1)..(1017): transl_table=11

SEQ ID NO: 85634 - protein, 338 aa, Vibrio vulnificus YJ016; identical to SEQ ID NO: 44989

SEQ ID NO: 85635 - DNA, 1149 bp, Corynebacterium diphtheriae NCTC 13129; identical to SEQ ID NO: 44990
  CDS (1)..(1149): transl_table=11

SEQ ID NO: 85636 - protein, 382 aa, Corynebacterium diphtheriae NCTC 13129; identical to SEQ ID NO: 44991

SEQ ID NO: 85637 - DNA, 1257 bp, Rhodopseudomonas palustris CGA009; identical to SEQ ID NO: 44992
  CDS (1)..(1257): transl_table=11

SEQ ID NO: 85638 - protein, 418 aa, Rhodopseudomonas palustris CGA009; identical to SEQ ID NO: 44993

SEQ ID NO: 85639 - DNA, 1023 bp, Geobacter sulfurreducens PCA; identical to SEQ ID NO: 44994
  CDS (1)..(1023): transl_table=11

SEQ ID NO: 85640 - protein, 340 aa, Geobacter sulfurreducens PCA; identical to SEQ ID NO: 44995

SEQ ID NO: 85641 - DNA, 1248 bp, Mycobacterium avium subsp. paratuberculosis str. k10; identical to SEQ ID NO: 44996
  CDS (1)..(1248): transl_table=11

SEQ ID NO: 85642 - protein, 415 aa, Mycobacterium avium subsp. paratuberculosis str. k10; identical to SEQ ID NO: 44997

SEQ ID NO: 85643 - DNA, 1095 bp, Lactobacillus johnsonii NCC 533; identical to SEQ ID NO: 44998
  CDS (1)..(1095): transl_table=11

SEQ ID NO: 85644 - protein, 364 aa, Lactobacillus johnsonii NCC 533; identical to SEQ ID NO: 44999

SEQ ID NO: 85645 - DNA, 1083 bp, Bdellovibrio bacteriovorus HD100; identical to SEQ ID NO: 45000
  CDS (1)..(1083): transl_table=11

SEQ ID NO: 85646 - protein, 360 aa, Bdellovibrio bacteriovorus HD100; identical to SEQ ID NO: 45001

SEQ ID NO: 85647 - DNA, 1023 bp, Treponema denticola ATCC 35405; identical to SEQ ID NO: 45002
  CDS (1)..(1023): transl_table=11

SEQ ID NO: 85648 - protein, 340 aa, Treponema denticola ATCC 35405; identical to SEQ ID NO: 45003

SEQ ID NO: 85649 - DNA, 1041 bp, Leptospira interrogans serovar Copenhageni str. Fiocruz L1-130; identical to SEQ ID NO: 45004
  CDS (1)..(1041): transl_table=11

SEQ ID NO: 85650 - protein, 346 aa, Leptospira interrogans serovar Copenhageni str. Fiocruz L1-130; identical to SEQ ID NO: 45005

SEQ ID NO: 85651 - DNA, 1323 bp, Desulfovibrio vulgaris subsp. vulgaris str. Hildenborough; identical to SEQ ID NO: 45006
  CDS (1)..(1323): transl_table=11

SEQ ID NO: 85652 - protein, 440 aa, Desulfovibrio vulgaris subsp. vulgaris str. Hildenborough; identical to SEQ ID NO: 45007

SEQ ID NO: 85653 - DNA, 1110 bp, Bartonella quintana str. Toulouse; identical to SEQ ID NO: 45008
  CDS (1)..(1110): transl_table=11

SEQ ID NO: 85654 - protein, 369 aa, Bartonella quintana str. Toulouse; identical to SEQ ID NO: 45009

SEQ ID NO: 85655 - DNA, 1107 bp, Bartonella henselae str. Houston-1; identical to SEQ ID NO: 45010
  CDS (1)..(1107): transl_table=11

SEQ ID NO: 85656 - protein, 368 aa, Bartonella henselae str. Houston-1; identical to SEQ ID NO: 45011

SEQ ID NO: 85657 - DNA, 1074 bp, Acinetobacter sp. ADP1; identical to SEQ ID NO: 45012
  CDS (1)..(1074): transl_table=11

SEQ ID NO: 85658 - protein, 357 aa, Acinetobacter sp. ADP1; identical to SEQ ID NO: 45013

SEQ ID NO: 85659 - DNA, 1020 bp, Erwinia carotovora subsp. atroseptica SCRI1043; identical to SEQ ID NO: 45014
  CDS (1)..(1020)

SEQ ID NO: 85660 - protein, 339 aa, Erwinia carotovora subsp. atroseptica SCRI1043; identical to SEQ ID NO: 45015

SEQ ID NO: 85661 - DNA, 1110 bp, Propionibacterium acnes KPA171202; identical to SEQ ID NO: 45016
  CDS (1)..(1110): transl_table=11

SEQ ID NO: 85662 - protein, 369 aa, Propionibacterium acnes KPA171202; identical to SEQ ID NO: 45017

SEQ ID NO: 85663 - DNA, 1575 bp, Streptococcus pyogenes MGAS10394; identical to SEQ ID NO: 45018
  CDS (1)..(1575): transl_table=11

SEQ ID NO: 85664 - protein, 524 aa, Streptococcus pyogenes MGAS10394; identical to SEQ ID NO: 45019

SEQ ID NO: 85665 - DNA, 1086 bp, Desulfotalea psychrophila LSv54; identical to SEQ ID NO: 45020
  CDS (1)..(1086): transl_table=11

SEQ ID NO: 85666 - protein, 361 aa, Desulfotalea psychrophila LSv54; identical to SEQ ID NO: 45021

SEQ ID NO: 85667 - DNA, 1032 bp, Rickettsia typhi str. Wilmington; identical to SEQ ID NO: 45022
  CDS (1)..(1032): transl_table=11

SEQ ID NO: 85668 - protein, 343 aa, Rickettsia typhi str. Wilmington; identical to SEQ ID NO: 45023

SEQ ID NO: 85669 - DNA, 1026 bp, Yersinia pseudotuberculosis IP 32953; identical to SEQ ID NO: 45024
  CDS (1)..(1026): transl_table=11

SEQ ID NO: 85670 - protein, 341 aa, Yersinia pseudotuberculosis IP 32953; identical to SEQ ID NO: 45025

SEQ ID NO: 85671 - DNA, 1032 bp, Borrelia garinii PBi; identical to SEQ ID NO: 45026
  CDS (1)..(1032): transl_table=11

SEQ ID NO: 85672 - protein, 343 aa, Borrelia garinii PBi; identical to SEQ ID NO: 45027

SEQ ID NO: 85673 - DNA, 1056 bp, Symbiobacterium thermophilum IAM 14863; identical to SEQ ID NO: 45028
  CDS (1)..(1056): transl_table=11

SEQ ID NO: 85674 - protein, 351 aa, Symbiobacterium thermophilum IAM 14863; identical to SEQ ID NO: 45029

SEQ ID NO: 85675 - DNA, 1074 bp, Mannheimia succiniciproducens MBEL55E; identical to SEQ ID NO: 45030
  CDS (1)..(1074): transl_table=11

SEQ ID NO: 85676 - protein, 357 aa, Mannheimia succiniciproducens MBEL55E; identical to SEQ ID NO: 45031

SEQ ID NO: 85677 - DNA, 1038 bp, Bacteroides fragilis YCH46; identical to SEQ ID NO: 45032
  CDS (1)..(1038): transl_table=11

SEQ ID NO: 85678 - protein, 345 aa, Bacteroides fragilis YCH46; identical to SEQ ID NO: 45033

SEQ ID NO: 85679 - DNA, 1020 bp, Burkholderia mallei ATCC 23344; identical to SEQ ID NO: 45034
  CDS (1)..(1020): transl_table=11

SEQ ID NO: 85680 - protein, 339 aa, Burkholderia mallei ATCC 23344; identical to SEQ ID NO: 45035

SEQ ID NO: 85681 - DNA, 996 bp, Methylococcus capsulatus str. Bath; identical to SEQ ID NO: 45036
  CDS (1)..(996): transl_table=11

SEQ ID NO: 85682 - protein, 331 aa, Methylococcus capsulatus str. Bath; identical to SEQ ID NO: 45037

SEQ ID NO: 85683 - DNA, 999 bp, Legionella pneumophila str. Lens; identical to SEQ ID NO: 45038
  CDS (1)..(999): transl_table=11

SEQ ID NO: 85684 - protein, 332 aa, Legionella pneumophila str. Lens; identical to SEQ ID NO: 45039

SEQ ID NO: 85685 - DNA, 1014 bp, Photobacterium profundum SS9; identical to SEQ ID NO: 45040
  CDS (1)..(1014): transl_table=11

SEQ ID NO: 85686 - protein, 337 aa, Photobacterium profundum SS9; identical to SEQ ID NO: 45041

SEQ ID NO: 85687 - DNA, 984 bp, Thermus thermophilus HB8; identical to SEQ ID NO: 45042
  CDS (1)..(984): transl_table=11

SEQ ID NO: 85688 - protein, 327 aa, Thermus thermophilus HB8; identical to SEQ ID NO: 45043

SEQ ID NO: 85689 - DNA, 1092 bp, Geobacillus kaustophilus HTA426; identical to SEQ ID NO: 45044
  CDS (1)..(1092): transl_table=11

SEQ ID NO: 85690 - protein, 363 aa, Geobacillus kaustophilus HTA426; identical to SEQ ID NO: 45045

SEQ ID NO: 85691 - DNA, 957 bp, Salmonella enterica subsp. enterica serovar Paratypi A str. ATCC; identical to SEQ ID NO: 45046
  CDS (1)..(957): transl_table=11

SEQ ID NO: 85692 - protein, 318 aa, Salmonella enterica subsp. enterica serovar Paratypi A str. ATCC; identical to SEQ ID NO: 45047

SEQ ID NO: 85693 - DNA, 1005 bp, Idiomarina loihiensis L2TR; identical to SEQ ID NO: 45048
  CDS (1)..(1005): transl_table=11

SEQ ID NO: 85694 - protein, 334 aa, Idiomarina loihiensis L2TR; identical to SEQ ID NO: 45049

SEQ ID NO: 85695 - DNA, 1002 bp, Azoarcus sp. EbN1; identical to SEQ ID NO: 45050
  CDS (1)..(1002): transl_table=11

SEQ ID NO: 85696 - protein, 333 aa, Azoarcus sp. EbN1; identical to SEQ ID NO: 45051

SEQ ID NO: 85697 - DNA, 1002 bp, Zymomonas mobilis subsp. mobilis ZM4; identical to SEQ ID NO: 45052
  CDS (1)..(1002): transl_table=11

SEQ ID NO: 85698 - protein, 333 aa, Zymomonas mobilis subsp. mobilis ZM4; identical to SEQ ID NO: 45053

SEQ ID NO: 85699 - DNA, 1155 bp, Silicibacter pomeroyi DSS-3; identical to SEQ ID NO: 45054
  CDS (1)..(1155): transl_table=11

SEQ ID NO: 85700 - protein, 384 aa, Silicibacter pomeroyi DSS-3; identical to SEQ ID NO: 45055

SEQ ID NO: 85701 - DNA, 1140 bp, Bacillus clausii KSM-K16; identical to SEQ ID NO: 45056
  CDS (1)..(1140): transl_table=11

SEQ ID NO: 85702 - protein, 379 aa, Bacillus clausii KSM-K16; identical to SEQ ID NO: 45057

SEQ ID NO: 85703 - DNA, 1050 bp, Gluconobacter oxydans 621H; identical to SEQ ID NO: 45058
  CDS (1)..(1050): transl_table=11

SEQ ID NO: 85704 - protein, 349 aa, Gluconobacter oxydans 621H; identical to SEQ ID NO: 45059

SEQ ID NO: 85705 - DNA, 1074 bp, Xanthomonas oryzae pv. oryzae KACC10331; identical to SEQ ID NO: 45060
  CDS (1)..(1074): transl_table=11

SEQ ID NO: 85706 - protein, 357 aa, Xanthomonas oryzae pv. oryzae KACC10331; identical to SEQ ID NO: 45061

SEQ ID NO: 85707 - DNA, 948 bp, Neisseria gonorrhoeae FA 1090; identical to SEQ ID NO: 45062
  CDS (1)..(948): transl_table=11

SEQ ID NO: 85708 - protein, 315 aa, Neisseria gonorrhoeae FA 1090; identical to SEQ ID NO: 45063

SEQ ID NO: 85709 - DNA, 1095 bp, Lactobacillus gasseri; identical to SEQ ID NO: 45064
  CDS (1)..(1095)

SEQ ID NO: 85710 - protein, 364 aa, Lactobacillus gasseri; identical to SEQ ID NO: 45065

SEQ ID NO: 85711 - DNA, 963 bp, Magnetospirillum magnetotacticum MS-1; identical to SEQ ID NO: 45066
  CDS (1)..(963)

SEQ ID NO: 85712 - protein, 320 aa, Magnetospirillum magnetotacticum MS-1; identical to SEQ ID NO: 45067

SEQ ID NO: 85713 - DNA, 1077 bp, Azotobacter vinelandii; identical to SEQ ID NO: 45068
  CDS (1)..(1077)

SEQ ID NO: 85714 - protein, 358 aa, Azotobacter vinelandii; identical to SEQ ID NO: 45069

SEQ ID NO: 85715 - DNA, 981 bp, Desulfitobacterium hafniense DCB-2; identical to SEQ ID NO: 45070
  CDS (1)..(981)

SEQ ID NO: 85716 - protein, 326 aa, Desulfitobacterium hafniense DCB-2; identical to SEQ ID NO: 45071

SEQ ID NO: 85717 - DNA, 1170 bp, Desulfovibrio desulfuricans G20; identical to SEQ ID NO: 45072
  CDS (1)..(1170)

SEQ ID NO: 85718 - protein, 389 aa, Desulfovibrio desulfuricans G20; identical to SEQ ID NO: 45073

SEQ ID NO: 85719 - DNA, 1041 bp, Haemophilus somnus 2336; identical to SEQ ID NO: 45074
  CDS (1)..(1041)

SEQ ID NO: 85720 - protein, 346 aa, Haemophilus somnus 2336; identical to SEQ ID NO: 45075

SEQ ID NO: 85721 - DNA, 1035 bp, Actinobacillus pleuropneumoniae serovar 1 str. 4074; identical to SEQ ID NO: 45076
  CDS (1)..(1035)

SEQ ID NO: 85722 - protein, 344 aa, Actinobacillus pleuropneumoniae serovar 1 str. 4074; identical to SEQ ID NO: 45077

SEQ ID NO: 85723 - DNA, 1050 bp, Pseudomonas aeruginosa UCBPP-PA14; identical to SEQ ID NO: 45078
  CDS (1)..(1050)

SEQ ID NO: 85724 - protein, 349 aa, Pseudomonas aeruginosa UCBPP-PA14; identical to SEQ ID NO: 45079

SEQ ID NO: 85725 - DNA, 933 bp, Fusobacterium nucleatum subsp. vincentii ATCC 49256; identical to SEQ ID NO: 45080
  CDS (1)..(933): transl_table=11

SEQ ID NO: 85726 - protein, 310 aa, Fusobacterium nucleatum subsp. vincentii ATCC 49256; identical to SEQ ID NO: 45081

SEQ ID NO: 85727 - DNA, 1284 bp, Psychrobacter sp. 273-4; identical to SEQ ID NO: 45082
  CDS (1)..(1284)

SEQ ID NO: 85728 - protein, 427 aa, Psychrobacter sp. 273-4; identical to SEQ ID NO: 45083

SEQ ID NO: 85729 - DNA, 996 bp, Ralstonia eutropha JMP134; identical to SEQ ID NO: 45084
  CDS (1)..(996)

SEQ ID NO: 85730 - protein, 331 aa, Ralstonia eutropha JMP134; identical to SEQ ID NO: 45085

SEQ ID NO: 85731 - DNA, 1176 bp, Mesorhizobium sp. BNC1; identical to SEQ ID NO: 45086
  CDS (1)..(1176)

SEQ ID NO: 85732 - protein, 391 aa, Mesorhizobium sp. BNC1; identical to SEQ ID NO: 45087

SEQ ID NO: 85733 - DNA, 1113 bp, Rubrobacter xylanophilus DSM 9941; identical to SEQ ID NO: 45088
  CDS (1)..(1113)

SEQ ID NO: 85734 - protein, 370 aa, Rubrobacter xylanophilus DSM 9941; identical to SEQ ID NO: 45089

SEQ ID NO: 85735 - DNA, 1179 bp, Rhodobacter sphaeroides 2.4.1; identical to SEQ ID NO: 45090
  CDS (1)..(1179)

SEQ ID NO: 85736 - protein, 392 aa, Rhodobacter sphaeroides 2.4.1; identical to SEQ ID NO: 45091

SEQ ID NO: 85737 - DNA, 1014 bp, Rubrivivax gelatinosus PM1; identical to SEQ ID NO: 45092
  CDS (1)..(1014)

SEQ ID NO: 85738 - protein, 337 aa, Rubrivivax gelatinosus PM1; identical to SEQ ID NO: 45093

SEQ ID NO: 85739 - DNA, 1167 bp, Pseudomonas fluorescens PfO-1; identical to SEQ ID NO: 45094
  CDS (1)..(1167)

SEQ ID NO: 85740 - protein, 388 aa, Pseudomonas fluorescens PfO-1; identical to SEQ ID NO: 45095

SEQ ID NO: 85741 - DNA, 987 bp, Rhodospirillum rubrum; identical to SEQ ID NO: 45096
  CDS (1)..(987)

SEQ ID NO: 85742 - protein, 328 aa, Rhodospirillum rubrum; identical to SEQ ID NO: 45097

SEQ ID NO: 85743 - DNA, 999 bp, Ralstonia metallidurans CH34; identical to SEQ ID NO: 45098
  CDS (1)..(999)

SEQ ID NO: 85744 - protein, 332 aa, Ralstonia metallidurans CH34; identical to SEQ ID NO: 45099

SEQ ID NO: 85745 - DNA, 1011 bp, Burkholderia fungorum LB400; identical to SEQ ID NO: 45100
  CDS (1)..(1011)

SEQ ID NO: 85746 - protein, 336 aa, Burkholderia fungorum LB400; identical to SEQ ID NO: 45101

SEQ ID NO: 85747 - DNA, 1176 bp, Enterococcus faecium; identical to SEQ ID NO: 45102
  CDS (1)..(1176)

SEQ ID NO: 85748 - protein, 391 aa, Enterococcus faecium; identical to SEQ ID NO: 45103

SEQ ID NO: 85749 - DNA, 939 bp, Magnetococcus sp. MC-1; identical to SEQ ID NO: 45104
  CDS (1)..(939)

SEQ ID NO: 85750 - protein, 312 aa, Magnetococcus sp. MC-1; identical to SEQ ID NO: 45105

SEQ ID NO: 85751 - DNA, 2058 bp, Thermobifida fusca; identical to SEQ ID NO: 45106
  CDS (1)..(2058)

SEQ ID NO: 85752 - protein, 685 aa, Thermobifida fusca; identical to SEQ ID NO: 45107

SEQ ID NO: 85753 - DNA, 1077 bp, Geobacter metallireducens GS-15; identical to SEQ ID NO: 45108
  CDS (1)..(1077)

SEQ ID NO: 85754 - protein, 358 aa, Geobacter metallireducens GS-15; identical to SEQ ID NO: 45109

SEQ ID NO: 85755 - DNA, 954 bp, Novosphingobium aromaticivorans DSM 12444; identical to SEQ ID NO: 45110
  CDS (1)..(954)

SEQ ID NO: 85756 - protein, 317 aa, Novosphingobium aromaticivorans DSM 12444; identical to SEQ ID NO: 45111

SEQ ID NO: 85757 - DNA, 1047 bp, Cytophaga hutchinsonii; identical to SEQ ID NO: 45112
  CDS (1)..(1047)

SEQ ID NO: 85758 - protein, 348 aa, Cytophaga hutchinsonii; identical to SEQ ID NO: 45113

SEQ ID NO: 85759 - DNA, 1092 bp, Cytophaga hutchinsonii; identical to SEQ ID NO: 45114
  CDS (1)..(1092)

SEQ ID NO: 85760 - protein, 363 aa, Cytophaga hutchinsonii; identical to SEQ ID NO: 45115

SEQ ID NO: 85761 - DNA, 1134 bp, Clostridium thermocellum ATCC 27405; identical to SEQ ID NO: 45116
  CDS (1)..(1134)

SEQ ID NO: 85762 - protein, 377 aa, Clostridium thermocellum ATCC 27405; identical to SEQ ID NO: 45117

SEQ ID NO: 85763 - DNA, 1068 bp, Microbulbifer degradans 2-40; identical to SEQ ID NO: 45118
  CDS (1)..(1068)

SEQ ID NO: 85764 - protein, 355 aa, Microbulbifer degradans 2-40; identical to SEQ ID NO: 45119

SEQ ID NO: 85765 - DNA, 1185 bp, Pediococcus pentosaceus ATCC 25745; identical to SEQ ID NO: 45120
  CDS (1)..(1185)

SEQ ID NO: 85766 - protein, 394 aa, Pediococcus pentosaceus ATCC 25745; identical to SEQ ID NO: 45121

SEQ ID NO: 85767 - DNA, 1089 bp, Trichodesmium erythraeum IMS101; identical to SEQ ID NO: 45122
  CDS (1)..(1089)

SEQ ID NO: 85768 - protein, 362 aa, Trichodesmium erythraeum IMS101; identical to SEQ ID NO: 45123

SEQ ID NO: 85769 - DNA, 1059 bp, Moorella thermoacetica ATCC 39073; identical to SEQ ID NO: 45124
  CDS (1)..(1059)

SEQ ID NO: 85770 - protein, 352 aa, Moorella thermoacetica ATCC 39073; identical to SEQ ID NO: 45125

SEQ ID NO: 85771 - DNA, 1818 bp, Streptococcus suis 89/1591; identical to SEQ ID NO: 45126
  CDS (1)..(1818)

SEQ ID NO: 85772 - protein, 605 aa, Streptococcus suis 89/1591; identical to SEQ ID NO: 45127

SEQ ID NO: 85773 - DNA, 969 bp, Thiobacillus denitrificans ATCC 25259; identical to SEQ ID NO: 45128
  CDS (1)..(969)

SEQ ID NO: 85774 - protein, 322 aa, Thiobacillus denitrificans ATCC 25259; identical to SEQ ID NO: 45129

SEQ ID NO: 85775 - DNA, 1155 bp, Silicibacter sp. TM1040; identical to SEQ ID NO: 45130
  CDS (1)..(1155)

SEQ ID NO: 85776 - protein, 384 aa, Silicibacter sp. TM1040; identical to SEQ ID NO: 45131

SEQ ID NO: 85777 - DNA, 1050 bp, Rickettsia akari str. Hartford; identical to SEQ ID NO: 45132
  CDS (1)..(1050)

SEQ ID NO: 85778 - protein, 349 aa, Rickettsia akari str. Hartford; identical to SEQ ID NO: 45133

SEQ ID NO: 85779 - DNA, 996 bp, Dechloromonas aromatica RCB; identical to SEQ ID NO: 45134
  CDS (1)..(996)

SEQ ID NO: 85780 - protein, 331 aa, Dechloromonas aromatica RCB; identical to SEQ ID NO: 45135

SEQ ID NO: 85781 - DNA, 1044 bp, Haemophilus influenzae R2866; identical to SEQ ID NO: 45136
  CDS (1)..(1044)

SEQ ID NO: 85782 - protein, 347 aa, Haemophilus influenzae R2866; identical to SEQ ID NO: 45137

SEQ ID NO: 85783 - DNA, 942 bp, Methylobacillus flagellatus KT; identical to SEQ ID NO: 45138
  CDS (1)..(942)

SEQ ID NO: 85784 - protein, 313 aa, Methylobacillus flagellatus KT; identical to SEQ ID NO: 45139

SEQ ID NO: 85785 - DNA, 1071 bp, Chloroflexus aurantiacus; identical to SEQ ID NO: 45140
  CDS (1)..(1071)

SEQ ID NO: 85786 - protein, 356 aa, Chloroflexus aurantiacus; identical to SEQ ID NO: 45141

SEQ ID NO: 85787 - DNA, 987 bp, Polaromonas sp. JS666; identical to SEQ ID NO: 45142
  CDS (1)..(987)

SEQ ID NO: 85788 - protein, 328 aa, Polaromonas sp. JS666; identical to SEQ ID NO: 45143

SEQ ID NO: 85789 - DNA, 1575 bp, Streptococcus pyogenes M49 591; identical to SEQ ID NO: 45144
  CDS (1)..(1575)

SEQ ID NO: 85790 - protein, 524 aa, Streptococcus pyogenes M49 591; identical to SEQ ID NO: 45145

SEQ ID NO: 85791 - DNA, 1002 bp, Campylobacter coli RM2228; identical to SEQ ID NO: 45146
  CDS (1)..(1002): transl_table=11

SEQ ID NO: 85792 - protein, 333 aa, Campylobacter coli RM2228; identical to SEQ ID NO: 45147

SEQ ID NO: 85793 - DNA, 954 bp, Campylobacter lari RM2100; identical to SEQ ID NO: 45148
  CDS (1)..(954): transl_table=11

SEQ ID NO: 85794 - protein, 317 aa, Campylobacter lari RM2100; identical to SEQ ID NO: 45149

SEQ ID NO: 85795 - DNA, 1080 bp, Xanthomonas albilineans; identical to SEQ ID NO: 45150
  CDS (1)..(1080): transl_table=11

SEQ ID NO: 85796 - protein, 359 aa, Xanthomonas albilineans; identical to SEQ ID NO: 45151

SEQ ID NO: 85797 - DNA, 999 bp, Vibrio marinus; identical to SEQ ID NO: 45152
  CDS (1)..(999): transl_table=11

SEQ ID NO: 85798 - protein, 332 aa, Vibrio marinus; identical to SEQ ID NO: 45153

SEQ ID NO: 85799 - DNA, 27 bp, Primer
atgaaaaaagtgttattgataatcttg

SEQ ID NO: 85800 - DNA, 25 bp, Primer
ttactgcgcatttttttccttaagc

SEQ ID NO: 85801 - protein, 374 aa, consensus; identical to SEQ ID NO: 45156
  MISC_FEATURE (1)..(374): consensus for the disclosure of xaa see table XV

SEQ ID NO: 85802 - protein, 49 aa, consensus; identical to SEQ ID NO: 45157
  MISC_FEATURE (1)..(49): consensus for the disclosure of xaa see table XV

SEQ ID NO: 85803 - protein, 41 aa, consensus; identical to SEQ ID NO: 45158
  MISC_FEATURE (1)..(41): consensus for the disclosure of xaa see table XV

SEQ ID NO: 85804 - DNA, 1404 bp, Escherichia coli; identical to SEQ ID NO: 77196
  CDS (1)..(1404)

SEQ ID NO: 85805 - protein, 467 aa, Escherichia coli; identical to SEQ ID NO: 77197

SEQ ID NO: 85806 - DNA, 1359 bp, Mesorhizobium loti MAFF303099; identical to SEQ ID NO: 77198
  CDS (1)..(1359): transl_table=11

SEQ ID NO: 85807 - protein, 452 aa, Mesorhizobium loti MAFF303099; identical to SEQ ID NO: 77199

SEQ ID NO: 85808 - DNA, 1389 bp, Bacillus halodurans C-125; identical to SEQ ID NO: 77200
  CDS (1)..(1389): transl_table=11

SEQ ID NO: 85809 - protein, 462 aa, Bacillus halodurans C-125; identical to SEQ ID NO: 77201

SEQ ID NO: 85810 - DNA, 1332 bp, Pseudomonas aeruginosa PAO1; identical to SEQ ID NO: 77202
  CDS (1)..(1332): transl_table=11

SEQ ID NO: 85811 - protein, 443 aa, Pseudomonas aeruginosa PAO1; identical to SEQ ID NO: 77203

SEQ ID NO: 85812 - DNA, 1701 bp, Deinococcus radiodurans R1; identical to SEQ ID NO: 77204
  CDS (1)..(1701): transl_table=11

SEQ ID NO: 85813 - protein, 566 aa, Deinococcus radiodurans R1; identical to SEQ ID NO: 77205

SEQ ID NO: 85814 - DNA, 1497 bp, Clostridium acetobutylicum ATCC 824; identical to SEQ ID NO: 77206
  CDS (1)..(1497): transl_table=11

SEQ ID NO: 85815 - protein, 498 aa, Clostridium acetobutylicum ATCC 824; identical to SEQ ID NO: 77207

SEQ ID NO: 85816 - DNA, 1374 bp, Clostridium acetobutylicum ATCC 824; identical to SEQ ID NO: 77208
  CDS (1)..(1374): transl_table=11

SEQ ID NO: 85817 - protein, 457 aa, Clostridium acetobutylicum ATCC 824; identical to SEQ ID NO: 77209

SEQ ID NO: 85818 - DNA, 1701 bp, Clostridium acetobutylicum ATCC 824; identical to SEQ ID NO: 77210
  CDS (1)..(1701)

SEQ ID NO: 85819 - protein, 566 aa, Clostridium acetobutylicum ATCC 824; identical to SEQ ID NO: 77211

SEQ ID NO: 85820 - DNA, 1428 bp, Clostridium acetobutylicum ATCC 824; identical to SEQ ID NO: 77212
  CDS (1)..(1428): transl_table=11

SEQ ID NO: 85821 - protein, 475 aa, Clostridium acetobutylicum ATCC 824; identical to SEQ ID NO: 77213

SEQ ID NO: 85822 - DNA, 1974 bp, Caulobacter crescentus CB15; identical to SEQ ID NO: 77214
  CDS (1)..(1974): transl_table=11

SEQ ID NO: 85823 - protein, 657 aa, Caulobacter crescentus CB15; identical to SEQ ID NO: 77215

SEQ ID NO: 85824 - DNA, 1263 bp, Sinorhizobium meliloti 1021; identical to SEQ ID NO: 77216
  CDS (1)..(1263): transl_table=11

SEQ ID NO: 85825 - protein, 420 aa, Sinorhizobium meliloti 1021; identical to SEQ ID NO: 77217

SEQ ID NO: 85826 - DNA, 1218 bp, Synechocystis sp. PCC 6803; identical to SEQ ID NO: 77218
  CDS (1)..(1218): transl_table=11

SEQ ID NO: 85827 - protein, 405 aa, Synechocystis sp. PCC 6803; identical to SEQ ID NO: 77219

SEQ ID NO: 85828 - DNA, 1539 bp, Ralstonia solanacearum GMI1000; identical to SEQ ID NO: 77220
  CDS (1)..(1539): transl_table=11

SEQ ID NO: 85829 - protein, 512 aa, Ralstonia solanacearum GMI1000; identical to SEQ ID NO: 77221

SEQ ID NO: 85830 - DNA, 1656 bp, Ralstonia solanacearum GMI1000; identical to SEQ ID NO: 77222
  CDS (1)..(1656): transl_table=11

SEQ ID NO: 85831 - protein, 551 aa, Ralstonia solanacearum GMI1000; identical to SEQ ID NO: 77223

SEQ ID NO: 85832 - DNA, 1239 bp, Brucella melitensis 16M; identical to SEQ ID NO: 77224
  CDS (1)..(1239): transl_table=11

SEQ ID NO: 85833 - protein, 412 aa, Brucella melitensis 16M; identical to SEQ ID NO: 77225

SEQ ID NO: 85834 - DNA, 1404 bp, Clostridium perfringens str. 13; identical to SEQ ID NO: 77226
  CDS (1)..(1404): transl_table=11

SEQ ID NO: 85835 - protein, 467 aa, Clostridium perfringens str. 13; identical to SEQ ID NO: 77227

SEQ ID NO: 85836 - DNA, 1410 bp, Clostridium perfringens str. 13; identical to SEQ ID NO: 77228
  CDS (1)..(1410): transl_table=11

SEQ ID NO: 85837 - protein, 469 aa, Clostridium perfringens str. 13; identical to SEQ ID NO: 77229

SEQ ID NO: 85838 - DNA, 1119 bp, Corynebacterium glutamicum ATCC 13032; identical to SEQ ID NO: 77230
  CDS (1)..(1119): transl_table=11

SEQ ID NO: 85839 - protein, 372 aa, Corynebacterium glutamicum ATCC 13032; identical to SEQ ID NO: 77231

SEQ ID NO: 85840 - DNA, 1347 bp, Thermoanaerobacter tengcongensis MB4; identical to SEQ ID NO: 77232
  CDS (1)..(1347): transl_table=11

SEQ ID NO: 85841 - protein, 448 aa, Thermoanaerobacter tengcongensis MB4; identical to SEQ ID NO: 77233

SEQ ID NO: 85842 - DNA, 1356 bp, Thermoanaerobacter tengcongensis MB4; identical to SEQ ID NO: 77234
  CDS (1)..(1356): transl_table=11

SEQ ID NO: 85843 - protein, 451 aa, Thermoanaerobacter tengcongensis MB4; identical to SEQ ID NO: 77235

SEQ ID NO: 85844 - DNA, 1410 bp, Thermoanaerobacter tengcongensis MB4; identical to SEQ ID NO: 77236
  CDS (1)..(1410): transl_table=11

SEQ ID NO: 85845 - protein, 469 aa, Thermoanaerobacter tengcongensis MB4; identical to SEQ ID NO: 77237

SEQ ID NO: 85846 - DNA, 1128 bp, Streptomyces coelicolor A3(2); identical to SEQ ID NO: 77238
  CDS (1)..(1128)

SEQ ID NO: 85847 - protein, 375 aa, Streptomyces coelicolor A3(2); identical to SEQ ID NO: 77239

SEQ ID NO: 85848 - DNA, 1380 bp, Xanthomonas axonopodis pv. citri str. 306; identical to SEQ ID NO: 77240
  CDS (1)..(1380): transl_table=11

SEQ ID NO: 85849 - protein, 459 aa, Xanthomonas axonopodis pv. citri str. 306; identical to SEQ ID NO: 77241

SEQ ID NO: 85850 - DNA, 1698 bp, Bifidobacterium longum NCC2705; identical to SEQ ID NO: 77242
  CDS (1)..(1698): transl_table=11

SEQ ID NO: 85851 - protein, 565 aa, Bifidobacterium longum NCC2705; identical to SEQ ID NO: 77243

SEQ ID NO: 85852 - DNA, 1446 bp, Streptomyces coelicolor A3(2); identical to SEQ ID NO: 77244
  CDS (1)..(1446)

SEQ ID NO: 85853 - protein, 481 aa, Streptomyces coelicolor A3(2); identical to SEQ ID NO: 77245

SEQ ID NO: 85854 - DNA, 1476 bp, Corynebacterium efficiens YS-314; identical to SEQ ID NO: 77246
  CDS (1)..(1476): transl_table=11

SEQ ID NO: 85855 - protein, 491 aa, Corynebacterium efficiens YS-314; identical to SEQ ID NO: 77247

SEQ ID NO: 85856 - DNA, 1197 bp, Corynebacterium efficiens YS-314; identical to SEQ ID NO: 77248
  CDS (1)..(1197): transl_table=11

SEQ ID NO: 85857 - protein, 398 aa, Corynebacterium efficiens YS-314; identical to SEQ ID NO: 77249

SEQ ID NO: 85858 - DNA, 1437 bp, Clostridium tetani E88; identical to SEQ ID NO: 77250
  CDS (1)..(1437): transl_table=11

SEQ ID NO: 85859 - protein, 478 aa, Clostridium tetani E88; identical to SEQ ID NO: 77251

SEQ ID NO: 85860 - DNA, 1524 bp, Lactobacillus plantarum WCFS1; identical to SEQ ID NO: 77252
  CDS (1)..(1524): transl_table=11

SEQ ID NO: 85861 - protein, 507 aa, Lactobacillus plantarum WCFS1; identical to SEQ ID NO: 77253

SEQ ID NO: 85862 - DNA, 1455 bp, Tropheryma whipplei str. Twist; identical to SEQ ID NO: 77254
  CDS (1)..(1455): transl_table=11

SEQ ID NO: 85863 - protein, 484 aa, Tropheryma whipplei str. Twist; identical to SEQ ID NO: 77255

SEQ ID NO: 85864 - DNA, 1404 bp, Salmonella enterica subsp. enterica serovar Typhi Ty2; identical to SEQ ID NO: 77256
  CDS (1)..(1404): transl_table=11

SEQ ID NO: 85865 - protein, 467 aa, Salmonella enterica subsp. enterica serovar Typhi Ty2; identical to SEQ ID NO: 77257

SEQ ID NO: 85866 - DNA, 1437 bp, Streptomyces avermitilis MA-4680; identical to SEQ ID NO: 77258
  CDS (1)..(1437)

SEQ ID NO: 85867 - protein, 478 aa, Streptomyces avermitilis MA-4680; identical to SEQ ID NO: 77259

SEQ ID NO: 85868 - DNA, 1407 bp, Streptomyces avermitilis MA-4680; identical to SEQ ID NO: 77260
  CDS (1)..(1407)

SEQ ID NO: 85869 - protein, 468 aa, Streptomyces avermitilis MA-4680; identical to SEQ ID NO: 77261

SEQ ID NO: 85870 - DNA, 1107 bp, Streptomyces avermitilis MA-4680; identical to SEQ ID NO: 77262
  CDS (1)..(1107)

SEQ ID NO: 85871 - protein, 368 aa, Streptomyces avermitilis MA-4680; identical to SEQ ID NO: 77263

SEQ ID NO: 85872 - DNA, 1566 bp, Streptomyces avermitilis MA-4680; identical to SEQ ID NO: 77264
  CDS (1)..(1566)

SEQ ID NO: 85873 - protein, 521 aa, Streptomyces avermitilis MA-4680; identical to SEQ ID NO: 77265

SEQ ID NO: 85874 - DNA, 1506 bp, Bacillus cereus ATCC 14579; identical to SEQ ID NO: 77266
  CDS (1)..(1506): transl_table=11

SEQ ID NO: 85875 - protein, 501 aa, Bacillus cereus ATCC 14579; identical to SEQ ID NO: 77267

SEQ ID NO: 85876 - DNA, 1392 bp, Bacillus cereus ATCC 14579; identical to SEQ ID NO: 77268
  CDS (1)..(1392): transl_table=11

SEQ ID NO: 85877 - protein, 463 aa, Bacillus cereus ATCC 14579; identical to SEQ ID NO: 77269

SEQ ID NO: 85878 - DNA, 1776 bp, Bacillus cereus ATCC 14579; identical to SEQ ID NO: 77270
  CDS (1)..(1776): transl_table=11

SEQ ID NO: 85879 - protein, 591 aa, Bacillus cereus ATCC 14579; identical to SEQ ID NO: 77271

SEQ ID NO: 85880 - DNA, 1437 bp, Nitrosomonas europaea ATCC 19718; identical to SEQ ID NO: 77272
  CDS (1)..(1437): transl_table=11

SEQ ID NO: 85881 - protein, 478 aa, Nitrosomonas europaea ATCC 19718; identical to SEQ ID NO: 77273

SEQ ID NO: 85882 - DNA, 1392 bp, Bacillus anthracis str. Ames; identical to SEQ ID NO: 77274
  CDS (1)..(1392): transl_table=11

SEQ ID NO: 85883 - protein, 463 aa, Bacillus anthracis str. Ames; identical to SEQ ID NO: 77275

SEQ ID NO: 85884 - DNA, 1527 bp, Gloeobacter violaceus PCC 7421; identical to SEQ ID NO: 77276
  CDS (1)..(1527): transl_table=11

SEQ ID NO: 85885 - protein, 508 aa, Gloeobacter violaceus PCC 7421; identical to SEQ ID NO: 77277

SEQ ID NO: 85886 - DNA, 1443 bp, Gloeobacter violaceus PCC 7421; identical to SEQ ID NO: 77278
  CDS (1)..(1443): transl_table=11

SEQ ID NO: 85887 - protein, 480 aa, Gloeobacter violaceus PCC 7421; identical to SEQ ID NO: 77279

SEQ ID NO: 85888 - DNA, 1389 bp, Photorhabdus luminescens subsp. laumondii TTO1; identical to SEQ ID NO: 77280
  CDS (1)..(1389): transl_table=11

SEQ ID NO: 85889 - protein, 462 aa, Photorhabdus luminescens subsp. laumondii TTO1; identical to SEQ ID NO: 77281

SEQ ID NO: 85890 - DNA, 1128 bp, Corynebacterium diphtheriae NCTC 13129; identical to SEQ ID NO: 77282
  CDS (1)..(1128): transl_table=11

SEQ ID NO: 85891 - protein, 375 aa, Corynebacterium diphtheriae NCTC 13129; identical to SEQ ID NO: 77283

SEQ ID NO: 85892 - DNA, 1560 bp, Corynebacterium diphtheriae NCTC 13129; identical to SEQ ID NO: 77284
  CDS (1)..(1560): transl_table=11

SEQ ID NO: 85893 - protein, 519 aa, Corynebacterium diphtheriae NCTC 13129; identical to SEQ ID NO: 77285

SEQ ID NO: 85894 - DNA, 1104 bp, Rhodopseudomonas palustris CGA009; identical to SEQ ID NO: 77286
  CDS (1)..(1104): transl_table=11

SEQ ID NO: 85895 - protein, 367 aa, Rhodopseudomonas palustris CGA009; identical to SEQ ID NO: 77287

SEQ ID NO: 85896 - DNA, 1290 bp, Geobacter sulfurreducens PCA; identical to SEQ ID NO: 77288
  CDS (1)..(1290): transl_table=11

SEQ ID NO: 85897 - protein, 429 aa, Geobacter sulfurreducens PCA; identical to SEQ ID NO: 77289

SEQ ID NO: 85898 - DNA, 1551 bp, Geobacter sulfurreducens PCA; identical to SEQ ID NO: 77290
  CDS (1)..(1551): transl_table=11

SEQ ID NO: 85899 - protein, 516 aa, Geobacter sulfurreducens PCA; identical to SEQ ID NO: 77291

SEQ ID NO: 85900 - DNA, 1491 bp, Mycobacterium avium subsp. paratuberculosis str. k10; identical to SEQ ID NO: 77292
  CDS (1)..(1491): transl_table=11

SEQ ID NO: 85901 - protein, 496 aa, Mycobacterium avium subsp. paratuberculosis str. k10; identical to SEQ ID NO: 77293

SEQ ID NO: 85902 - DNA, 1437 bp, Mycobacterium avium subsp. paratuberculosis str. k10; identical to SEQ ID NO: 77294
  CDS (1)..(1437): transl_table=11

SEQ ID NO: 85903 - protein, 478 aa, Mycobacterium avium subsp. paratuberculosis str. k10; identical to SEQ ID NO: 77295

SEQ ID NO: 85904 - DNA, 1539 bp, Mycobacterium avium subsp. paratuberculosis str. k10; identical to SEQ ID NO: 77296
  CDS (1)..(1539): transl_table=11

SEQ ID NO: 85905 - protein, 512 aa, Mycobacterium avium subsp. paratuberculosis str. k10; identical to SEQ ID NO: 77297

SEQ ID NO: 85906 - DNA, 1404 bp, Mycobacterium avium subsp. paratuberculosis str. k10; identical to SEQ ID NO: 77298
  CDS (1)..(1404): transl_table=11

SEQ ID NO: 85907 - protein, 467 aa, Mycobacterium avium subsp. paratuberculosis str. k10; identical to SEQ ID NO: 77299

SEQ ID NO: 85908 - DNA, 1443 bp, Mycobacterium avium subsp. paratuberculosis str. k10; identical to SEQ ID NO: 77300
  CDS (1)..(1443): transl_table=11

SEQ ID NO: 85909 - protein, 480 aa, Mycobacterium avium subsp. paratuberculosis str. k10; identical to SEQ ID NO: 77301

SEQ ID NO: 85910 - DNA, 1695 bp, Mycobacterium avium subsp. paratuberculosis str. k10; identical to SEQ ID NO: 77302
  CDS (1)..(1695): transl_table=11

SEQ ID NO: 85911 - protein, 564 aa, Mycobacterium avium subsp. paratuberculosis str. k10; identical to SEQ ID NO: 77303

SEQ ID NO: 85912 - DNA, 1452 bp, Lactobacillus johnsonii NCC 533; identical to SEQ ID NO: 77304
  CDS (1)..(1452): transl_table=11

SEQ ID NO: 85913 - protein, 483 aa, Lactobacillus johnsonii NCC 533; identical to SEQ ID NO: 77305

SEQ ID NO: 85914 - DNA, 1458 bp, Bdellovibrio bacteriovorus HD100; identical to SEQ ID NO: 77306
  CDS (1)..(1458): transl_table=11

SEQ ID NO: 85915 - protein, 485 aa, Bdellovibrio bacteriovorus HD100; identical to SEQ ID NO: 77307

SEQ ID NO: 85916 - DNA, 1506 bp, Bacillus cereus ATCC 10987; identical to SEQ ID NO: 77308
  CDS (1)..(1506): transl_table=11

SEQ ID NO: 85917 - protein, 501 aa, Bacillus cereus ATCC 10987; identical to SEQ ID NO: 77309

SEQ ID NO: 85918 - DNA, 1392 bp, Bacillus cereus ATCC 10987; identical to SEQ ID NO: 77310
  CDS (1)..(1392): transl_table=11

SEQ ID NO: 85919 - protein, 463 aa, Bacillus cereus ATCC 10987; identical to SEQ ID NO: 77311

SEQ ID NO: 85920 - DNA, 1848 bp, Bacillus cereus ATCC 10987; identical to SEQ ID NO: 77312
  CDS (1)..(1848): transl_table=11

SEQ ID NO: 85921 - protein, 615 aa, Bacillus cereus ATCC 10987; identical to SEQ ID NO: 77313

SEQ ID NO: 85922 - DNA, 1377 bp, Bacillus cereus ATCC 10987; identical to SEQ ID NO: 77314
  CDS (1)..(1377): transl_table=11

SEQ ID NO: 85923 - protein, 458 aa, Bacillus cereus ATCC 10987; identical to SEQ ID NO: 77315

SEQ ID NO: 85924 - DNA, 1920 bp, Methanococcus maripaludis S2; identical to SEQ ID NO: 77316
  CDS (1)..(1920): transl_table=11

SEQ ID NO: 85925 - protein, 639 aa, Methanococcus maripaludis S2; identical to SEQ ID NO: 77317

SEQ ID NO: 85926 - DNA, 1332 bp, Yersinia pestis biovar Medievalis str. 91001; identical to SEQ ID NO: 77318
  CDS (1)..(1332): transl_table=11

SEQ ID NO: 85927 - protein, 443 aa, Yersinia pestis biovar Medievalis str. 91001; identical to SEQ ID NO: 77319

SEQ ID NO: 85928 - DNA, 1122 bp, Thermus thermophilus HB27; identical to SEQ ID NO: 77320
  CDS (1)..(1122): transl_table=11

SEQ ID NO: 85929 - protein, 373 aa, Thermus thermophilus HB27; identical to SEQ ID NO: 77321

SEQ ID NO: 85930 - DNA, 1386 bp, Desulfovibrio vulgaris subsp. vulgaris str. Hildenborough; identical to SEQ ID NO: 77322
  CDS (1)..(1386): transl_table=11

SEQ ID NO: 85931 - protein, 461 aa, Desulfovibrio vulgaris subsp. vulgaris str. Hildenborough; identical to SEQ ID NO: 77323

SEQ ID NO: 85932 - DNA, 1392 bp, Bacillus thuringiensis serovar konkukian str. 97-27; identical to SEQ ID NO: 77324
  CDS (1)..(1392): transl_table=11

SEQ ID NO: 85933 - protein, 463 aa, Bacillus thuringiensis serovar konkukian str. 97-27; identical to SEQ ID NO: 77325

SEQ ID NO: 85934 - DNA, 1698 bp, Acinetobacter sp. ADP1; identical to SEQ ID NO: 77326
  CDS (1)..(1698): transl_table=11

SEQ ID NO: 85935 - protein, 565 aa, Acinetobacter sp. ADP1; identical to SEQ ID NO: 77327

SEQ ID NO: 85936 - DNA, 1368 bp, Erwinia carotovora subsp. atroseptica SCRI1043; identical to SEQ ID NO: 77328
  CDS (1)..(1368)

SEQ ID NO: 85937 - protein, 455 aa, Erwinia carotovora subsp. atroseptica SCRI1043; identical to SEQ ID NO: 77329

SEQ ID NO: 85938 - DNA, 1431 bp, Propionibacterium acnes KPA171202; identical to SEQ ID NO: 77330
  CDS (1)..(1431): transl_table=11

SEQ ID NO: 85939 - protein, 476 aa, Propionibacterium acnes KPA171202; identical to SEQ ID NO: 77331

SEQ ID NO: 85940 - DNA, 1659 bp, Leifsonia xyli subsp. xyli str. CTCB07; identical to SEQ ID NO: 77332
  CDS (1)..(1659): transl_table=11

SEQ ID NO: 85941 - protein, 552 aa, Leifsonia xyli subsp. xyli str. CTCB07; identical to SEQ ID NO: 77333

SEQ ID NO: 85942 - DNA, 1386 bp, Yersinia pseudotuberculosis IP 32953; identical to SEQ ID NO: 77334
  CDS (1)..(1386): transl_table=11

SEQ ID NO: 85943 - protein, 461 aa, Yersinia pseudotuberculosis IP 32953; identical to SEQ ID NO: 77335

SEQ ID NO: 85944 - DNA, 1377 bp, Symbiobacterium thermophilum IAM 14863; identical to SEQ ID NO: 77336
  CDS (1)..(1377): transl_table=11

SEQ ID NO: 85945 - protein, 458 aa, Symbiobacterium thermophilum IAM 14863; identical to SEQ ID NO: 77337

SEQ ID NO: 85946 - DNA, 1380 bp, Symbiobacterium thermophilum IAM 14863; identical to SEQ ID NO: 77338
  CDS (1)..(1380): transl_table=11

SEQ ID NO: 85947 - protein, 459 aa, Symbiobacterium thermophilum IAM 14863; identical to SEQ ID NO: 77339

SEQ ID NO: 85948 - DNA, 1521 bp, Symbiobacterium thermophilum IAM 14863; identical to SEQ ID NO: 77340
  CDS (1)..(1521): transl_table=11

SEQ ID NO: 85949 - protein, 506 aa, Symbiobacterium thermophilum IAM 14863; identical to SEQ ID NO: 77341

SEQ ID NO: 85950 - DNA, 1389 bp, Bacillus cereus ZK; identical to SEQ ID NO: 77342
  CDS (1)..(1389): transl_table=11

SEQ ID NO: 85951 - protein, 462 aa, Bacillus cereus ZK; identical to SEQ ID NO: 77343

SEQ ID NO: 85952 - DNA, 1317 bp, Burkholderia pseudomallei K96243; identical to SEQ ID NO: 77344
  CDS (1)..(1317): transl_table=11

SEQ ID NO: 85953 - protein, 438 aa, Burkholderia pseudomallei K96243; identical to SEQ ID NO: 77345

SEQ ID NO: 85954 - DNA, 1401 bp, Methylococcus capsulatus str. Bath; identical to SEQ ID NO: 77346
  CDS (1)..(1401): transl_table=11

SEQ ID NO: 85955 - protein, 466 aa, Methylococcus capsulatus str. Bath; identical to SEQ ID NO: 77347

SEQ ID NO: 85956 - DNA, 1536 bp, Nocardia farcinica IFM 10152; identical to SEQ ID NO: 77348
  CDS (1)..(1536): transl_table=11

SEQ ID NO: 85957 - protein, 511 aa, Nocardia farcinica IFM 10152; identical to SEQ ID NO: 77349

SEQ ID NO: 85958 - DNA, 1467 bp, Nocardia farcinica IFM 10152; identical to SEQ ID NO: 77350
  CDS (1)..(1467): transl_table=11

SEQ ID NO: 85959 - protein, 488 aa, Nocardia farcinica IFM 10152; identical to SEQ ID NO: 77351

SEQ ID NO: 85960 - DNA, 1065 bp, Geobacillus kaustophilus HTA426; identical to SEQ ID NO: 77352
  CDS (1)..(1065): transl_table=11

SEQ ID NO: 85961 - protein, 354 aa, Geobacillus kaustophilus HTA426; identical to SEQ ID NO: 77353

SEQ ID NO: 85962 - DNA, 1638 bp, Zymomonas mobilis subsp. mobilis ZM4; identical to SEQ ID NO: 77354
  CDS (1)..(1638): transl_table=11

SEQ ID NO: 85963 - protein, 545 aa, Zymomonas mobilis subsp. mobilis ZM4; identical to SEQ ID NO: 77355

SEQ ID NO: 85964 - DNA, 1419 bp, Bacillus clausii KSM-K16; identical to SEQ ID NO: 77356
  CDS (1)..(1419): transl_table=11

SEQ ID NO: 85965 - protein, 472 aa, Bacillus clausii KSM-K16; identical to SEQ ID NO: 77357

SEQ ID NO: 85966 - DNA, 1422 bp, Dehalococcoides ethenogenes 195; identical to SEQ ID NO: 77358
  CDS (1)..(1422): transl_table=11

SEQ ID NO: 85967 - protein, 473 aa, Dehalococcoides ethenogenes 195; identical to SEQ ID NO: 77359

SEQ ID NO: 85968 - DNA, 1347 bp, Dehalococcoides ethenogenes 195; identical to SEQ ID NO: 77360
  CDS (1)..(1347): transl_table=11

SEQ ID NO: 85969 - protein, 448 aa, Dehalococcoides ethenogenes 195; identical to SEQ ID NO: 77361

SEQ ID NO: 85970 - DNA, 1194 bp, Xanthomonas oryzae pv. oryzae KACC10331; identical to SEQ ID NO: 77362
  CDS (1)..(1194): transl_table=11

SEQ ID NO: 85971 - protein, 397 aa, Xanthomonas oryzae pv. oryzae KACC10331; identical to SEQ ID NO: 77363

SEQ ID NO: 85972 - DNA, 1407 bp, Neisseria gonorrhoeae FA 1090; identical to SEQ ID NO: 77364
  CDS (1)..(1407): transl_table=11

SEQ ID NO: 85973 - protein, 468 aa, Neisseria gonorrhoeae FA 1090; identical to SEQ ID NO: 77365

SEQ ID NO: 85974 - DNA, 1296 bp, Azotobacter vinelandii; identical to SEQ ID NO: 77366
  CDS (1)..(1296)

SEQ ID NO: 85975 - protein, 431 aa, Azotobacter vinelandii; identical to SEQ ID NO: 77367

SEQ ID NO: 85976 - DNA, 1392 bp, Desulfitobacterium hafniense DCB-2; identical to SEQ ID NO: 77368
  CDS (1)..(1392)

SEQ ID NO: 85977 - protein, 463 aa, Desulfitobacterium hafniense DCB-2; identical to SEQ ID NO: 77369

SEQ ID NO: 85978 - DNA, 1431 bp, Desulfitobacterium hafniense DCB-2; identical to SEQ ID NO: 77370
  CDS (1)..(1431)

SEQ ID NO: 85979 - protein, 476 aa, Desulfitobacterium hafniense DCB-2; identical to SEQ ID NO: 77371

SEQ ID NO: 85980 - DNA, 1428 bp, Desulfitobacterium hafniense DCB-2; identical to SEQ ID NO: 77372
  CDS (1)..(1428)

SEQ ID NO: 85981 - protein, 475 aa, Desulfitobacterium hafniense DCB-2; identical to SEQ ID NO: 77373

SEQ ID NO: 85982 - DNA, 1428 bp, Nostoc punctiforme PCC 73102; identical to SEQ ID NO: 77374
  CDS (1)..(1428)

SEQ ID NO: 85983 - protein, 475 aa, Nostoc punctiforme PCC 73102; identical to SEQ ID NO: 77375

SEQ ID NO: 85984 - DNA, 1434 bp, Nostoc punctiforme PCC 73102; identical to SEQ ID NO: 77376
  CDS (1)..(1434)

SEQ ID NO: 85985 - protein, 477 aa, Nostoc punctiforme PCC 73102; identical to SEQ ID NO: 77377

SEQ ID NO: 85986 - DNA, 1251 bp, Pseudomonas syringae pv. syringae B728a; identical to SEQ ID NO: 77378
  CDS (1)..(1251)

SEQ ID NO: 85987 - protein, 416 aa, Pseudomonas syringae pv. syringae B728a; identical to SEQ ID NO: 77379

SEQ ID NO: 85988 - DNA, 1392 bp, Pseudomonas syringae pv. syringae B728a; identical to SEQ ID NO: 77380
  CDS (1)..(1392)

SEQ ID NO: 85989 - protein, 463 aa, Pseudomonas syringae pv. syringae B728a; identical to SEQ ID NO: 77381

SEQ ID NO: 85990 - DNA, 1332 bp, Pseudomonas aeruginosa UCBPP-PA14; identical to SEQ ID NO: 77382
  CDS (1)..(1332)

SEQ ID NO: 85991 - protein, 443 aa, Pseudomonas aeruginosa UCBPP-PA14; identical to SEQ ID NO: 77383

SEQ ID NO: 85992 - DNA, 1902 bp, Methanococcoides burtonii DSM 6242; identical to SEQ ID NO: 77384
  CDS (1)..(1902)

SEQ ID NO: 85993 - protein, 633 aa, Methanococcoides burtonii DSM 6242; identical to SEQ ID NO: 77385

SEQ ID NO: 85994 - DNA, 1431 bp, Anabaena variabilis ATCC 29413; identical to SEQ ID NO: 77386
  CDS (1)..(1431)

SEQ ID NO: 85995 - protein, 476 aa, Anabaena variabilis ATCC 29413; identical to SEQ ID NO: 77387

SEQ ID NO: 85996 - DNA, 1338 bp, Methylobacillus flagellatus KT; identical to SEQ ID NO: 77388
  CDS (1)..(1338)

SEQ ID NO: 85997 - protein, 445 aa, Methylobacillus flagellatus KT; identical to SEQ ID NO: 77389

SEQ ID NO: 85998 - DNA, 1362 bp, Exiguobacterium sp. 255-15; identical to SEQ ID NO: 77390
  CDS (1)..(1362)

SEQ ID NO: 85999 - protein, 453 aa, Exiguobacterium sp. 255-15; identical to SEQ ID NO: 77391

SEQ ID NO: 86000 - DNA, 1755 bp, Rubrobacter xylanophilus DSM 9941; identical to SEQ ID NO: 77392
  CDS (1)..(1755)

SEQ ID NO: 86001 - protein, 584 aa, Rubrobacter xylanophilus DSM 9941; identical to SEQ ID NO: 77393

SEQ ID NO: 86002 - DNA, 1125 bp, Crocosphaera watsonii WH 8501; identical to SEQ ID NO: 77394
  CDS (1)..(1125)

SEQ ID NO: 86003 - protein, 374 aa, Crocosphaera watsonii WH 8501; identical to SEQ ID NO: 77395

SEQ ID NO: 86004 - DNA, 1473 bp, Anabaena variabilis ATCC 29413; identical to SEQ ID NO: 77396
  CDS (1)..(1473)

SEQ ID NO: 86005 - protein, 490 aa, Anabaena variabilis ATCC 29413; identical to SEQ ID NO: 77397

SEQ ID NO: 86006 - DNA, 1035 bp, Bifidobacterium longum DJO10A; identical to SEQ ID NO: 77398
  CDS (1)..(1035)

SEQ ID NO: 86007 - protein, 344 aa, Bifidobacterium longum DJO10A; identical to SEQ ID NO: 77399

SEQ ID NO: 86008 - DNA, 1617 bp, Magnetospirillum magnetotacticum MS-1; identical to SEQ ID NO: 77400
  CDS (1)..(1617)

SEQ ID NO: 86009 - protein, 538 aa, Magnetospirillum magnetotacticum MS-1; identical to SEQ ID NO: 77401

SEQ ID NO: 86010 - DNA, 1140 bp, Burkholderia cepacia R18194; identical to SEQ ID NO: 77402
  CDS (1)..(1140)

SEQ ID NO: 86011 - protein, 379 aa, Burkholderia cepacia R18194; identical to SEQ ID NO: 77403

SEQ ID NO: 86012 - DNA, 1326 bp, Burkholderia cepacia R18194; identical to SEQ ID NO: 77404
  CDS (1)..(1326)

SEQ ID NO: 86013 - protein, 441 aa, Burkholderia cepacia R18194; identical to SEQ ID NO: 77405

SEQ ID NO: 86014 - DNA, 1320 bp, Burkholderia cepacia R1808; identical to SEQ ID NO: 77406
  CDS (1)..(1320)

SEQ ID NO: 86015 - protein, 439 aa, Burkholderia cepacia R1808; identical to SEQ ID NO: 77407

SEQ ID NO: 86016 - DNA, 1431 bp, Listeria monocytogenes str. 4b H7858; identical to SEQ ID NO: 77408
  CDS (1)..(1431): transl_table=11

SEQ ID NO: 86017 - protein, 476 aa, Listeria monocytogenes str. 4b H7858; identical to SEQ ID NO: 77409

SEQ ID NO: 86018 - DNA, 1380 bp, Listeria monocytogenes str. 1/2a F6854; identical to SEQ ID NO: 77410
  CDS (1)..(1380): transl_table=11

SEQ ID NO: 86019 - protein, 459 aa, Listeria monocytogenes str. 1/2a F6854; identical to SEQ ID NO: 77411

SEQ ID NO: 86020 - DNA, 1053 bp, Bacillus cereus G9241; identical to SEQ ID NO: 77412
  CDS (1)..(1053): transl_table=11

SEQ ID NO: 86021 - protein, 350 aa, Bacillus cereus G9241; identical to SEQ ID NO: 77413

SEQ ID NO: 86022 - DNA, 1341 bp, Pseudomonas fluorescens PfO-1; identical to SEQ ID NO: 77414
  CDS (1)..(1341)

SEQ ID NO: 86023 - protein, 446 aa, Pseudomonas fluorescens PfO-1; identical to SEQ ID NO: 77415

SEQ ID NO: 86024 - DNA, 1902 bp, Pseudomonas fluorescens PfO-1; identical to SEQ ID NO: 77416
  CDS (1)..(1902)

SEQ ID NO: 86025 - protein, 633 aa, Pseudomonas fluorescens PfO-1; identical to SEQ ID NO: 77417

SEQ ID NO: 86026 - DNA, 1611 bp, Pseudomonas fluorescens PfO-1; identical to SEQ ID NO: 77418
  CDS (1)..(1611)

SEQ ID NO: 86027 - protein, 536 aa, Pseudomonas fluorescens PfO-1; identical to SEQ ID NO: 77419

SEQ ID NO: 86028 - DNA, 1602 bp, Rhodospirillum rubrum; identical to SEQ ID NO: 77420
  CDS (1)..(1602)

SEQ ID NO: 86029 - protein, 533 aa, Rhodospirillum rubrum; identical to SEQ ID NO: 77421

SEQ ID NO: 86030 - DNA, 1008 bp, Rhodospirillum rubrum; identical to SEQ ID NO: 77422
  CDS (1)..(1008)

SEQ ID NO: 86031 - protein, 335 aa, Rhodospirillum rubrum; identical to SEQ ID NO: 77423

SEQ ID NO: 86032 - DNA, 1302 bp, Burkholderia fungorum LB400; identical to SEQ ID NO: 77424
  CDS (1)..(1302)

SEQ ID NO: 86033 - protein, 433 aa, Burkholderia fungorum LB400; identical to SEQ ID NO: 77425

SEQ ID NO: 86034 - DNA, 1836 bp, Enterococcus faecium; identical to SEQ ID NO: 77426
  CDS (1)..(1836)

SEQ ID NO: 86035 - protein, 611 aa, Enterococcus faecium; identical to SEQ ID NO: 77427

SEQ ID NO: 86036 - DNA, 1410 bp, Magnetococcus sp. MC-1; identical to SEQ ID NO: 77428
  CDS (1)..(1410)

SEQ ID NO: 86037 - protein, 469 aa, Magnetococcus sp. MC-1; identical to SEQ ID NO: 77429

SEQ ID NO: 86038 - DNA, 1740 bp, Thermobifida fusca; identical to SEQ ID NO: 77430
  CDS (1)..(1740)

SEQ ID NO: 86039 - protein, 579 aa, Thermobifida fusca; identical to SEQ ID NO: 77431

SEQ ID NO: 86040 - DNA, 1452 bp, Novosphingobium aromaticivorans DSM 12444; identical to SEQ ID NO: 77432
  CDS (1)..(1452)

SEQ ID NO: 86041 - protein, 483 aa, Novosphingobium aromaticivorans DSM 12444; identical to SEQ ID NO: 77433

SEQ ID NO: 86042 - DNA, 1392 bp, Clostridium thermocellum ATCC 27405; identical to SEQ ID NO: 77434
  CDS (1)..(1392)

SEQ ID NO: 86043 - protein, 463 aa, Clostridium thermocellum ATCC 27405; identical to SEQ ID NO: 77435

SEQ ID NO: 86044 - DNA, 1488 bp, Clostridium thermocellum ATCC 27405; identical to SEQ ID NO: 77436
  CDS (1)..(1488)

SEQ ID NO: 86045 - protein, 495 aa, Clostridium thermocellum ATCC 27405; identical to SEQ ID NO: 77437

SEQ ID NO: 86046 - DNA, 1515 bp, Clostridium thermocellum ATCC 27405; identical to SEQ ID NO: 77438
  CDS (1)..(1515)

SEQ ID NO: 86047 - protein, 504 aa, Clostridium thermocellum ATCC 27405; identical to SEQ ID NO: 77439

SEQ ID NO: 86048 - DNA, 1449 bp, Microbulbifer degradans 2-40; identical to SEQ ID NO: 77440
  CDS (1)..(1449)

SEQ ID NO: 86049 - protein, 482 aa, Microbulbifer degradans 2-40; identical to SEQ ID NO: 77441

SEQ ID NO: 86050 - DNA, 1413 bp, Microbulbifer degradans 2-40; identical to SEQ ID NO: 77442
  CDS (1)..(1413)

SEQ ID NO: 86051 - protein, 470 aa, Microbulbifer degradans 2-40; identical to SEQ ID NO: 77443

SEQ ID NO: 86052 - DNA, 1452 bp, Pediococcus pentosaceus ATCC 25745; identical to SEQ ID NO: 77444
  CDS (1)..(1452)

SEQ ID NO: 86053 - protein, 483 aa, Pediococcus pentosaceus ATCC 25745; identical to SEQ ID NO: 77445

SEQ ID NO: 86054 - DNA, 3360 bp, Trichodesmium erythraeum IMS101; identical to SEQ ID NO: 77446
  CDS (1)..(3360)

SEQ ID NO: 86055 - protein, 1119 aa, Trichodesmium erythraeum IMS101; identical to SEQ ID NO: 77447

SEQ ID NO: 86056 - DNA, 3402 bp, Trichodesmium erythraeum IMS101; identical to SEQ ID NO: 77448
  CDS (1)..(3402)

SEQ ID NO: 86057 - protein, 1133 aa, Trichodesmium erythraeum IMS101; identical to SEQ ID NO: 77449

SEQ ID NO: 86058 - DNA, 1410 bp, Moorella thermoacetica ATCC 39073; identical to SEQ ID NO: 77450
  CDS (1)..(1410)

SEQ ID NO: 86059 - protein, 469 aa, Moorella thermoacetica ATCC 39073; identical to SEQ ID NO: 77451

SEQ ID NO: 86060 - DNA, 1395 bp, Moorella thermoacetica ATCC 39073; identical to SEQ ID NO: 77452
  CDS (1)..(1395)

SEQ ID NO: 86061 - protein, 464 aa, Moorella thermoacetica ATCC 39073; identical to SEQ ID NO: 77453

SEQ ID NO: 86062 - DNA, 1287 bp, Thiobacillus denitrificans ATCC 25259; identical to SEQ ID NO: 77454
  CDS (1)..(1287)

SEQ ID NO: 86063 - protein, 428 aa, Thiobacillus denitrificans ATCC 25259; identical to SEQ ID NO: 77455

SEQ ID NO: 86064 - DNA, 1398 bp, Azotobacter vinelandii; identical to SEQ ID NO: 77456
  CDS (1)..(1398)

SEQ ID NO: 86065 - protein, 465 aa, Azotobacter vinelandii; identical to SEQ ID NO: 77457

SEQ ID NO: 86066 - DNA, 1395 bp, Desulfitobacterium hafniense DCB-2; identical to SEQ ID NO: 77458
  CDS (1)..(1395)

SEQ ID NO: 86067 - protein, 464 aa, Desulfitobacterium hafniense DCB-2; identical to SEQ ID NO: 77459

SEQ ID NO: 86068 - DNA, 1368 bp, Dechloromonas aromatica RCB; identical to SEQ ID NO: 77460
  CDS (1)..(1368)

SEQ ID NO: 86069 - protein, 455 aa, Dechloromonas aromatica RCB; identical to SEQ ID NO: 77461

SEQ ID NO: 86070 - DNA, 1455 bp, Kineococcus radiotolerans SRS30216; identical to SEQ ID NO: 77462
  CDS (1)..(1455)

SEQ ID NO: 86071 - protein, 484 aa, Kineococcus radiotolerans SRS30216; identical to SEQ ID NO: 77463

SEQ ID NO: 86072 - DNA, 1425 bp, Chloroflexus aurantiacus; identical to SEQ ID NO: 77464
  CDS (1)..(1425)

SEQ ID NO: 86073 - protein, 474 aa, Chloroflexus aurantiacus; identical to SEQ ID NO: 77465

SEQ ID NO: 86074 - DNA, 1395 bp, Lactococcus lactis; identical to SEQ ID NO: 77466
  CDS (1)..(1395): transl_table=11

SEQ ID NO: 86075 - protein, 464 aa, Lactococcus lactis; identical to SEQ ID NO: 77467

SEQ ID NO: 86076 - DNA, 1455 bp, Xanthomonas campestris; identical to SEQ ID NO: 77468
  CDS (1)..(1455): transl_table=11

SEQ ID NO: 86077 - protein, 484 aa, Xanthomonas campestris; identical to SEQ ID NO: 77469

SEQ ID NO: 86078 - DNA, 1395 bp, Corynebacterium equii; identical to SEQ ID NO: 77470
  CDS (1)..(1395): transl_table=11

SEQ ID NO: 86079 - protein, 464 aa, Corynebacterium equii; identical to SEQ ID NO: 77471

SEQ ID NO: 86080 - DNA, 1074 bp, Acinetobacter baumannii; identical to SEQ ID NO: 77472
  CDS (1)..(1074): transl_table=11

SEQ ID NO: 86081 - protein, 357 aa, Acinetobacter baumannii; identical to SEQ ID NO: 77473

SEQ ID NO: 86082 - DNA, 1431 bp, Amycolatopsis mediterranei; identical to SEQ ID NO: 77474
  CDS (1)..(1431): transl_table=11

SEQ ID NO: 86083 - protein, 476 aa, Amycolatopsis mediterranei; identical to SEQ ID NO: 77475

SEQ ID NO: 86084 - DNA, 1461 bp, Myxococcus xanthus; identical to SEQ ID NO: 77476
  CDS (1)..(1461): transl_table=11

SEQ ID NO: 86085 - protein, 486 aa, Myxococcus xanthus; identical to SEQ ID NO: 77477

SEQ ID NO: 86086 - DNA, 1209 bp, Listeria monocytogenes; identical to SEQ ID NO: 77478
  CDS (1)..(1209): transl_table=11

SEQ ID NO: 86087 - protein, 402 aa, Listeria monocytogenes; identical to SEQ ID NO: 77479

SEQ ID NO: 86088 - DNA, 1410 bp, Amycolatopsis mediterranei; identical to SEQ ID NO: 77480
  CDS (1)..(1410): transl_table=11

SEQ ID NO: 86089 - protein, 469 aa, Amycolatopsis mediterranei; identical to SEQ ID NO: 77481

SEQ ID NO: 86090 - DNA, 1419 bp, Amycolatopsis mediterranei; identical to SEQ ID NO: 77482
  CDS (1)..(1419): transl_table=11

SEQ ID NO: 86091 - protein, 472 aa, Amycolatopsis mediterranei; identical to SEQ ID NO: 77483

SEQ ID NO: 86092 - DNA, 1404 bp, Xanthomonas maltophilia; identical to SEQ ID NO: 77484
  CDS (1)..(1404): transl_table=11

SEQ ID NO: 86093 - protein, 467 aa, Xanthomonas maltophilia; identical to SEQ ID NO: 77485

SEQ ID NO: 86094 - DNA, 1437 bp, Lactobacillus sakei; identical to SEQ ID NO: 77486
  CDS (1)..(1437): n means a or g or c or t/u

SEQ ID NO: 86095 - protein, 478 aa, Lactobacillus sakei; identical to SEQ ID NO: 77487
  misc_feature (418)..(418): Xaa can be Arg or Gln or Leu or Pro

SEQ ID NO: 86096 - DNA, 1608 bp, Streptomyces coelicolor; identical to SEQ ID NO: 77488
  CDS (1)..(1608): transl_table=11

SEQ ID NO: 86097 - protein, 535 aa, Streptomyces coelicolor; identical to SEQ ID NO: 77489

SEQ ID NO: 86098 - DNA, 1698 bp, Mycobacterium paratuberculosis; identical to SEQ ID NO: 77490
  CDS (1)..(1698): transl_table=11

SEQ ID NO: 86099 - protein, 565 aa, Mycobacterium paratuberculosis; identical to SEQ ID NO: 77491

SEQ ID NO: 86100 - DNA, 1422 bp, Bacillus subtilis; identical to SEQ ID NO: 77492
  CDS (1)..(1422): transl_table=11

SEQ ID NO: 86101 - protein, 473 aa, Bacillus subtilis; identical to SEQ ID NO: 77493

SEQ ID NO: 86102 - DNA, 22 bp, Primer
atgaagttctggcgacccggta

SEQ ID NO: 86103 - DNA, 27 bp, Primer
ttatacttctctctgtaaatcccgttc

SEQ ID NO: 86104 - protein, 476 aa, consensus; identical to SEQ ID NO: 77496
  MISC_FEATURE (1)..(476): consensus for the disclosure of xaa see table XV

SEQ ID NO: 86105 - protein, 150 aa, consensus; identical to SEQ ID NO: 77497
  MISC_FEATURE (1)..(150): consensus for the disclosure of xaa see table XV

SEQ ID NO: 86106 - protein, 68 aa, consensus; identical to SEQ ID NO: 77498
  MISC_FEATURE (1)..(68): consensus for the disclosure of xaa see table XV

SEQ ID NO: 86107 - DNA, 725 bp, Escherichia coli K12; identical to SEQ ID NO: 31626
  CDS (4)..(432)

SEQ ID NO: 86108 - protein, 142 aa, Escherichia coli K12 [sequence omitted]

SEQ ID NO: 86109 - DNA, 982 bp, Spinacia oleracea (spinach); identical to SEQ ID NO: 31628
  CDS (40)..(792)

SEQ ID NO: 86110 - protein, 250 aa, Spinacia oleracea (spinach); identical to SEQ ID NO: 31629

SEQ ID NO: 86111 - DNA, 444 bp, Mycobacterium tuberculosis; identical to SEQ ID NO: 31630
  CDS (1)..(444)

SEQ ID NO: 86112 - protein, 147 aa, Mycobacterium tuberculosis; identical to SEQ ID NO: 31631

SEQ ID NO: 86113 - DNA, 453 bp, Chlamydia trachomatis; identical to SEQ ID NO: 31632
  CDS (1)..(453)

SEQ ID NO: 86114 - protein, 150 aa, Chlamydia trachomatis; identical to SEQ ID NO: 31633

SEQ ID NO: 86115 - DNA, 429 bp, Pseudomonas aeruginosa; identical to SEQ ID NO: 31634
  CDS (1)..(429)

SEQ ID NO: 86116 - protein, 142 aa, Pseudomonas aeruginosa; identical to SEQ ID NO: 31635

SEQ ID NO: 86117 - DNA, 474 bp, Caulobacter crescentus; identical to SEQ ID NO: 31636
  CDS (1)..(474)

SEQ ID NO: 86118 - protein, 157 aa, Caulobacter crescentus; identical to SEQ ID NO: 31637

SEQ ID NO: 86119 - DNA, 757 bp, Arabidopsis thaliana (mouse-ear cress); identical to SEQ ID NO: 31638
  CDS (1)..(726)

SEQ ID NO: 86120 - protein, 241 aa, Arabidopsis thaliana (mouse-ear cress); identical to SEQ ID NO: 31639

SEQ ID NO: 86121 - DNA, 465 bp, Agrobacterium tumefaciens; identical to SEQ ID NO: 31640
  CDS (1)..(465)

SEQ ID NO: 86122 - protein, 154 aa, Agrobacterium tumefaciens; identical to SEQ ID NO: 31641

SEQ ID NO: 86123 - DNA, 465 bp, Brucella melitensis; identical to SEQ ID NO: 31642
  CDS (1)..(465)

SEQ ID NO: 86124 - protein, 154 aa, Brucella melitensis; identical to SEQ ID NO: 31643

SEQ ID NO: 86125 - DNA, 438 bp, Listeria monocytogenes; identical to SEQ ID NO: 31644
  CDS (1)..(438)

SEQ ID NO: 86126 - protein, 145 aa, Listeria monocytogenes; identical to SEQ ID NO: 31645

SEQ ID NO: 86127 - DNA, 456 bp, Nostoc sp. PCC 7120; identical to SEQ ID NO: 31646
  CDS (1)..(456)

SEQ ID NO: 86128 - protein, 151 aa, Nostoc sp. PCC 7120; identical to SEQ ID NO: 31647

SEQ ID NO: 86129 - DNA, 438 bp, Haloarcula marismortui; identical to SEQ ID NO: 31648
  CDS (1)..(438)

SEQ ID NO: 86130 - protein, 145 aa, Haloarcula marismortui; identical to SEQ ID NO: 31649

SEQ ID NO: 86131 - DNA, 441 bp, Mycoplasma genitalium; identical to SEQ ID NO: 31650
  CDS (1)..(441): transl_table=4

SEQ ID NO: 86132 - protein, 146 aa, Mycoplasma genitalium; identical to SEQ ID NO: 31651

SEQ ID NO: 86133 - DNA, 441 bp, Borrelia burgdorferi (Lyme disease spirochete); identical to SEQ ID NO: 31652
  CDS (1)..(441)

SEQ ID NO: 86134 - protein, 146 aa, Borrelia burgdorferi (Lyme disease spirochete); identical to SEQ ID NO: 31653

SEQ ID NO: 86135 - DNA, 429 bp, Pyrococcus horikoshii; identical to SEQ ID NO: 31654
  CDS (1)..(429)

SEQ ID NO: 86136 - protein, 142 aa, Pyrococcus horikoshii; identical to SEQ ID NO: 31655

SEQ ID NO: 86137 - DNA, 432 bp, Neisseria meningitidis; identical to SEQ ID NO: 31656
  CDS (1)..(432)

SEQ ID NO: 86138 - protein, 143 aa, Neisseria meningitidis; identical to SEQ ID NO: 31657

SEQ ID NO: 86139 - DNA, 429 bp, Vibrio cholerae; identical to SEQ ID NO: 31658
  CDS (1)..(429)

SEQ ID NO: 86140 - protein, 142 aa, Vibrio cholerae; identical to SEQ ID NO: 31659

SEQ ID NO: 86141 - DNA, 423 bp, Methanococcus jannaschii; identical to SEQ ID NO: 31660
  CDS (1)..(423)

SEQ ID NO: 86142 - protein, 140 aa, Methanococcus jannaschii; identical to SEQ ID NO: 31661

SEQ ID NO: 86143 - DNA, 435 bp, Clostridium acetobutylicum; identical to SEQ ID NO: 31662
  CDS (1)..(435)

SEQ ID NO: 86144 - protein, 144 aa, Clostridium acetobutylicum; identical to SEQ ID NO: 31663

SEQ ID NO: 86145 - DNA, 483 bp, Helicobacter pylori; identical to SEQ ID NO: 31664
  CDS (19)..(444)

SEQ ID NO: 86146 - protein, 141 aa, Helicobacter pylori; identical to SEQ ID NO: 31665

SEQ ID NO: 86147 - DNA, 429 bp, Treponema pallidum subsp. pallidum (syphilis spirochete); identical to SEQ ID NO: 31666
  CDS (1)..(429)

SEQ ID NO: 86148 - protein, 142 aa, Treponema pallidum subsp. pallidum (syphilis spirochete); identical to SEQ ID NO: 31667

SEQ ID NO: 86149 - DNA, 849 bp, Methanobacterium thermoautotrophicum; identical to SEQ ID NO: 31668
  CDS (1)..(849)

SEQ ID NO: 86150 - protein, 282 aa, Methanobacterium thermoautotrophicum; identical to SEQ ID NO: 31669

SEQ ID NO: 86151 - DNA, 525 bp, Deinococcus radiodurans; identical to SEQ ID NO: 31670
  CDS (1)..(525)

SEQ ID NO: 86152 - protein, 174 aa, Deinococcus radiodurans; identical to SEQ ID NO: 31671

SEQ ID NO: 86153 - DNA, 426 bp, Campylobacter jejuni; identical to SEQ ID NO: 31672
  CDS (1)..(426)

SEQ ID NO: 86154 - protein, 141 aa, Campylobacter jejuni; identical to SEQ ID NO: 31673

SEQ ID NO: 86155 - DNA, 447 bp, Ureaplasma urealyticum; identical to SEQ ID NO: 31674
  CDS (1)..(447): transl_table=4

SEQ ID NO: 86156 - protein, 148 aa, Ureaplasma urealyticum; identical to SEQ ID NO: 31675

SEQ ID NO: 86157 - DNA, 438 bp, Staphylococcus aureus; identical to SEQ ID NO: 31676
  CDS (1)..(438)

SEQ ID NO: 86158 - protein, 145 aa, Staphylococcus aureus; identical to SEQ ID NO: 31677

SEQ ID NO: 86159 - DNA, 522 bp, Plasmodium falciparum; identical to SEQ ID NO: 31678
  CDS (1)..(522)

SEQ ID NO: 86160 - protein, 173 aa, Plasmodium falciparum; identical to SEQ ID NO: 31679

SEQ ID NO: 86161 - DNA, 468 bp, Rickettsia prowazekii; identical to SEQ ID NO: 31680
  CDS (1)..(468)

SEQ ID NO: 86162 - protein, 155 aa, Rickettsia prowazekii; identical to SEQ ID NO: 31681

SEQ ID NO: 86163 - DNA, 429 bp, Xylella fastidiosa; identical to SEQ ID NO: 31682
  CDS (1)..(429)

SEQ ID NO: 86164 - protein, 142 aa, Xylella fastidiosa; identical to SEQ ID NO: 31683

SEQ ID NO: 86165 - DNA, 438 bp, Halobacterium sp. NRC-1; identical to SEQ ID NO: 31684
  CDS (1)..(438)

SEQ ID NO: 86166 - protein, 145 aa, Halobacterium sp. NRC-1; identical to SEQ ID NO: 31685

SEQ ID NO: 86167 - DNA, 429 bp, Buchnera sp; identical to SEQ ID NO: 31686
  CDS (1)..(429)

SEQ ID NO: 86168 - protein, 142 aa, Buchnera sp; identical to SEQ ID NO: 31687

SEQ ID NO: 86169 - DNA, 447 bp, Lactococcus lactis subsp. lactis; identical to SEQ ID NO: 31688
  CDS (1)..(447)

SEQ ID NO: 86170 - protein, 148 aa, Lactococcus lactis subsp. lactis; identical to SEQ ID NO: 31689

SEQ ID NO: 86171 - DNA, 429 bp, Haemophilus influenzae; identical to SEQ ID NO: 31690
  CDS (1)..(429)

SEQ ID NO: 86172 - protein, 142 aa, Haemophilus influenzae; identical to SEQ ID NO: 31691

SEQ ID NO: 86173 - DNA, 471 bp, Archaeoglobus fulgidus; identical to SEQ ID NO: 31692
  CDS (1)..(471)

SEQ ID NO: 86174 - protein, 156 aa, Archaeoglobus fulgidus; identical to SEQ ID NO: 31693

SEQ ID NO: 86175 - DNA, 438 bp, Bacillus subtilis; identical to SEQ ID NO: 31694
  CDS (1)..(438)

SEQ ID NO: 86176 - protein, 145 aa, Bacillus subtilis; identical to SEQ ID NO: 31695

SEQ ID NO: 86177 - DNA, 450 bp, Thermotoga maritima; identical to SEQ ID NO: 31696
  CDS (1)..(450)

SEQ ID NO: 86178 - protein, 149 aa, Thermotoga maritima; identical to SEQ ID NO: 31697

SEQ ID NO: 86179 - DNA, 468 bp, Aeropyrum pernix; identical to SEQ ID NO: 31698
  CDS (1)..(468)

SEQ ID NO: 86180 - protein, 155 aa, Aeropyrum pernix; identical to SEQ ID NO: 31699

SEQ ID NO: 86181 - DNA, 450 bp, Chlamydophila pneumoniae, Chlamydia pneumoniae; identical to SEQ ID NO: 31700
  CDS (1)..(450)

SEQ ID NO: 86182 - protein, 149 aa, Chlamydophila pneumoniae, Chlamydia pneumoniae; identical to SEQ ID NO: 31701

SEQ ID NO: 86183 - DNA, 435 bp, Mycoplasma pulmonis; identical to SEQ ID NO: 31702
  CDS (1)..(435): transl_table=4

SEQ ID NO: 86184 - protein, 144 aa, Mycoplasma pulmonis; identical to SEQ ID NO: 31703

SEQ ID NO: 86185 - DNA, 447 bp, Streptococcus pneumoniae; identical to SEQ ID NO: 31704
  CDS (1)..(447)

SEQ ID NO: 86186 - protein, 148 aa, Streptococcus pneumoniae; identical to SEQ ID NO: 31705

SEQ ID NO: 86187 - DNA, 435 bp, Aquifex aeolicus; identical to SEQ ID NO: 31706
  CDS (1)..(435)

SEQ ID NO: 86188 - protein, 144 aa, Aquifex aeolicus; identical to SEQ ID NO: 31707

SEQ ID NO: 86189 - DNA, 438 bp, Bacillus halodurans; identical to SEQ ID NO: 31708
  CDS (1)..(438)

SEQ ID NO: 86190 - protein, 145 aa, Bacillus halodurans; identical to SEQ ID NO: 31709

SEQ ID NO: 86191 - DNA, 438 bp, Staphylococcus carnosus; identical to SEQ ID NO: 31710
  CDS (1)..(438)

SEQ ID NO: 86192 - protein, 145 aa, Staphylococcus carnosus; identical to SEQ ID NO: 31711

SEQ ID NO: 86193 - DNA, 438 bp, Sulfolobus acidocaldarius; identical to SEQ ID NO: 31712
  CDS (1)..(438)

SEQ ID NO: 86194 - protein, 145 aa, Sulfolobus acidocaldarius; identical to SEQ ID NO: 31713

SEQ ID NO: 86195 - DNA, 492 bp, Saccharomyces cerevisiae; identical to SEQ ID NO: 31714
  CDS (1)..(492)

SEQ ID NO: 86196 - protein, 163 aa, Saccharomyces cerevisiae; identical to SEQ ID NO: 31715

SEQ ID NO: 86197 - DNA, 444 bp, Mycobacterium leprae; identical to SEQ ID NO: 31716
  CDS (1)..(444)

SEQ ID NO: 86198 - protein, 147 aa, Mycobacterium leprae; identical to SEQ ID NO: 31717

SEQ ID NO: 86199 - DNA, 429 bp, chloroplast Porphyra purpurea; identical to SEQ ID NO: 31718
  CDS (1)..(429)

SEQ ID NO: 86200 - protein, 142 aa, chloroplast Porphyra purpurea; identical to SEQ ID NO: 31719

SEQ ID NO: 86201 - DNA, 450 bp, Sulfolobus solfataricus; identical to SEQ ID NO: 31720
  CDS (1)..(450)

SEQ ID NO: 86202 - protein, 149 aa, Sulfolobus solfataricus; identical to SEQ ID NO: 31721

SEQ ID NO: 86203 - DNA, 456 bp, Synechocystis sp; identical to SEQ ID NO: 31722
  CDS (1)..(456)

SEQ ID NO: 86204 - protein, 151 aa, Synechocystis sp; identical to SEQ ID NO: 31723

SEQ ID NO: 86205 - DNA, 420 bp, chloroplast Odontella sinensis; identical to SEQ ID NO: 31724
  CDS (1)..(420)

SEQ ID NO: 86206 - protein, 139 aa, chloroplast Odontella sinensis; identical to SEQ ID NO: 31725

SEQ ID NO: 86207 - DNA, 444 bp, Streptomyces coelicolor; identical to SEQ ID NO: 31726
  CDS (1)..(444)

SEQ ID NO: 86208 - protein, 147 aa, Streptomyces coelicolor; identical to SEQ ID NO: 31727

SEQ ID NO: 86209 - DNA, 474 bp, Schizosaccharomyces pombe; identical to SEQ ID NO: 31728
  CDS (1)..(474)

SEQ ID NO: 86210 - protein, 157 aa, Schizosaccharomyces pombe; identical to SEQ ID NO: 31729

SEQ ID NO: 86211 - DNA, 540 bp, Burkholderia mallei ATCC 23344; identical to SEQ ID NO: 31730
  CDS (112)..(540)

SEQ ID NO: 86212 - protein, 142 aa, Burkholderia mallei ATCC 23344; identical to SEQ ID NO: 31731

SEQ ID NO: 86213 - DNA, 438 bp, Bacillus cereus ZK; identical to SEQ ID NO: 31732
  CDS (1)..(438)

SEQ ID NO: 86214 - protein, 145 aa, Bacillus cereus ZK; identical to SEQ ID NO: 31733

SEQ ID NO: 86215 - DNA, 462 bp, Bacteroides fragilis; identical to SEQ ID NO: 31734
  CDS (1)..(462)

SEQ ID NO: 86216 - protein, 153 aa, Bacteroides fragilis; identical to SEQ ID NO: 31735

SEQ ID NO: 86217 - DNA, 438 bp, Bacillus licheniformis DSM 13; identical to SEQ ID NO: 31736
  CDS (1)..(438)

SEQ ID NO: 86218 - protein, 145 aa, Bacillus licheniformis DSM 13; identical to SEQ ID NO: 31737

SEQ ID NO: 86219 - DNA, 444 bp, Mannheimia succiniciproducens MBEL55E; identical to SEQ ID NO: 31738
  CDS (1)..(444)

SEQ ID NO: 86220 - protein, 147 aa, Mannheimia succiniciproducens MBEL55E; identical to SEQ ID NO: 31739

SEQ ID NO: 86221 - DNA, 465 bp, Borrelia garinii PBi; identical to SEQ ID NO: 31740
  CDS (1)..(465)

SEQ ID NO: 86222 - protein, 154 aa, Borrelia garinii PBi; identical to SEQ ID NO: 31741

SEQ ID NO: 86223 - DNA, 432 bp, Symbiobacterium thermophilum; identical to SEQ ID NO: 31742
  CDS (1)..(432)

SEQ ID NO: 86224 - protein, 143 aa, Symbiobacterium thermophilum; identical to SEQ ID NO: 31743

SEQ ID NO: 86225 - DNA, 468 bp, Rickettsia typhi; identical to SEQ ID NO: 31744
  CDS (1)..(468)

SEQ ID NO: 86226 - protein, 155 aa, Rickettsia typhi; identical to SEQ ID NO: 31745

SEQ ID NO: 86227 - DNA, 444 bp, Propionibacterium acnes; identical to SEQ ID NO: 31746
  CDS (1)..(444)

SEQ ID NO: 86228 - protein, 147 aa, Propionibacterium acnes; identical to SEQ ID NO: 31747

SEQ ID NO: 86229 - DNA, 447 bp, Leifsonia xyli; identical to SEQ ID NO: 31748
  CDS (1)..(447)

SEQ ID NO: 86230 - protein, 148 aa, Leifsonia xyli; identical to SEQ ID NO: 31749

SEQ ID NO: 86231 - DNA, 429 bp, Desulfotalea psychrophila; identical to SEQ ID NO: 31750
  CDS (1)..(429)

SEQ ID NO: 86232 - protein, 142 aa, Desulfotalea psychrophila; identical to SEQ ID NO: 31751

SEQ ID NO: 86233 - DNA, 432 bp, Gracilaria tenuistipitata var; identical to SEQ ID NO: 31752
  CDS (1)..(432)

SEQ ID NO: 86234 - protein, 143 aa, Gracilaria tenuistipitata var; identical to SEQ ID NO: 31753

SEQ ID NO: 86235 - DNA, 525 bp, Debaryomyces hansenii CBS767; identical to SEQ ID NO: 31754
  CDS (1)..(525)

SEQ ID NO: 86236 - protein, 174 aa, Debaryomyces hansenii CBS767; identical to SEQ ID NO: 31755

SEQ ID NO: 86237 - DNA, 468 bp, Kluyveromyces lactis NRRL Y; identical to SEQ ID NO: 31756
  CDS (1)..(468)

SEQ ID NO: 86238 - protein, 155 aa, Kluyveromyces lactis NRRL Y; identical to SEQ ID NO: 31757

SEQ ID NO: 86239 - DNA, 453 bp, Mesoplasma florum; identical to SEQ ID NO: 31758
  CDS (1)..(453): transl_table=4

SEQ ID NO: 86240 - protein, 150 aa, Mesoplasma florum; identical to SEQ ID NO: 31759

SEQ ID NO: 86241 - DNA, 429 bp, Acinetobacter sp; identical to SEQ ID NO: 31760
  CDS (1)..(429)

SEQ ID NO: 86242 - protein, 142 aa, Acinetobacter sp; identical to SEQ ID NO: 31761

SEQ ID NO: 86243 - DNA, 504 bp, Candida glabrata CBS138; identical to SEQ ID NO: 31762
  CDS (1)..(504)

SEQ ID NO: 86244 - protein, 167 aa, Candida glabrata CBS138; identical to SEQ ID NO: 31763

SEQ ID NO: 86245 - DNA, 465 bp, Bartonella quintana; identical to SEQ ID NO: 31764
  CDS (1)..(465)

SEQ ID NO: 86246 - protein, 154 aa, Bartonella quintana; identical to SEQ ID NO: 31765

SEQ ID NO: 86247 - DNA, 465 bp, Bartonella henselae; identical to SEQ ID NO: 31766
  CDS (1)..(465)

SEQ ID NO: 86248 - protein, 154 aa, Bartonella henselae; identical to SEQ ID NO: 31767

SEQ ID NO: 86249 - DNA, 477 bp, Fremyella diplosiphon; identical to SEQ ID NO: 31768
  CDS (1)..(477)

SEQ ID NO: 86250 - protein, 158 aa, Fremyella diplosiphon; identical to SEQ ID NO: 31769

SEQ ID NO: 86251 - DNA, 435 bp, Mycoplasma mobile; identical to SEQ ID NO: 31770
  CDS (1)..(435): transl_table=4

SEQ ID NO: 86252 - protein, 144 aa, Mycoplasma mobile; identical to SEQ ID NO: 31771

SEQ ID NO: 86253 - DNA, 429 bp, Photobacterium profundum; identical to SEQ ID NO: 31772
  CDS (1)..(429)

SEQ ID NO: 86254 - protein, 142 aa, Photobacterium profundum; identical to SEQ ID NO: 31773

SEQ ID NO: 86255 - DNA, 432 bp, Parachlamydia sp; identical to SEQ ID NO: 31774
  CDS (1)..(432)

SEQ ID NO: 86256 - protein, 143 aa, Parachlamydia sp; identical to SEQ ID NO: 31775

SEQ ID NO: 86257 - DNA, 441 bp, Bdellovibrio bacteriovorus; identical to SEQ ID NO: 31776
  CDS (1)..(441)

SEQ ID NO: 86258 - protein, 146 aa, Bdellovibrio bacteriovorus; identical to SEQ ID NO: 31777

SEQ ID NO: 86259 - DNA, 456 bp, Mycoplasma mycoides; identical to SEQ ID NO: 31778
  CDS (1)..(456): transl_table=4

SEQ ID NO: 86260 - protein, 151 aa, Mycoplasma mycoides; identical to SEQ ID NO: 31779

SEQ ID NO: 86261 - DNA, 444 bp, Corynebacterium diphtheriae; identical to SEQ ID NO: 31780
  CDS (1)..(444)

SEQ ID NO: 86262 - protein, 147 aa, Corynebacterium diphtheriae; identical to SEQ ID NO: 31781

SEQ ID NO: 86263 - DNA, 459 bp, Onion yellows phytoplasma; identical to SEQ ID NO: 31782
  CDS (1)..(459)

SEQ ID NO: 86264 - protein, 152 aa, Onion yellows phytoplasma; identical to SEQ ID NO: 31783

SEQ ID NO: 86265 - DNA, 435 bp, Desulfovibrio vulgaris; identical to SEQ ID NO: 31784
  CDS (1)..(435)

SEQ ID NO: 86266 - protein, 144 aa, Desulfovibrio vulgaris; identical to SEQ ID NO: 31785

SEQ ID NO: 86267 - DNA, 492 bp, Thermus thermophilus; identical to SEQ ID NO: 31786
  CDS (1)..(492)

SEQ ID NO: 86268 - protein, 163 aa, Thermus thermophilus; identical to SEQ ID NO: 31787

SEQ ID NO: 86269 - DNA, 450 bp, Leptospira interrogans; identical to SEQ ID NO: 31788
  CDS (1)..(450)

SEQ ID NO: 86270 - protein, 149 aa, Leptospira interrogans; identical to SEQ ID NO: 31789

SEQ ID NO: 86271 - DNA, 438 bp, Bacillus cereus; identical to SEQ ID NO: 31790
  CDS (1)..(438)

SEQ ID NO: 86272 - protein, 145 aa, Bacillus cereus; identical to SEQ ID NO: 31791

SEQ ID NO: 86273 - DNA, 459 bp, Wolbachia pipientis wMel; identical to SEQ ID NO: 31792
  CDS (1)..(459)

SEQ ID NO: 86274 - protein, 152 aa, Wolbachia pipientis wMel; identical to SEQ ID NO: 31793

SEQ ID NO: 86275 - DNA, 429 bp, Treponema denticola; identical to SEQ ID NO: 31794
  CDS (1)..(429)

SEQ ID NO: 86276 - protein, 142 aa, Treponema denticola; identical to SEQ ID NO: 31795

SEQ ID NO: 86277 - DNA, 444 bp, Mycobacterium paratuberculosis; identical to SEQ ID NO: 31796
  CDS (1)..(444)

SEQ ID NO: 86278 - protein, 147 aa, Mycobacterium paratuberculosis; identical to SEQ ID NO: 31797

SEQ ID NO: 86279 - DNA, 432 bp, Geobacter sulfurreducens; identical to SEQ ID NO: 31798
  CDS (1)..(432)

SEQ ID NO: 86280 - protein, 143 aa, Geobacter sulfurreducens; identical to SEQ ID NO: 31799

SEQ ID NO: 86281 - DNA, 444 bp, Lactobacillus johnsonii; identical to SEQ ID NO: 31800
  CDS (1)..(444)

SEQ ID NO: 86282 - protein, 147 aa, Lactobacillus johnsonii; identical to SEQ ID NO: 31801

SEQ ID NO: 86283 - DNA, 489 bp, Nanoarchaeum equitans; identical to SEQ ID NO: 31802
  CDS (1)..(489)

SEQ ID NO: 86284 - protein, 162 aa, Nanoarchaeum equitans; identical to SEQ ID NO: 31803

SEQ ID NO: 86285 - DNA, 471 bp, Ashbya gossypii; identical to SEQ ID NO: 31804
  CDS (1)..(471)

SEQ ID NO: 86286 - protein, 156 aa, Ashbya gossypii; identical to SEQ ID NO: 31805

SEQ ID NO: 86287 - DNA, 690 bp, Oryza sativa; identical to SEQ ID NO: 31806
  CDS (1)..(690)

SEQ ID NO: 86288 - protein, 229 aa, Oryza sativa; identical to SEQ ID NO: 31807

SEQ ID NO: 86289 - DNA, 420 bp, Wolinella succinogenes; identical to SEQ ID NO: 31808
  CDS (1)..(420)

SEQ ID NO: 86290 - protein, 139 aa, Wolinella succinogenes; identical to SEQ ID NO: 31809

SEQ ID NO: 86291 - DNA, 429 bp, Vibrio vulnificus; identical to SEQ ID NO: 31810
  CDS (1)..(429)

SEQ ID NO: 86292 - protein, 142 aa, Vibrio vulnificus; identical to SEQ ID NO: 31811

SEQ ID NO: 86293 - DNA, 456 bp, Porphyromonas gingivalis; identical to SEQ ID NO: 31812
  CDS (1)..(456)

SEQ ID NO: 86294 - protein, 151 aa, Porphyromonas gingivalis; identical to SEQ ID NO: 31813

SEQ ID NO: 86295 - DNA, 429 bp, Photorhabdus luminescens; identical to SEQ ID NO: 31814
  CDS (1)..(429)

SEQ ID NO: 86296 - protein, 142 aa, Photorhabdus luminescens; identical to SEQ ID NO: 31815

SEQ ID NO: 86297 - DNA, 459 bp, Gloeobacter violaceus; identical to SEQ ID NO: 31816
  CDS (1)..(459)

SEQ ID NO: 86298 - protein, 152 aa, Gloeobacter violaceus; identical to SEQ ID NO: 31817

SEQ ID NO: 86299 - DNA, 429 bp, Chromobacterium violaceum; identical to SEQ ID NO: 31818
  CDS (1)..(429)

SEQ ID NO: 86300 - protein, 142 aa, Chromobacterium violaceum; identical to SEQ ID NO: 31819

SEQ ID NO: 86301 - DNA, 552 bp, Neurospora crassa; identical to SEQ ID NO: 31820
  CDS (1)..(552)

SEQ ID NO: 86302 - protein, 183 aa, Neurospora crassa; identical to SEQ ID NO: 31821

SEQ ID NO: 86303 - DNA, 453 bp, Synechococcus sp; identical to SEQ ID NO: 31822
  CDS (1)..(453)

SEQ ID NO: 86304 - protein, 150 aa, Synechococcus sp; identical to SEQ ID NO: 31823

SEQ ID NO: 86305 - DNA, 456 bp, Rhodopirellula baltica; identical to SEQ ID NO: 31824
  CDS (1)..(456)

SEQ ID NO: 86306 - protein, 151 aa, Rhodopirellula baltica; identical to SEQ ID NO: 31825

SEQ ID NO: 86307 - DNA, 432 bp, Prochlorococcus marinus subsp; identical to SEQ ID NO: 31826
  CDS (1)..(432)

SEQ ID NO: 86308 - protein, 143 aa, Prochlorococcus marinus subsp; identical to SEQ ID NO: 31827

SEQ ID NO: 86309 - DNA, 453 bp, Prochlorococcus marinus; identical to SEQ ID NO: 31828
  CDS (1)..(453)

SEQ ID NO: 86310 - protein, 150 aa, Prochlorococcus marinus; identical to SEQ ID NO: 31829

SEQ ID NO: 86311 - DNA, 453 bp, Prochlorococcus marinus; identical to SEQ ID NO: 31830
  CDS (1)..(453)

SEQ ID NO: 86312 - protein, 150 aa, Prochlorococcus marinus; identical to SEQ ID NO: 31831

SEQ ID NO: 86313 - DNA, 429 bp, Helicobacter hepaticus; identical to SEQ ID NO: 31832
  CDS (1)..(429)

SEQ ID NO: 86314 - protein, 142 aa, Helicobacter hepaticus; identical to SEQ ID NO: 31833

SEQ ID NO: 86315 - DNA, 423 bp, Haemophilus ducreyi; identical to SEQ ID NO: 31834
  CDS (1)..(423)

SEQ ID NO: 86316 - protein, 140 aa, Haemophilus ducreyi; identical to SEQ ID NO: 31835

SEQ ID NO: 86317 - DNA, 420 bp, Candidatus Blochmannia floridanus; identical to SEQ ID NO: 31836
  CDS (1)..(420)

SEQ ID NO: 86318 - protein, 139 aa, Candidatus Blochmannia floridanus; identical to SEQ ID NO: 31837

SEQ ID NO: 86319 - DNA, 429 bp, Bordetella pertussis; identical to SEQ ID NO: 31838
  CDS (1)..(429)

SEQ ID NO: 86320 - protein, 142 aa, Bordetella pertussis; identical to SEQ ID NO: 31839

SEQ ID NO: 86321 - DNA, 618 bp, Arabidopsis thaliana; identical to SEQ ID NO: 31840
  CDS (1)..(618)

SEQ ID NO: 86322 - protein, 205 aa, Arabidopsis thaliana; identical to SEQ ID NO: 31841

SEQ ID NO: 86323 - DNA, 1001 bp, Chlorarachnion sp; identical to SEQ ID NO: 31842
  CDS (48)..(869)

SEQ ID NO: 86324 - protein, 273 aa, Chlorarachnion sp; identical to SEQ ID NO: 31843

SEQ ID NO: 86325 - DNA, 453 bp, Chlamydophila caviae; identical to SEQ ID NO: 31844
  CDS (1)..(453)

SEQ ID NO: 86326 - protein, 150 aa, Chlamydophila caviae; identical to SEQ ID NO: 31845

SEQ ID NO: 86327 - DNA, 444 bp, Streptomyces avermitilis; identical to SEQ ID NO: 31846
  CDS (1)..(444)

SEQ ID NO: 86328 - protein, 147 aa, Streptomyces avermitilis; identical to SEQ ID NO: 31847

SEQ ID NO: 86329 - DNA, 435 bp, Nitrosomonas europaea; identical to SEQ ID NO: 31848
  CDS (1)..(435)

SEQ ID NO: 86330 - protein, 144 aa, Nitrosomonas europaea; identical to SEQ ID NO: 31849

SEQ ID NO: 86331 - DNA, 429 bp, Coxiella burnetii; identical to SEQ ID NO: 31850
  CDS (1)..(429)

SEQ ID NO: 86332 - protein, 142 aa, Coxiella burnetii; identical to SEQ ID NO: 31851

SEQ ID NO: 86333 - DNA, 426 bp, Tropheryma whipplei; identical to SEQ ID NO: 31852
  CDS (1)..(426)

SEQ ID NO: 86334 - protein, 141 aa, Tropheryma whipplei; identical to SEQ ID NO: 31853

SEQ ID NO: 86335 - DNA, 603 bp, Dictyostelium discoideum; identical to SEQ ID NO: 31854
  CDS (1)..(603)

SEQ ID NO: 86336 - protein, 200 aa, Dictyostelium discoideum; identical to SEQ ID NO: 31855

SEQ ID NO: 86337 - DNA, 429 bp, Xylella fastidiosa; identical to SEQ ID NO: 31856
  CDS (1)..(429)

SEQ ID NO: 86338 - protein, 142 aa, Xylella fastidiosa; identical to SEQ ID NO: 31857

SEQ ID NO: 86339 - DNA, 429 bp, Vibrio parahaemolyticus; identical to SEQ ID NO: 31858
  CDS (1)..(429)

SEQ ID NO: 86340 - protein, 142 aa, Vibrio parahaemolyticus; identical to SEQ ID NO: 31859

SEQ ID NO: 86341 - DNA, 429 bp, Pseudomonas syringae; identical to SEQ ID NO: 31860
  CDS (1)..(429)

SEQ ID NO: 86342 - protein, 142 aa, Pseudomonas syringae; identical to SEQ ID NO: 31861

SEQ ID NO: 86343 - DNA, 444 bp, Lactobacillus plantarum; identical to SEQ ID NO: 31862
  CDS (1)..(444)

SEQ ID NO: 86344 - protein, 147 aa, Lactobacillus plantarum; identical to SEQ ID NO: 31863

SEQ ID NO: 86345 - DNA, 435 bp, Clostridium tetani; identical to SEQ ID NO: 31864
  CDS (1)..(435)

SEQ ID NO: 86346 - protein, 144 aa, Clostridium tetani; identical to SEQ ID NO: 31865

SEQ ID NO: 86347 - DNA, 462 bp, Bacteroides thetaiotaomicron; identical to SEQ ID NO: 31866
  CDS (1)..(462)

SEQ ID NO: 86348 - protein, 153 aa, Bacteroides thetaiotaomicron; identical to SEQ ID NO: 31867

SEQ ID NO: 86349 - DNA, 438 bp, Staphylococcus epidermidis; identical to SEQ ID NO: 31868
  CDS (1)..(438)

SEQ ID NO: 86350 - protein, 145 aa, Staphylococcus epidermidis; identical to SEQ ID NO: 31869

SEQ ID NO: 86351 - DNA, 444 bp, Yersinia pestis; identical to SEQ ID NO: 31870
  CDS (1)..(444)

SEQ ID NO: 86352 - protein, 147 aa, Yersinia pestis; identical to SEQ ID NO: 31871

SEQ ID NO: 86353 - DNA, 429 bp, Wigglesworthia glossinidia brevipalpis; identical to SEQ ID NO: 31872
  CDS (1)..(429)

SEQ ID NO: 86354 - protein, 142 aa, Wigglesworthia glossinidia brevipalpis; identical to SEQ ID NO: 31873

SEQ ID NO: 86355 - DNA, 459 bp, Synechococcus elongatus; identical to SEQ ID NO: 31874
  CDS (1)..(459)

SEQ ID NO: 86356 - protein, 152 aa, Synechococcus elongatus; identical to SEQ ID NO: 31875

SEQ ID NO: 86357 - DNA, 447 bp, Streptococcus mutans; identical to SEQ ID NO: 31876
  CDS (1)..(447)

SEQ ID NO: 86358 - protein, 148 aa, Streptococcus mutans; identical to SEQ ID NO: 31877

SEQ ID NO: 86359 - DNA, 447 bp, Streptococcus agalactiae; identical to SEQ ID NO: 31878
  CDS (1)..(447)

SEQ ID NO: 86360 - protein, 148 aa, Streptococcus agalactiae; identical to SEQ ID NO: 31879

SEQ ID NO: 86361 - DNA, 429 bp, Shewanella oneidensis; identical to SEQ ID NO: 31880
  CDS (1)..(429)

SEQ ID NO: 86362 - protein, 142 aa, Shewanella oneidensis; identical to SEQ ID NO: 31881

SEQ ID NO: 86363 - DNA, 438 bp, Oceanobacillus iheyensis; identical to SEQ ID NO: 31882
  CDS (1)..(438)

SEQ ID NO: 86364 - protein, 145 aa, Oceanobacillus iheyensis; identical to SEQ ID NO: 31883

SEQ ID NO: 86365 - DNA, 441 bp, Mycoplasma penetrans; identical to SEQ ID NO: 31884
  CDS (1)..(441): transl_table=4

SEQ ID NO: 86366 - protein, 146 aa, Mycoplasma penetrans; identical to SEQ ID NO: 31885

SEQ ID NO: 86367 - DNA, 444 bp, Corynebacterium efficiens; identical to SEQ ID NO: 31886
  CDS (1)..(444)

SEQ ID NO: 86368 - protein, 147 aa, Corynebacterium efficiens; identical to SEQ ID NO: 31887

SEQ ID NO: 86369 - DNA, 465 bp, Brucella suis; identical to SEQ ID NO: 31888
  CDS (1)..(465)

SEQ ID NO: 86370 - protein, 154 aa, Brucella suis; identical to SEQ ID NO: 31889

SEQ ID NO: 86371 - DNA, 450 bp, Bifidobacterium longum; identical to SEQ ID NO: 31890
  CDS (1)..(450)

SEQ ID NO: 86372 - protein, 149 aa, Bifidobacterium longum; identical to SEQ ID NO: 31891

SEQ ID NO: 86373 - DNA, 447 bp, Streptococcus pyogenes; identical to SEQ ID NO: 31892
  CDS (1)..(447)

SEQ ID NO: 86374 - protein, 148 aa, Streptococcus pyogenes; identical to SEQ ID NO: 31893

SEQ ID NO: 86375 - DNA, 453 bp, Chlorobium tepidum; identical to SEQ ID NO: 31894
  CDS (1)..(453)

SEQ ID NO: 86376 - protein, 150 aa, Chlorobium tepidum; identical to SEQ ID NO: 31895

SEQ ID NO: 86377 - DNA, 375 bp, Candidatus Tremblaya princeps; identical to SEQ ID NO: 31896
  CDS (1)..(375)

SEQ ID NO: 86378 - protein, 124 aa, Candidatus Tremblaya princeps; identical to SEQ ID NO: 31897

SEQ ID NO: 86379 - DNA, 429 bp, Xanthomonas axonopodis; identical to SEQ ID NO: 31898
  CDS (1)..(429)

SEQ ID NO: 86380 - protein, 142 aa, Xanthomonas axonopodis; identical to SEQ ID NO: 31899

SEQ ID NO: 86381 - DNA, 444 bp, Corynebacterium glutamicum; identical to SEQ ID NO: 31900
  CDS (1)..(444)

SEQ ID NO: 86382 - protein, 147 aa, Corynebacterium glutamicum; identical to SEQ ID NO: 31901

SEQ ID NO: 86383 - DNA, 429 bp, Streptococcus pyogenes; identical to SEQ ID NO: 31902
  CDS (1)..(429)

SEQ ID NO: 86384 - protein, 142 aa, Streptococcus pyogenes; identical to SEQ ID NO: 31903

SEQ ID NO: 86385 - DNA, 489 bp, Methanosarcina mazei; identical to SEQ ID NO: 31904
  CDS (1)..(489)

SEQ ID NO: 86386 - protein, 162 aa, Methanosarcina mazei; identical to SEQ ID NO: 31905

SEQ ID NO: 86387 - DNA, 432 bp, Thermoanaerobacter tengcongensis; identical to SEQ ID NO: 31906
  CDS (1)..(432)

SEQ ID NO: 86388 - protein, 143 aa, Thermoanaerobacter tengcongensis; identical to SEQ ID NO: 31907

SEQ ID NO: 86389 - DNA, 435 bp, Fusobacterium nucleatum; identical to SEQ ID NO: 31908
  CDS (1)..(435)

SEQ ID NO: 86390 - protein, 144 aa, Fusobacterium nucleatum; identical to SEQ ID NO: 31909

SEQ ID NO: 86391 - DNA, 432 bp, Methanosarcina acetivorans; identical to SEQ ID NO: 31910
  CDS (1)..(432)

SEQ ID NO: 86392 - protein, 143 aa, Methanosarcina acetivorans; identical to SEQ ID NO: 31911

SEQ ID NO: 86393 - DNA, 480 bp, Methanopyrus kandleri; identical to SEQ ID NO: 31912
  CDS (1)..(480)

SEQ ID NO: 86394 - protein, 159 aa, Methanopyrus kandleri; identical to SEQ ID NO: 31913

SEQ ID NO: 86395 - DNA, 429 bp, Pyrococcus furiosus; identical to SEQ ID NO: 31914
  CDS (1)..(429)

SEQ ID NO: 86396 - protein, 142 aa, Pyrococcus furiosus; identical to SEQ ID NO: 31915

SEQ ID NO: 86397 - DNA, 435 bp, Clostridium perfringens; identical to SEQ ID NO: 31916
  CDS (1)..(435)

SEQ ID NO: 86398 - protein, 144 aa, Clostridium perfringens; identical to SEQ ID NO: 31917

SEQ ID NO: 86399 - DNA, 429 bp, Ralstonia solanacearum; identical to SEQ ID NO: 31918
  CDS (1)..(429)

SEQ ID NO: 86400 - protein, 142 aa, Ralstonia solanacearum; identical to SEQ ID NO: 31919

SEQ ID NO: 86401 - DNA, 564 bp, Pyrobaculum aerophilum; identical to SEQ ID NO: 31920
  CDS (1)..(564)

SEQ ID NO: 86402 - protein, 187 aa, Pyrobaculum aerophilum; identical to SEQ ID NO: 31921

SEQ ID NO: 86403 - DNA, 465 bp, Rhizobium meliloti; identical to SEQ ID NO: 31922
  CDS (1)..(465)

SEQ ID NO: 86404 - protein, 154 aa, Rhizobium meliloti; identical to SEQ ID NO: 31923

SEQ ID NO: 86405 - DNA, 702 bp, Oryza sativa; identical to SEQ ID NO: 31924
  CDS (1)..(702)

SEQ ID NO: 86406 - protein, 233 aa, Oryza sativa; identical to SEQ ID NO: 31925

SEQ ID NO: 86407 - DNA, 465 bp, Rhizobium loti; identical to SEQ ID NO: 31926
  CDS (1)..(465)

SEQ ID NO: 86408 - protein, 154 aa, Rhizobium loti; identical to SEQ ID NO: 31927

SEQ ID NO: 86409 - DNA, 429 bp, Pasteurella multocida; identical to SEQ ID NO: 31928
  CDS (1)..(429)

SEQ ID NO: 86410 - protein, 142 aa, Pasteurella multocida; identical to SEQ ID NO: 31929

SEQ ID NO: 86411 - DNA, 846 bp, Ceratopteris richardii; identical to SEQ ID NO: 31930
  CDS (54)..(479): n means a or g or c or t/u

SEQ ID NO: 86412 - protein, 141 aa, Ceratopteris richardii; identical to SEQ ID NO: 31931
  misc_feature (101)..(101): Xaa can be Arg or Gln or Leu or Pro
  misc_feature (134)..(134): Xaa can be Asn or Asp or His or Tyr

SEQ ID NO: 86413 - DNA, 414 bp, Arabidopsis thaliana; identical to SEQ ID NO: 31932
  CDS (1)..(414)

SEQ ID NO: 86414 - protein, 137 aa, Arabidopsis thaliana; identical to SEQ ID NO: 31933

SEQ ID NO: 86415 - DNA, 432 bp, Cyanidium caldarium; identical to SEQ ID NO: 31934
  CDS (1)..(432)

SEQ ID NO: 86416 - protein, 143 aa, Cyanidium caldarium; identical to SEQ ID NO: 31935

SEQ ID NO: 86417 - DNA, 432 bp, Guillardia theta; identical to SEQ ID NO: 31936
  CDS (1)..(432)

SEQ ID NO: 86418 - protein, 143 aa, Guillardia theta; identical to SEQ ID NO: 31937

SEQ ID NO: 86419 - DNA, 435 bp, Buchnera aphidicola; identical to SEQ ID NO: 31938
  CDS (1)..(435)

SEQ ID NO: 86420 - protein, 144 aa, Buchnera aphidicola; identical to SEQ ID NO: 31939

SEQ ID NO: 86421 - DNA, 618 bp, Drosophila melanogaster; identical to SEQ ID NO: 31940
  CDS (31)..(567)

SEQ ID NO: 86422 - protein, 178 aa, Drosophila melanogaster; identical to SEQ ID NO: 31941

SEQ ID NO: 86423 - DNA, 839 bp, Homo sapiens; identical to SEQ ID NO: 31942
  CDS (40)..(576)

SEQ ID NO: 86424 - protein, 178 aa, Homo sapiens; identical to SEQ ID NO: 31943

SEQ ID NO: 86425 - DNA, 26 bp, Primer
atgaaaacttttacagctaaaccaga

SEQ ID NO: 86426 - DNA, 24 bp, Primer
ttagatgtcaagaacttgcggttg

SEQ ID NO: 86427 - protein, 162 aa, consensus; identical to SEQ ID NO: 31946
  MISC_FEATURE (1)..(162): consensus for the disclosure of xaa see table XV

SEQ ID NO: 86428 - protein, 58 aa, consensus; identical to SEQ ID NO: 31947
  MISC_FEATURE (1)..(58): consensus for the disclosure of xaa see table XV

SEQ ID NO: 86429 - protein, 26 aa, consensus
  MISC_FEATURE (1)..(26): consensus for the disclosure of xaa see table XV
XXXXXXXMXXXXXXXXXXXXXXXXXX

SEQ ID NO: 86430 - DNA, 159 bp, Escherichia coli; identical to SEQ ID NO: 57058
  CDS (1)..(159)

SEQ ID NO: 86431 - protein, 52 aa, Escherichia coli; identical to SEQ ID NO: 57059

SEQ ID NO: 86432 - DNA, 25 bp, Primer
atgaacggtgctacctccttatatg

SEQ ID NO: 86433 - DNA, 26 bp, Primer
ttattctggctcattcaataattgcg

SEQ ID NO: 86434 - DNA, 1425 bp, Escherichia coli K12; identical to SEQ ID NO: 28717
  CDS (1)..(1425)

SEQ ID NO: 86435 - protein, 474 aa, Escherichia coli K12; identical to SEQ ID NO: 28718

SEQ ID NO: 86436 - DNA, 1401 bp, Haemophilus influenzae; identical to SEQ ID NO: 28719
  CDS (1)..(1401)

SEQ ID NO: 86437 - protein, 466 aa, Haemophilus influenzae; identical to SEQ ID NO: 28720

SEQ ID NO: 86438 - DNA, 1350 bp, Bacillus subtilis; identical to SEQ ID NO: 28721
  CDS (1)..(1350)

SEQ ID NO: 86439 - protein, 449 aa, Bacillus subtilis; identical to SEQ ID NO: 28722

SEQ ID NO: 86440 - DNA, 1545 bp, Xylella fastidiosa; identical to SEQ ID NO: 28723
  CDS (1)..(1545)

SEQ ID NO: 86441 - protein, 514 aa, Xylella fastidiosa; identical to SEQ ID NO: 28724

SEQ ID NO: 86442 - DNA, 1251 bp, Nostoc sp. PCC 7120; identical to SEQ ID NO: 28725
  CDS (1)..(1251)

SEQ ID NO: 86443 - protein, 416 aa, Nostoc sp. PCC 7120; identical to SEQ ID NO: 28726

SEQ ID NO: 86444 - DNA, 1428 bp, Salmonella enterica subsp. enterica serovar Typhi; identical to SEQ ID NO: 28727
  CDS (1)..(1428)

SEQ ID NO: 86445 - protein, 475 aa, Salmonella enterica subsp. enterica serovar Typhi; identical to SEQ ID NO: 28728

SEQ ID NO: 86446 - DNA, 1290 bp, Nostoc sp. PCC 7120; identical to SEQ ID NO: 28729
  CDS (1)..(1290)

SEQ ID NO: 86447 - protein, 429 aa, Nostoc sp. PCC 7120; identical to SEQ ID NO: 28730

SEQ ID NO: 86448 - DNA, 1206 bp, Nostoc sp. PCC 7120; identical to SEQ ID NO: 28731
  CDS (1)..(1206)

SEQ ID NO: 86449 - protein, 401 aa, Nostoc sp. PCC 7120; identical to SEQ ID NO: 28732

SEQ ID NO: 86450 - DNA, 1545 bp, Agrobacterium tumefaciens; identical to SEQ ID NO: 28733
  CDS (1)..(1545)

SEQ ID NO: 86451 - protein, 514 aa, Agrobacterium tumefaciens; identical to SEQ ID NO: 28734

SEQ ID NO: 86452 - DNA, 1446 bp, Yersinia pestis; identical to SEQ ID NO: 28735
  CDS (1)..(1446)

SEQ ID NO: 86453 - protein, 481 aa, Yersinia pestis; identical to SEQ ID NO: 28736

SEQ ID NO: 86454 - DNA, 1572 bp, Agrobacterium tumefaciens; identical to SEQ ID NO: 28737
  CDS (1)..(1572)

SEQ ID NO: 86455 - protein, 523 aa, Agrobacterium tumefaciens; identical to SEQ ID NO: 28738

SEQ ID NO: 86456 - DNA, 1407 bp, Agrobacterium tumefaciens; identical to SEQ ID NO: 28739
  CDS (1)..(1407)

SEQ ID NO: 86457 - protein, 468 aa, Agrobacterium tumefaciens; identical to SEQ ID NO: 28740

SEQ ID NO: 86458 - DNA, 1425 bp, Brucella melitensis; identical to SEQ ID NO: 28741
  CDS (1)..(1425)

SEQ ID NO: 86459 - protein, 474 aa, Brucella melitensis; identical to SEQ ID NO: 28742

SEQ ID NO: 86460 - DNA, 1362 bp, Aquifex aeolicus; identical to SEQ ID NO: 28743
  CDS (1)..(1362)

SEQ ID NO: 86461 - protein, 453 aa, Aquifex aeolicus; identical to SEQ ID NO: 28744

SEQ ID NO: 86462 - DNA, 1500 bp, Neisseria meningitidis; identical to SEQ ID NO: 28745
  CDS (1)..(1500)

SEQ ID NO: 86463 - protein, 499 aa, Neisseria meningitidis; identical to SEQ ID NO: 28746

SEQ ID NO: 86464 - DNA, 1170 bp, Pseudomonas aeruginosa; identical to SEQ ID NO: 28747
  CDS (1)..(1170)

SEQ ID NO: 86465 - protein, 389 aa, Pseudomonas aeruginosa; identical to SEQ ID NO: 28748

SEQ ID NO: 86466 - DNA, 1407 bp, Sinorhizobium meliloti; identical to SEQ ID NO: 28749
  CDS (1)..(1407)

SEQ ID NO: 86467 - protein, 468 aa, Sinorhizobium meliloti; identical to SEQ ID NO: 28750

SEQ ID NO: 86468 - DNA, 1332 bp, Helicobacter pylori; identical to SEQ ID NO: 28751
  CDS (1)..(1332)

SEQ ID NO: 86469 - protein, 443 aa, Helicobacter pylori; identical to SEQ ID NO: 28752

SEQ ID NO: 86470 - DNA, 1419 bp, Caulobacter crescentus; identical to SEQ ID NO: 28753
  CDS (1)..(1419)

SEQ ID NO: 86471 - protein, 472 aa, Caulobacter crescentus; identical to SEQ ID NO: 28754

SEQ ID NO: 86472 - DNA, 1446 bp, Xylella fastidiosa; identical to SEQ ID NO: 28755
  CDS (1)..(1446)

SEQ ID NO: 86473 - protein, 481 aa, Xylella fastidiosa; identical to SEQ ID NO: 28756

SEQ ID NO: 86474 - DNA, 1458 bp, Treponema pallidum subsp. pallidum (syphilis spirochete); identical to SEQ ID NO: 28757
  CDS (1)..(1458)

SEQ ID NO: 86475 - protein, 485 aa, Treponema pallidum subsp. pallidum (syphilis spirochete); identical to SEQ ID NO: 28758

SEQ ID NO: 86476 - DNA, 1380 bp, Thermotoga maritima; identical to SEQ ID NO: 28759
  CDS (1)..(1380)

SEQ ID NO: 86477 - protein, 459 aa, Thermotoga maritima; identical to SEQ ID NO: 28760

SEQ ID NO: 86478 - DNA, 1371 bp, Vibrio cholerae; identical to SEQ ID NO: 28761
  CDS (1)..(1371)

SEQ ID NO: 86479 - protein, 456 aa, Vibrio cholerae; identical to SEQ ID NO: 28762

SEQ ID NO: 86480 - DNA, 1961 bp, Pseudomonas aeruginosa; identical to SEQ ID NO: 28763
  CDS (496)..(1920)

SEQ ID NO: 86481 - protein, 474 aa, Pseudomonas aeruginosa; identical to SEQ ID NO: 28764

SEQ ID NO: 86482 - DNA, 1593 bp, Caulobacter crescentus; identical to SEQ ID NO: 28765
  CDS (1)..(1593)

SEQ ID NO: 86483 - protein, 530 aa, Caulobacter crescentus; identical to SEQ ID NO: 28766

SEQ ID NO: 86484 - DNA, 1536 bp, Rickettsia conorii; identical to SEQ ID NO: 28767
  CDS (1)..(1536)

SEQ ID NO: 86485 - protein, 511 aa, Rickettsia conorii; identical to SEQ ID NO: 28768

SEQ ID NO: 86486 - DNA, 1452 bp, Borrelia burgdorferi (Lyme disease spirochete); identical to SEQ ID NO: 28769
  CDS (1)..(1452)

SEQ ID NO: 86487 - protein, 483 aa, Borrelia burgdorferi (Lyme disease spirochete); identical to SEQ ID NO: 28770

SEQ ID NO: 86488 - DNA, 1494 bp, Chlamydia trachomatis; identical to SEQ ID NO: 28771
  CDS (1)..(1494)

SEQ ID NO: 86489 - protein, 497 aa, Chlamydia trachomatis; identical to SEQ ID NO: 28772

SEQ ID NO: 86490 - DNA, 1431 bp, Helicobacter pylori; identical to SEQ ID NO: 28773
  CDS (1)..(1431)

SEQ ID NO: 86491 - protein, 476 aa, Helicobacter pylori; identical to SEQ ID NO: 28774

SEQ ID NO: 86492 - DNA, 1302 bp, Clostridium acetobutylicum; identical to SEQ ID NO: 28775
  CDS (1)..(1302)

SEQ ID NO: 86493 - protein, 433 aa, Clostridium acetobutylicum; identical to SEQ ID NO: 28776

SEQ ID NO: 86494 - DNA, 2009 bp, Brucella abortus; identical to SEQ ID NO: 28777
  CDS (275)..(1816)

SEQ ID NO: 86495 - protein, 513 aa, Brucella abortus; identical to SEQ ID NO: 28778

SEQ ID NO: 86496 - DNA, 1185 bp, Synechocystis sp; identical to SEQ ID NO: 28779
  CDS (1)..(1185)

SEQ ID NO: 86497 - protein, 394 aa, Synechocystis sp; identical to SEQ ID NO: 28780

SEQ ID NO: 86498 - DNA, 1251 bp, Synechocystis sp; identical to SEQ ID NO: 28781
  CDS (1)..(1251)

SEQ ID NO: 86499 - protein, 416 aa, Synechocystis sp; identical to SEQ ID NO: 28782

SEQ ID NO: 86500 - DNA, 1359 bp, Synechocystis sp; identical to SEQ ID NO: 28783
  CDS (1)..(1359)

SEQ ID NO: 86501 - protein, 452 aa, Synechocystis sp; identical to SEQ ID NO: 28784

SEQ ID NO: 86502 - DNA, 1740 bp, Lactococcus lactis; identical to SEQ ID NO: 28785
  CDS (230)..(1456)

SEQ ID NO: 86503 - protein, 408 aa, Lactococcus lactis; identical to SEQ ID NO: 28786

SEQ ID NO: 86504 - DNA, 1383 bp, Rhodobacter capsulatus; identical to SEQ ID NO: 28787
  CDS (1)..(1383)

SEQ ID NO: 86505 - protein, 460 aa, Rhodobacter capsulatus; identical to SEQ ID NO: 28788

SEQ ID NO: 86506 - DNA, 1392 bp, Haemophilus influenzae; identical to SEQ ID NO: 28789
  CDS (1)..(1392)

SEQ ID NO: 86507 - protein, 463 aa, Haemophilus influenzae; identical to SEQ ID NO: 28790

SEQ ID NO: 86508 - DNA, 1800 bp, Yersinia enterocolitica; identical to SEQ ID NO: 28791
  CDS (244)..(1680)

SEQ ID NO: 86509 - protein, 478 aa, Yersinia enterocolitica; identical to SEQ ID NO: 28792

SEQ ID NO: 86510 - DNA, 2027 bp, Azotobacter vinelandii; identical to SEQ ID NO: 28793
  CDS (483)..(1904)

SEQ ID NO: 86511 - protein, 473 aa, Azotobacter vinelandii; identical to SEQ ID NO: 28794

SEQ ID NO: 86512 - DNA, 1905 bp, Brucella abortus; identical to SEQ ID NO: 28795
  CDS (333)..(1835)

SEQ ID NO: 86513 - protein, 500 aa, Brucella abortus; identical to SEQ ID NO: 28796

SEQ ID NO: 86514 - DNA, 1466 bp, Campylobacter jejuni; identical to SEQ ID NO: 28797
  CDS (48)..(1466)

SEQ ID NO: 86515 - protein, 472 aa, Campylobacter jejuni; identical to SEQ ID NO: 28798

SEQ ID NO: 86516 - DNA, 1191 bp, Pseudomonas aeruginosa; identical to SEQ ID NO: 28799
  CDS (14)..(1183)

SEQ ID NO: 86517 - protein, 389 aa, Pseudomonas aeruginosa; identical to SEQ ID NO: 28800

SEQ ID NO: 86518 - DNA, 1488 bp, Burkholderia mallei ATCC 23344; identical to SEQ ID NO: 28801
  CDS (1)..(1488)

SEQ ID NO: 86519 - protein, 495 aa, Burkholderia mallei ATCC 23344; identical to SEQ ID NO: 28802

SEQ ID NO: 86520 - DNA, 1209 bp, Burkholderia pseudomallei K96243; identical to SEQ ID NO: 28803
  CDS (1)..(1209)

SEQ ID NO: 86521 - protein, 402 aa, Burkholderia pseudomallei K96243; identical to SEQ ID NO: 28804

SEQ ID NO: 86522 - DNA, 1458 bp, Burkholderia pseudomallei K96243; identical to SEQ ID NO: 28805
  CDS (1)..(1458)

SEQ ID NO: 86523 - protein, 485 aa, Burkholderia pseudomallei K96243; identical to SEQ ID NO: 28806

SEQ ID NO: 86524 - DNA, 1557 bp, Burkholderia pseudomallei K96243; identical to SEQ ID NO: 28807
  CDS (1)..(1557)

SEQ ID NO: 86525 - protein, 518 aa, Burkholderia pseudomallei K96243; identical to SEQ ID NO: 28808

SEQ ID NO: 86526 - DNA, 1419 bp, Burkholderia pseudomallei K96243; identical to SEQ ID NO: 28809
  CDS (1)..(1419)

SEQ ID NO: 86527 - protein, 472 aa, Burkholderia pseudomallei K96243; identical to SEQ ID NO: 28810

SEQ ID NO: 86528 - DNA, 1566 bp, Bacteroides fragilis; identical to SEQ ID NO: 28811
  CDS (19)..(1566)

SEQ ID NO: 86529 - protein, 515 aa, Bacteroides fragilis; identical to SEQ ID NO: 28812

SEQ ID NO: 86530 - DNA, 2358 bp, Bacillus licheniformis DSM 13; identical to SEQ ID NO: 28813
  CDS (501)..(1871)

SEQ ID NO: 86531 - protein, 456 aa, Bacillus licheniformis DSM 13; identical to SEQ ID NO: 28814

SEQ ID NO: 86532 - DNA, 1470 bp, Mannheimia succiniciproducens MBEL55E; identical to SEQ ID NO: 28815
  CDS (1)..(1470)

SEQ ID NO: 86533 - protein, 489 aa, Mannheimia succiniciproducens MBEL55E; identical to SEQ ID NO: 28816

SEQ ID NO: 86534 - DNA, 1425 bp, Borrelia garinii PBi; identical to SEQ ID NO: 28817
  CDS (1)..(1425)

SEQ ID NO: 86535 - protein, 474 aa, Borrelia garinii PBi; identical to SEQ ID NO: 28818

SEQ ID NO: 86536 - DNA, 1224 bp, Lactococcus lactis; identical to SEQ ID NO: 28819
  CDS (1)..(1224)

SEQ ID NO: 86537 - protein, 407 aa, Lactococcus lactis; identical to SEQ ID NO: 28820

SEQ ID NO: 86538 - DNA, 1557 bp, Rickettsia typhi; identical to SEQ ID NO: 28821
  CDS (1)..(1557)

SEQ ID NO: 86539 - protein, 518 aa, Rickettsia typhi; identical to SEQ ID NO: 28822

SEQ ID NO: 86540 - DNA, 1485 bp, Onchocerca volvulus endobacterium; identical to SEQ ID NO: 28823
  CDS (1)..(1485)

SEQ ID NO: 86541 - protein, 494 aa, Onchocerca volvulus endobacterium; identical to SEQ ID NO: 28824

SEQ ID NO: 86542 - DNA, 1455 bp, Desulfotalea psychrophila; identical to SEQ ID NO: 28825
  CDS (1)..(1455)

SEQ ID NO: 86543 - protein, 484 aa, Desulfotalea psychrophila; identical to SEQ ID NO: 28826

SEQ ID NO: 86544 - DNA, 1467 bp, Erwinia carotovora; identical to SEQ ID NO: 28827
  CDS (1)..(1467)

SEQ ID NO: 86545 - protein, 488 aa, Erwinia carotovora; identical to SEQ ID NO: 28828

SEQ ID NO: 86546 - DNA, 1371 bp, Erwinia carotovora; identical to SEQ ID NO: 28829
  CDS (1)..(1371)

SEQ ID NO: 86547 - protein, 456 aa, Erwinia carotovora; identical to SEQ ID NO: 28830

SEQ ID NO: 86548 - DNA, 1404 bp, Acinetobacter sp; identical to SEQ ID NO: 28831
  CDS (1)..(1404)

SEQ ID NO: 86549 - protein, 467 aa, Acinetobacter sp; identical to SEQ ID NO: 28832

SEQ ID NO: 86550 - DNA, 1518 bp, Bartonella quintana; identical to SEQ ID NO: 28833
  CDS (1)..(1518)

SEQ ID NO: 86551 - protein, 505 aa, Bartonella quintana; identical to SEQ ID NO: 28834

SEQ ID NO: 86552 - DNA, 1395 bp, Bartonella quintana; identical to SEQ ID NO: 28835
  CDS (1)..(1395)

SEQ ID NO: 86553 - protein, 464 aa, Bartonella quintana; identical to SEQ ID NO: 28836

SEQ ID NO: 86554 - DNA, 1512 bp, Bartonella quintana; identical to SEQ ID NO: 28837
  CDS (1)..(1512)

SEQ ID NO: 86555 - protein, 503 aa, Bartonella quintana; identical to SEQ ID NO: 28838

SEQ ID NO: 86556 - DNA, 1518 bp, Bartonella henselae; identical to SEQ ID NO: 28839
  CDS (1)..(1518)

SEQ ID NO: 86557 - protein, 505 aa, Bartonella henselae; identical to SEQ ID NO: 28840

SEQ ID NO: 86558 - DNA, 1392 bp, Bartonella henselae; identical to SEQ ID NO: 28841
  CDS (1)..(1392)

SEQ ID NO: 86559 - protein, 463 aa, Bartonella henselae; identical to SEQ ID NO: 28842

SEQ ID NO: 86560 - DNA, 1368 bp, Photobacterium profundum; identical to SEQ ID NO: 28843
  CDS (1)..(1368)

SEQ ID NO: 86561 - protein, 455 aa, Photobacterium profundum; identical to SEQ ID NO: 28844

SEQ ID NO: 86562 - DNA, 1455 bp, Parachlamydia sp; identical to SEQ ID NO: 28845
  CDS (1)..(1455)

SEQ ID NO: 86563 - protein, 484 aa, Parachlamydia sp; identical to SEQ ID NO: 28846

SEQ ID NO: 86564 - DNA, 1563 bp, Rhodopseudomonas palustris; identical to SEQ ID NO: 28847
  CDS (1)..(1563)

SEQ ID NO: 86565 - protein, 520 aa, Rhodopseudomonas palustris; identical to SEQ ID NO: 28848

SEQ ID NO: 86566 - DNA, 1506 bp, Rhodopseudomonas palustris; identical to SEQ ID NO: 28849
  CDS (1)..(1506)

SEQ ID NO: 86567 - protein, 501 aa, Rhodopseudomonas palustris; identical to SEQ ID NO: 28850

SEQ ID NO: 86568 - DNA, 1200 bp, Rhodopseudomonas palustris; identical to SEQ ID NO: 28851
  CDS (1)..(1200)

SEQ ID NO: 86569 - protein, 399 aa, Rhodopseudomonas palustris; identical to SEQ ID NO: 28852

SEQ ID NO: 86570 - DNA, 1392 bp, Rhodopseudomonas palustris; identical to SEQ ID NO: 28853
  CDS (1)..(1392)

SEQ ID NO: 86571 - protein, 463 aa, Rhodopseudomonas palustris; identical to SEQ ID NO: 28854

SEQ ID NO: 86572 - DNA, 1572 bp, Rhodopseudomonas palustris; identical to SEQ ID NO: 28855
  CDS (1)..(1572)

SEQ ID NO: 86573 - protein, 523 aa, Rhodopseudomonas palustris; identical to SEQ ID NO: 28856

SEQ ID NO: 86574 - DNA, 1401 bp, uncultured bacterium 580; identical to SEQ ID NO: 28857
  CDS (1)..(1401)

SEQ ID NO: 86575 - protein, 466 aa, uncultured bacterium 580; identical to SEQ ID NO: 28858

SEQ ID NO: 86576 - DNA, 1476 bp, uncultured bacterium 106; identical to SEQ ID NO: 28859
  CDS (1)..(1476)

SEQ ID NO: 86577 - protein, 491 aa, uncultured bacterium 106; identical to SEQ ID NO: 28860

SEQ ID NO: 86578 - DNA, 1143 bp, uncultured bacterium 105; identical to SEQ ID NO: 28861
  CDS (1)..(1143)

SEQ ID NO: 86579 - protein, 380 aa, uncultured bacterium 105; identical to SEQ ID NO: 28862

SEQ ID NO: 86580 - DNA, 1395 bp, Rhizobium sp; identical to SEQ ID NO: 28863
  CDS (1)..(1395)

SEQ ID NO: 86581 - protein, 464 aa, Rhizobium sp; identical to SEQ ID NO: 28864

SEQ ID NO: 86582 - DNA, 1449 bp, Desulfovibrio vulgaris; identical to SEQ ID NO: 28865
  CDS (1)..(1449)

SEQ ID NO: 86583 - protein, 482 aa, Desulfovibrio vulgaris; identical to SEQ ID NO: 28866

SEQ ID NO: 86584 - DNA, 1167 bp, Leptospira interrogans; identical to SEQ ID NO: 28867
  CDS (1)..(1167)

SEQ ID NO: 86585 - protein, 388 aa, Leptospira interrogans; identical to SEQ ID NO: 28868

SEQ ID NO: 86586 - DNA, 1494 bp, Wolbachia pipientis wMel; identical to SEQ ID NO: 28869
  CDS (1)..(1494)

SEQ ID NO: 86587 - protein, 497 aa, Wolbachia pipientis wMel; identical to SEQ ID NO: 28870

SEQ ID NO: 86588 - DNA, 1482 bp, Treponema denticola; identical to SEQ ID NO: 28871
  CDS (1)..(1482)

SEQ ID NO: 86589 - protein, 493 aa, Treponema denticola; identical to SEQ ID NO: 28872

SEQ ID NO: 86590 - DNA, 1395 bp, Geobacter sulfurreducens; identical to SEQ ID NO: 28873
  CDS (1)..(1395)

SEQ ID NO: 86591 - protein, 464 aa, Geobacter sulfurreducens; identical to SEQ ID NO: 28874

SEQ ID NO: 86592 - DNA, 1416 bp, Geobacter sulfurreducens; identical to SEQ ID NO: 28875
  CDS (1)..(1416)

SEQ ID NO: 86593 - protein, 471 aa, Geobacter sulfurreducens; identical to SEQ ID NO: 28876

SEQ ID NO: 86594 - DNA, 1221 bp, Lactobacillus johnsonii; identical to SEQ ID NO: 28877
  CDS (1)..(1221)

SEQ ID NO: 86595 - protein, 406 aa, Lactobacillus johnsonii; identical to SEQ ID NO: 28878

SEQ ID NO: 86596 - DNA, 1425 bp, Wolinella succinogenes; identical to SEQ ID NO: 28879
  CDS (1)..(1425)

SEQ ID NO: 86597 - protein, 474 aa, Wolinella succinogenes; identical to SEQ ID NO: 28880

SEQ ID NO: 86598 - DNA, 1368 bp, Vibrio vulnificus; identical to SEQ ID NO: 28881
  CDS (1)..(1368)

SEQ ID NO: 86599 - protein, 455 aa, Vibrio vulnificus; identical to SEQ ID NO: 28882

SEQ ID NO: 86600 - DNA, 1497 bp, Porphyromonas gingivalis; identical to SEQ ID NO: 28883
  CDS (1)..(1497)

SEQ ID NO: 86601 - protein, 498 aa, Porphyromonas gingivalis; identical to SEQ ID NO: 28884

SEQ ID NO: 86602 - DNA, 1320 bp, Gloeobacter violaceus; identical to SEQ ID NO: 28885
  CDS (1)..(1320)

SEQ ID NO: 86603 - protein, 439 aa, Gloeobacter violaceus; identical to SEQ ID NO: 28886

SEQ ID NO: 86604 - DNA, 1467 bp, Chromobacterium violaceum; identical to SEQ ID NO: 28887
  CDS (1)..(1467)

SEQ ID NO: 86605 - protein, 488 aa, Chromobacterium violaceum; identical to SEQ ID NO: 28888

SEQ ID NO: 86606 - DNA, 1413 bp, Chromobacterium violaceum; identical to SEQ ID NO: 28889
  CDS (1)..(1413)

SEQ ID NO: 86607 - protein, 470 aa, Chromobacterium violaceum; identical to SEQ ID NO: 28890

SEQ ID NO: 86608 - DNA, 1158 bp, Prochlorococcus marinus; identical to SEQ ID NO: 28891
  CDS (1)..(1158)

SEQ ID NO: 86609 - protein, 385 aa, Prochlorococcus marinus; identical to SEQ ID NO: 28892

SEQ ID NO: 86610 - DNA, 1125 bp, Synechococcus sp; identical to SEQ ID NO: 28893
  CDS (1)..(1125)

SEQ ID NO: 86611 - protein, 374 aa, Synechococcus sp; identical to SEQ ID NO: 28894

SEQ ID NO: 86612 - DNA, 1299 bp, Synechococcus sp; identical to SEQ ID NO: 28895
  CDS (1)..(1299)

SEQ ID NO: 86613 - protein, 432 aa, Synechococcus sp; identical to SEQ ID NO: 28896

SEQ ID NO: 86614 - DNA, 1527 bp, Rhodopirellula baltica; identical to SEQ ID NO: 28897
  CDS (1)..(1527)

SEQ ID NO: 86615 - protein, 508 aa, Rhodopirellula baltica; identical to SEQ ID NO: 28898

SEQ ID NO: 86616 - DNA, 1530 bp, Rhodopirellula baltica; identical to SEQ ID NO: 28899
  CDS (1)..(1530)

SEQ ID NO: 86617 - protein, 509 aa, Rhodopirellula baltica; identical to SEQ ID NO: 28900

SEQ ID NO: 86618 - DNA, 1890 bp, Rhodopirellula baltica; identical to SEQ ID NO: 28901
  CDS (1)..(1890)

SEQ ID NO: 86619 - protein, 629 aa, Rhodopirellula baltica; identical to SEQ ID NO: 28902

SEQ ID NO: 86620 - DNA, 1188 bp, Prochlorococcus marinus; identical to SEQ ID NO: 28903
  CDS (1)..(1188)

SEQ ID NO: 86621 - protein, 395 aa, Prochlorococcus marinus; identical to SEQ ID NO: 28904

SEQ ID NO: 86622 - DNA, 1176 bp, Prochlorococcus marinus; identical to SEQ ID NO: 28905
  CDS (1)..(1176)

SEQ ID NO: 86623 - protein, 391 aa, Prochlorococcus marinus; identical to SEQ ID NO: 28906

SEQ ID NO: 86624 - DNA, 1434 bp, Helicobacter hepaticus; identical to SEQ ID NO: 28907
  CDS (1)..(1434)

SEQ ID NO: 86625 - protein, 477 aa, Helicobacter hepaticus; identical to SEQ ID NO: 28908

SEQ ID NO: 86626 - DNA, 1419 bp, Haemophilus ducreyi; identical to SEQ ID NO: 28909
  CDS (1)..(1419)

SEQ ID NO: 86627 - protein, 472 aa, Haemophilus ducreyi; identical to SEQ ID NO: 28910

SEQ ID NO: 86628 - DNA, 1386 bp, Candidatus Blochmannia floridanus; identical to SEQ ID NO: 28911
  CDS (1)..(1386)

SEQ ID NO: 86629 - protein, 461 aa, Candidatus Blochmannia floridanus; identical to SEQ ID NO: 28912

SEQ ID NO: 86630 - DNA, 1137 bp, Bordetella pertussis; identical to SEQ ID NO: 28913
  CDS (1)..(1137)

SEQ ID NO: 86631 - protein, 378 aa, Bordetella pertussis; identical to SEQ ID NO: 28914

SEQ ID NO: 86632 - DNA, 1116 bp, Bordetella parapertussis; identical to SEQ ID NO: 28915
  CDS (1)..(1116)

SEQ ID NO: 86633 - protein, 371 aa, Bordetella parapertussis; identical to SEQ ID NO: 28916

SEQ ID NO: 86634 - DNA, 1488 bp, Bordetella parapertussis; identical to SEQ ID NO: 28917
  CDS (1)..(1488)

SEQ ID NO: 86635 - protein, 495 aa, Bordetella parapertussis; identical to SEQ ID NO: 28918

SEQ ID NO: 86636 - DNA, 1467 bp, Chlamydophila caviae; identical to SEQ ID NO: 28919
  CDS (1)..(1467)

SEQ ID NO: 86637 - protein, 488 aa, Chlamydophila caviae; identical to SEQ ID NO: 28920

SEQ ID NO: 86638 - DNA, 1419 bp, Streptomyces avermitilis; identical to SEQ ID NO: 28921
  CDS (1)..(1419)

SEQ ID NO: 86639 - protein, 472 aa, Streptomyces avermitilis; identical to SEQ ID NO: 28922

SEQ ID NO: 86640 - DNA, 1491 bp, Nitrosomonas europaea; identical to SEQ ID NO: 28923
  CDS (1)..(1491)

SEQ ID NO: 86641 - protein, 496 aa, Nitrosomonas europaea; identical to SEQ ID NO: 28924

SEQ ID NO: 86642 - DNA, 1323 bp, Enterococcus faecalis; identical to SEQ ID NO: 28925
  CDS (25)..(1323)

SEQ ID NO: 86643 - protein, 432 aa, Enterococcus faecalis; identical to SEQ ID NO: 28926

SEQ ID NO: 86644 - DNA, 1356 bp, Coxiella burnetii; identical to SEQ ID NO: 28927
  CDS (1)..(1356)

SEQ ID NO: 86645 - protein, 451 aa, Coxiella burnetii; identical to SEQ ID NO: 28928

SEQ ID NO: 86646 - DNA, 1368 bp, Enterobacter cloacae; identical to SEQ ID NO: 28929
  CDS (1)..(1368)

SEQ ID NO: 86647 - protein, 455 aa, Enterobacter cloacae; identical to SEQ ID NO: 28930

SEQ ID NO: 86648 - DNA, 1545 bp, Xylella fastidiosa; identical to SEQ ID NO: 28931
  CDS (1)..(1545)

SEQ ID NO: 86649 - protein, 514 aa, Xylella fastidiosa; identical to SEQ ID NO: 28932

SEQ ID NO: 86650 - DNA, 1377 bp, Xylella fastidiosa; identical to SEQ ID NO: 28933
  CDS (1)..(1377)

SEQ ID NO: 86651 - protein, 458 aa, Xylella fastidiosa; identical to SEQ ID NO: 28934

SEQ ID NO: 86652 - DNA, 1368 bp, Vibrio parahaemolyticus; identical to SEQ ID NO: 28935
  CDS (1)..(1368)

SEQ ID NO: 86653 - protein, 455 aa, Vibrio parahaemolyticus; identical to SEQ ID NO: 28936

SEQ ID NO: 86654 - DNA, 1161 bp, Pseudomonas syringae; identical to SEQ ID NO: 28937
  CDS (1)..(1161)

SEQ ID NO: 86655 - protein, 386 aa, Pseudomonas syringae; identical to SEQ ID NO: 28938

SEQ ID NO: 86656 - DNA, 1440 bp, Pseudomonas syringae; identical to SEQ ID NO: 28939
  CDS (1)..(1440)

SEQ ID NO: 86657 - protein, 479 aa, Pseudomonas syringae; identical to SEQ ID NO: 28940

SEQ ID NO: 86658 - DNA, 1479 bp, Pseudomonas putida; identical to SEQ ID NO: 28941
  CDS (1)..(1479)

SEQ ID NO: 86659 - protein, 492 aa, Pseudomonas putida; identical to SEQ ID NO: 28942

SEQ ID NO: 86660 - DNA, 1524 bp, Bradyrhizobium japonicum; identical to SEQ ID NO: 28943
  CDS (1)..(1524)

SEQ ID NO: 86661 - protein, 507 aa, Bradyrhizobium japonicum; identical to SEQ ID NO: 28944

SEQ ID NO: 86662 - DNA, 1272 bp, Bradyrhizobium japonicum; identical to SEQ ID NO: 28945
  CDS (1)..(1272)

SEQ ID NO: 86663 - protein, 423 aa, Bradyrhizobium japonicum; identical to SEQ ID NO: 28946

SEQ ID NO: 86664 - DNA, 1578 bp, Bradyrhizobium japonicum; identical to SEQ ID NO: 28947
  CDS (1)..(1578)

SEQ ID NO: 86665 - protein, 525 aa, Bradyrhizobium japonicum; identical to SEQ ID NO: 28948

SEQ ID NO: 86666 - DNA, 1587 bp, Bradyrhizobium japonicum; identical to SEQ ID NO: 28949
  CDS (1)..(1587)

SEQ ID NO: 86667 - protein, 528 aa, Bradyrhizobium japonicum; identical to SEQ ID NO: 28950

SEQ ID NO: 86668 - DNA, 1536 bp, Bacteroides thetaiotaomicron; identical to SEQ ID NO: 28951
  CDS (1)..(1536)

SEQ ID NO: 86669 - protein, 511 aa, Bacteroides thetaiotaomicron; identical to SEQ ID NO: 28952

SEQ ID NO: 86670 - DNA, 1410 bp, Escherichia coli O6; identical to SEQ ID NO: 28953
  CDS (1)..(1410)

SEQ ID NO: 86671 - protein, 469 aa, Escherichia coli O6; identical to SEQ ID NO: 28954

SEQ ID NO: 86672 - DNA, 1392 bp, Yersinia pestis; identical to SEQ ID NO: 28955
  CDS (1)..(1392)

SEQ ID NO: 86673 - protein, 463 aa, Yersinia pestis; identical to SEQ ID NO: 28956

SEQ ID NO: 86674 - DNA, 1374 bp, Wigglesworthia glossinidia brevipalpis; identical to SEQ ID NO: 28957
  CDS (1)..(1374)

SEQ ID NO: 86675 - protein, 457 aa, Wigglesworthia glossinidia brevipalpis; identical to SEQ ID NO: 28958

SEQ ID NO: 86676 - DNA, 1128 bp, Synechococcus elongatus; identical to SEQ ID NO: 28959
  CDS (1)..(1128)

SEQ ID NO: 86677 - protein, 375 aa, Synechococcus elongatus; identical to SEQ ID NO: 28960

SEQ ID NO: 86678 - DNA, 1170 bp, Synechococcus elongatus; identical to SEQ ID NO: 28961
  CDS (1)..(1170)

SEQ ID NO: 86679 - protein, 389 aa, Synechococcus elongatus; identical to SEQ ID NO: 28962

SEQ ID NO: 86680 - DNA, 1353 bp, Shewanella oneidensis; identical to SEQ ID NO: 28963
  CDS (1)..(1353)

SEQ ID NO: 86681 - protein, 450 aa, Shewanella oneidensis; identical to SEQ ID NO: 28964

SEQ ID NO: 86682 - DNA, 1518 bp, Chlorobium tepidum; identical to SEQ ID NO: 28965
  CDS (1)..(1518)

SEQ ID NO: 86683 - protein, 505 aa, Chlorobium tepidum; identical to SEQ ID NO: 28966

SEQ ID NO: 86684 - DNA, 1461 bp, Rhizobium etli; identical to SEQ ID NO: 28967
  CDS (1)..(1461)

SEQ ID NO: 86685 - protein, 486 aa, Rhizobium etli; identical to SEQ ID NO: 28968

SEQ ID NO: 86686 - DNA, 1368 bp, Pasteurella piscicida; identical to SEQ ID NO: 28969
  CDS (1)..(1368)

SEQ ID NO: 86687 - protein, 455 aa, Pasteurella piscicida; identical to SEQ ID NO: 28970

SEQ ID NO: 86688 - DNA, 1437 bp, Xanthomonas campestris; identical to SEQ ID NO: 28971
  CDS (1)..(1437)

SEQ ID NO: 86689 - protein, 478 aa, Xanthomonas campestris; identical to SEQ ID NO: 28972

SEQ ID NO: 86690 - DNA, 1437 bp, Xanthomonas axonopodis; identical to SEQ ID NO: 28973
  CDS (1)..(1437)

SEQ ID NO: 86691 - protein, 478 aa, Xanthomonas axonopodis; identical to SEQ ID NO: 28974

SEQ ID NO: 86692 - DNA, 1578 bp, Xanthomonas axonopodis; identical to SEQ ID NO: 28975
  CDS (1)..(1578)

SEQ ID NO: 86693 - protein, 525 aa, Xanthomonas axonopodis; identical to SEQ ID NO: 28976

SEQ ID NO: 86694 - DNA, 2077 bp, Klebsiella pneumoniae; identical to SEQ ID NO: 28977
  CDS (374)..(1807)

SEQ ID NO: 86695 - protein, 477 aa, Klebsiella pneumoniae; identical to SEQ ID NO: 28978

SEQ ID NO: 86696 - DNA, 1536 bp, Xanthomonas campestris; identical to SEQ ID NO: 28979
  CDS (1)..(1536)

SEQ ID NO: 86697 - protein, 511 aa, Xanthomonas campestris; identical to SEQ ID NO: 28980

SEQ ID NO: 86698 - DNA, 1473 bp, Ralstonia solanacearum; identical to SEQ ID NO: 28981
  CDS (1)..(1473)

SEQ ID NO: 86699 - protein, 490 aa, Ralstonia solanacearum; identical to SEQ ID NO: 28982

SEQ ID NO: 86700 - DNA, 1518 bp, Ralstonia solanacearum; identical to SEQ ID NO: 28983
  CDS (1)..(1518)

SEQ ID NO: 86701 - protein, 505 aa, Ralstonia solanacearum; identical to SEQ ID NO: 28984

SEQ ID NO: 86702 - DNA, 1368 bp, Salmonella typhimurium; identical to SEQ ID NO: 28985
  CDS (1)..(1368)

SEQ ID NO: 86703 - protein, 455 aa, Salmonella typhimurium; identical to SEQ ID NO: 28986

SEQ ID NO: 86704 - DNA, 1512 bp, Rhizobium meliloti; identical to SEQ ID NO: 28987
  CDS (1)..(1512)

SEQ ID NO: 86705 - protein, 503 aa, Rhizobium meliloti; identical to SEQ ID NO: 28988

SEQ ID NO: 86706 - DNA, 1398 bp, Rhizobium meliloti; identical to SEQ ID NO: 28989
  CDS (1)..(1398)

SEQ ID NO: 86707 - protein, 465 aa, Rhizobium meliloti; identical to SEQ ID NO: 28990

SEQ ID NO: 86708 - DNA, 1551 bp, Rhizobium loti; identical to SEQ ID NO: 28991
  CDS (1)..(1551)

SEQ ID NO: 86709 - protein, 516 aa, Rhizobium loti; identical to SEQ ID NO: 28992

SEQ ID NO: 86710 - DNA, 1542 bp, Rhizobium loti; identical to SEQ ID NO: 28993
  CDS (1)..(1542)

SEQ ID NO: 86711 - protein, 513 aa, Rhizobium loti; identical to SEQ ID NO: 28994

SEQ ID NO: 86712 - DNA, 1515 bp, Rhizobium loti; identical to SEQ ID NO: 28995
  CDS (1)..(1515)

SEQ ID NO: 86713 - protein, 504 aa, Rhizobium loti; identical to SEQ ID NO: 28996

SEQ ID NO: 86714 - DNA, 1287 bp, Rhizobium loti; identical to SEQ ID NO: 28997
  CDS (1)..(1287)

SEQ ID NO: 86715 - protein, 428 aa, Rhizobium loti; identical to SEQ ID NO: 28998

SEQ ID NO: 86716 - DNA, 1446 bp, Pseudomonas syringae; identical to SEQ ID NO: 28999
  CDS (1)..(1446)

SEQ ID NO: 86717 - protein, 481 aa, Pseudomonas syringae; identical to SEQ ID NO: 29000

SEQ ID NO: 86718 - DNA, 1380 bp, Pasteurella multocida; identical to SEQ ID NO: 29001
  CDS (1)..(1380)

SEQ ID NO: 86719 - protein, 459 aa, Pasteurella multocida; identical to SEQ ID NO: 29002

SEQ ID NO: 86720 - DNA, 1362 bp, Aeromonas hydrophila; identical to SEQ ID NO: 29003
  CDS (1)..(1362)

SEQ ID NO: 86721 - protein, 453 aa, Aeromonas hydrophila; identical to SEQ ID NO: 29004

SEQ ID NO: 86722 - DNA, 1503 bp, Myxococcus xanthus; identical to SEQ ID NO: 29005
  CDS (1)..(1503)

SEQ ID NO: 86723 - protein, 500 aa, Myxococcus xanthus; identical to SEQ ID NO: 29006

SEQ ID NO: 86724 - DNA, 1476 bp, Shigella sonnei; identical to SEQ ID NO: 29007
  CDS (1)..(1476)

SEQ ID NO: 86725 - protein, 491 aa, Shigella sonnei; identical to SEQ ID NO: 29008

SEQ ID NO: 86726 - DNA, 1512 bp, Bartonella henselae; identical to SEQ ID NO: 29009
  CDS (1)..(1512)

SEQ ID NO: 86727 - protein, 503 aa, Bartonella henselae; identical to SEQ ID NO: 29010

SEQ ID NO: 86728 - DNA, 1437 bp, Buchnera aphidicola; identical to SEQ ID NO: 29011
  CDS (1)..(1437)

SEQ ID NO: 86729 - protein, 478 aa, Buchnera aphidicola; identical to SEQ ID NO: 29012

SEQ ID NO: 86730 - DNA, 1515 bp, Rhizobium meliloti; identical to SEQ ID NO: 29013
  CDS (1)..(1515)

SEQ ID NO: 86731 - protein, 504 aa, Rhizobium meliloti; identical to SEQ ID NO: 29014

SEQ ID NO: 86732 - DNA, 1377 bp, Bacillus subtilis; identical to SEQ ID NO: 29015
  CDS (1)..(1377)

SEQ ID NO: 86733 - protein, 458 aa, Bacillus subtilis; identical to SEQ ID NO: 29016

SEQ ID NO: 86734 - DNA, 24 bp, Primer
atgaaaaaaaccacattagcactg

SEQ ID NO: 86735 - DNA, 25 bp, Primer
ttactgcattaacaggtagatggtg

SEQ ID NO: 86736 - protein, 406 aa, consensus; identical to SEQ ID NO: 29019
  MISC_FEATURE (1)..(406): consensus for the disclosure of xaa see table XV

SEQ ID NO: 86737 - protein, 66 aa, consensus; identical to SEQ ID NO: 29020
  MISC_FEATURE (1)..(66): consensus for the disclosure of xaa see table XV

SEQ ID NO: 86738 - protein, 37 aa, consensus; identical to SEQ ID NO: 29021
  MISC_FEATURE (1)..(37): consensus for the disclosure of xaa see table XV

SEQ ID NO: 86739 - protein, 30 aa, consensus; identical to SEQ ID NO: 29022
  MISC_FEATURE (1)..(30): consensus for the disclosure of xaa see table XV

SEQ ID NO: 86740 - protein, 34 aa, consensus; identical to SEQ ID NO: 29023
  MISC_FEATURE (1)..(34): consensus for the disclosure of xaa see table XV

SEQ ID NO: 86741 - protein, 68 aa, consensus; identical to SEQ ID NO: 29024
  MISC_FEATURE (1)..(68): consensus for the disclosure of xaa see table XV

SEQ ID NO: 86742 - DNA, 660 bp, Escherichia coli; identical to SEQ ID NO: 58632
  CDS (1)..(660)

SEQ ID NO: 86743 - protein, 219 aa, Escherichia coli; identical to SEQ ID NO: 58633

SEQ ID NO: 86744 - DNA, 977 bp, Cryptococcus neoformans var. neoformans JEC21; identical to SEQ ID NO: 58634
  CDS (27)..(878)

SEQ ID NO: 86745 - protein, 283 aa, Cryptococcus neoformans var. neoformans JEC21; identical to SEQ ID NO: 58635

SEQ ID NO: 86746 - DNA, 663 bp, Azoarcus sp. EbN1; identical to SEQ ID NO: 58636
  CDS (1)..(663)

SEQ ID NO: 86747 - protein, 220 aa, Azoarcus sp. EbN1; identical to SEQ ID NO: 58637

SEQ ID NO: 86748 - DNA, 705 bp, Ehrlichia ruminantium str. Welgevonden; identical to SEQ ID NO: 58638
  CDS (1)..(705)

SEQ ID NO: 86749 - protein, 234 aa, Ehrlichia ruminantium str. Welgevonden; identical to SEQ ID NO: 58639

SEQ ID NO: 86750 - DNA, 723 bp, Wolbachia endosymbiont strain TRS of Brugia malayi; identical to SEQ ID NO: 58640
  CDS (1)..(723)

SEQ ID NO: 86751 - protein, 240 aa, Wolbachia endosymbiont strain TRS of Brugia malayi; identical to SEQ ID NO: 58641

SEQ ID NO: 86752 - DNA, 663 bp, Vibrio fischeri ES114; identical to SEQ ID NO: 58642
  CDS (1)..(663)

SEQ ID NO: 86753 - protein, 220 aa, Vibrio fischeri ES114; identical to SEQ ID NO: 58643

SEQ ID NO: 86754 - DNA, 684 bp, Neisseria gonorrhoeae FA 1090; identical to SEQ ID NO: 58644
  CDS (1)..(684)

SEQ ID NO: 86755 - protein, 227 aa, Neisseria gonorrhoeae FA 1090; identical to SEQ ID NO: 58645

SEQ ID NO: 86756 - DNA, 708 bp, Xenopus tropicalis; identical to SEQ ID NO: 58646
  CDS (1)..(708)

SEQ ID NO: 86757 - protein, 235 aa, Xenopus tropicalis; identical to SEQ ID NO: 58647

SEQ ID NO: 86758 - DNA, 714 bp, Sus scrofa; identical to SEQ ID NO: 58648
  CDS (1)..(714)

SEQ ID NO: 86759 - protein, 237 aa, Sus scrofa; identical to SEQ ID NO: 58649

SEQ ID NO: 86760 - DNA, 975 bp, Danio rerio; identical to SEQ ID NO: 58650
  CDS (1)..(975)

SEQ ID NO: 86761 - protein, 324 aa, Danio rerio; identical to SEQ ID NO: 58651

SEQ ID NO: 86762 - DNA, 1116 bp, Homo sapiens; identical to SEQ ID NO: 58652
  CDS (1)..(1116)

SEQ ID NO: 86763 - protein, 371 aa, Homo sapiens; identical to SEQ ID NO: 58653

SEQ ID NO: 86764 - DNA, 714 bp, Mus musculus; identical to SEQ ID NO: 58654
  CDS (1)..(714)

SEQ ID NO: 86765 - protein, 237 aa, Mus musculus; identical to SEQ ID NO: 58655

SEQ ID NO: 86766 - DNA, 774 bp, Mesorhizobium loti MAFF303099; identical to SEQ ID NO: 58656
  CDS (1)..(774): transl_table=11

SEQ ID NO: 86767 - protein, 257 aa, Mesorhizobium loti MAFF303099; identical to SEQ ID NO: 58657

SEQ ID NO: 86768 - DNA, 744 bp, Arabidopsis thaliana; identical to SEQ ID NO: 58658
  CDS (1)..(744)

SEQ ID NO: 86769 - protein, 247 aa, Arabidopsis thaliana; identical to SEQ ID NO: 58659

SEQ ID NO: 86770 - DNA, 720 bp, Arabidopsis thaliana; identical to SEQ ID NO: 58660
  CDS (1)..(720)

SEQ ID NO: 86771 - protein, 239 aa, Arabidopsis thaliana; identical to SEQ ID NO: 58661

SEQ ID NO: 86772 - DNA, 747 bp, Arabidopsis thaliana; identical to SEQ ID NO: 58662
  CDS (1)..(747)

SEQ ID NO: 86773 - protein, 248 aa, Arabidopsis thaliana; identical to SEQ ID NO: 58663

SEQ ID NO: 86774 - DNA, 708 bp, Arabidopsis thaliana; identical to SEQ ID NO: 58664
  CDS (1)..(708)

SEQ ID NO: 86775 - protein, 235 aa, Arabidopsis thaliana; identical to SEQ ID NO: 58665

SEQ ID NO: 86776 - DNA, 744 bp, Arabidopsis thaliana; identical to SEQ ID NO: 58666
  CDS (1)..(744)

SEQ ID NO: 86777 - protein, 247 aa, Arabidopsis thaliana; identical to SEQ ID NO: 58667

SEQ ID NO: 86778 - DNA, 714 bp, Lactococcus lactis subsp. lactis Il1403; identical to SEQ ID NO: 58668
  CDS (1)..(714): transl_table=11

SEQ ID NO: 86779 - protein, 237 aa, Lactococcus lactis subsp. lactis Il1403; identical to SEQ ID NO: 58669

SEQ ID NO: 86780 - DNA, 705 bp, Escherichia coli O157:H7; identical to SEQ ID NO: 58670
  CDS (1)..(705): transl_table=11

SEQ ID NO: 86781 - protein, 234 aa, Escherichia coli O157:H7; identical to SEQ ID NO: 58671

SEQ ID NO: 86782 - DNA, 696 bp, Clostridium acetobutylicum ATCC 824; identical to SEQ ID NO: 58672
  CDS (1)..(696): transl_table=11

SEQ ID NO: 86783 - protein, 231 aa, Clostridium acetobutylicum ATCC 824; identical to SEQ ID NO: 58673

SEQ ID NO: 86784 - DNA, 708 bp, Streptococcus pneumoniae R6; identical to SEQ ID NO: 58674
  CDS (1)..(708): transl_table=11

SEQ ID NO: 86785 - protein, 235 aa, Streptococcus pneumoniae R6; identical to SEQ ID NO: 58675

SEQ ID NO: 86786 - DNA, 738 bp, Sinorhizobium meliloti 1021; identical to SEQ ID NO: 58676
  CDS (1)..(738): transl_table=11

SEQ ID NO: 86787 - protein, 245 aa, Sinorhizobium meliloti 1021; identical to SEQ ID NO: 58677

SEQ ID NO: 86788 - DNA, 645 bp, Bacillus subtilis subsp. subtilis str. 168; identical to SEQ ID NO: 58678
  CDS (1)..(645): transl_table=11

SEQ ID NO: 86789 - protein, 214 aa, Bacillus subtilis subsp. subtilis str. 168; identical to SEQ ID NO: 58679

SEQ ID NO: 86790 - DNA, 705 bp, Salmonella typhimurium LT2; identical to SEQ ID NO: 58680
  CDS (1)..(705): transl_table=11

SEQ ID NO: 86791 - protein, 234 aa, Salmonella typhimurium LT2; identical to SEQ ID NO: 58681

SEQ ID NO: 86792 - DNA, 660 bp, Salmonella typhimurium LT2; identical to SEQ ID NO: 58682
  CDS (1)..(660): transl_table=11

SEQ ID NO: 86793 - protein, 219 aa, Salmonella typhimurium LT2; identical to SEQ ID NO: 58683

SEQ ID NO: 86794 - DNA, 678 bp, Listeria innocua Clip11262; identical to SEQ ID NO: 58684
  CDS (1)..(678): transl_table=11

SEQ ID NO: 86795 - protein, 225 aa, Listeria innocua Clip11262; identical to SEQ ID NO: 58685

SEQ ID NO: 86796 - DNA, 702 bp, Ralstonia solanacearum GMI1000; identical to SEQ ID NO: 58686
  CDS (1)..(702): transl_table=11

SEQ ID NO: 86797 - protein, 233 aa, Ralstonia solanacearum GMI1000; identical to SEQ ID NO: 58687

SEQ ID NO: 86798 - DNA, 783 bp, Agrobacterium tumefaciens str. C58; identical to SEQ ID NO: 58688
  CDS (1)..(783): transl_table=11

SEQ ID NO: 86799 - protein, 260 aa, Agrobacterium tumefaciens str. C58; identical to SEQ ID NO: 58689

SEQ ID NO: 86800 - DNA, 771 bp, Arabidopsis thaliana; identical to SEQ ID NO: 58690
  CDS (1)..(771)

SEQ ID NO: 86801 - protein, 256 aa, Arabidopsis thaliana; identical to SEQ ID NO: 58691

SEQ ID NO: 86802 - DNA, 714 bp, Camelpox virus; identical to SEQ ID NO: 58692
  CDS (1)..(714)

SEQ ID NO: 86803 - protein, 237 aa, Camelpox virus; identical to SEQ ID NO: 58693

SEQ ID NO: 86804 - DNA, 690 bp, Streptococcus pyogenes MGAS8232; identical to SEQ ID NO: 58694
  CDS (1)..(690): transl_table=11

SEQ ID NO: 86805 - protein, 229 aa, Streptococcus pyogenes MGAS8232; identical to SEQ ID NO: 58695

SEQ ID NO: 86806 - DNA, 795 bp, Drosophila melanogaster; identical to SEQ ID NO: 58696
  CDS (1)..(795)

SEQ ID NO: 86807 - protein, 264 aa, Drosophila melanogaster; identical to SEQ ID NO: 58697

SEQ ID NO: 86808 - DNA, 711 bp, Yersinia pestis KIM; identical to SEQ ID NO: 58698
  CDS (1)..(711): transl_table=11

SEQ ID NO: 86809 - protein, 236 aa, Yersinia pestis KIM; identical to SEQ ID NO: 58699

SEQ ID NO: 86810 - DNA, 690 bp, Streptococcus agalactiae 2603V/R; identical to SEQ ID NO: 58700
  CDS (1)..(690): transl_table=11

SEQ ID NO: 86811 - protein, 229 aa, Streptococcus agalactiae 2603V/R; identical to SEQ ID NO: 58701

SEQ ID NO: 86812 - DNA, 900 bp, Bifidobacterium longum NCC2705; identical to SEQ ID NO: 58702
  CDS (1)..(900): transl_table=11

SEQ ID NO: 86813 - protein, 299 aa, Bifidobacterium longum NCC2705; identical to SEQ ID NO: 58703

SEQ ID NO: 86814 - DNA, 738 bp, Brucella suis 1330; identical to SEQ ID NO: 58704
  CDS (1)..(738): transl_table=11

SEQ ID NO: 86815 - protein, 245 aa, Brucella suis 1330; identical to SEQ ID NO: 58705

SEQ ID NO: 86816 - DNA, 870 bp, Plasmodium falciparum 3D7; identical to SEQ ID NO: 58706
  CDS (1)..(870)

SEQ ID NO: 86817 - protein, 289 aa, Plasmodium falciparum 3D7; identical to SEQ ID NO: 58707

SEQ ID NO: 86818 - DNA, 705 bp, Shigella flexneri 2a str. 301; identical to SEQ ID NO: 58708
  CDS (1)..(705): transl_table=11

SEQ ID NO: 86819 - protein, 234 aa, Shigella flexneri 2a str. 301; identical to SEQ ID NO: 58709

SEQ ID NO: 86820 - DNA, 660 bp, Shewanella oneidensis MR-1; identical to SEQ ID NO: 58710
  CDS (1)..(660): transl_table=11

SEQ ID NO: 86821 - protein, 219 aa, Shewanella oneidensis MR-1; identical to SEQ ID NO: 58711

SEQ ID NO: 86822 - DNA, 825 bp, Drosophila melanogaster; identical to SEQ ID NO: 58712
  CDS (1)..(825)

SEQ ID NO: 86823 - protein, 274 aa, Drosophila melanogaster; identical to SEQ ID NO: 58713

SEQ ID NO: 86824 - DNA, 714 bp, Drosophila melanogaster; identical to SEQ ID NO: 58714
  CDS (1)..(714)

SEQ ID NO: 86825 - protein, 237 aa, Drosophila melanogaster; identical to SEQ ID NO: 58715

SEQ ID NO: 86826 - DNA, 672 bp, Pseudomonas putida KT2440; identical to SEQ ID NO: 58716
  CDS (1)..(672): transl_table=11

SEQ ID NO: 86827 - protein, 223 aa, Pseudomonas putida KT2440; identical to SEQ ID NO: 58717

SEQ ID NO: 86828 - DNA, 663 bp, Vibrio vulnificus CMCP6; identical to SEQ ID NO: 58718
  CDS (1)..(663): transl_table=11

SEQ ID NO: 86829 - protein, 220 aa, Vibrio vulnificus CMCP6; identical to SEQ ID NO: 58719

SEQ ID NO: 86830 - DNA, 837 bp, Bradyrhizobium japonicum USDA 110; identical to SEQ ID NO: 58720
  CDS (1)..(837)

SEQ ID NO: 86831 - protein, 278 aa, Bradyrhizobium japonicum USDA 110; identical to SEQ ID NO: 58721

SEQ ID NO: 86832 - DNA, 699 bp, Bradyrhizobium japonicum USDA 110; identical to SEQ ID NO: 58722
  CDS (1)..(699)

SEQ ID NO: 86833 - protein, 232 aa, Bradyrhizobium japonicum USDA 110; identical to SEQ ID NO: 58723

SEQ ID NO: 86834 - DNA, 690 bp, Streptococcus pyogenes SSI-1; identical to SEQ ID NO: 58724
  CDS (1)..(690): transl_table=11

SEQ ID NO: 86835 - protein, 229 aa, Streptococcus pyogenes SSI-1; identical to SEQ ID NO: 58725

SEQ ID NO: 86836 - DNA, 687 bp, Enterococcus faecalis V583; identical to SEQ ID NO: 58726
  CDS (1)..(687): transl_table=11

SEQ ID NO: 86837 - protein, 228 aa, Enterococcus faecalis V583; identical to SEQ ID NO: 58727

SEQ ID NO: 86838 - DNA, 720 bp, Coxiella burnetii RSA 493; identical to SEQ ID NO: 58728
  CDS (1)..(720): transl_table=11

SEQ ID NO: 86839 - protein, 239 aa, Coxiella burnetii RSA 493; identical to SEQ ID NO: 58729

SEQ ID NO: 86840 - DNA, 696 bp, Nitrosomonas europaea ATCC 19718; identical to SEQ ID NO: 58730
  CDS (1)..(696): transl_table=11

SEQ ID NO: 86841 - protein, 231 aa, Nitrosomonas europaea ATCC 19718; identical to SEQ ID NO: 58731

SEQ ID NO: 86842 - DNA, 693 bp, Helicobacter hepaticus ATCC 51449; identical to SEQ ID NO: 58732
  CDS (1)..(693): transl_table=11

SEQ ID NO: 86843 - protein, 230 aa, Helicobacter hepaticus ATCC 51449; identical to SEQ ID NO: 58733

SEQ ID NO: 86844 - DNA, 660 bp, Wigglesworthia glossinidia endosymbiont of Glossina brevipalpis; identical to SEQ ID NO: 58734
  CDS (1)..(660): transl_table=11

SEQ ID NO: 86845 - protein, 219 aa, Wigglesworthia glossinidia endosymbiont of Glossina brevipalpis; identical to SEQ ID NO: 58735

SEQ ID NO: 86846 - DNA, 711 bp, Candidatus Blochmannia floridanus; identical to SEQ ID NO: 58736
  CDS (1)..(711): transl_table=11

SEQ ID NO: 86847 - protein, 236 aa, Candidatus Blochmannia floridanus; identical to SEQ ID NO: 58737

SEQ ID NO: 86848 - DNA, 711 bp, Bordetella bronchiseptica RB50; identical to SEQ ID NO: 58738
  CDS (1)..(711): transl_table=11

SEQ ID NO: 86849 - protein, 236 aa, Bordetella bronchiseptica RB50; identical to SEQ ID NO: 58739

SEQ ID NO: 86850 - DNA, 690 bp, Chromobacterium violaceum ATCC 12472; identical to SEQ ID NO: 58740
  CDS (1)..(690): transl_table=11

SEQ ID NO: 86851 - protein, 229 aa, Chromobacterium violaceum ATCC 12472; identical to SEQ ID NO: 58741

SEQ ID NO: 86852 - DNA, 717 bp, Wolinella succinogenes DSM 1740; identical to SEQ ID NO: 58742
  CDS (1)..(717): transl_table=11

SEQ ID NO: 86853 - protein, 238 aa, Wolinella succinogenes DSM 1740; identical to SEQ ID NO: 58743

SEQ ID NO: 86854 - DNA, 711 bp, Photorhabdus luminescens subsp. laumondii TTO1; identical to SEQ ID NO: 58744
  CDS (1)..(711): transl_table=11

SEQ ID NO: 86855 - protein, 236 aa, Photorhabdus luminescens subsp. laumondii TTO1; identical to SEQ ID NO: 58745

SEQ ID NO: 86856 - DNA, 669 bp, Vibrio vulnificus YJ016; identical to SEQ ID NO: 58746
  CDS (1)..(669): transl_table=11

SEQ ID NO: 86857 - protein, 222 aa, Vibrio vulnificus YJ016; identical to SEQ ID NO: 58747

SEQ ID NO: 86858 - DNA, 792 bp, Rhodopseudomonas palustris CGA009; identical to SEQ ID NO: 58748
  CDS (1)..(792): transl_table=11

SEQ ID NO: 86859 - protein, 263 aa, Rhodopseudomonas palustris CGA009; identical to SEQ ID NO: 58749

SEQ ID NO: 86860 - DNA, 714 bp, Lactobacillus johnsonii NCC 533; identical to SEQ ID NO: 58750
  CDS (1)..(714): transl_table=11

SEQ ID NO: 86861 - protein, 237 aa, Lactobacillus johnsonii NCC 533; identical to SEQ ID NO: 58751

SEQ ID NO: 86862 - DNA, 723 bp, Wolbachia endosymbiont of Drosophila melanogaster; identical to SEQ ID NO: 58752
  CDS (1)..(723): transl_table=11

SEQ ID NO: 86863 - protein, 240 aa, Wolbachia endosymbiont of Drosophila melanogaster; identical to SEQ ID NO: 58753

SEQ ID NO: 86864 - DNA, 864 bp, Neurospora crassa; identical to SEQ ID NO: 58754
  CDS (1)..(864)

SEQ ID NO: 86865 - protein, 287 aa, Neurospora crassa; identical to SEQ ID NO: 58755

SEQ ID NO: 86866 - DNA, 849 bp, Magnaporthe grisea 70-15; identical to SEQ ID NO: 58756
  CDS (1)..(849)

SEQ ID NO: 86867 - protein, 282 aa, Magnaporthe grisea 70-15; identical to SEQ ID NO: 58757

SEQ ID NO: 86868 - DNA, 831 bp, Gibberella zeae PH-1; identical to SEQ ID NO: 58758
  CDS (1)..(831)

SEQ ID NO: 86869 - protein, 276 aa, Gibberella zeae PH-1; identical to SEQ ID NO: 58759

SEQ ID NO: 86870 - DNA, 822 bp, Ustilago maydis 521; identical to SEQ ID NO: 58760
  CDS (1)..(822)

SEQ ID NO: 86871 - protein, 273 aa, Ustilago maydis 521; identical to SEQ ID NO: 58761

SEQ ID NO: 86872 - DNA, 813 bp, Aspergillus nidulans FGSC A4; identical to SEQ ID NO: 58762
  CDS (1)..(813)

SEQ ID NO: 86873 - protein, 270 aa, Aspergillus nidulans FGSC A4; identical to SEQ ID NO: 58763

SEQ ID NO: 86874 - DNA, 555 bp, Oryza sativa (japonica cultivar-group); identical to SEQ ID NO: 58764
  CDS (1)..(555)

SEQ ID NO: 86875 - protein, 184 aa, Oryza sativa (japonica cultivar-group); identical to SEQ ID NO: 58765

SEQ ID NO: 86876 - DNA, 690 bp, Oryza sativa (japonica cultivar-group); identical to SEQ ID NO: 58766
  CDS (1)..(690)

SEQ ID NO: 86877 - protein, 229 aa, Oryza sativa (japonica cultivar-group); identical to SEQ ID NO: 58767

SEQ ID NO: 86878 - DNA, 672 bp, Oryza sativa (japonica cultivar-group); identical to SEQ ID NO: 58768
  CDS (1)..(672)

SEQ ID NO: 86879 - protein, 223 aa, Oryza sativa (japonica cultivar-group); identical to SEQ ID NO: 58769

SEQ ID NO: 86880 - DNA, 735 bp, Oryza sativa (japonica cultivar-group); identical to SEQ ID NO: 58770
  CDS (1)..(735)

SEQ ID NO: 86881 - protein, 244 aa, Oryza sativa (japonica cultivar-group); identical to SEQ ID NO: 58771

SEQ ID NO: 86882 - DNA, 786 bp, Yarrowia lipolytica CLIB99; identical to SEQ ID NO: 58772
  CDS (1)..(786)

SEQ ID NO: 86883 - protein, 261 aa, Yarrowia lipolytica CLIB99; identical to SEQ ID NO: 58773

SEQ ID NO: 86884 - DNA, 657 bp, Pan troglodytes; identical to SEQ ID NO: 58774
  CDS (1)..(657)

SEQ ID NO: 86885 - protein, 218 aa, Pan troglodytes; identical to SEQ ID NO: 58775

SEQ ID NO: 86886 - DNA, 702 bp, Desulfovibrio vulgaris subsp. vulgaris str. Hildenborough; identical to SEQ ID NO: 58776
  CDS (1)..(702): transl_table=11

SEQ ID NO: 86887 - protein, 233 aa, Desulfovibrio vulgaris subsp. vulgaris str. Hildenborough; identical to SEQ ID NO: 58777

SEQ ID NO: 86888 - DNA, 774 bp, Bartonella quintana str. Toulouse; identical to SEQ ID NO: 58778
  CDS (1)..(774): transl_table=11

SEQ ID NO: 86889 - protein, 257 aa, Bartonella quintana str. Toulouse; identical to SEQ ID NO: 58779

SEQ ID NO: 86890 - DNA, 774 bp, Bartonella henselae str. Houston-1; identical to SEQ ID NO: 58780
  CDS (1)..(774): transl_table=11

SEQ ID NO: 86891 - protein, 257 aa, Bartonella henselae str. Houston-1; identical to SEQ ID NO: 58781

SEQ ID NO: 86892 - DNA, 660 bp, Erwinia carotovora subsp. atroseptica SCRI1043; identical to SEQ ID NO: 58782
  CDS (1)..(660)

SEQ ID NO: 86893 - protein, 219 aa, Erwinia carotovora subsp. atroseptica SCRI1043; identical to SEQ ID NO: 58783

SEQ ID NO: 86894 - DNA, 708 bp, Erwinia carotovora subsp. atroseptica SCRI1043; identical to SEQ ID NO: 58784
  CDS (1)..(708)

SEQ ID NO: 86895 - protein, 235 aa, Erwinia carotovora subsp. atroseptica SCRI1043; identical to SEQ ID NO: 58785

SEQ ID NO: 86896 - DNA, 723 bp, Desulfotalea psychrophila LSv54; identical to SEQ ID NO: 58786
  CDS (1)..(723): transl_table=11

SEQ ID NO: 86897 - protein, 240 aa, Desulfotalea psychrophila LSv54; identical to SEQ ID NO: 58787

SEQ ID NO: 86898 - DNA, 711 bp, Yersinia pseudotuberculosis IP 32953; identical to SEQ ID NO: 58788
  CDS (1)..(711): transl_table=11

SEQ ID NO: 86899 - protein, 236 aa, Yersinia pseudotuberculosis IP 32953; identical to SEQ ID NO: 58789

SEQ ID NO: 86900 - DNA, 699 bp, Borrelia garinii PBi; identical to SEQ ID NO: 58790
  CDS (1)..(699): transl_table=11

SEQ ID NO: 86901 - protein, 232 aa, Borrelia garinii PBi; identical to SEQ ID NO: 58791

SEQ ID NO: 86902 - DNA, 672 bp, Mannheimia succiniciproducens MBEL55E; identical to SEQ ID NO: 58792
  CDS (1)..(672): transl_table=11

SEQ ID NO: 86903 - protein, 223 aa, Mannheimia succiniciproducens MBEL55E; identical to SEQ ID NO: 58793

SEQ ID NO: 86904 - DNA, 675 bp, Legionella pneumophila subsp. pneumophila str. Philadelphia 1; identical to SEQ ID NO: 58794
  CDS (1)..(675): transl_table=11

SEQ ID NO: 86905 - protein, 224 aa, Legionella pneumophila subsp. pneumophila str. Philadelphia 1; identical to SEQ ID NO: 58795

SEQ ID NO: 86906 - DNA, 714 bp, Burkholderia pseudomallei K96243; identical to SEQ ID NO: 58796
  CDS (1)..(714): transl_table=11

SEQ ID NO: 86907 - protein, 237 aa, Burkholderia pseudomallei K96243; identical to SEQ ID NO: 58797

SEQ ID NO: 86908 - DNA, 678 bp, Methylococcus capsulatus str. Bath; identical to SEQ ID NO: 58798
  CDS (1)..(678): transl_table=11

SEQ ID NO: 86909 - protein, 225 aa, Methylococcus capsulatus str. Bath; identical to SEQ ID NO: 58799

SEQ ID NO: 86910 - DNA, 666 bp, Photobacterium profundum SS9; identical to SEQ ID NO: 58800
  CDS (1)..(666): transl_table=11

SEQ ID NO: 86911 - protein, 221 aa, Photobacterium profundum SS9; identical to SEQ ID NO: 58801

SEQ ID NO: 86912 - DNA, 690 bp, Streptococcus thermophilus CNRZ1066; identical to SEQ ID NO: 58802
  CDS (1)..(690): transl_table=11

SEQ ID NO: 86913 - protein, 229 aa, Streptococcus thermophilus CNRZ1066; identical to SEQ ID NO: 58803

SEQ ID NO: 86914 - DNA, 639 bp, Geobacillus kaustophilus HTA426; identical to SEQ ID NO: 58804
  CDS (1)..(639): transl_table=11

SEQ ID NO: 86915 - protein, 212 aa, Geobacillus kaustophilus HTA426; identical to SEQ ID NO: 58805

SEQ ID NO: 86916 - DNA, 705 bp, Salmonella enterica subsp. enterica serovar Paratypi A str. ATCC; identical to SEQ ID NO: 58806
  CDS (1)..(705): transl_table=11

SEQ ID NO: 86917 - protein, 234 aa, Salmonella enterica subsp. enterica serovar Paratypi A str. ATCC; identical to SEQ ID NO: 58807

SEQ ID NO: 86918 - DNA, 702 bp, Anaplasma marginale str. St. Maries; identical to SEQ ID NO: 58808
  CDS (1)..(702): transl_table=11

SEQ ID NO: 86919 - protein, 233 aa, Anaplasma marginale str. St. Maries; identical to SEQ ID NO: 58809

SEQ ID NO: 86920 - DNA, 669 bp, Idiomarina loihiensis L2TR; identical to SEQ ID NO: 58810
  CDS (1)..(669): transl_table=11

SEQ ID NO: 86921 - protein, 222 aa, Idiomarina loihiensis L2TR; identical to SEQ ID NO: 58811

SEQ ID NO: 86922 - DNA, 666 bp, Azoarcus sp. EbN1; identical to SEQ ID NO: 58812
  CDS (1)..(666): transl_table=11

SEQ ID NO: 86923 - protein, 221 aa, Azoarcus sp. EbN1; identical to SEQ ID NO: 58813

SEQ ID NO: 86924 - DNA, 705 bp, Zymomonas mobilis subsp. mobilis ZM4; identical to SEQ ID NO: 58814
  CDS (1)..(705): transl_table=11

SEQ ID NO: 86925 - protein, 234 aa, Zymomonas mobilis subsp. mobilis ZM4; identical to SEQ ID NO: 58815

SEQ ID NO: 86926 - DNA, 687 bp, Francisella tularensis subsp. tularensis Schu 4; identical to SEQ ID NO: 58816
  CDS (1)..(687): transl_table=11

SEQ ID NO: 86927 - protein, 228 aa, Francisella tularensis subsp. tularensis Schu 4; identical to SEQ ID NO: 58817

SEQ ID NO: 86928 - DNA, 705 bp, Ehrlichia ruminantium str. Welgevonden; identical to SEQ ID NO: 58818
  CDS (1)..(705): transl_table=11

SEQ ID NO: 86929 - protein, 234 aa, Ehrlichia ruminantium str. Welgevonden; identical to SEQ ID NO: 58819

SEQ ID NO: 86930 - DNA, 714 bp, Rhodobacter sphaeroides 2.4.1; identical to SEQ ID NO: 58820
  CDS (1)..(714)

SEQ ID NO: 86931 - protein, 237 aa, Rhodobacter sphaeroides 2.4.1; identical to SEQ ID NO: 58821

SEQ ID NO: 86932 - DNA, 732 bp, Lactobacillus gasseri; identical to SEQ ID NO: 58822
  CDS (1)..(732)

SEQ ID NO: 86933 - protein, 243 aa, Lactobacillus gasseri; identical to SEQ ID NO: 58823

SEQ ID NO: 86934 - DNA, 768 bp, Magnetospirillum magnetotacticum MS-1; identical to SEQ ID NO: 58824
  CDS (1)..(768)

SEQ ID NO: 86935 - protein, 255 aa, Magnetospirillum magnetotacticum MS-1; identical to SEQ ID NO: 58825

SEQ ID NO: 86936 - DNA, 696 bp, Magnetospirillum magnetotacticum MS-1; identical to SEQ ID NO: 58826
  CDS (1)..(696)

SEQ ID NO: 86937 - protein, 231 aa, Magnetospirillum magnetotacticum MS-1; identical to SEQ ID NO: 58827

SEQ ID NO: 86938 - DNA, 720 bp, Leuconostoc mesenteroides subsp. mesenteroides ATCC 8293; identical to SEQ ID NO: 58828
  CDS (1)..(720)

SEQ ID NO: 86939 - protein, 239 aa, Leuconostoc mesenteroides subsp. mesenteroides ATCC 8293; identical to SEQ ID NO: 58829

SEQ ID NO: 86940 - DNA, 672 bp, Azotobacter vinelandii; identical to SEQ ID NO: 58830
  CDS (1)..(672)

SEQ ID NO: 86941 - protein, 223 aa, Azotobacter vinelandii; identical to SEQ ID NO: 58831

SEQ ID NO: 86942 - DNA, 702 bp, Desulfovibrio desulfuricans G20; identical to SEQ ID NO: 58832
  CDS (1)..(702)

SEQ ID NO: 86943 - protein, 233 aa, Desulfovibrio desulfuricans G20; identical to SEQ ID NO: 58833

SEQ ID NO: 86944 - DNA, 711 bp, Rickettsia sibirica 246; identical to SEQ ID NO: 58834
  CDS (1)..(711): transl_table=11

SEQ ID NO: 86945 - protein, 236 aa, Rickettsia sibirica 246; identical to SEQ ID NO: 58835

SEQ ID NO: 86946 - DNA, 693 bp, Dechloromonas aromatica RCB; identical to SEQ ID NO: 58836
  CDS (1)..(693)

SEQ ID NO: 86947 - protein, 230 aa, Dechloromonas aromatica RCB; identical to SEQ ID NO: 58837

SEQ ID NO: 86948 - DNA, 711 bp, Rickettsia rickettsii; identical to SEQ ID NO: 58838
  CDS (1)..(711)

SEQ ID NO: 86949 - protein, 236 aa, Rickettsia rickettsii; identical to SEQ ID NO: 58839

SEQ ID NO: 86950 - DNA, 702 bp, Ralstonia eutropha JMP134; identical to SEQ ID NO: 58840
  CDS (1)..(702)

SEQ ID NO: 86951 - protein, 233 aa, Ralstonia eutropha JMP134; identical to SEQ ID NO: 58841

SEQ ID NO: 86952 - DNA, 606 bp, Methylobacillus flagellatus KT; identical to SEQ ID NO: 58842
  CDS (1)..(606)

SEQ ID NO: 86953 - protein, 201 aa, Methylobacillus flagellatus KT; identical to SEQ ID NO: 58843

SEQ ID NO: 86954 - DNA, 645 bp, Exiguobacterium sp. 255-15; identical to SEQ ID NO: 58844
  CDS (1)..(645)

SEQ ID NO: 86955 - protein, 214 aa, Exiguobacterium sp. 255-15; identical to SEQ ID NO: 58845

SEQ ID NO: 86956 - DNA, 705 bp, Ehrlichia canis str. Jake; identical to SEQ ID NO: 58846
  CDS (1)..(705)

SEQ ID NO: 86957 - protein, 234 aa, Ehrlichia canis str. Jake; identical to SEQ ID NO: 58847

SEQ ID NO: 86958 - DNA, 699 bp, Burkholderia cepacia R18194; identical to SEQ ID NO: 58848
  CDS (1)..(699)

SEQ ID NO: 86959 - protein, 232 aa, Burkholderia cepacia R18194; identical to SEQ ID NO: 58849

SEQ ID NO: 86960 - DNA, 831 bp, Burkholderia cepacia R1808; identical to SEQ ID NO: 58850
  CDS (1)..(831)

SEQ ID NO: 86961 - protein, 276 aa, Burkholderia cepacia R1808; identical to SEQ ID NO: 58851

SEQ ID NO: 86962 - DNA, 696 bp, Rubrivivax gelatinosus PM1; identical to SEQ ID NO: 58852
  CDS (1)..(696)

SEQ ID NO: 86963 - protein, 231 aa, Rubrivivax gelatinosus PM1; identical to SEQ ID NO: 58853

SEQ ID NO: 86964 - DNA, 609 bp, Rubrivivax gelatinosus PM1; identical to SEQ ID NO: 58854
  CDS (1)..(609)

SEQ ID NO: 86965 - protein, 202 aa, Rubrivivax gelatinosus PM1; identical to SEQ ID NO: 58855

SEQ ID NO: 86966 - DNA, 753 bp, Rhodospirillum rubrum; identical to SEQ ID NO: 58856
  CDS (1)..(753)

SEQ ID NO: 86967 - protein, 250 aa, Rhodospirillum rubrum; identical to SEQ ID NO: 58857

SEQ ID NO: 86968 - DNA, 708 bp, Ralstonia metallidurans CH34; identical to SEQ ID NO: 58858
  CDS (1)..(708)

SEQ ID NO: 86969 - protein, 235 aa, Ralstonia metallidurans CH34; identical to SEQ ID NO: 58859

SEQ ID NO: 86970 - DNA, 699 bp, Burkholderia fungorum LB400; identical to SEQ ID NO: 58860
  CDS (1)..(699)

SEQ ID NO: 86971 - protein, 232 aa, Burkholderia fungorum LB400; identical to SEQ ID NO: 58861

SEQ ID NO: 86972 - DNA, 705 bp, Magnetococcus sp. MC-1; identical to SEQ ID NO: 58862
  CDS (1)..(705)

SEQ ID NO: 86973 - protein, 234 aa, Magnetococcus sp. MC-1; identical to SEQ ID NO: 58863

SEQ ID NO: 86974 - DNA, 744 bp, Novosphingobium aromaticivorans DSM 12444; identical to SEQ ID NO: 58864
  CDS (1)..(744)

SEQ ID NO: 86975 - protein, 247 aa, Novosphingobium aromaticivorans DSM 12444; identical to SEQ ID NO: 58865

SEQ ID NO: 86976 - DNA, 627 bp, Microbulbifer degradans 2-40; identical to SEQ ID NO: 58866
  CDS (1)..(627)

SEQ ID NO: 86977 - protein, 208 aa, Microbulbifer degradans 2-40; identical to SEQ ID NO: 58867

SEQ ID NO: 86978 - DNA, 639 bp, Pediococcus pentosaceus ATCC 25745; identical to SEQ ID NO: 58868
  CDS (1)..(639)

SEQ ID NO: 86979 - protein, 212 aa, Pediococcus pentosaceus ATCC 25745; identical to SEQ ID NO: 58869

SEQ ID NO: 86980 - DNA, 666 bp, Thiobacillus denitrificans ATCC 25259; identical to SEQ ID NO: 58870
  CDS (1)..(666)

SEQ ID NO: 86981 - protein, 221 aa, Thiobacillus denitrificans ATCC 25259; identical to SEQ ID NO: 58871
